United States Patent 9,487,797 (GENOMIC PLANT SEQUENCES AND USES THEREOF) - sequence listing, part 102

SEQ ID NO: 90708 - DNA, 2602 bp, Oryza sativa
tccgcctaagggacttgttcgtgttttagagttgtaatagaagtagagtcgtgtccgacaaggacataatatgtgttttgggtataaatatgacccgagaccttataaacaaagagaccagctcaatatactctcggcgcatcgccaccctttttacttttcattgttgtcaacgagttcttactttcgagttgggctgcatcagtttcgatctccgacaagaggtaaagcttgttatggcggcttgcattctcgggattagtgcttacatctttatgacactctaatcctgtccatgtaaatcgtcgagttatcatatatgctatataatctagatcgaccttactatctgatctcgtcggctagcctctatcatcaaaaacagccgataggatccgatattatcgtcaaattagattatatagcatatccaccatcccgaaaaggcttccattggcttttttagatcttatgtttctctttatgcttaatgctgcatcaattgtgtttgatctactaagcaatatccagagccataatatctagcttgcttcaatctgtgatcactgaacttattcatgaaaatcaatatggtttcataaagcaaaggacaattcacgactgtttggtgtggacttttgaattccttcaccaatgtcatcagagcaaaaaagaaatcctcattctcaaaattgattttgaaaaggcttttgatactgtagagcatgcttgtatcctggaaattcttaaggcaaagggctttgacaatacatggatcaattgggtaaaagatattttaactacagcctcctcctcaattttacacaatggtgtcccaggaaaaaaaacttcaattgtctcagaggtgtaaaacagggagaccctatctctgctcttctgtttgtccttgctgctgatcttcttcaatctatgatcaacaaagctctcaacctgggagtcctctcccttcctattcctcaagttgacaccaagttccttataatccaatatgctgatgacacccttatcattatgaaggcgtgtcaaagagaagttttctgtctaaaaggcatcctgcaatcttttgccatgtccactgggttaaaaatcaattttcacaaatattctatgatcccaatcaatgttaatcaggatagaattgaaatcctggcagagacttttggatgcccaattggatctctcccctttacgtaccttggtctaccggttggaacaacaaaacccaaaatctgtgattttgcacctctcattgatagagtggaaagaaactcctggctataacaatgttttagaatcaaggacagagactaaccatggtcaactcagttatgtcatccctgccaacaaattacatgtgcacacttaaaatccctaaaaagattttgttgcacatcgatagagcaagaaggcattgtctttggagaaaatctcacgaaattgatgcaaaagctcattctttttggcagcatgggacaagatttgtagaccaaaaaaaagagggggactgggtgtcattaatttagaattccaaaactatgcccttttgatgaatcatctcgacaaatttttcaacaagaaaaatctcccatgggtaaaacttctttggacatcattttataataatagatccatgccaccgcatgcattaccagactttggatccttttggtggaaagacatcactcaactaatacctcactttagaggtttcagctctattcagatcaacacaggggacatagctcttttctagaaagatctctggtcagacactttacttcaaaactccttttccaccattttctcttttgtgaaagtgaaggcattcctctggctcctgtttatggatagattaaacgagacatgctacaaagaagacacctctctattcaggatggaccctcttgccaaatctgcagcttagatattttggaggatatgtctcatctttttttcacgtgcccatttgcccaaaactgctggaattctcttgcaatctatttggatgtgaatcttgatctctttgacatgattcaaactgcattcagaaattttggtcaaaacttctttgtggaagtggtgggtacagcatgctggcaaatttggttgaaaagaaatgctctcatttttgacaatgtccaaccatctttcaatatttggaaagctgatttcaaggaggatttcactcttcttttgcatagagtgaaggaggaagacatgcctaaatatcaatcatggattgacaacttattttatttttttcctctttagtacatattttgtaattttgatgtaactcatgttcatatattaatataattaccacagtaggagcctctcctattgtttaaagtcaaaaaacagggatagtatcggggtttcagctgatcttacctggttcagttatcttgttttcttatatgtttacttggtatactgaatctgccctttatattaagatctcgtttggttgaaatacgttaagctcactatcggtctgttagggtatactgacattgattcgattcttatttagtatatttaatccatactagtatcttagtataaagtagtaccgagt

SEQ ID NO: 90709 - DNA, 2762 bp, Oryza sativa
ctctcagctgacaagttccctcaaatccagtttgatttggcctttgacaaagagtttgagctgtcacacacttcaaagactgctagtgtgttcttttctggctacaaagtttcccagccggctgaggaagatgaatatcctttgtaatgttttaccatgtttggtcaatatatgtaatgcatataatgtcatactctattttattttcattaaggtatgtattacaatattgttttccttgacctgccttttttgttgttccacaatggattttgattctgaagaagttgaaggtatgattgctactagtgcttgtgttctgcctagagagaatttaacgagcctgtttataatttatttcagatgaagaggaggaagaaaagatcattccagctcccagggcaaatggtaccatagtttctcctttctgattatgattggaatcacagaatccttttgcacctctctttaaaactttataaggaagtacttatgactaaaacttttctaaggcaaagttgaagggaaggaaaatgagcagaaaaaacaaggcaagacagattcttcagcttcaaaatcaaaggctgcagtgaatgacgatgatgatgatgatgacacgatgaggatgattatgaggacgaagatctttctcctgaggatgatgatgatgtgagtaatttatgggtactgttgtgtattattgtggaggattgttccatactaacagtggtgcaatggcctgttataggattcttctgaggatgattccagcgaagatgatgaggatgagagtgacgaggaagatactcccaagaaggtatgtgtatgtgtttgaaggatatagtctgcttgtttctgtgcacttatatgtgtttgaaggatacagttagtttgtttgttctgtactcttaccataaacaatgtgatgacttgcagccagagactggaaagaggaaagtagctgaaattgtgttgaagacaccttcgtctgataagaaagcaaagattgctacaccgtcaggccagaagacaggttagtagctgtgaagctgcgcctgcgatgaataaattggcactggaagtagtgatgaatttgtatcatttggtcctcctgagcaggtgacaagaagggtgtccatgtagcaactccacatccggcaaagcaggctagcaagacccccgtgaatgacaagtcaaaggagaagtccccaaaatccggtggtgggtcaatttcttgcaagtcatgcagcaagtaagtttagatgcgctgtcttcttgttttggagtattacgtaaggaaatgattcaaagtttgcatgaatgcattgtttaggacgttcaacagtgaaatggctctgcaatctcactcgaaggccaagcaccccgccaagtgaagaatgagacaacggatgctgagctgagaaatattggtgtcgtttgagttggttatctgaaatgaaatgaaatgctgcaaactatttggtgttatgagtagtgtcgtgacggtttatgtggtgcaaactatttagtctagaaaaaaaaaatctgtggtgcgaactgagctacaattttattcggtcaaggtcagtggagtgattggtttattttggatggaattattgttcttccctgttattcggttaattcccacgagaaaggattgataacaccacactgaattgactagctgaacaaagtcgtaatatctggttttgccctcggccaaatccgaatattagggtgtgtttagttcgtgttttttgggtgttacattggatgttgaccttagaaaggatttttttgatacgaatgaaaaaaattaatttctaacttgcttggaaaccgtgagacgaatttattatgtctaattaaactgttattagcatttatagattactgtagcacttatagttaattatggactaattagacttaaaagatttgtctcgtgatttacatttaaactgtacaattagttttttaatgtatatttaatgctctatactctgcacatgttacatgtgttcaaattttttatatgagtaagaactaaataaggccttagtgagcattttagtagcggctgagcgcttgatcgtttgctgtctgcagccgcaaggcccgcaactacaggaagttttctccgccaaaaggcagcgacaatgcaccagccttaatatcagacaaacagcctctacccaacaattcggctcctagttggaactctttgttcaccaacacgagatggcactgcagctaggcagtagacacgagagtcattccagtttgttcgcatttgtccctgcccatccttttctatttttcgcctacaatataaccataagtatatcatcattgaatatggaatatttcttctcctttctaaaatatataacttttagccttcacaaccaatcacaactttccacctcttaatatctatgccttctccttaaccaatcacaaccatcacatatctaattttacctacttttttaatactcgtgttcaaccaaaactcaggttgtaataaaattttggagttacaacaacgagagtaacaacagcatttgcagttttacttaataattagtcaacagcatttgtgtaacgagttgtgtcgcatgctttattcacagtttttttttaaaattcaagttctttgacttacactcacccgacccaaaataaatcaacttttatatatctatgtcatcctttttaaagtgttagttttgaacatagtaccctgtaaaaaaaat

SEQ ID NO: 90710 - DNA, 4692 bp, Oryza sativa
  unsure (1)..(4692): unsure at all n locations
atcatcacatttgtgcttgcataaattttatttaaattctctcaggatttacttattgaagctgttgctctcaaatggagttgcacacaaaagaacatggcttccattgagctcgatacaaaggtatgctttgtgagaaactagttactttcataacacaaaacttcttgaattgaactgtgcatatttcttgcattttgattaccttgcagtgacccaattaatctccgcttggaaactttgcaattaatcacccaattaatcacagctgttttacaaatgtttggctgcttgcaataagatatataaattactaaaatactagtttggtctaaagcacacataatttgcacatgttacaccagaaaattgccatatttgcttatgtcttatcccgttccttgtaccgaaacaattcgcacatgtaatcatctgtccttcattaatcatctgatagatatgggagatggaaaaggatgtgaagaaacttgaaaagaatgctattgaagctgctaaagaatatgaaaactgtgagttgatgtttcaatccattcttttgttgtttctaaccactcagtttggcaaatattttggaaagtggcttagggtccaaggcaattttttctttgagtttttgcctttgggttgacaaatcttatgctcactttcatgtcatgctcattcctcaggtctgtttggtttgtagaggtgaagactattcaaaatccatcatgcatctcctgagtagatttttttttgaagtatagctatatcagaaccatgtgagttcttnngctgatnnnttttgnanactgggnnattaattaattncctttaaaaaattttaaattttttccctaaacaacgttagactttagtcccaggcaagtcatgggtattctaacatgtcgtaagttaacaactactctactaaaaaagtgtatttttattttctgaggtgttctaagaatctgttaagtattgactgacaaagttgaacagatgctctcttgggcttttgagttttgaataaagacaactatgttttgagactggtactataaatggtcaactgcggttgaatgtgcctggcaagcttataaaggcctttgtaggaaatttcatttctgtaatgattgagagtagtgtagcatatggcaagttggcaatacattactttcgtgattgattccatttgtctcatgctggcactatcacatgacatatgttcctctaatcaggtaaaagaaaaactcaagagcataagcagcagttgtctaatgcaaaacagcatgcagagtcaatagctatgatcaccgaagaccttgcaaaaaagtttcttgaggtactgtttgaatttaattttgtacttttcttgtcttatttgtgaatcagcattcacatattttagttgagttagcataccaactgtaaaatctccctaatctgcaaccactagatccttttataaaattatttttttaatgataaatttatcacaaaaccttagttaccagatttgcagcatagtttgtcaaacccaaaatcagatcacatgatttggggtttaccagcgatctacctgcacgtaccgtgaaagtcaagcaggaactcaatcaggatgagcttaacgatgttgctgggctgagccagtcaactacaagctcctttacctttaccttttctttttaatataaggccacggttcgatattcaatgaaactttgtggcattgtttgggttatgaacctcagattggattcataaataggagaggtacatccctcttgctaaatcctaggtttgtcaagtgatgaattgcgcaggcagggacacgtaccaggaaccaacagatcatgattctggcaactacagtagcaacaacttgatgttcaaacaaccacgaatggctgaattctgtctgaagcacctatgctctagggtgttagtttcttctcataagaattaactcttctgattttagctcatttagttgttggaatgctccataaggccacagtaaaagatcctcactgcttgtttggttgtttaggatttatgatgtccctctaattatctgctgtttacaactggatttcttatgttgttttctctattacttccagttttcctttttattattatgtgaataatttgagatgcattgccatttactttggccaaaaaaaccacatgtattatcagcatatgctggcacttagcacccacgatcctgcttccactgtttctgtttgcagatgcctactaccatagaagaactggattgtgcaattcaagatactgaatccgaagcaaattctatgctttttcttaatcaaaatgttttgttggagtatcaaagccggcagcgtgaggtacaatggattaataagtgtacctcttttttatttcatactttctttacttccagtgttgcaatatgcataagttgttcagcatcagtttgtctcatcaggaatagcacctagccacccagcaggttttgtattttcagaataggactgggtggtgccttcatagcagttagttgagagacccttattttctcctaatactgctgcagagttgcttctaaacaaaacagaaataagctagagtctgaggtttcatgttggtattattaaagggactatttcctgaagagtattaaaaattttgaattccccatagtgatctccttcaggattcccatgtgggaatatttttccttacagacagaatattgcactatatgctgaaattttgacaaaatgacttttagaaaactaatttaaaaaataaacgtggcaaaaactaattgagaaaatgaacctttgactccgcgccagcctcgacggcgctgagctcttgtccaaggtgccccaggtttgctgactcatcagagctcagctccaagcagcctagcatgttggtggaggtcgtcagctataaacagtgtgcagggttcgatttcgattatcccctccctccacaccttttttttgttttctcttactttcctaattttctttttagtatacttctttttgcttgatttgaaatatttgtttacaaaatgtttgctcaaatagacagaggcgtacatccacatccaatagccagtatttccacatgtaaaatggcctcaagagctcgttgctcgcattcaccatgttcctgttactcgctagcctgctatctcccgtgaaaggcattgatctgttgacctcgccggtttatcctgaccctgccaaggattcgaccaaaatcaactccaatggtgatggtcagtagtaagcacatcgccagatatatacacatacacattatgtttttgtgttctttctcagataatagaacaacttatagttctttcatatattttttcaaattcaaaataaataaatttacaaattaaacatgtcatttatgaaaagaatattagatcaaaataaataaatttgcaaataaaacatgccatttcttaaaagaatatgagtattgtggtggaggaatggaggatcgaactcaacaccacctggtaggctggcacacagctgatgtcctcccccaccatgctaggctagctttgctgatgacgttggtgctgaggcaaaggttcatttttgcaattagtttttaccaaggtttattcttcaaataagttttctaaaagggtcattttgtcaaaatttcggccaccatatgagtgcagagaagatacttcattcagtttttcttttcttatatatttgtcattatactatatgttaataaggtagtatagcagataaaggagatcggagcgttggactatttaagaatgctgcttttgcaacacagtatatttctcatgttgctggttttgttacccataaatctacgggaaatactcgatgtttcacatgtgctatgaaaatgtttctattagaacttaatggcatttcatcataatataatcatgtgatatgttgttttagatttaattgcaacagtaatcggatcgtagatttgttaagtaatttaaaagaaagaaaaacatttgaagcttgcaaatagagcttcatgcgtgcatgcaaaagaggttggcctactgtacaaagagagaaatgtagagcgggtacattgcaaaaaatgacttagaggcttgcatatgcagctgcagcacgcagaaagtgtgagagggaggcaacatgcagcagctgccagatggggatagcacctgattttttgtgttttactgggcgcccaatgcctagtcccgtcctaaatctactactacactgattactttgacagtgacaatacctattttaactgtgtagatagaatcaatatccataaagctggaagatgataaaggagaatgtgaaagatgctactctgatatagaggctacaaaggtctggacattttcatattgtcagctatattaccatactttgtccaaatcttttttggcatcctgcctcacttgacttgactttggcaatatcctagggcaaatggcttccaactctgcgcactcttgtttcaaaaataaacagcacgtttagtcgtaactttcaagaaatggctgttgctggagaagtttcacttggtatgtgtggcagttccttctttgcgttatcacactgttatttgtactattttcagatggcataccaatctgtaccaaatttcctgcagatg

SEQ ID NO: 90711 - DNA, 669 bp, Oryza sativa
ggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccattacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttctatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgc

SEQ ID NO: 90712 - DNA, 1370 bp, Oryza sativa
cacccccgcccccgaccgcgcgagctccggagcagttggcgtcgacaaggaagggaggtgaggcggcggagatgttctccggcgagtggacgccgccgtgcggcagctgctgcaccaagaagtacgccagcctcgtccaaatcccatgtcagtgtgctaccgcccaatacttccctctcgcaagtccccggtagaggatttggtttaatttgttgtgccatttttttgttttggcgcgattgggcttggatttgcagggagggtcttctgcaagaaggggtgcgacgcggacggcgacacctgggacgagtgtgagtattatcatctgccaaatgtcgctgtgaattgattcatccgctcattacccgattttggttttgctgatggtttagttcatcgccgattcaaatattttccataggatgagatatttatgttatgttattcgtggctgtccttgtgaatggatggaaaattaatattaggcgtatatgctttacaccgttgatggaaatcatgttttggagttcaatagtactagtatgtggctagttatctgacaaaataggcatggttaacataatgacccccttcattcagtggaatatagttaaaatttttaattggtaacttgcagtgctgtttgtgtcaatgctagctgcaatgagtcatgtactcgtgtttacagtggatcgttggtgcattccttgctcagaagtttgtgttgtttctgttggtgccctaggagcattttattcttctgttgataccaatctgtgtgatttagggctaagattcattccgattttgattgcacatgaaaaaattttggcttaaaattgctgatcactttgttttctagcatagcttagcttacttgccataaaaattctcaggcataagtaaatgtacggaaatatgctacaaagatcctgttttggaagatcaccagtggagtgcatatatcgatcggtctccaggacaggatagctactccttggtgagtttgtgatctgtttgtacaattcttataatttccatattccttttactgaaagtactttggtaagtgataacccattcgatggcatatgtttgtactgtatactgctgtcacagcgaaagattaggttgcattttgctgaccgaaattataatcaccctcacatgattacttgatcataaacaggaagttatagttgtcatatcttctataagaaagtgcatatatttaccatctgttgcatgatggaatagaattaactgcactagttgattttgagtaagagttgtttgttcaagattttgtatacctttcacatgattatcacagtaaagatcagtacatcagactgctgttgtatggtccg

SEQ ID NO: 90713 - DNA, 1539 bp, Oryza sativa
aattcctgcagccctggaaaaataaaaccaaccacctacattattttattcatgggaaaggaaacatctaattagcgtaatacttattttcctttcccatttctacgaatgcgcgcttgatcttagcgcacaaaccgcgactaagggtatcgaaattatttctaatttcagcaagctctacccctagctccgtgttgcgatccctaagctctatattctccttgcggagtttcttcacttgcacggcgagcttatggatcgagggctctgacgacttcacctcatcttcttgatattggccgggaacccgtcctgagatataccagccatgggtgttcactaggacttggatcaaaggtttttgagggtgaatgggagattgaatagagaggcttttgcaaaggaggaagaaagagaggaactagctcaggagagtgatccgatcgctctacctccaaactcgcatctaaacagactcaggacgggcgggggagtctaccatccaaaaatggggccgaacgggtgccgccctggttcggccgaaccctggtgggtccggcaggcctccattttctttcctaagcctactaatttctaagctaagcacaaacatgacaattataaagggttttaagcatgcataagatgagatcatcatggttcataattgattaattcaacgacatccacttcttcatctaaagtttcatttggctaaaggaaaatttttaagcgttgaccgtttaccttgaatatattacctgaatcgttgcggagagtgattgccccgtgcgaagaggtattgatgacgttgaacggtccttcccatttactacgcaattttccgtgaccgaaaagcttaacctcggagttgaacattagcactttgtctcctggcttgaatttcttgatttttatccttttgtcatgtcagtgcttcgtcctttctttatatatctttgcgttgtggtaggccttctctctccattcttcaagttcggtgatttgcattttcctccattctcctgctccgtcaaagtcccatgttccagtttctgatggcccagtatacttgctcaagttccacgggtagtcgacatgacttcctgtagattatctgatatggggacattccaatgggtgtctcatacgctgtccggtatgcccacagtgcgtccgacaatttatccttccatcctgtttccattttgttgaccgtcttctacagaatattcttaatccgtttgtttgatgtttctgcttgaccactggtctgcggatggtaaggagtggccacattgtgtttggctcccatctctcgtaggaggtcttggaaggttttgtcaatgaagtgagaacctccgtcacttatgaccattctggggataccaaatcttgtaaagatgatttctgtgaacatcttcttggcatgcctcgcatcagcggtgttgcatggcatagcctcaacccacttggagacatagtcaactgccaccagaatgtactcgcagttgcgagacttatggaaaggtcccataa

SEQ ID NO: 90714 - DNA, 827 bp, Oryza sativa
tgagcttttccatgaaatagctcctactgtgagggtaaatacgtatcccgatgttgactttgtattatcttttgcaaagtcagaatctgaataccccactgtctggagcgattctgattttctgtaagacagcatgaggccttttattccttgcaaataacacaagactttctataccaatttccagtgctctgggcctggattactctgaaatctgccaagtaacccggtaacaaatgccaagtcaggtcgtgtgcacaattgagcatactgtaggcttcctacaactgatgcatttggctttgttttcatttcattgagctcacactgatttctgggacattgcgatgccccatacttttcgcctttgactataggagcaggtgcagcactgcatctgttcatattgaatttcttcaacaccttttctatatatgccttttgagaaagtcccaatgcatactttgttctatctcggtgaatctctatgcccaaaacatgtgagtcctcaccgaggtctttcatgtcaaagtttgaggataagaatttctttgtttcctgcagtagactaacatcactactagcaagtagaatgtcatctacatacagaattaggaaaataaatctcccattcttaaactttgaataaatacagttgtcctcgacattctcttgaaaacccaaatttctttattgttccatcaaatttcaagtatcactgtctcgaagcttgttctaagccattgggctgggcgcccccaatcagggcgcgggtcaaggcccccttgagccgttgggctcaaggggagggagatctatctaacagt

SEQ ID NO: 90715 - DNA, 4143 bp, Oryza sativa
cattgggaaggtttcttggactacaattcacaaaggggtttttaaataaatttaaataaaggaaatcatggtaaaaaaggaagtatcaaatcacgatataactgaagataggttttaaataaaagtcataaaataatttaaataaacgaagaagttttacgcaagttagttttaggaggtctctctctctctaattatattttcctaggtttagaaggttaataagaacataagaaccggcatgatcaggaaattcttcccgggtgcacacgagtgaggacaaagtgtgcagaaaagacttgtgttagtctgtgagggcattctatgacctatgagagctatcagatgtaagcggcccggcctgggagaggcggaacgttacagtcaggatcaagtgtgggcaaaatccatagaatattcaagtggtcgaagtggagcatggtgaagttcatgcagaatttcctgaaaaaggaaacaacgtttcccaggaaccgttattggaagacgctagtaaaatccagtacaccggccaagaagctagagcaaccggctcagaagaagccatctcccgcaccaaaaccaaagagggtgtggaaggaaaagccaaagacgcccgctccatcacctccggagacgggtggaaaatctgcgaactaaactgaaaggaggtacggtcttgcacgtcggacccaaaatgacacgaccctcgccaacaggtaaattggtatgtatccgcatatttattttcatcaatttgaatttttgcatcaacacatgtttgcatcaacacaggtaaattaggtttactaacctcttgcagagaatgaactcaaaatggaggagaatggacatcaaatcagacgatcaatcaatcggacgatgtcgagaatcagacttatcaatgaataggccaagaactcagaaatgacacgactaattgggccaaagttcagaagtctgtggaggggagaagtccaagaagccagcagccaaattatgggctggttgggccggcctctggttcggccgaacccccctcatcgccgttggatgcagggtttctcctggacggtgtagattggcccccaatgccggttggagggtatttccgaccattccaaccatcacaaccgtcattgggaggctatataaacccctcactctctccatttcaaaacacactccaagcaaatctctctcattttctctcaagtttagtttagtgttcttaagctagtagagtaggaatagaatagaaatcagagtccgaaagccttcgaaagagttcgggtatgactctagtagctctcctttcctcttttgtaagctttgtactttatttagaatactcttctttatacatttcttgtaacaaacccaaattgtagaaacttggaaattcaatataatgaaaaaaatattattgtggtgaaaatttgttttaggtgtttttggatcttctatgcatcatttcattttgcatatataaattaaattaaacaaaaaagggtaatacgattagtgatgagtataataaacaacaaatttaattagttataactcagcttttgcatctcaattaaaaagatgaaggcaaccacaattaatttaaattggaataaaagaaggaaacttgtttgaatttccaaaaaataactgcacatgagaaaaatctcaaaaaaaaaatcaccaaatggagttcaccactacagtaacttgcagtaaaattggcgcatgcttttgagcagtgtagtcattccaaaaaaaaaaaagaattcgtcagaccctcagccctctctaaaaatccctgggaagaaatgttcctcacctcccctattcctgtacttctctgatcaacgggcccaagcaccctggaccccacctgccagtggcccagcaccccatcccactctccttctctttcccatctctttccttgcagatatttcatcgaacacataggatgcgagccgaaagtcgtcgcctccaagccgcccattcctcctctgcccgcgaatctcactgcaaggctgtgcaaagctgacgacgcctctgccccgcctctgcccgatgccctgccgcgcccagcgctgccctcgcagccgctgcgcccaaccgacgccgtccctctgcccggagcgacgagacgctacaaactcgaccgttgcttcctccgtctgcaaagccgccgacctgcgtctgccgtctgcaaagccgacgcccctgcctccgtgtctcccggctgcaaagccggcctcgcagcgcgcctcgccaacccggagccgccgccctctgccaaagccgacgcccgaagcgacaaggcgagaccgaccgcccctggcttcctctgactacccctgcactccctctgcaatccctgcgcaaagccgacgcctgctgcccgccgtgttccccgccgaccaccgcctgcgcgcgcgagagacgccgaacgcgtcacgacaacctccgcgtccgcctctcgctcctccctcgcctataaatcgaaccctcgcgctagctaactctccagaccaccttcaacctccactcctaaagcggaagccctaaaccctctgattcaccgggaacggccgcgccaccgtcgcgccccgcgccggccaaacagaacgccgccgctgagcccacaccatcgagccgtcgcctcggtgagtttcctctcgattcctcgcgccatcaggctcataggacctccataaatccattttcgaaatctcttttatgacccctcgaccggagagccgccgccaccattgccgccgccgaccgcctcgggagctcgtcgccacgccacctcggaccgcctccgcccaaaaagaacgcggggtaagccaccacatagtccctaggtgcttccctgtcctttaatcgagtcgccgttcgccatagccgccggccgccatcataccgaaccactgccgccgcttgccatggccagccgcctctagccacccccggccacgccaccgccactaggagatgcacgtgaacctcctctagccacccctgcctctgccctagccagccccgcggccgctcgccgccggccagcccatccggagccgccctcgtgctcccctctgtctgttgcgaacggaggaagaagacaggacctgttcgtaaataagaaaaactctagggctcttgatacaaagcgccaatacacttacatgttggaccgagacctagatctcaatagccgcaagattagggtctgttctgtgaaacatcgagacacttacatgtggaccccactgtttaaagtggatgcgcgctaccgtaatacgttttgcatgtaggaaagcgtactctatatagtacgcttcagccttttgtaaagagaaattaataaatctaagaaaatggtttcggttaattatttatgcactataaaatgctgaaactttgtaaaatcatagaaaattcattttaactccgattgaggtgaaccaaatttcgttagattcataataatgttgtctttaatactgtacactcaaattatcaccactgttgtgaaaattttcactaatttaaatttgaatagtaaacttcgtatttaccgtactttaaatattagaaacacgataacttgcacatacaacatcaggtttaggcgattctttctcatttatattaaatcactctctttacactgaacatgttcatgcaccatgcatcatattttatcttggagttttattggatgttcatttgaatgtacgtttaaatttaattagaggacgaatcgattgttgccgttggcgagagtgtgcaggaccaagagttatttgaggaaccaactgagcaaggcaagtcctattcaattcctacttcgatcatgttgaatcctatatcttcgcaaatgctttattattttataaattgcatgcgatgttttataaagaaaatggggtattggtagaaataacctaattgctgcattacctaccttgatatattgattatcgttgaagccctaggctgagaatatgtgtgtgttgtacatgcacaatgtgggtatattcgagctgctactatagctacttgcttagccatgcttagaaaatttccaatggttatatatgacatggtaatcattctttacaaatggagggctgcagg

SEQ ID NO: 90716 - DNA, 2312 bp, Oryza sativa
  unsure (1)..(2312): unsure at all n locations
gagtccagcaaaacaacatggtaatttttggtgtcaaagtatgcaacaccgacagtcattgtaatgccacgctccctttcatcagcactctcatccattgcccaagcatatgcaaatgatcctttcccctggaagaagaaacgttatatatgaacagctcccaagatgcataaaaggcacatactgagataacatcaatcattaaaataagagaaccttttctttagcttccttctcatatttatgcatttgcttttttgaaatcctccccagggcatgtaacaaacgaccacatagagttgatttcccagaatcgacatggccaacctagcatgtttctggtntgagttattcataaagataggcagatagaaggcaaacaagtaataagcaaaatgatggatacatcaaatatatcgtgtatatatagatatgtagttgcttacaatagcaagatttaattgtctagggatgccttcatcttcatgctggagcatccatggttctggcttgtacagggatgaagaaactggctttttaatattggctttacttttttgtgacttcctctccaaactcaaatgctgtagctcatggtccaagcaaagtgtttcattttgactaccaacagaaacactctcactactttcaccgaattcattcgactttacaggcaaatttgagtctgcagttgtatccttctcaggtgtagaactatcattatccatcaccctcttttcagtgacatggggagcatctgtgtcaactgatgtgaatcaagttactatggaactatagcacgcactgcacaaccaaaattattcaagtgtggaaaagaaactttgtttagaaaactatcttagcataacctttcattggtaccaaccacataaattttgaaaataacaatatctataacaaggaacagttcaaatgttcaagtgtgttggcacacagtagttctctatctgaccagactaactcattcagcataaactctaatcaaactaattaactgaaaaggttccacaaagactcgcgcatagaaaagaaaataaaggtttcacatatagatgttaatgttaagttgttaagatgcatccttttcactagtctgagttagtctaactacatgggagtgggggaatgcagagataataccttttctaaaacttctcgacgattttagtcctgtagcgaccacgtcatccggagatggtgtatcaaacttgaaaggcactgtgaacatgaagatatgcagtcatattacagatttctccatcaggaagtctaataaataaatgaaacataagttcaacatatggatctcccattggaaaaacacgggtcaactgaatgcttaccctaattcaggggaagaactgaacattcataagtaggttaaaatttacactgactatcttcatatttcaaagttcaggtaaaccaaattatataaaaccctgtaaactcccaagacctgtaagctacctcccacatatgtgcttcagtttgtttgtttgcagaaggaccatggcaggctagctaagcttatagttcagacagtcacttggttttgaaacaggaaaattttacacccaaaatggtagtcacaccagatgcacaatgaggcaattgagagttaagctatgcaaatgactagcatatatagaatcatacaacattaaatatctggtttatatatagcagcaagtacatataactacaagaatttggataatgccataaattaaacaaatcaaattaccaaaagcgcttgatgtacaaatgcagtgtacctatgttaatgtggcgttctttacgggtcatgtatgtcttatgcagcgcatccacgtagctcgtgtacttcctgttgcatttctgctagctttaaagccaccagaaagaacaacgtcttttgacttggcactggatggtgagaaaagagttcttgccagtacagataccgcataatgcttgtctctccgtttagctggatgtcatgatagaaaaataaataaattaacaggctagaaaacataaatatatctaatcaaagccataagtcaacagtgcaacaaaaaactaaccataccagggaatggaacaacaaggaatacactatacctctgccatcaacttcaagggcattattgaaatacagcgagaaatatcgaagaacaccgcattgctcacatgattttttttttgcatcatttccgtgttcgcaaatggtgcattgccaaatgccaggatttcttgatggctcctgaggatcagaccggttatctaattcaggaataaactagaga

SEQ ID NO: 90717 - DNA, 606 bp, Oryza sativa
ggcatatccgaaggacgatttccccttgccacggatcgaccaactcgtggattcgacagctggctgcgaactcatcagcttcttggatgcatattccggctatcaccagatccacatgaactcggccgacatccctaagacagccttcatcacgccatttggcaccttttgtcacctcaggatgtctttcggcctgaggaatgccggcacaaccttcgccaggatggtgtacaaggtcctttacaagcagttggggcgaaatgtggaatcttatgtcgacgatatcatcgtaaaaagcagcaaggctttcgaccacgtgttcaacctacaggagaccttcaacaacttacgcgcggcgggtatgaaactgaatcctgagaaatgtgtttttggtgttcatgcgggcaagttgttgggtttccttgtttctgaaagaggcatcgaggaaaaccccgagaaaatcgatgccattcatcaaatgaagcctctgtcgagcgtacgtgaagtacaaaagcgcgcaggccgaattacggcactcagtcgattcctctcaaaggcagccgaaagaggtttgaccttcttcaagaccctccggggcacccgtat

SEQ ID NO: 90718 - DNA, 675 bp, Oryza sativa
ctttttggtctattgaaagaccttcggtcattgtctacgaaatttagacaaagtcttacaacgatgccaagagaaggacctggtacttaattgggaaaagtaccatttcatgggccatgaaggaatagttcttgggcatcgagtgtccgaacgaggaatcgaagttgatcgggttaaaattgatgttatagatcagcttcctcctcctgtgaacatcaaaggaattcacagcttcttgggacatgccggcttttatagaaggttcatcaaggacttttctacaatcgctagacctctgaccaatttgctagccaaggatgcgccctttgtgttcgatgacacgtgcctaaaatcttttgaaattctcaaaaaggcactcgtctccgctccaatcattcaacctcctggatggactctgcccttcaagatcatgtgtgatgcaagcaatttcgctgttggtgcggccttgggccaaaccaaggataaaaatcatcatgcaatctgctctgctagcaaaactctaaccggagctcagttgaattatgcaactaccgaaaaagagctgctcgcggttgtttttgctatcgataagtttaggtcttacttagtgggaggcaagctgataatctatactgatcatgctgccttgaagtacctgctcactaagaaagatgc

SEQ ID NO: 90719 - DNA, 1734 bp, Oryza sativa
ttcaagtttgcatatgtcagtgacttttttttaatctaacgatttttttgttcggcttcgtttgttcatcaggtttatgtagatggaacgaccaccttgtcaactcatgaaaggaaagcgagcattagggaattctatggtaaatgctctaaaatgttgagctgagattttctttttctttttcttggttcacaattgagaggtgtttactgtctaaagtgttaacattagcctgcattgttttcagctgttatatttccctcactcatgcaactccacaagggtatcagcgatgtcgatgaccggaggcagaaggcaatctgtactgagagatacagaagaagagatgaggatgagagcaagaggcatgtttctgagattgatgtcgagagagaggaagagtgcgggatttgcatggagatgaataacaaggttgtcttgcccaactgcagccatgctatgtgcatgaagtgttaccgtcaatggtgagaatcaaatccttccatcccaaaaattgtttgtcatgttcatcactaatggttaatcgatgccgtattggtccttggtaacagtctgagatgtgtttagttcttcaattcaaagttagtttagtcaaaacacgagtaaaactctgtccagatatagtggaccattttggttctgagaggttaatagcagcacgctgttttactctgtatgaatggctctgcacaataaataagatggtgctatgctgcaacctcattaatagatctgtacctgattattacagcaagacattgcatatttttcagtcattgcagcaaggttgtcagctttgtgcttaactcttactggtctttcagagatcactttttctttgacactataatttagctcctgtgaaatcccttctatggcataaccccactaagcaaatgatcccttgcaaagggaaaaacagccttaagaacatcagttcagtttcataatttcccaaacttatgtcaatacatagctctgcaaaaactctgccaccaaagcatgtagtaccgcacgtaaatgacagtactaatgtttatgtataaaataccttaccagttacatgaacataaggaattcaaaggacatacatatcaatttatatcttcagtacatgaacttaaaaatagcttctctgctatatgaataactatgtggtcactggttacgaactctcttaagatattgctgcattctttgaaccatgtgctatccttgttgcaggcgctcaagatcccagtcctgccccttctgccgtgacagcctcaaaagagtaaattctggtgatctgtggatgctcacagatgaccgagatgtcattgacatggcaacgattactagagagaaccttaggcgcctgtttatgtacattgagaagctgcctcttgttgctccggacaacatcttctatgcctatgattctcatgtaaaataaccagagctactcataatgacctactcataattgttttcggagagtgacgcatgtcttattcattcatgcagaggatgttccttgtcgtaggatgtggctaaccccaggagcagactgaactttgacaagagaacttgtgaattctgactagatccaatgctgtggtcagatgttgtaaatgcttgtacagatttgtaatttgcagtgtaaaaaaattagtgaggaaaaaccttgtgttccacattgaactcctagtgtgaaattccaagtacatatat

SEQ ID NO: 90720 - DNA, 1787 bp, Oryza sativa
gtacatgctaaatatctctacttcatagagttggctcctggaagctcgtcggaagtcctgattacctctgcagattcaagaatccgtgttgttaatggtgatgaactcgttcacaaattaaaggtaatgcttcattcactgtacttgtgtatcctctagacgttgacggatgtagaacacctagaaggaacctggccgatttaaagtagtaagtaacccaaattcaagtgattcatactttggaaaacccccacatcccacctatttacctcagttcctaacatgttcacagatcaaatcataggttccatttccccaatttcccccgatgggtgtgtttagttcacgccaaaattggaagtttgattgaaattggaacgatgtgacggaaaagttggaagtttgtgtgtgtaggaaagttttgatgtgatggaaaagttgggaactaaaccaggccctaatcacaagaactgtgcacttgattggtgcattagctcactcagtaggccagtatttatactgtttcacttacattttatttgatcttttcaccagggttccgaaatacaagtagccaaatatccgcttctgtagctccaaacgggaaatatgtggtctgtgccagtgaggactcccacgtgtatgtctggaggcatgacaatacttcccatccgagcagaagcaggagtgcagttgatgtaaccaactcatatgagcatttccattgccatgatgtcactgtggctatcacatggcccggcgctgaatcccgtggctcattcgggtcccgtagcagcagaaacagtgattcagacgatgcagtgatgaacacgggtcgggatgcccctgtagagaacagtgagcatgatctgaatggcactgtcaatagatgcaccaagcgcccagtttgtgaaggtgttgcaagcacaagcaatcctccagcggatggagtatcaacgtcctggcctgacgagaaacaatcgtctgccaagagcagtcctggtcactgctcatccgacctttgcattggagctttggatgttcagcgccggtcagcttggggattggtgattgtcactgcaggaaggggtggtgaaattagggtgttccagaatttcggcttcccggttcaagtgtaaagctagtgtgagaatattcagagatgtccgtttgtttactgtatagatatcgttagttttttctccatttcacctagttcttttactagctaaaagatttccctgtttcgctgtcaggttgggagccccagtagctcaatccaacttgctaagcaccacactattttttaccctctgttgatacaaggctttgtgtaattgtatggttaacaaccaatacatcgatttgtttgttcatatattgtttcttggttatacactgattgatatatgaagataatttctaactccatgataatccattgtgcaatcttccctcccagtatggcttttattgaactacactgttcagcattctacagttcatttaattactaggagcacatgctagaatcttgatggcaacaaactcttattattgtcattaacactgcacatacgtaaacacatcttccagctacagatcacgattcactgatcccaatgataatcaccacatcattgtgcaagcgtatgaaattggtgagagaagaaaactgcaaacaccacgttggataattgagctgcttaattacattcccaataattatatcataatccctagctcagcaaaatatacttcataccgatcgaagaacacactacctg

SEQ ID NO: 90721 - DNA, 4487 bp, Oryza sativa
atgctaatttcagtcaacggcagctagctcgtagtagctttttttttttcgacagcattttagcaacacactaaaaatttgactagaactaactttttcttttaagataatggaattgatttcattaagatgaaattgcacccgggcaaaaattaagtttaagataattacacacaaaatgcatatataattcaatttctgtgtggtaataaaccttttgttcccagatgttggtgtgatgagcggctgcattctcttcatccagagagacctccacatcaatgaagtgcagcaagaagtgctcgtcgggtgcctcagcttcatctccctcctcggcagcctcgccggcggaaggacgtcggacgccgtcggccggaaatggacgatcggcctcgccgccatcgtgttccaggccggcgcggccgtcatgacgctcgccccgtcgttcgaggtgctcatggtcgggaggctgctggccggcgtcggcatcgggttcggcgtcatgatcgcgccggtgtacatcgccgagatctccccggcggcgtcgcggggctccttcacctccttcccggagatcttcatcaacctcggcatcctcctcgggtacatctccaactacgccttctccggcctcccggaccacgtcagctggcgcgtcatgctcgccgtcggcatcctcccgtcggtgtccatcgcctttgcactgctggtgatcccagagtcgccgcggtggctggtcatgaagaacagggccgacgaggcgcgcgaggtgcttctcaaggtcaccgacagcgaggacgaggcgaaggagaggcttgccgagatcgaggccgccgccgccgtcgcgagcgccggcaagtacggcgacaagacggtgtggcaggagctgacgaggccgtctccggtgatccggcggatgctcatcaccgggctaggcatccagtgcttccagcagatcaccggcatcgacgcgctcgtctactacagcccgacgatattccgggacgccgggatcaccaccgagagccagctcctcgtcgccaccgtcgccgtcgggttcttcaagacggcgttcatcgcgcttgccatcgtgctcatcgaccgcgtcgggaggaagccgctgctgtacgtcagcacggtcggcatgacggcctgcctcgtcgtgctcgcggcgacgctcgccgcgctcgcgcacgggtcggcgtccaggagcgctggcatcgccgtcgccatcctgaccgtgtgcggcgacgtcgcgttcttctccgtcgggatagggcccatctgctgggtgatgagctcggagatcttcccgctccggctgcggtctcaggcggcggcgctcggcgcggtgatgaacagggtgaccagcggcgccgtggccatgtccttcctgtccgtctgccgcgccatctcggttgccggcgccttctccgtcttcgccgtcatatccgccctgtccgtcgtgttcgtctaccggtacgtgccggagacgagcggcaagacgctggaagagatcgagctgctcttcggcggcggcggcggcgacggcgaggcggcgcggggagaggtggagctcggtgacggcgagcacctggtgcacaagggatgaggatcttgagttattgaccaaatggatcaatgtgaacttggccatttttttaggtgggttttaacagtattactagatactggtgttgcggtgaatgcaaattgcaaaccaaattgttttgttttagagcactaataggaaagaaaatatctcatactcttttccaacttcagaatcctctgtagcatcaacgaatcatacagtgtaaatgttggtgccactgtgccagtcaatcagtcacagttggtaatgctagtaagctacacttgcacatccatgaaaccattacagtgaatgtaaatagattctgaactgaattattcaaattcattgaaaaagagcgaatttccagtgagttatatgatattttagcaaatagaagaaattttatgccaaatggaagtttgacatctaaccacatggtataagagcaattatctcgagtgaatattcagaacaaggtgatacctcaagtttaatactctgcaattcagcaattgtgcaagttcatgccaaaatgactgaccacagctccaaaatttcactctaagccttactactgaatacacaataacacaaccatgaaaatgtgggcagattcctgatacaaattttgacaatttgactttttgcaaaaactatttttacaaatgaaccgctgccaaaacttatttcaaatctgacccttttgctcaatgccaaatcatgtggcgctgaacttagacatctcagcgccacgttagctggcgctgaatgcggtgccacgacggatgggagactaagtcagcgtgccaacgtacattcagcgtcatgctatttggcgctgaggtgtctaattcaacgctacacaatttggcgttgagcaaaagagtcagatttgaaataagttttggcaacgattcatttgtaaaaatagtttttgcaaagagtcaaattgtcaaaatttgtggattcctgactccaactcttttaagctgaacaggtagtcatcaggttaccaaacatataaaaacgcctcattagtcttaaacaaatggttccctccttgtttcttcctcctcctacagtctcctccttcctccagatccaattgctagtccttttcccattcacaagccacattcttggagcttgcaagaggagagaagaggatgagccaaccatagccagagcacagcacaagaaagacggtgagaatggggcttcgtgccaccgaggcggcgacgggcaacggcggcggcatgaggagccttccggatttcttggggaggaagagcaagtacgtgcgcatggacgacgtgctcccggatgagcagggagatggcggcggcggcggcggcgtcgttcgtgtccgcggcggcggcggcagcgggagatacgtctttgcctgctctgtcttcgcctccctcaaccatgtcctgctcggctacggtgagcccctctcctgaatttgactgttcttgattcagatttggttgtattacacataatcaggggtttattttctgattaaagcaagatttgcagctagtaaaatatggggattgtatgtcatgttaatatgcttttagaagatgaagtgtttgaaaagttatcatcactgacagcccactctgcttcagattcagatgaaatgtaaattttgaccggtaatttggttcagatacttgttatggttgttaatctttatctgagtctctctctcagacagccattgacattgtttgtctcgtgaacaatcgatcaaactttcaaatggatgaaatatctttgcacaaattgtcaaatcctgtgttacatcgtggctgttaattttcagatgttggtgtgatgagtggctgcatcatattcatccagaaggacctccacatcagtgaagtgcagcaagaagtgctcgtcgggtgcctcagcttcatctccctcctcggcagcctcgccgccgggaggacgtccgacgccgtcggccggaaatggaccatcgggctcgccgctgccgtgttccaggccggcgcggccgtcatgacgctcgcgccgtccttcgccgtgctcatgatgggccggctgctggccggcatcggcatcgggatcgggatcatggtggcgccggtgtacatatcggagatcacgccggccacgctgcgggggtcgtacgcctcgttcccggagatcttcatcagcctcggcatcctcctcggctacgtctccaacctcgccttctccggtctccccgaccacatcaactggcgagtcatgctcgccgccggcatcgtcccttccatctccgtcgcgttcgtgctgctggtgatcccggagtcgccgcggtggctcgtcatgcagggccgggccgccgaggcgcgcgcggtgcttctcaaggtcaccgatggcgaggacgaggcgcaggagaggctcgccgagatcgaggaggcggcgcgcgtcacggccaccggcaacggcaaggccgtgtggcgcgagctcctgaggccgtcgccggtgatccgccgcatgctggtgaccggcatcggcgtgcagctcttccagcagatcaccggcatcgacgcgctggtctactacagcccgacgatattccgggacgccggcatcaccaccgagagccagctgctcgccgccaccgtcggcgtggggctctccaagacggtgttcatcgtgatcgccatcgtcctcgtcgaccgcgtcgggcggaagccgctgctgtacgtcagcacggccgggatcaccgcgtgcctggccgcgctcgccgcgtcgctctccctgctcgcgcacggcgcgctgccgcgggcggcggcgatcggggcggccatcctgacggtgtgcggcttcgtggcgttcttctcggtggggatcgggccgatcaaca

SEQ ID NO: 90722 - DNA, 1634 bp, Oryza sativa
ttcttccctgtggatactctgtgatcataagttcagaactgaaagcgcaactgagtgatggattatacacgatttctctctcctgtgccatgtctacagaagctgttctgttcaattgcccccaaaattaatgtccaacaagcagcgatcttgaattgctctgacgtaaacaagtcaggatcaacctactactatttacaagatctagatgccgcaatttgcacaaggaatggaaagaaacaacacgattcacaattggcacacatctaaacgtgtgccctctatgcactgtcactcaactcaacatgcaaaggtaagacaagaaacatagacccagcatcagcatcaatcagcctggtgatgttttccttccattttcaccttgggctgatctcggacaccgtgggtggcaccaccgtgctgaacatgtcggaggtgtcggacgccgagtgcttgaacctcgagttgctggagttggtggccttggagaccgtgccattgtagtcgtggatgtagcccggcgccgtgagctcgcgctcgttgatgcggatgggcttggacagcatcgtcaccacctgcggcatcgacggccgccgcgccgccgccgcctgcgtgcagaagagggccgtcttgatgtaccggaggacctcctcttcagggtaatctcccatttctgaatccaccagctccttgagcttccctacctcatgtagctcccatgcctgttaattgtgaaagctaggctgagtttggcagcaagagttggtaactcatcccccacacgcacgtaaaacggagcgactcattagtacataattaactaactttttttttttcaaaatatggattaatatgttctttttaaaaacaacttctcttttgcaaaaaaaaaatagcgtttaacagtttaaaagacatgcgcgtggaaaacgatagagatgagttgggaaatatagctgcgtaattaacacggccttaattgatgcagaggctggaattatacttccattctctaataaaagatttagatggagagtccagcgattacggcttaattggaatgtctctagagcaaatgtctgaaggtgaaagcaaatctctgaattttggatagtaaagatgatagtaagactgaccttctctaggagaatcttatcgtcagccaggagactccttgaactactcttgccacttacgatctcaagtacaaggacgccaaaactgtatatatcggctctcttcgtcaattggccatgccatgcatattccggtgcaaggtagcctctgcattgaacaaatagatcagttcagttactgcaactgcaaggttactttctactcaaacaaactgctaaatgctgaaatactcacgtcgttccagcaacacgggtactgatgtgggtgatattatcagggaataacttggctaaaccgaagtccccgatcttggggttgtaaagcttgtcaagaagtatattgctagccttgatatctctgtgcacaatcggtgacgcaatctcttcatgcaggtatgcaagtcctttggcgattcctatgcatatagcagatcttatgctccaagtaaaatttgcaggttcgctattagaacctacagaacacaagataaaaggttg

SEQ ID NO: 90723 - DNA, 2307 bp, Oryza sativa
attcctgcagcccgttttgtgactattggatcgtaggtttttttatttgattgtattaggaaatagtcagttcatgtaaaatttcgtgtaaaaaccatcctttccaaagtagaaaaaagaaaaaaaaaacaaattctatattactccttgtggtagcatgtctaaaaaaaattacaaagcaaaataggcgtaactaaaatgattatcctgtgatagaactagctcacctgagtttaaattctaaacttgacattattacttgtatttgtggctaattattttttcggtggtagacgatattcgtcaacaacaagcttctgatgacagtctaggatttgagaaagatgtatttgtaaaacccaaagatcgaactactcctatatgctaaaatctggctgccaaccctagtttcttagtataatcttactattaattctttaaacaggggtagtgcttggtatcggtattaattgcgtgacagtcggcaagtatcagtttcattttcgtattgacttttgatctgaccatttccagcttcaacttgtccgccggatttttttttcattggttcgtagtacttggtagtaggaagtagtacaggaacaccatttcaaaattccaactactacttgtctacttaaaccacacatgaatttccttttagcaaaaattcaaaaccacatgtattgatgtataaatttggagtttgacgtcgcagcagacgagtgctcggcgaaagtcatgtaacgcgcacctttggttttgtgtggcgaggaagattttaacacggaaagcgatttgacacgtacgtgtacgtcaacattggtgatgtccagactctagacttgtaaattgtcatgttggtgccagtatacctgtgaaatgatttcatttttctagtacattttatttctttcacatggaaaaaaaattggacggctaattgacggattgatcctggaaagtacgagtacggtactgaaattgaaaaaaacgagcaaatattatacacgttcgggggttcttttcatcagattttagttaggataggaaattgtagttaggagtatgttaagcacgttcatgggtagttttaaaataaaagcacattcatgggagcgtgagcgtgctgtgtagttatgcatgagtctttcgtctaaacgaaaaaaaacaagaaaaaaaatataaataattatccatgcatggacaactttgaaacacaaacttgccaatgggccaaaatgggctagggttgggtagcccaatcctttcattcaagaggcctgtagcccaatctaacataaaagggaataagttcacttcgtgaccctcaactgtgatcgaaatctaatccataaccctaaaccacaaaaccggatatttcgacccccaaactcctaaaactggtgcaatttaactccctcggcggttttggagggcggttttgctgacgtggcgcctacgtgacgatattgaccgagtcttcgttccacgtgacacttaggtggcattagaattaaaaatatgtgtggaacccattaatcattcacagaaaaagaaatgtgggccaactgacatgtggggcccacatgttagtcctcttccttcttcctcctccctctctcccttctctctctttctctccccttcttccccaagaagctaaagcggcagcgccggggacctgcagcatccctcggctcgtgctcccgcggtacgacgccgcgttggccgcgcccaccggcaacgtctggttgtagcagtcgccgccgccagatgaatccatcgatccagacaaatcacacacaaacaatctcacaaacgaatccatcaatcgttcacgccatgtatgactatgtgtttgctagctagcagcttataggatctggatcttgtcgtcggtcatccactagcggtgggagttgaagacgaggacgtcggcgcccttccagaaggtggagtgcttgttcatgggggcactgcggatgaggcggtcgtcgaggacagcggcaccgtcagagttggactcggcgagcatgggcgcccagtataactcgatggtggcgtcgtagtccttggccctgaagatgttgagcgagtccaccgtctcgaaggatctggacccgccggcgccgggagcgccgcggtggaggaggcagagcagcgaggcatacagcccacagagcagcgagtcccgaacttccaatcttgccgccgccgcgtcagcttccaccgccgccgccgccgccgccgctcgccgccgctccagcccgtgctccccgcggccggccgaaggggagagaagag

SEQ ID NO: 90724 - DNA, 1022 bp, Oryza sativa
ttggccacatccatgtgtccagtgctagcgcatgtgccatgctgtgtaaccactcccagtctacaccagccatgcccaccatgcctgcgcaactgcgatacacgcgcccgtgaaaccgcgagagttggctctgataccattttgtaacgtcccgcctcccccaggcctgtcgcacccgtgaaaccgcgagagttggctctgataccattttgtaacgtcccgcctcccccaggccgggcccgcttacatctgatagctttcataggtcatagactgtcctcacagaccaacacatatcttttctgcacactttatcctcactcatgtgcacccgggaagaatttcccggtcggtcacccatcccaaattgctccaggccaagcacgcttaaccctggagttctttggagattggcttctgtaaaagaagttgcaacttgttgatatgagtattctattaatcctattaagccctagaccgggatgttacaaataagcataagcacaagagtttatcctatcttactataaagttatcccccactaacttcttaagcttaacatgcaaagatgccacatcatcatccactaacaagatgccacatcatcattcactaattaacaagatgttacatcatcatccactaacaatcatcacatttaaacatcatacaaacatgatatatctttacagtttttataatttaagagcttttcaaatacaaacatgttaaattatcatccaacataattacataatgtttcaatgtatatctttattatgttttatgatatcctatatacttatatagttcattctcacttagttcttaaatgattaatctatggtccaaattatctctctctttttttcctctaattaagtcatatcccatcaattgtttttagcctttagatgattaatctacggtccaaactatctccctactttttacgtttgaatcaccattctacatactatttaaatttaaattatcataaaccacattaatttacttaatc

SEQ ID NO: 90725 - DNA, 807 bp, Oryza sativa
atgatgtcattatcaaatggacagaccagaacgtattaatgattcatctgtttttgtgaagtcatgaaagaaagttctgtctcaaccaaacaaaagaatattatattcacaatcgccgagaacattttacattgcttatctaaactgattatttattgttgatgaaaaagcttatgcacagtggagtacgatttattcaaatgacttatggttttcttggtccatttattactccaattttttatatggttgtaggatgcaaaacaaaatggtgcaagggttagtgtagaaacctgtcctcattacctggcgttttcagctgaagaagttcctgatggagatactcgctttaaatgtgctcctcctatacgcgattcaaccaacagagataatctctgggaagctctgcttgtacgccattcttcttattatgattggtttgttgaactttactaaactgttataggctaactggccaactattatatggctaacattaggatggacacatagacatgttgagctcagaccattcaccatcagctcctgatctcaaactcatggaggaaggtaacttcttaagggcatggggaggcatatcatctttgcaggtaagttttttagtgcatatgaataaatgtaccgtgccaagagtgccaagtaacgattttattttcccctaatcttaatacaaattggtcaacgttccaccgctggcccgtgaaaaacattttgagtaaaatcataatggtgaagtgtgaaggcctccagattgtgcttgcatagtagtaattagtttggtatgaa

SEQ ID NO: 90726 - DNA, 1188 bp, Oryza sativa
aaagggggagagggagccgaacgtggccgggagcggcgggattcgacggccgacgtgggggagtggggaggagagagaggcgggattcggttttcgaatcccggccatctcgggcgcgggcgcgaacgggagggagaggggaaagggcgcgggagacgcggcgcacgcgcgggcgtggccgacgtggcccgggagagacggaggcgtgggcgcggggcggtttcggcgcggcggcgcgccgggatcggcgggaggtgggggaaggacccgacaggtgggccccacctgtcggcgaccccgagagaggaggcgggcggcggctgccaggctgggccctcggcctgcggccggcccagcaaggaggagggggaggaaggaggggaatgggccggcggcccatccgaaaagaaaaaaggaggaaaaagggagggaaaagaaaaagaaaaaggaaaaggattttccctggaattaaaaattgcactttagtgatttttttttaattggttaaaaattatttctagagctctgaaaattccactaaaaatcctgttaatgaatttcgacatgtagaattcaagaaaaattccacatgtcaaatccgattattatttgcattgttttcttagggttttatcttgatttcctctgcattttcttggggtcatttgaaatttacaatttggcttgggaggaaaacttcggggtgtgacaggaagcagctgcgacgctgctggcggcgacggcgcgaccggacgacgctccggcgaggagggagaggcggctggaggcggccggcgtggaggaaagagaagggcgacggcgggaacgtgcctccggcggtcaccgcgcgaaacggagggcaggccggggtggaggaggtggcggcgacgctggaggaggcaacggcgcggccggccggcgcacggtcgaggcggcacaggcggctggaggcggccggcggcgtgggagagagaggagggcggcggggagagggctagggacaacggggaggctcgggatggggttaaaacgatagaacggagtgaggggatcccattttatagcggagggaagcgaaccgagcacgggagagggcggaacggcgacgggaatggcggccggcggccatggttggtggccgggaaaagcgcggccgttcccgacgattgggggcgccattcaaggggg

SEQ ID NO: 90727 - DNA, 845 bp, Oryza sativa
  unsure (1)..(845): unsure at all n locations
attttcttttcgtttccaataacaatttcagtgcaagcctagaatagttgtacatcttttgcgttgcgaggtagttccatctcattccaaggcctgttgtgatcnnnnnnnnnnnnnnnnnnnnnnnncagtcacaaagccaatgaaaatctttccaaatcaaggatccccagtcctcccaaatctctcggcatgcacacggtctgccagtttactagactcgtccccggtttgacgttctccggttcctctcccttccagaggaaagtccttctcattttgtcaatcattttgatcacccactttggggccggcagggcagtgagatagtgcaccggcattgccgtgaacactgacttaacgagagtctcccttccaactgatgagtaatatctccccttccaacccgggattttagatccaattttatcaagcagtgggacgtaatcgattttcctcgacttgcgcagatgaaggggcagacctaggtatgttgttggaaaggatgataaggtactcgggaagtgctggattacattgggggcattcaaatgcgaacatgcaataggaagaatctgagtcttttgtagaaatatggtctttaagtggtgttcattaactaagaaatcatatcgaactctatctttgtttatgcctaaagtttgtgttaaaaaaaatctaagtagtactagtcagatttctatttgtgttttaaatttatccaaaatcactatagaaaaactcaataaaactggcagaaaaacgtctcgtgcagcaagcaaaaatggcccaatgccccaatccgattcgtggtgcgaccttgaaaaattttgctggtgggccgt

SEQ ID NO: 90728 - DNA, 663 bp, Oryza sativa
gacgaatggcttggttaagtgtccttgttagcagagacacttcctcgtcttgtttctgcttatttatgactatgccttgcgactgcatctcgtcgtcccaccacttaactaagataggtggtcgtgagtcttcagctgatcggatctgaagaatttcttcttcatcaccagtcattgtgcctttacatgtataaagagaacaataaagcaattgaagaagattttctagatgcaaatatacacggaggattgttacctgttatgatcttcggcggtggacgagcaggcccctctaccttgtcaaaagtactggtttctgcaccagcatcaatgtcattgaagggagggctgctagcgtgcccctccgtttcagggatatcttcatcttgttgttcatcacctggctggtttccagtcggagctcctggttagcactagtttcggcgtccgccgactggtttctagtcggaggcgtatttccggcttctgcatcaccggttgtcgactgactacctatcgggcagttttctctaaaagtttcggcctcagcagcagtagcagaactagtttctttatcacctgtctcggagtttacagccgagtcagagtcctttccggatggatcgatgtctgatggcttcctgaagattgaaaagatgttat

SEQ ID NO: 90729 - DNA, 1277 bp, Oryza sativa
attcctgcagcccgcttgattgccacccccttttcgtattgccgaaatcttggttcgttatatgactttaaatataggcatttccacatatatacaaggcaacatcagtagaagagaaaagtagagatggagaatattatttattctatatggatatcccatatgcatataagtaccttttgttatcttctttggaaaaggtacgaattaccccccgaactatcatggccgaccgaattacccgaccccccgcaccacaaaaccggatattcttcacccccaactatgcaaaccggacgaattacccctctcgacccaatccacggtggttttggtttacgtggcgtacgcgtggcagtccattcagtattctatttataaaaaaaagttggacccacctgtcatactctctcttctctctcattcttcctctctctcttctttcagcgtggggtttagcaggccggcctctaggtcgatgcaggaggggtgccagtgtccggcgggatcgagctacagtaatgctttaagtttctttagtgataaatcatgctacagtaaaaagaaagatgttttgagtaagatggacagtcaaatatgatgtaaaagtttaacggtaaaataacgaaggtagtatatttttggacaaatgcagtagcttatagttaggcaagcttgtaagaatttagaagcagtggtgtctttctcttgggaaggaagcatcggtgatattgttatgtcttccgatgataataagctactggttcaagaaatctatttattttctgtcgattctccttcatgtctacatcaatctctacaaacaaataaaatcctagtacaagtggagatagattattctaaaacaaaatatgcattgcaagcatacctagttctactttattccgggtatattgacggtcgtaattggtttataacaaccgtcaacgcggccatgtatttcactctattgtaatcttgaaccgacatgtggggtatgagggattaggccgcccttatcttacttgttaagtaaaacgaagatagcgactaaaaccaaacatgaagttaatttaaacaaatagactaacttgctagaagaatattccttatttgttttttatgacgtcattgatatagcgcggtacaccttttgggttagtattttttaaaataaaattattccgatgacaactatatcatcaactatgtatatcaagcggcttctgaatataatttgaacctatattcaatgtaatgactactagaagtccctg

SEQ ID NO: 90730 - DNA, 671 bp, Oryza sativa
actatggacctacctatgtgcatcctacctcaattctccccatcaaaaaatccctgcaaatcatccattccagtgacttagaaaataaccggagagagaaaataatccctccaaatcaaccgttctacgttttgtgtcgaacaggtgaaaaaatgtgtaaggtagccagtgcaacggtcgaggcaaggcacccagccgtataaactacaacaaatcgccaccgtatggccttttggacgtcatcggctcatttcccatagccaggaatgggtattgcttcaccaacgttgccatagtgtacttctctagatggatcaaaccagagccccttgggtcaatcacttcgccagctgtgcagaaatttgtgtggaaaaacattatctgccaatttgatgtgctgaaggagttcatcactgacaatgcgaagtagtttaagtctgaaaagttcaaggagatgtgtgaggggctaaacttcaaaatcaaatttgcttcggtcatacacccacaagcgaacggggcggctgaaagagaaaatggcaaaattctggaagccttgaaaaagatgctgcaaggagcaccgaaagggttgtggcgagaggaaatgctttctgtccttgttggtatttcttaacgacattactagaaatatgattcccaacactggcgtagaa

SEQ ID NO: 90731 - DNA, 1183 bp, Oryza sativa
taggaactaaccaagagataattctcacaagataaatccaaattactcaagaagaatattatattgacttcagagtaataaataaaataaaagaaataggagaatattaccgacaactccggacttcttccgactccttctactctactctcttcctattctagtatacaatatagtacaatagagcctcttataattcatctcaagcttgggagtgtgtgttgaagtgagtgagctgatgtccttatataggggtaggtacgattggcgaaggggaaatgtccgaagtgcaatccaaccgtcattagggatgcatctgggacgtccacgccaaaccccacatccaacagtggaggtggtggttcggccgaacctgggctgggccctcctggcctggccatcagctcatgttccccccggtcctcctctattcattcttcggtattttgggccgatttactgatgttttgatgaagttcacaacccatccttgcaggggtaacatttctcctcactttagtctgattttcctcccatcatcgaggtttatcatttgcaaacaaatatataccaacacatatggaatatgtgagattatgtacctatcactatgttggatgttttattatctgaactttatgcagatgttggcggtatagaattgacatttaacagccgccaacagttttctaagaccttgtcattagcagctcgctttttgcctaaagcatcagtggttttagcttgcgcaaagacgagatctttcaaggagggttggttacagaaattactgttattgttacctccttgatagaataggcgtggctggttccaccactgacctcattgtggatgatactcgttgttgttgttgcccatgtacatcgcctcttcacgggtttctaggcaatcaatcccagagtggcctgtgctgccacagactgttggtatttcttacgatcacggatagaatccgcaagcgcacggatataccgatgtagcacttcccctacgaagtattccaagggtatcgaatccaagggaacgtgtgtgtttatctcctcgtcaggttcatccgaggacacaaagctaatatgggcagagggtagagaggatttcctaatgagaaacagtgtctagggaaagcttaactttaatcctaacacaatacttcaggcactgg

SEQ ID NO: 90732 - DNA, 2349 bp, Oryza sativa
acgtcgtgcacgcgcgccgcctgccttgcccggcgaggcgagcgagcgcgcgcgcgcgtgtttcccctattctctccaccacacatgcttcaagtggctagtagggcattctcccttttaaggaggtccccctctcctagaataagcaatgtggtactaaattccacatgcatgccatcccatgaggtgggcttttgtgattttccaaagaattaatcttcgaatgggccttagcccatctattaattccaacaatccccaaccaaatctcaaaatcccactgagatttgccttttccaatgtactgtttatataccagcggttcgatggagaccgattaagattgaatatccacctagaactccaagctacacttactcacaacttgaacaatggactacgccttgaattgcaagtcttgtgcaagcaagtttcactcagagtcttatctggtactagaccgtctgtagactacccctcgggtggagcgtataagtcatactcctaggtctttagtaagcttcctagaagattcacccaaaatctccatagactgcgaccaacagtcaagcttacaaaggtgagttctttcaagactgctctgcaggacaacatcttcactaattaaagccaacagaactcattaaggcatagccaacctgccttgcaactcacaagagtacatgcatcttcacttagagagggtatagattggtactctcctctagtttactaatggtttgttcttcccaggttctaattcacgggatctccgatcacatagactgggttaccaccatagtataactcatatgggtctcaaacccatctccttcgatgcattatctatcacatttcgtgataatccctttcgtgaatggatctgccaggtttctagctgtttggatgtaatccaacgttataactccggagtttctcaattttttgacagacttcaatcgtcttttcacatgtctagacgatttcatattatccttagaactattcactttgacaattaccgtttgattgtcacagttcataaggatagccggcactggtttttcaacaataggcagatccattaatagatcgcgtagccattctgcctcaacagtagaagtatccagtcccgtcagttctgcttccatggttgacctcgtcaaaatggtttgtttgcaagacctccacgaaacagcaccaccacctagtgtgaagacatatccactagtggctttgatctcatccacatcagagatccagttagaatcactatattcctccagtatcgcaggatacccagtatagtgaagccccaattccatagtacgttttagatagcgcattactcgctcgagcgcacgccagtgatcatctcttggattagaggtaaaccggctcaacttgctcacagcaaaggagatatcaggcctagttgtactagccaggtacatcagcgagccaatgatttgggagtattccagttgattcttagcaattcttttgttcttgagaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaaggtttgtcccaaatatcagtatgtcgtcaacatacaagcacagaataactccctcacccccatcatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaaactgtcttaacgtccatttgatgaacgaaaagaccatgtgagcctgttagggaaagtagcacacgaattgtggtcaatctagcaacaggtgagtaattgtcaaagaaatcttcgccttctttttgagtatagcccttagcaacaagccgagcattgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttctagtagtctgcatcaggagatgcatatgcttctgaaattgacttagga

SEQ ID NO: 90733 - DNA, 653 bp, Oryza sativa
ttcattgggaaaaaggctctcaaagaaggtagcatcacgagactccataattgtaccaacatgcatgtcaggtacctcgcatttaactattaaaaatctataggcaatgctatgatgagcatatcccaaaagacacagtccacagtcttaggtccaagtttgcgcttcttcgttattggtacattgactttcgccaacaccccccatgtgcgcaaataagaaagtgatggttttctcccaatccatatctcatatggtgttttgtccttctttctgttaggaactctgtttaacacatgattcgaggtcaacaatgcctccccccaccatgccttaggtagtcccgcggtgtctaacatggcattcaccaagtcagtcagtatgcggttcttcatttcagcaatcccattagactcgggagaatagggaggcgtcctctcatgtatgatgccatgttcctcacagaataagtcaaactcgttcgagaaaaactctccaccatgatcagacctaagcctttttatctttctgtcaaattgattttcaacttccgccttataaattttaaaatagtctagagcctcgtctttcattttcaacaagtacacatagcaaaatctagtagcatcatcaatcaacgtcatgaaatatcg

SEQ ID NO: 90734 - DNA, 874 bp, Oryza sativa
attcctgcagcccgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcggccatcagaaatttctctcagtggattgagaatgagcctaaggagaagtgggctctattgttcgacaccgatggatctcggtatggcataatgacaaccaatttggcagaggtgtacaactgggtaatgcgaggagttcgggtacttccattggttgctattgttgaattcatccttcacggcacgcaagcctactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcagga

SEQ ID NO: 90735 - DNA, 3412 bp, Oryza sativa
caactttgctttgttttatacttatgtttgaagtttgctctatacaggttgcggcggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcaccagttggtcccgtcgacggtgtttttgggtggaaggaggatatcactgcgcgcttctagcaggtgatgcgccttccacacctaggaccgaccaccacccttcctccgtactctacagtcgggcctagcaaggcttggttgctccagttcactgtaagtaaataagttgttattatcatacgtgcttatttgcgaccggatcagtgttttgtactaacatttcattcttaactgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgtcctatgttgcttcagctttgggcagccgagaggtttgccatagggcgaccagtggtggacagcgcaccctacggggttggtcgcagcgcgcagtggccagaggacggtcccacgatggggacttactggtgtcgacgtggggttagtgcaacttcgctgcgttataagtttatcagtcctcttctttttttttccttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactggccgcagcgtgtgatgagacagttcggacttaggcaggtgtttcccggcaacgtgcagccgaccgtcccccctgccgaccactcgtgagttcggattgttcatttctaaatttttatgataattacatcatcgagccatacaatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcactggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttccaacaattatgtcatttatcttgcataatataggacaactactgaattttttatttccatcttgcataggctgatgcggcacgggatatcagtgccgatatcaccgcagtccaggtgaggttgaacagaggtttgcacttgactgacgttgagcagaggtcgaccttcgaccggatgcaggagaagatgcgtgcggtcatgcgcgtcttctcctgtcgcagcgccgtggacgtcgtacctccagctggtccggtacacccacggcctcgcggtcctaccgtcggagcaggacctcgtttgtcttcgagcgcccctagcttcggagcagtgcgacctacagcaccggtttcgcacggtacagttcagcccagatattagttcatttttgtttcagcttttgcacgaatgtgtcaccatgttttaactgcacgtttcctcatcgcaggacctcgtatgccttcgagcgcgttcgcaggcacgaccggcgcttccgcgagctccgcaggggcgttcgccacctcttcaggcgcgttcgccagctcttcctctcacggagcgtcgatccctcgcccacacggtactttactttttattaatactgttaaatacctatacgaaactgatggtccttgtccagcaggatttgcagccgggatcttcggtactggggcctcttcgtctcacgccggtaggactggtcctactagccagttctacgacgacgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacgtagttcttttcattcgtatggtgcttgaacaacttatgctcacaacaacacactttcggcgcttcacggtagtgccatatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactaccacaccacacacgaaaatagaagcctattaattggtaatacgtaatctagaattgagattatgtacaacattcttcactacaattttacattttggcagcaaaccaaatatgatcaaatgcaattttaccttaccaaatatttggtagtgccaaaacttgcttatattttggcattaacaaaatatttgtacggtaacattccaaatatgccctaaaaaataataaaattgtattttaccaatcttggagattttaatcttgtatagttttcaatataaaaagatttgataactattgatatttatataaaaaaaatatagagcacagtacaaaatcgccctcccccagggcggcaagggggccgcctgcaaaatccatgccccctcgccgccatttgca

SEQ ID NO: 90736 - DNA, 765 bp, Oryza sativa
attgaactgctatcgtattcctgcagcccagacttatttatgtttaactatatttatagaattttttaaatatatactgatctgcgataacaaatgagttgcattaatattgaacatattttgatgatattttgtttgaaatgttacaataattttctataaacttgattaaacttaaaatagaaaaacaaataacttataatatgaaatggagacggagggagcaccacaaaattaacagctagtagctagcaaaatacaactcggtcgacagcttcggactcggtaattcatacgtatatataatcaatgtatacgatcgagccagctatagagatcccaagcacgtacgtacgcacagatcttagacgtacgcgatgcctgctgcatccgatcttgggcgggacgtcgttgttgtacctccagccggcatcatggacgacgatgatgaaagcacctggtcaccatggccggatctccagccggagctggcaggcatggtgttctgccggctgctgtcccacggcgaccgcctccgcttccgagccgtgtgccgccggtggcgcctcgccgcgtggcagcagcaccctctgccgccggcgctcccctggcttaacttggacggccgcatcacctaccagagtctccccgacggcgaggtgcaccgcatccccgtccccgacgagctccaagctggaggcacggtcgtctgccgcggctcgttcgatggctggctcctctacgaccgcagcgagcaactggagt

SEQ ID NO: 90737 - DNA, 1143 bp, Oryza sativa
aacacaaatgtagtcgacagattcaccagagccggcggaacgtaggacttaccccttcgccggagatcgaaagctgatgcagccctgcgtcaggtgccaaattccgccggttgataagtaaaaacctcaggaaagagggtggcgatgcgccgagagtagttgtattgatcgagattgattgattacagggacccctggtacacaatttatacccttgggtctatggagtccttgtcagacaagaaacaaactttctaaaagataaaacagaaacataaagtccttatcggacactaaacatactttcttaaagataaaaggaaactaacaaactattcctaattaatagatacaattgccttcttcggactcaatccgcatgtggcaatcctcatgaagcaccttaaacgaacccgacaatggttccaacatccccttgtcggaatcggctacatcggcttccttgtccgattcgatatcagttaatacaccgtagccgatgctgttccgaagccgatttatactctgtttctcttaccaatttccttccaaatccgcttcggtcttaactccaaatccgatacatgatttaccaaatttggtcgttaacaccggtatagtgaattccatagctcatagtgccctttagatagcgcattactctttccagagcctgccaatgatcatctcccggatttgagacaaaccggctcagcttgcttacagcaaatgagatgtcaggcctcgttgcactagccaagtacatcaatgaaccaatgatttgtgagtatctcagttgatcccttgctattcttcggtttttccttaatagcacgctgggatcataaggagtaggagctggcttacagtcactgtagccaaagcgactcaaaaccttatctacatagtgggattgcacaagtgtaatcccaccctcatctcatctcagtagcttaatgttaagaataacatcagcctctcccaaatcctttatttcaaagctcttggacagaaagtccttgacctcctcaatcacattgagggtggtcccaaagattaatatgtcatcgacatataaacacaatatcactccttgtccctcaccatagcgatagtacacacatttgtcagcttcgttcacaa

SEQ ID NO: 90738 - DNA, 656 bp, Oryza sativa
ttatgccgaaggaggaggtgccaagaacggcattggcacggatggcatcggcggcagcgtcaccttgggcacggccggcatcgacggcatcggcggcagcgtcaccttcggcacggccggcatgggcggcaacgcggcgttcggcacggcgggcatggctggcatcggcggcaagctcgccgccggcactgcaggcaccgcgggcatcggtggcaacgtggccgccggcacagcgggcaccgcgggcattggcggcacggtcaccgcggggacggtaggcacagccggcaccgcgggcattggcggaagtgccaccttcggcacggccggcatgggcggcaacgcggtgttcggcacgattggcaccgccggcatcggcggcagtgtcgccgccgggacggcaggaatggccggcatcggtggcaatgtgacagcgggcacggtaggcaccggcacggcggcaggaggtgttgcgtcggcgaggtggcgcgccgcttggcagctgcggctgctgccggcgagcaagacggccatggcgagcaccgtggcgaggagacccgaagtggaagccatggctgagagatcagtggctagctagctagaactgcaaaacgagagctgctcaattggtgatgcaaagatgtgcatctttcgca

SEQ ID NO: 90739 - DNA, 755 bp, Oryza sativa
cctgcagcccaattaatacacaagaggtataatataatactccactagctagctagtacagtagttgagcatgaaattttgtctaaattattatttctctctctctctatatatatatatagttaacatacctgacaaaccatatgtttacacgtcgtgttacattagagttattgcgcatatatacataagtttcccattatatatatagcactccagatatattcatatataccatgcctctttattgccaactatatatatcacataagtaagtaggagtaattaatagataaaggcatgcatcgaataattagtacgagtagctaactagctagtacacagcaaaacctctgcagtctgcacactcaccacagtgatcacctattacaggactaattgaaagtgctgcatatttgcatgtagatgagtactcttagaccatgcagaacttattaacgtagagatcgttatactcatcataatatagtctagatgatcagtagtaataatcatattatatccgtaattaaatcaggcagctggagccacatcgacgtcgtcgtcgtcgtcgtcgccgttgctgcgacggttgccgacgaggaggttgctctccagtagcaatgcccatgcaaggcgctcacactcgctcttcgctatcgccattgatgatctccaagcacagtgtattttggctatcgaggaagacgaagaagaaagtgtttctatatgtatatggtcgatcgagttgagtg

SEQ ID NO: 90740 - DNA, 591 bp, Oryza sativa
cccccatcatggtttacaacgttttcttaccatgtattccttgccatttgctgacatgttttatttgttatgctaatgatgttttggcatggaatttcccacgatatttcaaagacactactgcgggttgatctatcaaaaaataggactgataaaatcataattgttttgagcagattggttcactgcacacattcatgaggtatatatgtcataaaagttggctgggtgagtgatttctacctcagaagatcatgaattatttagccttaaagcttcctgattggtggtgggtttttggccttgatcaagcacttcatgttgacattgatatctggagttcaagtctttttcagagcgtcagaagaaggtaattacattgtgccatcttttaacgtgttagcaaattaattttgtggcctatgctatggtgtacatttctgaatttgatgattcagttcttctggagaaaatgtaatttgattccagtacaccagcaacattactctacacattgttgtcatgagcaaaaagttgtgcaaaattccatgtgaagtttgctgcgtggggatttttcttagtgactgatac

SEQ ID NO: 90741 - DNA, 733 bp, Oryza sativa
ccatgagatgcaggaacgggttcaccggaggcgcgacgtccatctcgccctccagcatcttcaccaccgcgcccatcggcggccgcgcctccggccgctgctgcacgcaccagaacgccacctggtacatcctcaccaccgcctccttgcaccgccgctcgtcgtcggcctcggccacggtcaccacggcctcgccgtcgctgccactacagatctcgtcgctcggatgattgatggcggcggcggcgtcgtcgaccatcatcaactcgccgcgctcgtacctggcccacgcctccatcggccaccactgctggctctccggcgcggcctcgtcgaagttcctcctccggccgacgatcttgaggaggagcatgccgaagctgtacacgtcgcacttctccgtcacgccggactgcatcaacgtctccggcgcggcgtagccgggggtgccgcgcatgccggacacggagacgtgcgtgtcgccgcggttcaccagccgggccagcccgaagtcggccaccttgggcgtcatgccgccgtcgagcaggacgttgccgggcttgatgtcgtagtgcacgatcttgtgctcgcactcctcgtggagcgtagcggaacccccgcgcgacgccgatggcgatggcgcgccgcgccgggacgccgacgtcgcggctcaggtcgaacaggtaggcgtctagcgcgccgttgcccatgtactcgtacaccagcgcgcgca

SEQ ID NO: 90742 - DNA, 926 bp, Oryza sativa
tcttgaattcaattattttccttctgcaggttgcttatgtgttaggtcagctgcaaaataaagctgcttcggatgcgctttccaccgtctgaagaatgttgatgagcatccaatggtcaggcatgaagctgctgaggcccttggttcaattgcaggtaactaatactgcaagatttgttaagtctcatattgagcgtccatatttcatagttttctgagggtactcccactgtcatctacagatcaagaaagcattgcacttctggaggaattcgcgaaggatcctgagcctatagtctcccaaagctgtgaagtcgcgctcagcatgctcgaatacgagagatccggaaaatccttcgaggtatattccctagatcaacagaaataacctttgtgcctttgtggtatcgtctaaccggcttgtgtttgttccatgcagtttttgtttctgcagactcctggggtgcagcaggagtcctgagtaagatagatatatctactccaggcttctatatcgatctactgccaagctgaccgacaaattttgtcatcaattttgtcaagacgcttcactcctatcaatagttataccataagagtgtttgttgcttatgtttttcaccactattgtttctcctggtctcctgctgcttatgtcttggaccatgagagtcaaaacagctagtaagaatttacctgagaattttcggtttcatggtaactagaaataccatgtaaaactttacacagatagtcaatgatgtatcgacatagcaacattaaatattgaaggacttcatgagcaaacagaaagagaacaataggcggacacgttctagagcaaaggttgctgattacctgttaagagtggattgttcctatcgagaatgattgtatactcgttttacatgattgtgactgttttg

SEQ ID NO: 90743 - DNA, 643 bp, Oryza sativa
tcaaataacaaagatggaattggaaagaacatctgactgcaactagaaagctcattcagcatctgcacaagcctcagtctcaatggtaagtaacgtgtgcctgggaataagtgagccactcctcttattatttgaacaactgaagaaagtaatggatgcatattgtagtccttgtagttacaacaaagaaacctaacccataggtttacacagttaatatattgccagttatctaccttcctgaggtcttcctgcaacaacagtcgagattgcatgtaaatatccatgtggtgccaacaaagcaaaaaagaaagcaaggcgtttaatgtacaagagcagatatcctatccttttcttttaaagatgtgaaaagggcatgtatatcagcaagaagttttttcttgtatgactgtacagaaagaacttttctattcatagcaacctagcaagaaaatgtaattggcatgtcataaattctaaattgtaaaaaagatgtggtgataactgattgactgcactttgtgaattcaacgttcacagtgcaagaaggaactaatcaacaacataacatatatgcctcaggatttcctttgactttactcacttcagtcttcagacagggaaaaaaatatacaaaccagaa

SEQ ID NO: 90744 - DNA, 894 bp, Oryza sativa
tatattccattatactataataattaactaatcatccttttgatattatgcttcaataacttgcagttgctttcaaactttatgatctcaaacaacaaggtttcattgagaagcaagaggtatcttccttctgcttgttcataagccactctttcttgttttgctatttactatactccatgagaagcaagtgttgcatttttttagacacatgctttcagtaccccatatattagcataatttcccacctaataatttagcacaacaattcaacttgtcaagtcatgttccaggataagccgtttactgtactggcttgagtatttaagaattgtgagagtttttatgtctattacggcaaactaaactgcatccctctggaaggttaattgtttatttgtttgagaaggcatacttgatttagcatcaactcatgtagcagctgttggtcaagaaaagttattctagtccttgattatcaggtgaagcaaatggtggtcgccacacttgctgaatcaggaatgaacctttcagatgagattatagaaggcattattgacaaggtatgcatgagaacctgcattgcagtacagtgcgtatatctgttgtatttatactcagttgcttatggagaaaaaaaacatttgctttgttactagacatttgaggaagcagatacaaagcatgatgggaaaattgacaaggaggagtggcgcaaccttgtgttgaggcatccatctttattaaagaatatgacactcccatatctcaggtcactgttgctaacctgtttgtgcattctgtttctttttggtatcttaggtcactgttgctaacctgtttgtgcattctgtttctttttgttcctaataaataacttgtcaacttttctt

SEQ ID NO: 90745 - DNA, 734 bp, Oryza sativa
ggactcatttgtcctctagcaaggacataagtgccacatgacacactcgcactaaacccctttcatttggctttgtcttccttgcgccgaaactacagcgccagcccccgtgatggccgccctttccattgcgctctcttctcctcttgatacagcgcgcttctcctctgaatcctttctatgcctcctttttttctctaaatcgaggcctcatcaacttagacatttttgctgctcaactgtcatggcttcaaggctgcatcacgaaaggatctgagaagtgagaactatcatgccatggtcgttgtgtgctgcaattcaggctgatttggattttcgtttggctttgtcttccatgcgccgaaactacagtgccagcccccgtgatggccgccctttccattgcgctctcttctcctcttgatacagcatgcttctcctctgaatcctttctatgccttccttttttctctaaattgaggtctcatcaacatagatattttcgctgctcaactgtcatggcttcaaggctgcatcacgaaaggatctgagaagcgagaactatcatgccatggtcgttgtgtgctgcaattcaggctgatttggattttcgtttggctttgtcttccatgcgccgaaactacagtgccagcctccgtgatggccgccctttccattgcgctctcttctcctcttgatacagcatgcttctcctctgaatcctttctatgctt

SEQ ID NO: 90746 - DNA, 722 bp, Oryza sativa
tgctttgtgggtgagtgttgaacaggattcttagcagggttaatagcactaatattatcacaaaagagagatactttcccaaaagtaagaccataatctttcaaagtagataaaagccaaagaatctgtgaacaacaactagcagcaacaacatattcagattcagcagttgattgagcaacactagattgtttcctagaagaccatgcaatcaatgatataccaagaaaatgacatgttccattagtacttttcctatcaattctacaaccgccaaaatcagcatcggaatatccacttaagcatatagaagatgaagtagaataccaaatttcaaactcaagtgtatgattcaaatacctcattattcgcttgaccgcttgacgatgtgaagcacgaggagaagcttgaaagcgcgcacacaaacacacagcaaattgtatgtcaggcctagaagcagttagatacaacaaagatctaatcatacttctatactccttttgatcaacagcttcaccatcttcatcaggatccaacacagttgtagaaccaattggtgttgaaattggcttgcaattctccatcttgaaccgtctcaaaagatccttcatgtacttcgtttgatgcacaaaagtaccttgaggtgtttgttatttgcaatcccaagaagtacgataactcacccatcatggtcatctcaaattccctgcgcatagtctcag

SEQ ID NO: 90747 - DNA, 1512 bp, Oryza sativa
tgaacaaatatgtaggtgaattatcacttgtattagtttgaatacatcacttcatggagctagagcccatctctcaagtgtgatgagatgcatatatatatctttaaggatatataagtggaacccttgtttgacatttcaagcaaaagggaagtagatcagtagcatcgccacttgtgatgccactatttgtgcatttgtgcaatactctcttttagataatggattaactaaaacccacactctacatcctacatgtacatgaccaaaactgtgcaatactcctttcaacaaaaactaacagttgtgcaactgtaacttccaggaaacatccaaattaagagaagcgctaatacagaggtaatgtcaatccaaacaactttatggtgttgcgcaatgcctaacattcatcatctcctctccaacttgcttcaaaccaacgaccactccactctacgagctccaaactccacccatatcttttgccacatactacttcctcagaataagttaattaatctgagattaatttattttggatagacgtctgtccagatttataaaattaggatgtgtcacattctgtgctatcaccgtaatggtatttgattagagcaagtttaatagtatagccaactactaactccaaagcatctacagctaatgtaatagctaattcatacaatagttccttactatactattaatacccggtcctacctgtcatacacacattacgtcttggagtttgtgctgcagctggctacagatctgtagcccactgcttttctctctcttcctttatctatttaaaatatgtttatagctggattatagcctgctattatacctgctcttaacaatgtaatgatccaattggaatgatcacctctgcagactgacgagaccctgatctcaatgagttatcactttcagctgaatctgtagtgcttgtccacctaagcgcagccgccggcgacgcgaccaaatgctggaacgggttcaccggcggcgcgtcgatgtccacctccccttccagcatcctcaccacggcgctcatcggcggcctcgcctccggctgctgctgcacgcaccagaacgccaccttgcacatcctctccaccgtctccctctcctgcttgtccatggcgtcgcagccctcgatggcctcggcgaggtgtccggcctcgtgcttgctccacgccagcatcgggaaccactggtgctggctccccggctcgccgccgtcgtcgaggttccgccgccggcggacgatctcgaacaggtgcacgccgaagctgtacacgtcgcacttctcggtcacgcccgcctgcatccacatctccggcgcggcgtaacccggggtgccgcgcatgccggacaccgagacgtgcgtgtcgccgccgctcgccagccgcgccagcccgaagtcggccaccttgggcgtcaggccgcctgcgaccaagacgttgccgggcctgatgttctaatgcaccatcttgtgctggcact

SEQ ID NO: 90748 - DNA, 1112 bp, Oryza sativa
tgagtaggtgtcgaaaaaatcatcgccttctttttgggtataacccttagccacaagccttgccttgtacttttcaattgtaccatcaagcctaagctttttcttgaaaacccatttgcatcctacaagtttgcacccatatggacgctcaacgacttcctaagtaccatagacataattgagtccatctcactgcgtattgcttccttccagtagtcagcgtcaggagataagtatgcctcttctatggtttttggagtgtcatccatgagttatataatgtagtcatctccaaaggattttgcaaccctttgtctcttactcttacgagtatctacaatgttatcctcctcaagatttccctcaggcgtttgatcattgtgttctatcggtgcaaagtgctcatggggtatgacagtttcttgactagaagtgctaggtgtattttcatgggaaattcattctcaaagaatgtggcatctctggactcaataattgtaccaactcgcatgtcgggtactccagagtttactattaagaatctataacccacgttgtgaatagcataaccaaggaacacacaatcaacagtattcggtccaagtttacgctttttggctataggtacatttaccttggccaaacagccccatgttcgtaggtatgagagatttaatttcttcctttctcattcctcgaatggtgttacttccttatgcttcattggaattttatttaggacatgacaagcagtcaaaactgtctcaccccaccattccttggaaagtcccgtagtgtctaacatggcattcaccatctcagttagagtacggttctttctttcggctaccccatttgattggggtgaatagggaggcatcctttcatgaataattccaaactcttcgcaaaaggatgtaaactcattagaaaaatactctccatccctatcagacctcaaccgtttgattttccttttaagttgcttttctacctcagctttataggtcttaaagtaatgcaatgcttcatcctttgttttcaatagtgtcggtgacatgggatcgggagtatcatgactagaggtttgaggcagacacaatcgcccacgt

SEQ ID NO: 90749 - DNA, 2642 bp, Oryza sativa
tttttttcgtgcattcattttctatgatgaattttggtttcttcttgttctgctaataatgctattgccgtgatgtaggtggaaagaatagttctgatcggtcatttatggctgatcttgtctattggatcgcacagaatcccccaccagcccattttttccttatatctggggataaagactttgcaaacattttgcatcgcctgcgaatgagcaactataacatactgcttgcttctcctggtactgctaccaccagtgtactctgtagtgcagcaacaatcatgtggccctgggaagctctagtgaaaggggaggatttctcacctaaacgttttaaccacccacctgatggtttagctggttcttggtatggtcactataaaggagccctggatgatccctttgtagacacagaacccgaggaactcgttgtagtaccatctgatctcaagcatggttcaatccccaaatatgtggttaatgcgatccagcaggtactaaaatcatatcctaatggagtgaatctgtcagacctccgactagagcttaaaaagaaaaatatttatctgggaaatgatttttttggccacaagaagttctcttgccttctccaatcgctgccaaattttgtggaatttattagtcctccagttggtgcaaaccagccatgtgtagttgcagccaacagaaaattgatgggtcctgacaaacaaaattttgagagttcaactgaaagtaatgtcggggacaataacttgaatcgagcaatacacaatgacaagccacctccactccctgtgtcgacttctttttctgaaaagaatgctaagaccgaaaattcttctcaaaatattgccaagaagctgcagactgcaagcgagaatccacctacatttgctgtcttatcttcccgatcagatgtgttacctgaggatcaaaaggagcacccagctgccaacttgaatgcacagatagaatcaccagaggaccacaaggaagttgatcctacgactgcctctggaattccctcttcctcaggggtggaagacaatgttaacaaggaagggctattcaaaaggatctggctattgtggaaaggccctgagagtgccaagtctgaagtttcccatcttgaaagtacttccactgtagtggttggtgatgcccaatctcctcagcaagagcataatgctaatgagcatcggagacttttgaagagagtctataaaaaatcttgtcgaaatggcagcacagacggatctgacagtgtgacaacaggcagtgcatcaacttcatctcatgatgaccgctctaaaaagttaaagcatgtggatgatatgagatcattagaaagggatacatcaaattcagaaccatgtgatagatctgtatctgtttccgtggacaaagctgagaaaggagatggtatttccaaaatggataagggtttatttagctgggtaacagggtggttgaaatttggaaaatcagatgcagataatgttacagccaatagaaatgtgattgatgaagcaagcacagactcactaaaaggacctgaatccttgaaggtttcagcttgtggaagtggagaagaggaggttcatgaaatattcacaaaatctttcttctgggatgttttgcagcaacagctatcaaagccccttggttctgagcttgtttcaaaagcaaagacaaggtaagatttttatgcctttatacattaattaatgccttctggttagttctagaccttactttgcataccaaaattttttgacctgataaaagatttccaataatgtaacatggtgttcttgtatttctttccataccagaagaaatatgtaggtctactgagtatcagcctgtcaattagtgagaagaaaataactcgcaaagctgagttttctactctgatgtcagcaagacaattctgagtgtgtttgtgacagatcaaaaactttggtttatgtgtgtagcttgatatagtgtgttatgagcaagttgaaataactgttattgcccagatggttcatttagtttgtagctggaatgcctgtaagtctatagaagtattagtttttccttttacttcaacttcctatgagcatgtctgtttgggtacactagaagacgagtactaattgccgggcgaaaaaaataattctaacccggattcttatgagatgatttgataaatcatttttggcttgtcccttcgagagaatcttactgacatgattacattttcgtgatcagggaggagttagtgcatcaattgcacaaattagattgttggcctctgaaaggcctagctgagaaagatctccatcagctggtgaatattttagtttcagagaagaaatgggttgaagaaaccccttccaggtattttccgtttcgtcttacccttcctcacaagagaacatgcattccatcgaactccaggaagtttgatggtctcagttctctgttttccaatgggaagccattgccgggcaatacactggtgatcaaagcacaaacagtcctctccctagggaggaaactttgtcggactgtcacaagctgttaaaggaccttcttctggaatatgaatatggttttaacatcagcattttcaagcttcgttttgc

SEQ ID NO: 90750 - DNA, 756 bp, Oryza sativa
tcctgcagcccagcccacccccctccgccgccatcagcagcgcggcgcgtcgagcgtatctccgggctcggtgcggcggcggcggcgactccagcacagtcaacttctcctcgtccatgtcatactctagtggggaggaaaagcttccttcccacaaggacgcaggccttggtatcaatctgatccttctccttgtgcagaatctcatcgctccagccatcggtgtaggaagagtacatcctgagagagctgtaggagtccatcgtgcgagtgcatgcggcgacgaccagaaatggtcccccgtggcagtgaagatgatcgttatggcactccaaaaggccacacatcacggccgccgtccagtactgcgtctcgacggggaagggaaatccatcgatccactgctcctcttcttcttcttcttccaccattggatcccagactacgaatcgctcctcctcgtcggagcaaaccctcacgtagaagaggaccaggccgtgtcggctgtcaaccgctgatgcgaggtcgtatatgtcgggactcgccctgaatgttgtcgtcatgtggacgaatcttgcgatctccattggctttccgggttcatcctcgttgatgaagtagccaagcataggaggtggatcatggaacttgcggaggaggcggatgaagcaggggtcgccgaggatcgcatgccattgcttgcaaaccagctggagtcgggcgaacagggctgggtcctccggtggggggcgaagg

SEQ ID NO: 90751 - DNA, 764 bp, Oryza sativa
actgaacgctatcttattcctgcagcccgttttccctatgcctccagaccaataattggcaagacagtcaggtattcttcacaacaagtaccctgagtgatactatctataattctcttcattacagcgtctctgccatacagggtgggctctatacttgttggtgcggtgatgggacgactcttagcagtgcttgattctatgctaagatgagaacccatgagctctagattaagaatggctgtaacttttgcacacacaggctgcagctgctctacaataatcttcatttttttggatagacctaccctgtcaaacttcaactttggcgttgatttccctttcacatggtctctctcatcgtgcacacagccataatcatgatcgcaatcatcaactagagaagtcgagaaacaaaggcgtttaccgatagcatggatggtgttgtgtggcgaaccgcagcatgcagcggtaatggaatcaccaggcccgttgttagtagcacaagaagagcatgatgaagagaatcccaacagcttgccagccgctttggccgtgtggtgagcgttgaggaagaggtcgctgacgcagcccttggcgtgctcagcagcggcctcggaggtgtcatcgagctcgtcctggatgcggaagtagtcgagctcgtcgagcacgtcgtcggcattgtacgctaagtcccgcagcttctgcaggagctcgttgaggtcggtgttgtggatctccctaccgcgaacgttggtgagctg

SEQ ID NO: 90752 - DNA, 760 bp, Oryza sativa
agtgactgcatctattcctgcagcccacagttaccttgggacaaaatcaattgcaaatagtactacactgttagttcaaggttagtaagtttacaaacctcagttagacagccttaattactacttagcccttagtacaggttaaaactatgacccctttgaacctgaaagctagctcatcagctacatgaaactctacaacacaatgagtggaatcaatcccaacaattcccccaaaatcaacatattaggtggagtccggactccagactctcctactgagatcctaaatcaagaactggtcaatcaatcccgatcgattgcaggtttgcaggtggaataacacaaaaataatcaagagttaataagcaaatcgatgagtatgcgcattgggcgaacgtaccgtcccactggaactcgttccagtaggtggtgtcgccccaggaccaggcgccgatgccgagcttggtcaccgccacgtccgacccacccagcctcaccttgccgtcctcctccaccgccgccgccgccgccgccgccgacgccgacgccccggacgcgcgtggcgggcgtaccgccgccgccgctcgtcggctggggaggaggggcgccaggcagccaccggcgacctgcagggtcccggccatcattgcaggcaagctacctcctcactgttgctcgggcctcgcgcggcgggggttgctgggcttccactgccagtggccgggaggcgcgagctttttttgggccacaacgagag

SEQ ID NO: 90753 - DNA, 768 bp, Oryza sativa
ttttgactgcttctattcctgcgccctgcatgaagaaaagattcttggcccgcggatgcgattatcattctgcatatcgtctggaacacggggtgcattcatagctggagaagggatctgaggcatctggtttggcagagaattgttcatgtaatatgttgttctttgcatctgattcaggccttgagcttgaccccaggcatgcatgccgtgttcaatcccatgcccatcggtggcatgagctggtgggtaccggggaacatcatcggcacaatcccggtagtcatccacatgatctgaacatgaagcaacagtctcacaatcaggcaccgtgatttgattcatccagaaggattgaaattctattgctactgtggagaaatggggaaagtttgatttcaaacctgaacttgcatttgcagggacttcaagtactcaattgcttcatctagtatggatgctttgtcagtctgagaaacagctagaatcatcaaattgccacaaaattcaaccatggcaatagccaagaacactatactattatacaggataacaaaaattcccacaacttttcgcagaaattattttaccttgttgcaatgaggtaccagttcttgcaatgctctcaacttctcattgatcctatcccttcttctctgcagcaagaacagcaaaaaaaatcaagaacattcaccttgttgcaaatgatgcaacaccatctattcatcaatggttggttggggttcttgaggtcttacacgctctgac

SEQ ID NO: 90754 - DNA, 764 bp, Oryza sativa
  unsure (1)..(764): unsure at all n locations
ggtgaactgctatcttattcctgcagcccagcaagccacagaagatgccttggaaatcatggaaccaaaggaagggatggcatttgccagtgtgaatgatgcttttgtgttctatgagagatatgctcagaagaagggattttctataacaaggagaatctcaagcactttccaatccttcaccttcgcttgcagaagacaagacaacgctcaatgctcctcaaacaatgcatggaagcatcatcagaatgaatgtccagctaagataattgtggatcttgatggtcctgacgacaaattcttcttatcttcagttacgcttgagcacaatcacgatctcagtccaagtgaaacaagtcgaatggaagttttcatatgtaacaaaaaactgattcgtgtgctaaaagaagaagggtgtcaaatgggagagcagacaatcatgccaacaagaagtccagtactccttgcttgcaagctgaaaatcgcccatttggtcaaaaggatcccatgaacaatttgcaattggaaagaaaactgaagctcagtgatgcatataggctntatcattacttcttctgcatgcagttcaagaatcctagctttttctatgctttggactttggcaaggactcctgcctgagaaatgttttctgggcagatgcaaaaagtagggcttcatgtaaatatttctcggatgtcgtgacagttgacactacatacttaatgaacaaggagagcatccctcttggccttttgttggtgaa

SEQ ID NO: 90755 - DNA, 761 bp, Oryza sativa
  unsure (1)..(761): unsure at all n locations
aattagctgctatcttattcctgcggcccgacttcgtcaacgcctggccgagatcgcgcgcgctaagctcgagaacgcggtggcgacgtcgcgcgcgcctctcctggagcgttggtcgcccgacggcggcgcggcggcgccggtggtgctcccttacgacgacctggcggggctcatcgcgaggacaacgacgacgaccctccgctgctgcgcgagcggatgctgcacttctcggcggagtcactggcggcgctcaaggagcgcgcgcggtgggagctcctcgccgccggggacgcagccggcgcggccgccgtgacgaggttccaggcgctgagctcgctgctatggcggtgcgtcacccgcgcgcggcggctggcgccgggccgggaggtggtgttccgcgcgtcggtcaacagccgcggccgcctccgcccgccgctgccaccggagtacttcgggaacagcatcctccccgcgtcgacggaggcggtgccggcgtcngagctcctggcgcgcgggcacgggtgggcggccgccgccgtggggcccgcggtggccgcgcacaccgacgagcgcattcgctcgcgctcggcggcggcgccgtctgagtcggcgttcaggctggtcgactcgagcggcgtggtcgtgagcaactcgccgcggttcgccatgtacgggtgccaactctggtgggggaaggcgcgatccgcccaggatccgctagggggacaagatctacggggacgtgtccttgttctcct

SEQ ID NO: 90756 - DNA, 782 bp, Oryza sativa
  unsure (1)..(782): unsure at all n locations
ggtgagctgctatcgagttcctgcggccctgcctgatacatgataggcacgctggcattctgcgagcgatagaagagttgcagtttgggagtatggaacgaggataccccggtgtttgggaagatgtacagagtaggtggtgcatgcgtcatatgggagctaatttcttcaagcaattcaagaacaaggagctcatgaacatgtcaagaggctgtgcaatcagaaccaggagaaaaaattcaatgagctttggaagagattagatgagttgacagccaaatgtagtgatcagcgtgcagcggctccatcgaccgccgttgctgaccctcctcaagctcttggacctctcccaacggatagtccaacattggttagaagaactgtattggagattcggaaattttctcagtggattctgcatgaaccaaaagagaaatgggccaaggcgtatgacacaggtggtgctagatatggaataatgacaacaaatttggcataagtttacaactaggtgatgcgcggtgtccgtggactgccactagttggcatagtggagttcattntacatgggacatgcaggtattttagggatcggttccaggcagttcttccctctatgccgaacaaagcattttgtttggagctttcatgcagaaaaagctagaggagttgcgtaaaaaggccatgaaacatcgagctctagtgaaggtacccaacaacacaggtttgagatactatgtcaagataaggcaagcangggtatctaccgcaagagagtgaat

SEQ ID NO: 90757 - DNA, 2435 bp, Oryza sativa
tggtcttgtccgagttctccaccgccttgtccatatcagcatcagccttcttggtctcgttgaaaggaaccgatgtcaccatggctgctgatgtaattgagggtacagatgaagctgtagtagcagggaacacgcgttctggtgcagcagcagtactcttggccactggcctggcggtggcgctacttggtaccatcgtcgaacaggtggtgtgcgtggcagtggcgccatctccagggaacatctggacgtgctgcatatccagtaagcagccctcgtcgtagatgtcgtgaccatgggtggtggaccgagccctctccgcgtcatggctggacatgaacgacacaagagccttgacttgccatgtgctcaccgcaagaacctgcaccgccactgctccataggtatcgtacacttgatgcaacacctcagatgtcactggatatatgatctggctcacggtgacgcaaaggacagcagctgagtcgcctcttggacagctcggcatttcattgaacaggtggtgggcatctcctccaaagacaccaccaccaggttgctggctgttcctctgaccaccagcgctcttccacttcatctccacacctaaaaccccacgaatcgactgctctgataccatattgtcacgaacgcactccattccaccccaaatcagcaacaaacacacaagagataaccatcaattctcagcagtaactcagttactcaagatacaatgtggcagaatagaggcagggattgagaagaagcaatctagacttggatttgagagaagaaaggttgagaaatcagataatagaatcaggggtaggggaagagagctcgaggaggaggaagagaggcatagccttctgtttgttcaattcttcgatgccctgttctgtggctgaagggaagtatttgtactcctgctcattgacttgctcccttgttaggtaacttgggctaagcccacttttagctgcagcccactatatggcccatcgtgtatccgaccatggggtacatgacattcctcccaccttgaaattcgatttgtccccaagtcgatccaaaggatggtacccttgccgacattgaggagatgctgaactggaaacaccaggatcccagggccagttcttctccaactcaataactatagcctcctgaattgcagaagtttccacaatatcaacagtttgtttctccttcatgccttgaaaactgctgctatcatttctcatttgaaaatgcatgctcatgaaacaacttgctgaaaatattgaattttcaatctgaagtcgaacttggttgcacctgaacaaacccatctccaagatggagcttggaacgatctgtgccgaagattgcacaagcaataatgccatagccatgatacttccaactgaatgatttggtaatttatccaaactgaacttggcaacaccaagctttggtccatccatttcatccttggagacagattgttccgtcatcttaatccgagtcaccatttcttgatcttctacagtgaccccttcaggaagtaaaaatgacagggaatcatccccttgcaaagctagattttcaagcaatgagctaccagcaaaatcaaccttgtactggaccaattcagcactttgcaacatggtgaagcaattggagatatgactgctatcttctagtgattctccccaaaccatctcattgtgaataccaccaatggtatagttaattgagaaattatccccattacacaacgtaattgtagtgagcactccatatatctgaacagtcaagtttggtggtggccatggaattttgagctctgtaggaatcagcactccctgcaaattcctaccattgaccaataccttttgggcctcctgatcttcattagcacaattaaacaagcactcaccccatgtgtcatgcattggccaggaaattagcttcagttgcacaaacataccaggatcatcaaatgaccaaccatagattgaatactgcatatgctggtaggcagtccaacatgtaccagatgaatgcagctcatagcaaatacaccatccaacaaccagattttgcagcaagcccttagtggaagtaattgttctactcatgaactgggcaacactgtagttcaaagagatttcaggatgctcaccatgtaaattcagtgcttcaatttcagctcgaacaccttcttgaataggagacgaccagggttgtaagagctttaccaccacacctccgttgccttgacaaagctgtggatcaggccatggtaagggccgagaacttgaggtcatcttagccttgttccatggaattactgctctccaaggtggtactggtggagatctaactgtgtattctgagctccggtcaaagcaaccatagattacttccaatttcgatgaaacgaaaga

SEQ ID NO: 90758 - DNA, 3943 bp, Oryza sativa
tagatttaggctagaaagaagaacattgttgaaagggacagattagactaattgatattcatcgcctaattgataatagatacaatcccatccttatatggatagtacaacttgactcctaagtaagaacttaatcttatcttatctctaacttaattggtataggctgcctatatgcctctgccttccggcccaatacccatgacaatcctatagaagtatttaatgcatatggtttatttagtatctaaaaggttcattgtctacttctatataactaaggacgaatgaaaattgctaacatatgcttacatgcatactgaaacataagacaaaattagaaacacaagaaaaggaataaggccataggtcactggtggagaaaccctttgtagtcccggttcgtaacccccctttagtcccggtttccaaaccgggagtaccaatccgggactaaagatcgctatctttagtcccgggtgaaataaccgggactaaagatcgagctgaccatttttttttgcatggccctgttgctgcatggtttatatatatatatagtttatatatatatatatatatatataaaccatgcatatatatgtttcaatacatatatatgcatacatatatatatatatgtatatatatatatatatattatattatattatatgtatatacatgcataatatatatgtatttatacacatatatatgttatgcaaattaatgcatatgtatatagatatatatatatgaccaaaatatatttacattatagaaaatgtgtacacatgcatatagaaacatatgtagtcatgtattaattacaatccattatatgtcctagctagctagctatcatttcgacgtagtagtactcgctgctagctcagaagctaaggaccggtgaattgtgtttccgtcgtagtagaattcacccttgggattaaggatttcttcgttgatgaatcccatgagttgttcttgaaccgccgtgataaattccttgtgtgtggtcaggttatcctcatgcgaataaactatatgaatgtatgaaattgattagtaattaaacaagaaatcgctacgtaatgaaattttgaatttatttgtacgtacatcgagctctcttgtggtgatgatttggtttgcaaggcagtggcaatactcgcacacgtaatagccgcacaagttatttccctgcttttgctttgcgcactacaaataaatgacaaacaacgagagatctaattaatatacacttgtatgtatttgaatcggagaaatataaatatagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaatttaaactaactctgtgttgtatggcaacagttgaacgtcttgtaatgctgcgccttcaggagatggacgagattgtcctctgtttcttgtggatattggtcgagcattgcgacgtttactctccgagggtcgatgaatccagtatcgaaaaccctccgccgtcgggccctttgaatctccattctacaacgataaaagggagtatattattttctatagtctacttatatacaaggacctaatttattaaaggagacgtatagtaagaaatctaaccgaacgatatacttacaaaatccagcaactcataatagagacgtcgagggcgtccagctggtatagttcgtagattcccttgaaattgatccagagaatgtcatctccttgcaagaagtccgtgtccctgatcctcgctccgatcatctctctaccggcggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtaaccaacggctcgatctctgttttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggcttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtgcagctgggggggcccttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcatgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcaggaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgcgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctctgtcgggtcggaacgtgccctgagaggaggcttccactgcatctgttagtcgttgcgcagcctctcgtatctgaacgccgaataccagtgagccatcagctgggttgagcgttccaccgtgagcatagtaccagaacttcgatcgttccggccaattggctgttgccggttcgatacccctctcaatcaagctagcctccatctcctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgg

SEQ ID NO: 90759 - DNA, 3181 bp, Oryza sativa
cgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaacttacgtgctaagtctaattacaaatcgtgatataagctaagtctaggtgacgtatattatacaaccctagctagtaaataattatatactaagtctaattacaaataaagtaatcttatattaaaactcaaataatattacatgctacgactaaaatagtcatgtatgctaagtgtttcgtgcatatatgctaagtctaattaagacaacaatagtcaattgctacttgtcgcaccatttccgtagtaaataattatatactaagtctaatctcaaataaagtaatcttatattaaaactcaaataatattacatgctaagactaaaatagtcatgtctgctaagtgtttcgtgcgtacatgctaagtgtaattaagactacaatagtcaattgctacttgtcgcaccacttccgtagtcaataattatatactaagtctaattacaaataaagtaatcttatatatatattcaaataatattacatgctaagactaaaatagtcatgtatgctaagtgtttcgtgcgtatatgctaagtctaattaagactacaatagtcaattgctacttgtcgcaccacttccgtagtcaataattatatactaagtctaattacaaataaagtaatcttatatatatattcaaataatattagaacactacacaatcttatatgataagtctaattacaggtctaataatcttaattaattgcattacaaatataacaatcatttatattattacgtcacttgcctgctccaattccttctagggctagctcttccactcaggcttgacgacgactccgacaacacgtcttttctgcaagatacaaaaagatgtatatagtcaaatgcgaagtaacatatacatatatatatatatatatacatatatatatatatatacatatatatattatacatatatatatatatatatattgcatttcacgttaacgttcgtcatcgttcgttcgctcgttcacgttccctagatcgttcacgttcgttccctcgttctcacttgtcatcgttcgatcgttctcgttatcgctctcgttcgttcgatcgttctcgttctcgttcacgttctcgcggcaacatacattgacgtgttcgttctcgctctcgttcgttcgatcgttctcgttctcgttcacgttctcacggcaacgtacgttgacgtgttcgttctcgcttctcgttcgttcgatcgttctcgttctcgttcgttaatggcggtgtggcggcatcggggcgacggttggcgccgtggcgacggcggcggcgtggcgacggcgtgaagacgccggcggcgtggcgacggcgtggcgacggcggcgtggcgacgacggcggcgtggtgacggcgtggcgacggtggcgtggcgacggcggcggcggcggcgtggcgttgcggggccgtggcggcatcggggcggcggttggcgccgtggcgacgcgggcggcgtggcgacggcggcggcgtggccacggcgtggcgacggcggcgtggcgacggcggcggcgtggtgacggcgtggcgacggtggcgtggcgacggcggcggcggcggcgtggcgttgcggggccgtggcggcggcggcgtggcgtggcggcggcgacggagagagacggagagagatcgagctgagatcggagagatcgagagataaagggagatctggcggcggcggctctcaccccagagatgcggcggcagcggaggaggcggaggcggcggcgaggacgacgagctcgagacgacggcgagatacggcggcgtcggcgcggggatttgccctaggcagtggcggcgaaggagagaggccgagagagatcgatcggccgaaaacgtctaagtgttggtgaagaagacgcggcgcaccgggaatatatatacccccggatcttactcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtactaaagattaatgacaattacttcgaaaaattatttttgtctgtaataaattaagtggataaatcgtaataagcaaatatatgacttataattaataaaaattccaatatatatatatatacttagcatatatatgaatgatattattatattggtaaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatataaaattgccacttgcgtgatttaaaacttttaaaaatcctctagtcaattataattagcatatgaatgctagtaaattaaatgttaaaacctctaatgaacgtacatatgaaattgccacctgtatgatttaaaacttttaaaaattgtaagtatcacatataactagcatatacatgattt

SEQ ID NO: 90760 - DNA, 515 bp, Oryza sativa
aagacttgcgttacatcattggcaagaacaaaaggtttgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatacatcggacttaccgatgttcctggcgcgaactagagccaagtgctcctcgatgtaaggagctaccaatgaagagtg

SEQ ID NO: 90761 - DNA, 633 bp, Oryza sativa
ggaattctcttctttgttagctgcccgtcaacttctcctggatcgtcccgtctaatcttgtatcgtagtgctttgcaaacagggcatgcttctaggttctcgtactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatttgaccaagatcatccgcaacgtcgttaccatcagcagctatttcctcctcgcccgtttgatttccttcaaatccaacaaattgagcaaagtccggaatattgtcgtcttccacttcatcttcttccatttcaacaccttgctctccgtgggatgtccaacaattatagcttggcatgaaccccgactcaaac

SEQ ID NO: 90762 - DNA, 1089 bp, Oryza sativa
tgagtactggcaaacctgaagagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaagatggctgacaaccgttctgtagtcgaacaggctcatgagatacaaaccatggctaaggaactcgaactccttaagtgtgtcttacccgacaaatttgtggccgggtgtattattgcaaaactacctccatcttggagaagtttcggtactgcactcaaacacaagagacaggaatactccgttgaggggttgatagcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacatcaatcctaatcaggatgagaggacttgctttgtgtgtggccaagttggtcatctggctaggaagtgtctacagtgcaaggggatgaaggcacctgcagggcagacttctaagtctgctaatgtgaccattggcaacactggagatggaagcgggtatggtatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgataggaatcttgttagtggctcccgtctgactagagacggatttaagttggtttttgagtctaataaagtagtcgtgtctaaacatggatattttattggtaaa

SEQ ID NO: 90763 - DNA, 719 bp, Oryza sativa
aggttgtgcattaagtgcattagacttcagcggcaatatgattcaaggacagctaccaagatctttggttgcctgtaggaatctggagatccttgacatcggcaacaatcaaattagtgaccacttcccatgttggatgagtaaacttcctgaacttcaagtcttggtcctcaagtctaacaagttccatgggaaaataatggatcctttgtataccagagatggaaacaactgtcaattttccatgttgcggattgctgacatagcctcaaacaacttcagtggcacattgccagaagagttgtttaagatgctcaagtccatgatgaccaggtcagataacgagactttagtcatggaacatcagtattcccacggccagacataccagtttactgctgcactcacatacaaaggcaatgacataacaatttccaagatcttgagatcacttgtgctcattgatgtctcaaataatgaattcgatggtagcatcccttcaagcattggggaacttgcgttgcttcatggactcaacatgtctcataacatgcttacagggccaattccaactcagtttgacaatttgaacaaccttgagtcgttggacctctcctcaaataagctttctggtgagattccacaagagctagcatcgttgaacttccttgacattgaatttgtcctataatatgttggctggaagaataccacaatcg

SEQ ID NO: 90764 - DNA, 2008 bp, Oryza sativa
  unsure (1)..(2008): unsure at all n locations
ttttgcaaatgtctaaaatttatccctgaactttaaaaccgaacaattactatctttaaacaacacttagtcatttttcattctttaaccagattcaaagtgattctggattacatggtattgcgatttaaggttgaaaaatcttttggttcttaaaaatcagtgcatgataaatccataaaattccttaaaagtataacttactttttacgacatgaataacatattttttttaaccatgtaaatataataatttggctgcacaaaatagttttgtaatatatttaaaatcaatttttttcttggaataatatttattttggaatggacataatttatttagatttaaagctagatnnatnaggtccattccaaatgaccaaatgaccggacaaatcacacacatagcaaatctgtcatcctagttcggattgttcttcttcttctttttcttgaagtcagtggtctgttgaactttgaagaatttttctttgttcttgttttgggctttgtgcatcacattagcactagactacctaccatcgcccttagacacaacgtcttttccttaagctttctcctcaacattaagagacattatactatcaagtatcaaccactcaatggagtactcctgtctcctatctcttgtgtttgagacattatactaaaatttctccatgaagaaggtagtttcacaataatgcatgcagccacaaaattgttgagtaaaacacacttggggagtttgagttccttctattaaaaaattataagcaatatgctcccgataagtgtcctgactctataggcaatgctccgaataagtcttatgttttctggaaaaaggtagttttgcaataatacacgcggccacaaatttattaggtaagacacacttgaggagtttggagtttgagttccctcaactgtctcttgtgttagagtgcacaaccgaagctgatttgttaggtaagacacaattgagaagtactagttttcttaactgtctcttgtgtttgagtgcagtaccgaaactttccatgaaaaagataagtttcgcaataatgcaagcagccacaaatttgtcaagtgaattcaagttcccttaactgtctcttgtattttagtgtagtactgaaactttttcatgaaaaaggtactttcgcaataatgcaagcagctaaatttatcaagtaagatacacttgaggagtccgagttcattctgttaaaaatctataggcatttgcttcggataaccatgcaaccacaaatttgttgggtaagacatacttgatgatgcggtggggagcgatgcagtgggaccggcgagcgagatgtgggacggcgcggatgcgggatgcattgtcgatcgaacggttttggaaaaactaatgacgtgggaagcaccaagaagcagagaatttctggtagtggggatgattgtatatgtatatatgatttgagttccttctattagaaatctgtgggcaatgcttcagacttcgcacaccgaattattctttctagttttctccgttacgcatgtctcaagtgactagctaggagatcactctttttttaaggagatcattctttcctaggatggacaaggtgattctaagcatctcatacatatgtcttccataagatagacttgtgtgtttttccaaaaaattaatctccaaataaaccttatctcatctattaattcgaacggatataacgaccaagcgtgtactactgaaaacttgctcgactactggccccagaaaattgacgtcctcgagtaaccaacattgtagaggtcaaactgcatgcgacaatatggatccacgaaattgacagagttggaggcggcagaaacaacagacgaaaatccaacaacatggaccaatttcacagatcgagagatattcagatggagtatatacctctcagtctcagagacggagatgtcaagctgttccagtcaagtctgcacctcatcatctatatattcatct

SEQ ID NO: 90765 - DNA, 1436 bp, Oryza sativa
tcctgcaccccgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaaacgattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaaggtttgtcccaaatatcagtatgtcgtcaacatacaagcacaaaataactccctcacccccaccatagcgatagtacacacatttatctgcctcattgactgcaaagcctgcagatgtcaatgttttgtcaaatttctcatgccattgcttaatagcttgtttcagaccatacaaagacttcaacaatttgcacactttgccttcttgaccttcaactacaaacccatcaggttgatacatatagatctcctcctccagctctccgtttaagaaagctgtcttaacgtccatctgatggacgagaagaccatgagaggctgccagagcaagtgcacacgaatcgtggtcaagcgagcaactggtgagtatatgtcaaagaagtcctcgccttccttttgggtataacccttgggcacaagccttgccttgtacttttcaattgtaccattaggcctaaactttttcttgaaaacccatttgcatcctatgggcttgcagccatatggacgctcaacgacttcccaactaccattagacataatcgggtccatttcactacgtactgcttccttccagtagtcagcgtcaggagatgaatatgcctcttctatggttcttggggtgtcatccacgagtgtcacgcccggaaattcactagtaatttccgaacttatttgtgcataaaaccctcgtccaggaatcagccgaggtacacaaactgactatttaatatacaaatccatcataataataacgttacatacttacaaaagaaaagaaaacagcagcggaataacggtctagcgatggcttctgctccactcccacaggcagctcaactggggtataagccaaacgtcttctcctcctgaatcctttttcttcaactgaggtttgatgattattgcaaga

SEQ ID NO: 90766 - DNA, 1271 bp, Oryza sativa
atctttctactagcttccttgatgaagagctggatgaagagaacagtgtattgtactacacctcatactcactctcgcagctctcagagccaagcttggacaccttgctggcaaacctcaccaacctgcaggagcttcgtctgggcatggtggacatgtccagcaatggagcacggtggtgcgacgccattgcccggttttccccaaagcttcagatcattagcatgccttattgctcactttctggtccgatttgtcggtccttctctgccttgaaatcacttgttgtgatagagctgcactacaattatttgtccggtccgattcccgaattcttggccgatctgtccaaccttagtgttcttcagctttcaaacaacaacttcgaaggatggttccctccaatcatcttccagcacaagaaattaagaggtattgacctcagtaagaattttgggatctctggaaatctgcctaatttctctgcagatagtaacatacagagtatatctgtgagcaacaccaacttctccggcacaattccaagttctatcagcaatctcaaatctctgaaggagttggcacttggagctagtggtttctctggagaactgccttcttccattggtaagctgaaatctttagatttactagaagtgtctgggttggagctagtaggatccatgccgtcctggatctcaaacctgacttctcttactgttctcaacttcttccattgtggcttgtccggacgcttaccagcttccatagtgtacttaacaaaattgacaaaactggcattgtacaattgccacttttcaggagaggtagctaatctggtcttaaatttgactcaattagaaaccctcctgctccattcaaacaattttgtcggcaccgcggagctagcttcactcgcaaaactgcaaaatctgtctgtccttaatctctcaaacaataaattagttgtgatcgatggagaaaatagttcttcggaagcgacctaccccagtattagtttcttacgtctatcatcttgcagcatatctagcttccctaacatcttgaggcatctccctgagattactagtcttgacctttcatataaccagatcagaggtgcaatacctcaatgggtatggaagacctcaggctatttttccttgttgaacctatcacataataagtttacgagtactggatctgaccctttacttccacttaacattgaattcttcgacctcagtttcaacaaaattgaaggggtaata

SEQ ID NO: 90767 - DNA, 1508 bp, Oryza sativa
gtagcatcccttcaagcattggggaacttgcgttgcttcacgggctcaacatgtctcgcaacatgcttacagggccaattccaactcagtttggcaacttgaacaaccttgagtctttggacctctcctcaaataagctttccaatgagatcccagagaagctagcatcactgaactttcttgcaacattgaatctgtcctataatatgttggctggaagaataccacaatcgtcacacttctcgacattttccaatgcctcttttgagggaaatattgggctgtgcggagccccattgtctaaacaatgtagctatcgatctgaaccaaacatcatgccacatgcttccaagaaggaccccatagatgttctactttttctcttcactgggttgggatttggtgtctgctttggaattacaattctagtgatatggggaagcaacaaaaggaagcagcaagcttgagagggaaccatattatagaatggcagaatattttgttagtcactcttgatcactctagcaacattcagaaagactagtattaatagtgatgtatgaattaaataaaggataactatgtttataaacctttgattctacattattcatttcagtttaaaaaataaggagctaatgtttgttcaaaaaactatgctgataacagatagtggcatgaatgttaagtgatctattccctgtgagccgcatgtttagttgtttattgtaagaaaaattggtttcgtgatatccaaggatgctaacttcagaaatataccatccaacttctcaagtaccctttagtaccatctaaagtttcccacatatagataatgactatttctgtcaagtagagggcccctatgaagcacctgatgccaacaaggagaaaagatttgcatgtcgggactccatagcaacagaacaacttgcacaaagacatgaacaagaatattacagctgggggtaaaactgaaagaaccgctgcattaactgaagcaattactgggggtggcgaattgttgggcgttcgctgcatccttagttgctgtcacctggtgactaggacatgcactgagatgtccaccaatcttgacaggatacggatcacaacaaaggtgacgaaacgtgaaagcgagcaacgtgaggagattggaatggtagatatacgaaagcgtttagaactttcagatggtactaaagtgtactagagatttctagtggaatgtttctaaacatgggatcttcggatgtcacttaaccaattgtaccttttttgttcgaaatgctcaaattctaccgtgaagttctgctggaagcttgtacaatgaaatttatgatgattggttcataataggtacaattatttaaatatctgctccagcttctgtagcggcgctgctacaatagctggagcagatatgttcattagattcggcagaatacccctcacacgttgtaggcttggagcacatccaaacaattcatttgtggttaggactggaa

SEQ ID NO: 90768 - DNA, 1775 bp, Oryza sativa
gcgatcagaacagatcggactcgcggcctccttatctatcaggagaaaggcagtcgtgggaacgtgggaacgtgtacgcgctgttgcggaggcagtcgtgggaacgtgggttagtggctgcaaaagagtagcgacgtgacgcacgcacgcacgcacgcccgccagccacacctcgccccggccaggcccgcgcgcgcgtgtggctttccgacccccacctcaaccagtcaacagggagcctccaataactccctatttaggttgagatattcctcgcttaaatcctgatgtggtattattatacttaacacttattatgggcctttgagatttaataggataagttgggcctagcccaattattctaacaatccccaccaaatttcaaggctcataagaaatgttctcaatgttgtgcctgtttgatataccagggttttggtggagactgttaagttgaacttccacctaggaaatgagctacatcagaccacaactgaacaatggactgtgccttgaattgtcagttttgtgtgatcaggtttcactcagaaccttgactggtactgggctgccgttcgcatcccctctgtttggagcatataagtcaaactccaggcctttcatgagtatctagagatcgcccaaacctcatagactgtgactagcagtcgaactcatataggtgtgttccttctgaaatgttctacaggtcaacatctctgcttggaaaagtcactcggatcacattaaggcatgagccatcctaccatgcaggaaagaagagaagtatatcatgaaaatgagcccttttcaagggtctcttctctcagtcacacaatagtttgtttcgccatccaaattcacgagatctccgatcacaatggacaggtttccactattgtgcaaccttaggtaggtatcatgcccatttccctcgatgcactatctatcacattacgtggtagccccttggtaaactgatctgccagatttctagccgtttggacatagtccaatgctatcactccggagtttttctactttctgacagatttcagtcttctcttgatatgcctagataacttcatgttgtcctttgaactgttcaatttaataatcactgtttgattatcacagttcattaggatagctggcactggtttttcaaccaccgacaaatccatcaggagttcacgaagccactcggcctcaactgtcgcagtatctagtgctgtaagttctacttccattgttgacctcgttaagatggtctgcttgcaagacttccaggaaacagcgccacctccaagtgtgaacacatatccacttgtgacttttatctcatcagcatcagatatccagtttgagtcactatacccttctagtacttttggatacccggtatagtgaattccatagctcatagtgccctttagatagcgcattactctttccagagcctgccaatgatcatctcccggatttgagacaaaccggctcagcttgcttacagcaaatgagatgtcaggcctcgttgcactagccaagtatatcaatgaaccaatgatttgagagtatctcagttgatcccttactattcttcggttttttcttaatagcacgctgggatcataaggagtaggagctggcttgcagtcactatatccaaagcgactcaaaaccttgtccacatagtgggattgcacaagtgtaatcccaccctcatctcctctttgtagtttgatgttaaggataacatcagcctctcccaa

SEQ ID NO: 90769 - DNA, 8202 bp, Oryza sativa
ctgcagcccaaatcaaacgggcgaggaggaaagggatgctgatggtaacaacttgcggatgatcttggtcagatgttgcaggacgccaaggaggattgagaaagtgaaaagggggcccataaattggacaagatgttagaggaccacagaatgtcgttgtacccaggttgcgagtaggggcacaaaaagttggataccactctggagttcttgcaatggaaggcaaaaaatggtgtcagtgacaagacatttggcgatttattgaaactcgtcaagagcattcttccggagggaaacaagttgcccgagacaacgtacgaggctaagaagatagtctgccctctaggactggaagttcagaagattcacgcatgtccgaatgattgtatcctatatcgcggtgaggagtacgaaaacctagaagcatgccctgtttgcaaagcactacgatacaagattagacgagatgatccaggagaagttgacaggcaactaacgaagaagagaattcctgctaaggtgatgtggtatttctctataataccacggctaaggtgtttgttcaggaacaaggggaatgctagaatgatgcgatggcacgctgaagagcgtcaacaggacgggatgctgagacaccccgccgatggttcgtagtggcgaaacatcgatagaaaatttaaagactttggaaaggacgcacgaaacatatggtttggtttaagtacggatggcatgaatccttttggagagatgagcagcggccatagcacttggcccgttacgatgtgtatctacaacctccccccatggctatgcatgaagaggaagtacataatgatgccgattataattcaaggccccaagcaacctggtaacgacatcaatgtgtacctaagaccattggtcgaagatcttaaactgttgtggaagaaggaaggtgtccccatgtgggatgaggacaaacaggaggagtttaacctacgagcgctgctgttcgtaaccatcaacgattggcctgtacttagcaacctatccgggcagtctaacaaggggtacaaggcttgcactcactgtatggatgaaatagaaagtacgtatcttaagcactgtaggaaggttgtgtacacgggtcatcgtcgatttcttgcagcaaatcacccgatacggaagaaaggcaagcactttgaacataaggcggaccaccgtatgaagcctaaacatcgcagcgggaaaacagtgtttgctatggttaaagatcttaaaatagtgtttggaaaggggcctagcagccagcctatagagagcgaagatggtcacgcggcgatgtggaaaaagaactctatatttgggagttaccctattgggaattcttggatgtccgccacgcaatcgacgtgatgcacctcactaagaatctttgcgtaaaccttcttggcttcctaggtgtatatggaaagtcaaaagatacactggaagcacgtaatgatctgaagcatatggaacaacgcggtgaccttcacccggaaccaaaggagaaaggaagccattacttgagtctagccagctacactcttagcaaggcagagaaggaaagtatgtttgaatgcttggagagcatcaaggtaccgtttggatactccacgaatataaagcgaataataagcacgaaggagaagaagttaacaaatctaaagtttcatgactgtcacgtgttgatgacacagctgctaccagttgtaataaggggtatcctcccagacaatgtccgggcaacaataacaaagctatgtgctttcatgaacgcaatttcgcagaaggtcatcgatcctgatagattagaagccctgcagaatgatgtggtgcaatgtcttgacagctttgagttgatatttccaccttcatttttcaatataatgacgcatctgctttgtcaccgtgtcaaagagatcggtactctcggtcctgtgtacctacacaacatgtttcctttcgagaggtacatgggcattctaaagaagtatgttcgtaactgtgctcgtccagaggcaagcatcaccaaggggtatagaacagaggaggtcattgaattctgcgtaaaatttatcgaagacctttgcctaatcggggtacctgaattacgccatgaagggagactacggggaaaggagactctcggaaggaaagcaataatgacagtagacaacaatttattccgtaaagcccatttcatggtgctgcaacaatcttcattggtggctccctacatcgaggagtacttggctctagttcgcgccagaaacatcggtaagtccgatgcatggattacaaggcatcacattaatactttctccacatggctgcgacaacatctcatgggtaacgagacgattaaccaacaactggccttcctggcgaggggaccatctggctcgatcgcgacattctagggatatgaaatcaatgggtacacattctacacgagggcccaagacatgaagagcacgaatcagaatagtgctgttcgtatcgatgccatgggacacgatggtacaactggcacgtattacggtgccatcgaggacatatgggaacttgactatggacctctcaaggtccctctgttccggtgccaatgggttaggttgactggtggaggcgtaacgattgatgacagtgggatgacaacggttgaccttaacaaggttggatactcggacgaaccttttgtccttgccaatgatgtaacccaagttttttacgtcaaggacatgtctagcaaaggaaaaaagggcaaagggcctgacgagccgaagcgccacgtggttctcccaggaaaaagaaaaatcgtcggagtagaggacaagactgacgaggattacaatcagtttgatgggcaaccccctttcacggtgacgattgaccctagcatcctcctatcaaatgaagacaccccttactcacgtagcgatcacaaggaaggaacaatagtgaggagaaagtacgtgcggtcaaccgtcaccgccgatgtattgccataattgttctgtacacgatgtaaactatgttggatgtactgaatatccatacaaatcaattgttgtatggcatatattaaatatgtatgattattagaatttttatcaaattgaaatcatccatatgctagttatatatgattattatattttttttaattatgtatgattattagaattttaatcaaattgaaatcatccatatgctagttatatatgattattatattttttttaattatgtatgattattagaatttttaaaggttttaaatcatgcacgtggcatttacatatgttaatcataattttcaacaatttaatatcatgatatgctagttatatatgattattagattttttattaaaatcatgcatgtggtatttacatatgttaattagaattttcaacaatttaatatcatgatatgctaattatatatgattattagattttgtattaattttaaatcatgcatgtgctatttacatatgttaattagaattttcaacaatttaatatcatgcatatgctaattatatatgattattagaatttttaacaattttaaatcattcatgtgcttattatatattatccacgtattctactacgtacaacaataacttttcgaaggttttatcattaattgttcgactttaaataattgtaatgcattaattactatcttagaaacacatatgcaatgaaattcaagacacagctgctattatctttagtcccagttcctaaccctaacctggtttaaaaagaatttggaaatagcgaaaaaagatctttagtcccggttggtgtcaccaaccgggacttaaagatccgggggtatatatattcccggtggccctcgtcttctccaccaacacttagacgtttttcgatcttggcttctccttcgccgccaccgtgcctagggcaaccccgcgccgacaccgccgtcgtctctcgccgtcgcttggcggtcctcgccgcctccgccgcagacgccgccgccgcatcacttgggtgagagccgccgctgactctctctctctctcgatctcgacctcgatctctctctctctctccacggccgatgaccgacttcgacgcggccgccgccgccgacgacgccgtcgccactaccacgaacgccgcccccgcctcgagctcgccacgccgccgggccgctacgccacgccgccgcgacgccacgccgtcgcccctgccactccgccgccaccgcctcgagctcgccacgccgccgcggccgccgcgtgccgccgccgcgcccccacgccgccgggccccaacaccgccgccgctcccgcacgccgccgggccccgatgccgccgcacccccacgccgccgggccccctcgccgccgccgccgcacccggaggccaccaggccggcccacggcgccctgacgccaccgccgcaccgccacgccactgccgcgcgcgcccaacattgccgaacgtgattgaaacgtgaccgaacgcgaacgaacgtgaacgatacgtggacgacctttgaacgaacgctgaacgaacgtaacgaaacgttaacgaacgtggacgaaacgttaacgaacgcgaacgaacgtgcacgaaacgttaacgaacacgaacgaacataacgaaacgttaacgaacgcgaacgaacgtgcacaaaacgttaacgaatgcgaacgaacgtgaacgaaatgttaacgaacacgaacgagcgtgaacgaaacgcttacgaacgtgaatgaaacgcttacgaatgcgaacgagcgtgaacgaaaagattacgaaacgtgaacgaacgtgcacgaaacgcttacgaacgtgaatgcacttgtactaaaagtgtgagaacgaacgcgtttatactaatacgatttactggtaatatatatatgattatatatgtaacttggcccgtctagactaatacattttcctggtaatgttgcagagaagacgtcgtcgtcgtccctcaagacgaagtggtagctagccatcgaaggaattcgcgcaggcaagtgatgtaaagaagtgattgttagatatttaatatatgattgttagacttagcatatatgattattacaattttaatataagattgttatcgatttaatataagattagtagcgatttaatataagattgttatacttagcatatatgactattacaattttaatataagattattagagattaaatataagatttttagagatttaatataagattgttagacttagcatatatatgtatgattattacaattttaatatgaaattagtagccatttaatataagattattagacttagcatatatgactattacaattttaatataagattattagagattaaatataagattgttagagatttaatataagattgttagacttagcatatatatatgattattacaattttaatatgagattagtagccatttaatataagattattagacttagcatatatatatatatatatatatatatatatatatatatatatatatatgattattacaattttaatataagattagtagcgatttaatatgagattagtagagatttaatataagattagtagcgatttaatataagattgttatacttagcatacatatatgattattacaattttaatatgagattagtagcgatttaatataagattgttagacttagcatatatgattattacaattttaatataagattattagagattaaatataagattgttagagatttaatataacattattagacttagcatatatatatgattattacaattttaatatgagattagtagccatttaatataagattattagagatttaatataagattagcagagttttaatattacggtacgcaaatacatcctatatacctaacaaatattttttgtatgcacagatggctgatcgcgatgaggaacagatactatacgatacaatcgcagagggaagcagccagtactggaatgaaggagaggggaacgaggatccaaaccagtacttgaacgaggaggggaacgtggagagggatgcggagggaacgaggaggggaacgatgaggaggagactagtggaagtcatccctccgctagacagaagagggcacgtggacaacaaggtgccgcgaagaagacagagggtcggcacatcataactgaggtggacgaagacggccgacctagtgccccggcagaagcagccaagaattttgtacgccacagcggttgggttgtgagggacaacgtgcctgttagcacggtgtactggcgcagaacaagggcacgcggggataatgacagctttggtcccgcgactcagagtaaatgagcatgttgtggaccacaatggctcgagacgttcacgctacccgcgggtacggagaacatagtgaaacagtggactatgaagaaaatggcagaacagttccagagcttcaagggagatctctacaagaaatacatcctgaagggactaacactgaacttcgacgtattcccaaagctaagggatcattgggacgagttcgctgcttacaagacagggcaacaagggcaagcgatgatggccagaaacaaagacaatgccgccaagaagaagtaccatcaccacttggggtcaggcggatatagcgtcgcaatgccaaagtgggaggagatggaggcaagtttgattgagaggggtatcgaaccggccaccgctaaatggccggatagatcgaagttttggtactatgctcacggtggaacgcttaacccagttgatggctcccttgtcttcagcgatcagatacgcgaggctgccagtcgactaacggacgcagtggtagcctcttctcagggtacattctgacccgacagagagaaggatgagctgtcactcgccctacagactcccgagcatccaggatgaacacgagggaaaggcgtgattccctggaagattggatttaaggaggacatccacacgtacaggagtcggatgaggagcaagagagataccgaggcgaagattgcagatcttgagtacagggtatcgagctacgagctcagcatgcaagaggaggtgtcaaggaaggtggatgaacgtatggccgcacatcggtcccaggatccccagccgtaaattcatcctgcaatggtcagcccatcaggcaatcgtagcagctgcgcctcaacggggcaggtcggatcacagagcatggacgccatgcaaacccatgacgaaaccacctaccccgttgatgagatcatgcagcggacaccatgtgagctgcatatttccttcaagaacttatcaatcaaggtatgctcgtagtttgatgatttttgacttgtacattccgcaagttgctgcttaggttgattactaatagataacctctcatcacgtgaaggtggcgtcgggaatggccatcccaacggacccttccgggacttaccactgcaggccgattccagcaggatactcgagggtcgaagttgagctggtggaagccgcgtacgaggacctcgagttggactacccaggaggagacggtgagacgtatctacgagacacaagccacgccatcatactatggcgcaagcggtacatcatccttcctgggagacaagcggcgtctcgtgcaccatctcctctggctccgccatctcctcctgcaccatctcctccgattcctccaccacgtcctcctgcaccatctcctccggctcctctggctcctccgcctcctccgcctccaccgtgtctgcctgcacctcccaagacaaggtctcgccaagctccaccacctgctcgcacaagggcaacgaaaaaggcgaaagttgacgccaccaaaaacaaggagccaccgtacgattgcagtcaagagagcttgatgcttatgtggcaggagaggtgaagaggcaactcaagcctcggagtcctgaaaagaagatacctattgacccgagcgtgaagaacttcttcaagggaatgtccacaacaaacaaggaggcgttacagatatcggactatgaccgaacacttcagagagcctatcacaagaagtccaaaccagtccctcagcttggagaacaaccaaaccaagaggtcgagccgttggtgaccggcgaaga

SEQ ID NO: 90770 - DNA, 2117 bp, Oryza sativa
gacggccgagatcgatcctatccaaaacggacggcggagatcgatcggtccacgtccggctcacagcagacggccacgatgacgtcagtggtgacgtcatcgccggcggcggcagcggctcggcggcttggcggctcgggcgcgcaagcttgccggcgaacgacggtgcggcggcgcgaacggagagcacccacgggtagcggacggcgcggcgaactcaccggtgaccaaagaaacggcggaggagcagcggacggtgacggcgacgaggttgaagcggcggagaccttcggcttgacgacggcgacggtgctccggcggtcttcagcgacggcgaaggggcggacgaggacggcgacgcgacggcgaccacgaaggcgacctccccgagcgacggcagcaactggagcgacggcggcgcacggctggagcggcggcaacgacggcggcgcgaggtcccacggcgctagggctcttccgacggcgagagacgaaggcgagggtggcgacgggtagaggagacaccggggatccttttaaaggggctaggaggcggtggcgaaggcccacggcgaccggcggcgggatggaaagctcgggctcggagaaagagagagaccgatccgaatcgacctcgaatcaaacactttccaagtgattttagccgatgattccataagagaaaaggtagagaagatcccgaagattgtttcccctcaatcgatttcaccggatcgggaaaggagcggccggatttggaaggaaacggcggcggcgcggcactagggtttcgggcggcagcgacgcgaggaagacgatcggtctgacagatgggccccacctgtcagcgaccgagcacgcgcgcggctgcggactgggccgtcttgagccggggggagagagagagagggttttgggccgactttcggcccaaagccaaaagagacttttaaaaacctttttcaattaaaattattcatgaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaataattccaattaaacaacaatttatatatttaggatttttagggtgtgacaagacatcggacggacgagggcagattcaaggtacaagggttgggttaggcagccttcagtacctttgtttaggacaggaaataacatatacctttatttaggggaaaaagtacgaattatactctcgaactatcgcggtcgaccgaattaccccccaaactcgaaaaccagacatagctcaccctaaactttcaatattgcacgaattacccccctcaacccaatccaaagctaggacaatttagtcgggggtggcgtgcacctggaactaccatcagcttattttttttatggtggggcggagggatcctgcactcttttaccctcttcctcctcttccctctctcttggcgttctcgccttctcagcaaagcagcgcgcggcggcggacgatgggcggcgccgtgggatgcggaggcggcggcggcgtgggatgcggagccggcggctgcgtcgctttctcctcttcccctctctctctgtctctctctctggcatcgttgggcgcgggtggcgggtgcggctgggcgagcgacgatgagctgcgggcgcggctgggcgagcggaggcagctgcgggttccccggacgccgcagcagcttcaggagatcagcgacgacgcaccgcgcattcttggtgatcggcgtagagaatgccctgcacctgacgcccgacgcggcaaagacgaagcatgtcgctgcagaagcaggagcaggcatggttgccatcgatctcgccgaaccattcggagctgtgtcgagcaaagcaagtgatcgataatagatggctaccaaaaggtagaaagcagttaagcagaagattgctcaaatgctgttcacggcttgagcataacacacgggcagtaggtattagtagctagtcgtgtgtccctcggctcggtcttcgttttt

SEQ ID NO: 90771 - DNA, 707 bp, Oryza sativa
gcaggagtattacgacacacaattgctgctgtttccttaacgaatgaggaaaccgtcagtggacgagcaattcgctcgttttgttgaagtaatccagaagatccacatcaatgtcccgttgttggacactatgcaagtgccaacatacgcccattatctcaaagacatactcaacaacaagcgaccactcccaacaacggaggtggtcaagctgacggtgtaatgcagcaacgtgatactccacaagctcccggagaagaagaaaaatccggggtgtcctacgatcacctgctcgatcggggcacaacagttcgaccaggccttgtgcgaccttggagccagtgtcagcgtcatgccaaaagacgtcttcgacaaggtcaacttcacggtgttggcaccaacaccgatgcgccttcaattgactgactcgtcagtccgttacccggcagggatagcggaggatgttccagccaagatacgggatttcttcatccctgttgactttgtggtgctggacatggacacgggaaatgagacgctgctcatcctagggcaaccgttcctttgcaccgcaggagccaacattgacgtgggaacgaggagtatctattccacatcaacgggaaggaagagaagtttgagtttcaaccaaggacggaacaatgctccgtggtcaggataaagtatggccgaacccacagaatatt

SEQ ID NO: 90772 - DNA, 713 bp, Oryza sativa
tcctgcagcccgatcagttggttcgaggcgcaccaatcccgaggcgaagtgacatacaagtttgaactcggtaaaccgcttgtcaaacctaaaaaactgcagtccctaccgacacagatgtacaaattccatgaacggtgcatggaaatgagcgccaaatgtagagagatgttcggagcgaggtcagaaaccccgacatcttgcaaggagaagatgttctctggatccatttcaaggatctcttcgatctataccagttggacgccctcgacgtctctcttttgagcgcatggattttgtgagtatctttgagttcgatttgattcgttaataattagctcctggcatatatgtaagcaataatactttcctttcatcgttgtagaatggagattcaaagggcccgacagaggagggtctacgatactaggttcatcgaccctcggaaaatcaacatcgaaatgatcgacaagtacgagaaagacacagaggacaatcttgtccatctcctaacgcagcagcatttcaagacgtacatactactgccgtacaacacagagtgagtttttattgtcgttcgaacaaatttcgttcccatacatatagcatgtacattttcgatcatatatatctcatctcacgcatattccagattccactgggtcctgttattctttgacttggacgcatgcagagtcactgtgtatgactca

SEQ ID NO: 90773 - DNA, 1746 bp, Oryza sativa
attatgtctaacctttaaatttttccagtactccaaatcccacagacaaactctcctactccaaattttcacatttgcagttttgtcactatccaaggcagaacgcttccttttcctgctctccttttgcttgatcccaggtttgacatgtctaaccttctctaattctgctagtagctctgcttttgtaaatttacctggtggatcattggttccatgaaggccactgtattcattgttcctcctcaaacgatgtccccttggcaggaaacggtagtgtccaatatatgcaattttattccttagtgcataagacagaggatttttgtcacagtgaatacaagcaaaatagccttttgtggtacgcccagacaaagtagccagagctgggtaatcatgaatgcaccataacactgctgcacgaagtttgaactctttgtcaataatggcatcataagtatgcacacccttccaaagctcaatcaattcttcaacaagaggctgtagaaataaatcaaagtctttcccaggtgaacatggacctggaatcaacagagccatcattagattggattgatccatgcatgcccaaggtggaaggttgtatggcacaacaaatacaggccacatgctgtacttcgtgttaaaattgccaaagggattgaatccatcagtagctagcccaagtctgaggtttctagcttctttagcaaaatctggatattccctgtcaaaatcttgccaagcctcaccatcaactggatgactcatttccttctcactaggctgcctctttaacttgtgccattgtgcttgttctgaaccctccttggttacaaatagcctctgtagcctaggcaccaatggaaaatgccgcaatactttctgcggaatcttcttcctctgtgggtctttccatcttgacaaaccacaaactgggcaattatcaagatcagaataatcctttcgaaacaaaatgcagttgttgtagcaaacatggatcgattcatatccaagtcctaattccttatatcattttctttgcttcatcgtatgatgttggtagtgtattaaactctggcaatgcttcagctagtatcttcaagattgcagaaaatgcagtgttggtaatcctataaaatgacttcatatgaagtatctttaccacaaaggagaactttgaaaatttggcacacccaggataaagctgacgcttagcctccttcaccagaagtttaagaaaagaggtttgactgtttccatcattgttcccattttcaggttcagagtcatgactaccatgtcctcttgcagtttgaaggtcactaagcaaactatctaaccgatcaccaacattgttgtcagtctgagccataccaatggaaccctcatcagtgtcaaaaacagaaacagaagcagggacttcattaacatgtacactaatgtcctctccatgatgtacccaccgagtatatgtacagtccataccattcatcaaaatgtgtttcttcacagtgggctgatgcaggtacttctgattaaggcatctagtacatgggcatagaatctcatcatcctcagcatatttttctttaatgaaatccataaattcattgacaccattgacatattgagtagaaaatagtgtgctgtgcacccaacttctatccatctgaacatgcattggggaaacacacaatttaattaataaacgtgcacagtacaagaaaatcagagagaagatgg

SEQ ID NO: 90774 - DNA, 1562 bp, Oryza sativa
acctagcaattcggttcttcagccactcgttgaaagaagacatgtgcttatttctgacccaactctctaatcggcctgggttctcctgtcggagaactgcaatgtgttcgtcaacgtacgacaccacctcagtcatatgctgcagtaccgtgaaatgagctttatcgtacaccttcccatccaacctaacagtctttctttcaacagtaccaacaccatcaagcatccctttgtgatgagatcgtggtaatccaattgaagatgtttctgacatgtagtccacacaaaaattgatgacctcttcgatagtgtaactctcgatgatactcccctcggggtgtgaacggttccgtacataacccttaaggatccccaggtacctttcgcaaggatacatctgcgtcaataatgctggaccgcagcactttgtttgcctcacaaggtgcacaggaagatgttccattatgtcaaagaaagtttgaggaaagtacatctcaagatgacatagggttctcacaagttctgcctgtagttcatctagtccctcgggatcaatgatcttctggccgattgcatggaagaaggaacacaaccgctggatcgtgtgtcacaccttaggaggcaaaatattccttattgcaacgggcaacagctgtgtgataagaacgtggcaatcatggaactttattcctaccaacttaagatcttgcagtgaaacgagcctactgattcttgatagtaaccagatggaacctttataccactcaaacatgttagcaaatcaatcttttcttctttcgagagagtgtagcagactagaggaaggtaaaccctgccggattccgtagttatgggatatagttccgagcgaacaaccatttcttccggatctcgtcgagcgttgacaccatcctttgtagtacctgggttaagcagtaatcccattaaactctcgcatacattcttctcaacatgcatcaaatctatgcagtggcgaacttcaagatccttccagtatggtagtctccaaaatattgacttctttttccacatgctcctctcttttgtcttttgttttttcacatgctcctctgttttttccttcgacatgctcttctcttttgtctttccaactttcctcttttttccaaactcgttggttattcccatcactaagttgtgcacctctgtccctgttagctctgccgggggtccggctgtatctctgtgtccattgaaattctttttcatattcctatacgggtgataccttgggagaaatctcctgtgacccatgtagaccgtcttgtgtgaatgcttcaaccatttgctttttgtttcctccatacactccgaatacgcccatttctctttcacagtttgcccagaaaggttgccaagggctggataatcgttgatggtacaaagcagcatcgcatggaggttgaaatactcttgtgcatatgcgtcccatgttcgtgtgccctcattccatagcctttcgaagtcatcgattatcggttcaaggaacacatcgatatcgttgccaggttgtctcggtc

SEQ ID NO: 90775 - DNA, 719 bp, Oryza sativa
tacttgtcctcctgacgaatagccttatccaccaacttctggaaatcaggataatctccagtcatgagggggtaagaaagctcatcattaagtccttccaagaacttctcctggcgctcttcatcattgcgcacatcttctggagcataacgagccagacgattgaactcgtgcagatactcggtgacagagcgagatccctgggtgagcgacctgaattccttcttcttgagagacaccactcctgatggtatatgcatcttccggaaagcagcggtgaactcaagcaaagtgataggttcagcagtagtcctattaaggcggaagtgatcccactattcagaggcagggccatgcagctggtgtgatgcaaatgagaccttctcctgatcagtgcactggagcaaatccaacttcttctctatggcatgcagccaatcaccagcttcaacaggattagtggtgctagagaaaataggcggcctcacacgaagaaattctgctaacttgttctgcggcggtggagcattgttgttcccttggttgagctggttctgctggttctggagttgctgcatcatcatgttcataagctgtgcctgttgagccaggacttgggcaagtgtgggattctctccattgttgttgttattgttattgttgttgttggggccattcccgttgctgcgagtgagcaccatctggcatggacaggacac

SEQ ID NO: 90776 - DNA, 1890 bp, Oryza sativa
taaactaggtctcacgtgtcattgactcaaagaagtgtggcgatgctcccttagatttgataaggtgtgccaataatgtgatcgcctcaacttaggcaagtggtaatatttgttagcaaattagtcccgttcttttcttcaacaagagttggatgaaaattaagatttttgtggcacacttttcaaactgctaaacggtgcgtttcgtgcgaaaactttctatatgaaagttattctaaaatatcgtattaatctagttttcaagtttgtaataattaaaactcaatcaatcatacgttaataccacctcgttttgcgtaaaaaacttaatcttcatcttcatattcatctttaggagaaatgaacaccatctaagtgtcattcactttcctacttttggcagcatatacctatgttggtgttggtgtagaggccaggttttacctattattttaaaaaataaatccactttcctactaggaaaccacatcattgaaaatcaccactatgacaaccaaaacatggtgattgaaagtttaaggtaaaaagatatactttgaatacagttcaatggtcaaaaatgaacttatagttgccccaagaacgtaattgacagtttttttttcttttgtgtggggagcaattgatagtaactgaccaaacatattaagaaaattaccatgattgtgggtcatctggatctcgatttgctagaatcatctctttgacctccaaggatgttaatgcatctggtctattttttgcgtgtttcgagaaaatttcctcaaactttgcaggaacaaacctgaaaatcatcatgtttaatatatatatagatccaaacaaagtgtagaaatcttcaaaaagagcatgcaattaattctaaagaccaggcctaaataggcctcgcgcatactgaatatgtgcaaataagatgcaatataattattaaaattaaaacaaattgatacttatggaatttgagtccaaaaataattgagttttgcatggtttcatgacaagaaagaagtgataatttgaaccataaatatattattcaaaggctagaaataattgaggtgatgtggcttaatgagagaagagaaaaataacattaattacacttagtggggatgaactatataagtatataggattacactcgaataaatgtaggatgatgccatgaccattttgatttaaggaaaaaattagtgtgttactattatgacctctgaattaattgcaacacataccgtacgagaaaagagtgtgtgggaggaatttttgccaaggcataacttaattaatcatgtatagtattactaatgtatgtaaagtggaataaaatatgcatctaaaagttgtatttcctattaaacaaaagatagagtatatcaagcaaatgttcaaaactcactaaagttcttttgtatgtactcctaaagcatttaaactaataatatgtaattatcttgctatttagatacatatgcatcacatattattgttaatatgcttgacattaattatatgatatcatgtgatatcttctaacacttatgtaagatatgtatatataggcatgtggttggtgttaccttcctttagcatctagtgcacctgtgtcactcccgtgcattcctttatagatgttctttatgtatatcgacaagtgaggtaatggtgcgtccttctgcacatttgaatacggaaacaatatctggtcaattatttccttgtgtgtacaataaattaaatagcatatctagttagtctattttggaccaaattcataataaacatgtcattatttttatatgatttgtttagaattagggttatgagagggattgagagagtacggggcttgttttaggaccaagacca

SEQ ID NO: 90777 - DNA, 1521 bp, Oryza sativa
cctccacctgggcgctgaatccatctagcaccgcggtgtttgcggcggccaaggcttgcagaaggggctcggcactcagcggggtggcagaagacgaggagaagagccgccttggagaaaatgcgacgcggctcggcccgccagaagacgcactgagctcggggatgtcccccggacccgtttggtcctgggcgtcgcccgagggagcgggcccaggcgatgcgcccgcggccttgtcgcaagctgccccggaggttgtcgcctgagcgtcacccgagggagtgggcccgagcgacgcgccggcggtcttgttgtgaaccgcctcggaagacgccatcgcctcagcctgcgagcccgggcggtttcctcccgagtggcttcttcagcctgacgagcccgggcggcctcctcccgagcggcttcttcagcttggcgagcccgggcggcctcctcccgagcggtatcctccgcctgccgaacccgagcggcctcccgggcggcctcttcagcttcccgaaggcgatctgcggcctctcgccggtcagattctcgcctctgttcctctgcggccgccggatcttcggcctcggattggccggacttgggatggcgggagggacgcgacgggacatcgctgaagcagaagaaaaaaccagaaggcaaacaaaataggtaaggtaaaacttgcttttgggatagaagaaaagacggtcgcaaagagagcgggacgaacctgcgagggggtcggttaaatgaccaccttggaggggaaattaggtttccctgggatggttctgtctcccccatcttgcgcagccgtttcttcttgcgctccccctcgggctgcgatgttggcgcggccccctccgggcgcctgctgctggcacgtgccgccccgccccctcggggaggagatgggggaggtgttcctcccagtttcctcttcccccgggcgtcggtagggcggttgctccccgagcccccgacgcggggcccagaagcacgaccccctccgggggtaggttgatccccccggcggctcccacctgcgccgccatggcccttaggagcctgctcctctgaggccccgaccgccgtcataatggtcaagatggagacgcgatctgggtcgctgcagagggggaggataccgtgggggatgagggacgcctccacggagttgagatttagcacccgttggatcagtatcttgaaatcctcgggggcccaatcccatctgaccccctggcgggtccgcatatagtcttcgggcccgatgtactcccaggcggcccgagcgcgccgctggagcggcgcaatccgacgacggaggtagtcgccgtacaccatggccccggtgagcccctgggatcgcaggcccgcgaggcggtcgaggacggcgacatagccatcccccagatgtcgcgcccagaaattcacgaaccagaatttctaagctgaatgtgtattaaacccctgtccaggaccagccagggtacacaaacgacaattgttgacata

SEQ ID NO: 90778 - DNA, 759 bp, Oryza sativa
ttcatcagtgaagttgccaccataggcatgattcaccatgttaatgtcgtgcgtcttgtggggttttgctccgaggaaatgagaagggccctagtttatgaacacatgcctagaggatctctagacaagtatatttacttgtctgagagaagtttctcatgggacaagatcaatgagattgctctaggcattgctagggggatcaactacttgcaccaagggtgtgatatgtagattctacactttgatatcaagccacacaacatccttcttgatgataactttgttccgaaagttgctgatttcggcctcgctaaactgtacccgagggacaagagttttgtgccggacagggctttacggggaacagtgggttatatggctcctgagatggtatcccggagttttggtgtcatatccagcaaatcagatgtttatagctttggaatgctactacttgagatggctggaggaagaagaaacgtgacccaaatgcagattcaagtaaaagtaaggcgtactacccatcatgggtttatgaccagctaatagcagatcaacaatttgatgagatatcaaatgttgctaacatgcatgagctggagaggaagctatgccttgttgggctgtggtgcattcagatgaaatcacacgatcgaccgacgatgagtgaggcaatagagatgctcgaagggggtgtggatgcgctgcaagtgcccccgagaccatttttctgcgatggggatggcattggcaatg

SEQ ID NO: 90779 - DNA, 617 bp, Oryza sativa
atgccttcagacttgcaatatgatttaaatatcttagaacagaactccatcccattgtcagtacgaaggattttcacctttctttcagtttgtctttcaaccatagttttccactctttaaacacatcaaaagcttgatatttgtgcttcaagaaataaggccaaacttttcgcgaataatcatcaacgatagtcattatgtaacgagcacctccaaaggatgtcttacgagcaggcccccataaatcagaatgcacataatcaagaataccttcagtggtatgtgtagatgtgttgaacttcaccctcttatgcttgccaaagatgcaatgctcacaaaatttgagcttcccgatgctttgtccatatagcaatcctcgcttgctcaattctgccaaaccaatttcactcatatgcccaagacgcatatgccaaagattagtagcatcggaattagataatgaatcagaaactgcagcaacattacctaatatagttgtacctcgcagatggtacaggttggcagatttaatatcagctttcatcacaacaagagagcctttagttaccttcaaaattccgtctccaccggaatatttgtaccctttgcgatcaag

SEQ ID NO: 90780 - DNA, 1941 bp, Oryza sativa
ggataagacgtaaccacagtgaccctatgtgcctgaaaataatggcgcagtttcctcgaggccatcagaatagcgtaaagcatcttctgggcctgagggtatcgggtcttagcgtcccggagggcctcactaacaaagtagacaggccgctgcacctttcggtggggccgatcctctttgctaggggccgtatccccggggcgttcttcattcaagtggcctttcggggcacacttgtcttctgtgccgatgacctcggggtcggaggatgaaaggggcggccttccctcagtggcctcggggccgtcctgggggtcgggggctcctggcatcgtcggacaagcaggcaaagggccaactccggtcgtcaggggcctctggcctccgttcgactcgggggcctcttctccctgctctttcccgggtcgagtcagcacagggttagcctcggggtcaaagggcgttaagtgcggccttcccgcagtggccttggggccctcctgagggtcgggggcacctagcaccgtctgacaagcgggcagagggccgactccggtcgtcaggggccgtaggccaccgtccgactcgggggcctctcctccccgctcgctcccgggccaagttagcacagaatgggggtgcacgaaatgaggattgtcttcatcgcgctccacaaccaacgctgcactaactacttggggggtcgccgctaagtaaagtagcaggggctcatttggctccggggcgactagaaccgggggagagctaagatatgcctttaactgagtgagggcatgttcagcttcctccgtccaagtaaacggccccgagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgctagatctgaaagtaaagtttcttggttgcgcgtttttacaaccaagtcatcgacatgagcctcaacattacgtcctatttggctacccaaagaaattcgagtagtacgttgaaaagtaggacctgcattctttaacccgaagggcattgatgtataacaataggttcctacgggggtaatgaacgcagttttctcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagtgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctcgggctgcaggaat

SEQ ID NO: 90781 - DNA, 1879 bp, Oryza sativa
aattcctgcagcccatctggaggtaggcgtagtggaccgccgccataaacttcaccaacgcgggcctccccaggaccgcgttgtagggcagactgaggtccgccacatcgaagttcacccgctccgtgcggaagttggctgatccaccaaaggtgaccggtaggtcgatgtgacctaacggccatgtgtgccccggcgtcacaccaatgatcggttgagacggctggagcaccatccccggggccttgatagcatcaaaggccgcgggggaaaggatgttgagagccgctcctccatctatgaggacacgccccaacttcacattgcagatggtgggggaaaccaccatcgcaatctgccctccccgggcaacgcacggtgggtggtcggtctggtcaaaggtgagggccacctccgaccaccgcgcccgacgcgtcgcctcatgagtaggggccgcggccagaagctctcgcttcatagccttgaagctccggcgagaaacgtgagcacacgctcccccgtcgacagtggcaatggtggccccaggttcttggaaacctaggtcatcatcaccatcatcgacgtcaacggcgggggccttctgtctggcctcacttcgccgtttaccggagggaactgccgcggacttgccctcacggcgttcctgcctcctgtcctcctcccacttcctcgttcgctcagccaagtttttgactgcgcgacaatccgcgagatcgtggagggaggtgttgtggacggagcaccacttgctggctgggcgctccctgctgggagtaccagcctctttctttttgtcgctcgcaggcctcccctttcgggtggcccgcggaacgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcaaggtatagtattgcggacttggcagaaacgctgaatgtacgagcgaagtgattcatcatcccctcgctgtactgcgtgcaagtccgcttcttcacctgggcgtggataagtgccttgaaagttcatggtgaactgctggcacaaatcctcccaggagtggaccgacgcgggcggcaggttcattagccaaccccgcgcctgtcccttcagggccatgggaaagaaattcgccatgactctgtcgtcacccccagcggcctcaatcccggtcgtatagacctggagaaactcggtggggttgacactcccgtcatacttctcggtgatggtgggccggaaccttgggggccaacggacattccgaagactcgccacaaaggctctacagccgacaccaccagccgggggcatggagggctggtcctcacgtccctgtcgaggtgacactctggacgaagaggcgccctccgttgcgcggggagtacgccggctattacgccgacgctcgatgtcgaggcgggcatccggctctccatgccgatcctcccgagtcggaggtgccgacgagggagtggcagccgaatggcgtgcaacagccgccgctcgccgcgccctccgtctcgacgacgcggaaccggtagtggcggcgccggaggtcttggtggtggcggaccgtccaccagcacccaggcgctgctgtgccgtcatgaccaagttggccacgtcggggctgcaggaatt

SEQ ID NO: 90782 - DNA, 555 bp, Oryza sativa
cagggatgcaaggtatagtattgcggacttggcagaaacgctgaatgtacgagcgaagggattcatcatcccctcgctgtactgcgtgcaagtccgcttcttcacctgggcgtggataggtgccttgaaagttcatggtgaactgctggcacagatcctcccaggagtggaccgacgcgggtggcaagttcattagccaaccccgcgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctgatcctcacgtccatgtcgaggtgacaccctggacgaagaggcaccctccgttgcgcggggagcacgccgatcactacgtcggcgctcaatgtcgaggcgggcatccggctcttcatgctgatcct

SEQ ID NO: 90783 - DNA, 615 bp, Oryza sativa
aacagactcgttgaggcaatctttgatgagaccataccaagtagtccaaggtcctccatatgtaggaaatttgacggcaaatccacccctcatggattttacaacatcttcatattcggacagattaatgctgttaccgttactgccaccgccgataggagtcatggccaagtatccacaagaaggttcgatgtcttggatagatggtgctccaaacgatgggagcatataataaacgtaggacgaagtcgtggtcaggcaattcatgggctggtatttgctactactgttcgtaattagttcctgcgaacaattgacaaagccgacccaagtaatcatatcatcaaggcccaagtcccagctgtcgtgtgatcctgggatacccagaccaacgtaaggcagctggtccgagcgaggaagagggcagctgctgtttgcatcatcctgcaggttggcgtcgacgacccaaaagatggaagcagtgtagtcgatgctactcacatagtatttccctgtgttgatccgaatggtggccttgccatcatcgctgctgcagtctaactcgtacgacgagacgccgcacctgcgaaggtcgcctcgccggcgaaaaggatg

SEQ ID NO: 90784 - DNA, 645 bp, Oryza sativa
ttctatagccacggccttctcttcatctgccttcctcgccattacactccatggacttgccaaaacttctcttcacagtactcatactctctcttctcaactacgaatcctcttccgccacagcatgggatgatgaagatttcttcaagacttgctcatcacacaggtgcagcaagcatggaccagagatcaggttccctttccggctctcgacacaacctccatcatgcggcgcacccggcatgcacttgtcatgctctggacaggacaccatcctcaatcacccagttcttggtccctgcaaagtaaccgagataagttacagttatgctaccatgaacgtcatcccacctgtagattcctcacctcactgcccacttcagaagctcatgtcgaaaaaccaatcaacttctgtgtacaaacctcaaggtcctcaatcgcagggagctacccttgtagtttgttcaagagatcccatacctgcaaatcaatacgacatagttggcccaatatcttgcctcggccataataaccagttctggtatttggcagatccctatacatacatgtctgttcttcccttggactgcacagttatttctaaaggcatcccaatgccctatagttatgataaaaaagggagaa

SEQ ID NO: 90785 - DNA, 676 bp, Oryza sativa
tttacatatttcacaaaagtttttgaataagacgaacggtcaaacatgtgctaaaaagtcaacggtattaaatatttagaaacggagggagtaacaatgaggattatttgttcttaagtatacatggttctttaccagcaatccacttcaaagtccacatggccagtggtattacacccacgatcagttggacaactggatgaggaagcaggcaaccccagaaatgatagtcaaatatcacagtgtagaaaatcctgaaagacgttggtcgttcctcttggacgatatttctgcagagacaatataatgtaaagcgtaaaaaaaacaatataatgtaaaatgaacttaagatgcccccgagcagtttctgagcagataagcaagagaaatccatgcatatataaaaaatcgactaaaagagaaatatgaaaccacatgcaggatgtcgcaaactcactggaatgactgtgctatgcactgtttgattttggaggagtagacataaaaacgacttgtgtatggaaaccgaatggcaaatccacctctcattagtttgacaacatctgcgtagcttgcattctctagcaccagtgggcggtcgccggcacccagaggagtcatggccaggtacccacaggaaggctcgagactcccaatagaatcagagttcatgcca

SEQ ID NO: 90786 - DNA, 3363 bp, Oryza sativa
cgactccattccacaggcaatccttgacggcagcgacgaaaccaacctcttcgagacatcttcaactgagaaggacttcaactctggtgtgggggaaaagagagcaagactgagtactacccactgtactcagcaagtcacaccggaagaggaggtatgatgcaagatatatccaagggaggctaaaggttcttttgcataaagccggcatttcaaagcagtagttgaaagcagtaaaacagttgtagtaattaatccatattaaccaatcactgtccaacgttacaccacgttgcaacaggcccaaaccaccacctgaactaaccagttcattaagctaaactagggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgtataaccccctctaaccgatcgcaccacaccttagggttcgcccccgtccccagcaggcaacgggcagcccccctttcgtgccgcggtgaatccggcagccgatcaaccggacaccccggccgacccaactccatcacgcccaccctcgcctgggtacgtcggctagagaaaagctacactacaagcccagccgttgcccacgctggcttgtggtaagtacgataaattcttccagggcatcccgcgaaccggtccttaatcgccatgggcacgtctagcaaaaccatgcacccacagcccaccatgtagtgtattttaattagccaacaccattgcggtggcactaatccaaagctattgccaataatcaagtctatgctttaatgtggtccccctttgtgcactagttgaactaagcatgactaagcatctcctaaaccaacatctagtcattttaataccccagctatcaatggcatacggaaaacaacatatagctgagtaataggacccatcccacatgatattgtaaaacaatgcaatatttaatagaaatgcgggacatttgtaaattaggtacaatatgatcaattgcaatgtatgacttgccttgctctcgcactgatggaaccacagcaacgtcttcgagaaaccacgaatcgacgaaacgggcgaaatctacgcgacaaacaaagcacacaagcaaaacatgctataagactactgaaacaggaaacaaaaccatttttaatggattctacacatttttatgaatttactgagacttgaatggacttaaacggagctcggatgaattagttatgatttttagaagattatctgtgtttttactaataaagaaaaactcttaatcaatttattgcgcaatattgccccagggctgacgtcagcaaggggtggggcggcgccgacatgcgggacccacgggtcagtgactcaaggagggagaggggcggctggcaagcgggccccaccgagcggcggctcaagagagtgagggagaggcgccggcacgcgggccctactggcagtgacacaaggggggggggaaaaggcggcctggctcggctcggcttcaaagccggcaggccaagcatggcgagcgacggcggcacgcgcggtcgccggcgacggcaaccggcggcacggacggcgacggcagacggcgcgaaaagcggcggcggcggccgaagacaacgatgcgcgcgcggaggacggcgacgcacacggaagagagggaaagggggaggagggggagtttttcaccgaggttggccggcgcgagtggagacgacggcgaacgacgacgacgagcgacgggaggacgacggcgacgggcgaacgatctccgggaggacctagagaaaaggttgggaggggttagagagagggagatggaccacggcgatcggaaaccatggccgacggcggcggtggaggtggtgctcacccgtgcgcaagaggatgagggctccggcgacgaacttcgacggaggaggggtggacggggtggatctcggccacgcgaatcgaacggcggcgacggcgcaagacggcggcgagcctagcgacggctagcggcggccggagtagcgggaagaagcggcggtgggtggttgcacggcgcggggacgatggggagcacgggaggggtcggcgaaatggggaaaaggagagagggggtgccggcgatgcttaaataaggggagagggggccggacgtggccgggagcggcgggaatcgccggccgacgtggggagtgggggaggagagagaggcgggatccgattttcgaatcccggccatctcgggcgcgggcgcgagcgggagagagagggaagtgggcgcgggggacgcggcgcacgcgcgggcgtggtcgacgagggccggggaaggcggagacgtgggcgcggcgacggttgcgggcgcggcggcgcgccgggatcggcgggaggagggagacgggcccgacaggtgggccccacctgtcggcgaccccgagagaggaggcggcgggcggcctgggccgccggactgggcctcggcctgtcgccggcccagcagagaggagggggaggaaaagggaaatgggccgacggcccatttgacaaaaaggaggaaaaagagaggaaaaagaaaaagaaaaagaaaaaggattttcccagggatttaatattgcactttgctcattttaattggttaaaattatttccaaggctctgaaaattccactaaaaatcctgttagcgtattttgacatgtagaacccaagaaaaattccacatgccgattccgattattatttgcgtttattaatttagggtttctctctaggttaaattaaacaatttcttcgaacgatttattttatgaatttagagcaagggaggggaacttcagggcgtgacaccagatctaccggcgcccgccagctggaggcctgcaccgggggctggctcggaagtcggagatgcgcttcgtcggcgaggggggtgtagaaccagtcgctcttccagtcatcccactttttgcggaggacgcaggggatgtagcggttcaacaccggcccccgcggcaggaaatagcagccgccgaccaccgacggcggcgacaccgactgcacggtgaagaaccaccggaacagccgaagagatgggcgcaccccaatgaacatctcgcacaggtgcgcgaagatggccaaagtcatcactgcgttgggggtgaggtgcgccatctggagatcatagaactccagaacatccataaagaaagaagaaaaaggaggaaccaacccggccattgcgaaggggagga

SEQ ID NO: 90787 - DNA, 1521 bp, Oryza sativa
gcacccacctgagatataagcccagatacccaaattattattttttccattataaatagagtcaatttgaacactggcatgttcttgatccatacatgactgaaacacaaacacaagaatacgacaacacctaaaataccacatgaaaatgcagggtcagcttggtagggctctttccgactgtttcccattttttttaaaaaagaaggaattctgcagtgatcatgtggcacggacacatggtactggtctatgtcttgtctgtgatttacaagggacttcaagaagatccttactccctagtgttaaacttagtaagtgctcagcaaaaagctaggtattgacagtagcttatgatttgtgcagttgacttgtgtgaagatcaggtgcttcaattagtccatttggtaaagatgtataaaaatatagaggaaggcgtgcaaatctgcagtcagggacttctaaatgccaaaggaaagagttagggtgcaggatatggaaataacatgcattattattggttcagttctgtatatatgtgctttgaatgaagtttcaaggttgaaatcaagaaaatagaggacaggaacaggaattcgtaagtgtcttaagtcacctattgacaatatatcagattgctccataaattgaatatgcaccagaaagtagaactaacaacatcaggatatacaatcttgtacaagatgtagagctagcagggacttttctggcactcacacgaggctcgatacgcattagccttcgctccaacctttgtattctagaaagcagggcagcttcgacaacctgaatataagagaaggcaataaataaccagatcatcttggcccagtatttggcaggaggatggtactctcaataatcgggtgaaaatgcaagcatagcatgacatgttggcaaatgcatgatggcgataaaaatgttttttgtcagcaatatatgttaaatgatttaatataataactaatgagaccaaaaaagatattgtacaatcaaaaagaacttttaaaatcaaagatgataatcctattcttgttcaagattccattcgaccgttaagagaaactaggaaaactcatggatgacaatcttattcctatgtgagttgaaaacaaagtaaaccttccatggaggcaaatataaatgaaacaattgacaaggaaaatatcatcatattaagactgttccagaccacaaatatggattaatataagaatatccatatgcctgatacctcaagttgaaatggcattgctggtccaccattgatatttcttggatttaaccgtggcagtaatgaatctaagaaggcctttcctcctgggctactcaagtcagataaaataattgataagtttcataacaatagtgatgttcaccaagtaaaatacaatttatattaaaatgactagtgtacaaactgacctgttgtaattgaatataagaacgcgttcatgcatagcaattgctcgcaaggaaccaagatttactaatatggct

SEQ ID NO: 90788 - DNA, 551 bp, Oryza sativa
agcagcagcagaacatgcagtttggtcctccacctcctcagtccaaactgttagaatttcttcgtgtcaagccgcccactttctcaagcaccaccaacccaatcgaggcccacgactggcttcatgccattgagaagaagctgaatcttttgcaatgcaacgagcaagagaaggttgcttttgctacacaccagctgcaaggtcccgcttctatttggtgggacaactacatggtgacccgtccaactggggcagaagttacttggacagagttttgtcatagtttcaataaagcacaggttcccgagggaattgtggcacaaaagaagagagagttccgtatactatgtgaatctggccatggcacggactgtgtgacatcttcttgaagcttctgtatcgctgatagcaaaccggcgtgtcggtcatgtagaacacacacatttggtctattttcaacaacacacattttaatgtgccgcaaaaaccatagccagcttgatgtgttctcgcttccaacaaatgcaaaagcaacaggaagcccatggcta

SEQ ID NO: 90789 - DNA, 546 bp, Oryza sativa
tatgtacaatttttcggctgtagtaaaaatcattaggtgtttccatttgggttaattttttgagattggatgaacacattccagttggagtcttacaacaaatctaaaaacattcttagatcatacgtgaaatcaatactaatactagcaggtgacaaaatcttgcagaaatacaacatgtttgttgcccagattggttgtgcggcatttggtgtgttagccctttccttatttgggcctggatggttggcaagaggtgctgctctttctgcatccatagcattcatgacaattacaggcgcctcacaccctccaggtatataatctttctttcaacagggatgtggtgctttagatgtgctcagcaggatttaaaaaaatatttctgattgacatctgtttttgtactctacttaaatgcatcatagcaaagctcaccatttccatgatgattgcagctgcaagcttgcctctcttgtttattgatggtccaaagtttcaccacttgcaactctggtatgccctttttcctggagctgcaggctg

SEQ ID NO: 90790 - DNA, 557 bp, Oryza sativa
tcctttcaatgaaaaagctcttagtgcagctcgtggagcctcattgcagcttccagttgtttttggtaactggtctgatctgcatgctttgatggctaaatttgatatgaagatgctggcaggtcatccagaaagcagcagtaatggatctgaaagaacacatgttctatctaaagaactagcggattcactgatgagtgaatcagtgtgcttagtgttaggaagtgagggcaatggcctttcggcagatacccttcaagcctgtgagcttgtaaacattcctatgcaaggtacatttgaatctcttaatgtttcagttgcaggtggtatcttcttatttatgttacaaactaaacagcaaaaaatggcagaacgttaactgtttaagtcatccttgattttttaataattttattgttcttgtccaatctgttacatttggttcttctttctgacatcattgctgatagcttgatatcaatccaaagtgaaggaacaaactgttaagaggaatgcaagatcttggttgacaaacaaaacaaaatgagaacatttta

SEQ ID NO: 90791 - DNA, 548 bp, Oryza sativa
tgtgttatagcacgtggaagcagatggaagactatccacgtcctggcctccaattgtagcccaaagtgtaacatcacatggaacctagacaaaaacgatagaacataaaaaattgaacaatgagcagtacaaaacaatcaatgtacacacaggactataaaaaccaaaccttatgaattgtgaaagaaggctgcaaatacttgaatccaagtaatggagctcgggaacagcttgtcacaaacttcagtagcatgcaacgttctgttggcttaaatcctttgataacctgcacattccaaaaaccatatttttattatgatcattccacttcagccttcaccaaaatttcttttgtttattgtcaatcagtaaaaatagcttcatctttgataataagctaatacgagtagcttccatcctttgtcttggaggcaccttttcaagggagatctcttcttcttagattaaatgaaagattggatcttgtcgttgtaattttttgtaccttctgattttatcaataaaaatttaactgtaggggccctccc

SEQ ID NO: 90792 - DNA, 652 bp, Oryza sativa
ttatgaagcctcatatgacaatttgccacgtctgctatctgttatccaacaaagaaaccctgggacgtcttgtgcactcaagacattcccctcaattgaacatcctggcaagactgtgctgcaaagagcgttcttagctctacatgcatgcaagatggcattcgtgcactgtcgtccagttctttgtattgatggcacatttttgaccgggaagtatcggggccagatactaacggcaattggggtagatgggaacaatcaggtattgccgttggcatttgcttttgtcgagagcgagaacaccgacagctggtactggttcctccatctggttaagacagaagttgttggtatgaggcccaatgtgtgtctaatacatgacaggcacgccggtatgcttcgagcgatagaagagttaaagtttgggactatggaaagaggataccctggccagtgggaagatgtacaaagcaggtggtgcatgcgtcatatgggagctaatttcttcaagcaatttaagaacaaggagttgatgaacatgttcaaaaggctatgcaatcagaaccaggagaaaaaattcaatgagctttggaagagattagatgagttgacaggcaaatgtagtgaccagcgtgcaacaagaccagcggcc

SEQ ID NO: 90793 - DNA, 732 bp, Oryza sativa
tccaaaaattttaccaatttctagaaactttttattattgttctctaactttgtcacatgtttattatccaactgctaatataattttgcacaaccttcttgaaattgttactttatttaaagaatacgaaaatgatgacgttctaactgaacctgtctttcacatgaaacaaaaatatttgaaatattggaaaaatatacctatgttgtatgctcttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcggagaccccctcctatccccactacaggtaagaagaagatacagtggggtaggatttggggtggatcgtcttcaagttcaatccaaggtggtggcagttcctctgctacaagtggagacgcctcttagcatgttgtggccgcaaagttgtccggttatttggacagcgactgccatccaccacgaagcacaagatttcaacgtcctcgggtggtggaatgaccacaagataacatatcctgtgctttcaaaactagcacgggatgtgttgacggtgcccgtgtcgacggtgtcctcagaatcggccttcagtctatgcggccgaatcatcgaagaccggaggacgact

SEQ ID NO: 90794 - DNA, 506 bp, Oryza sativa
cctcctcgagaaggagtgtccacacaccgtctcttgcgccgacatcctctctctcgtggctcgtgatagcgcctaccttgctggtgggctcgacttcgagatcccaacaggtcgtcgtgatggcttcgtctctaaggaggatgaggtcctctccaacgtccctcacccggagttcggtgccaaagacctcctcaaaaacttcaccgctaaaggtacatattatatacttgcactacatagatacgcatatcatcggtaacaatttcatggggtcatcatatgcacttgccagtttatctaaagtcttgttaatgctctccctcataccgatgtcccataaatcatcatagagcgagttatgaatgcaagatagtgagagttgtttagctctgatatacggaaagtgtttttatccctcgagaggatatcccaacgtttatgattgccacttaaatagttataaaagtatgaaaaaaattaacaagatagattaatataatatatat

SEQ ID NO: 90795 - DNA, 1118 bp, Oryza sativa
tgcagcccaccattttttacaattagagcaccaaggccagttggatagccaaatatctgcaggtttgccaaagatatcgatatcaattggtgacttctgtaggaccaagcatttcaaaacacaacaggtgcatgtggattaccttgtagaaggaacatacaacaaaatcagcaggatacacagttaaattcggtggttcagtggcacatccttttgcagcatctatcagaaccatccatttacccctatattaatgcatttaataagcatgctaaagacactagagtccaaggaaaacaaggcaatgatcctgcaagacaaattcaatgcatcttactgctgctgcaatgggatttttccttccttgatgagcttaaccaagctcagactgaacttttgtcctgaaaaattgcattctgacgggaatgcaaatatattccaattgttccctacagaagaaatgaatggggagtgagcataaatattaagcatcgcactggaattaatcttccaaatgagagcaaaccaaaagttttgctatcaatatttctagttatccatgttcattccacattgcatggtcatacaatatgaccatgtcaaaccaataaaccaaataaacaaacttcttaaggaaaaatccaggaatgataaatgtgttcccagttaactccctcataaagaataaaagaaagctagagaaaactgaaaacatcattaacagattggaaataagacaatcaaattctctgtgtaaattctacaatattgatcaataattgaacctgatcaagaatatgttattcagcaattgtaaaggacaaaaataaaaatcataagggactgacctgaaatatctgaaagacttccgttctgacaattgtgtgaaagcacatctttgcttcttctttggtttgtgcgtcttgaaatcttatacaaactataacttccattgtcttttgccagatcagcaccctcctcaacatcaacggccaacacagtagctcctttactcagagcatatctagaaatttgctaagggaagacaaaatttacaagatactatgtgccaatgtgaatttcatgatcctacacatagactgacaggaataaatgga

SEQ ID NO: 90796 - DNA, 583 bp, Oryza sativa
agtgagacagccgatgtctcgtcctggtgaaaagaatagaagatctcgtttggagcagcgtcgagttgtaagcccttgttgagcttaatggtcggcaggtctgtaaagccaacttacacgcaacttgggataaccttcttcctgtttctcaatccagcgtatcaatccaatgaaagggggtacatcgacagcccgaaaaagagcgcaatcacccactctgaactcacgtccgtcctgaaaaatcaataaatgatttattacctcttgtaaagaaaatagccttcgcacggcacacgatagtttagtacttcacaagcatggagcaaagcaggtctctatgactgagggatcagttgttatgttatgcaagaagttagtatcttacaagcaaaaagttgcatacaaaaaaaaaaagcaaccatgtgtttcggaaacactatacaattcagttttataacatgattgtgaacccaaggaacgataactatgttaaacatgtaacaagacgttggttccactagaacatgtgtttttaaccatgccaatgaccttggtcgactgcaaggtatagagcatgcttatt

SEQ ID NO: 90797 - DNA, 4007 bp, Oryza sativa
agcggttgccgctgttgcgtgattaaagggggcgtccagagctcgtcacatcactctcctgttgccttcgtggcttcgtgtcagctagcgagtgtgccccgcctgcccggggaccgcgacagcgaccgtccgtgtcctttggcttggcatttcccttccgtttcgtgcttcgttttctcttccccttcggctcgttcaattgctcataggagtataatctttctttggctttcctgatttcctcgccaggttagagaaatttgtacagtagtcagcagactattttagccaggttacagaaatttgtacggcaatcacgaatcagcagactatttgatcattctatggtcggaatggaagtaaacattccgttgagttgatttttattggtagtattaattagtagaggaatcaggttaattaagcttaccaagaactaaaagacacgccatacataatcgagccagccagcaaggagctagccacagcgagatgtcaggaaatatggacaacagcattctagtcatcaaacatctacacagtaggaagcgtcatggacgaggacgaccaacaactttggaggtaatcaggtagaggaaggcatgcagcaaataatataaccacctgcatattgaactatttcaaaaacaaaatatttttttgacatgaaaaacaaaataatttgcctcgcagaaagcgcctagaaaccatcagcgaacctcaatgactgaaaaatagcaacagatcattgcttatcggtccactaaatttcttaaccattgcaaggcaccgatggatacaccagaatgcgctttacaggcattcaggaactgcagatcgagtgtcatcccccaggatagtccactagagttacatgggcaaacagatgtaacgtttccacataaaatacatgttacatctaaatcatatgtaaggctgcagatgtgctccaaaaagagaaaattggtctgtcataagaaactaaaaacaaacaaactgaacctaattacagcggcttcagatgtttcttgaggcccaggacctataccgtttccatctccagtcataccctcccaagcaaattagaagcatgcctgagtccctgacagctaagaaaatctagcaaagcaactgccaatgccaaggaaaattgtttccaggaaagtatgaaatatgaacatttacagcaattacatcaaagcatcgttcctctcacattcacatcatcacaaggaaagtatccatgtatgaattgtatattccagcaagggtgcagtacacgaacccaagtaccacatgcagctgcctctgcaaatgaaaacacagcaccttaatatcaaaagaaaaagagctgcaggtgataaacaaagcaggtcgtttaaggcgagaagcaagcacatacaagctcattggatgccgaagtcgctgagaaatgataccagcaaaagctcattgccatgacaattgtttgtatgaagatcgttcggcatcccaactgccctctggttccttcctctttattccaacacctggaggcatttgatacattctcgtatgctcgtccacaaaggcatgtggtggcgcaataaaattttgtctaactggtaaagttactctatcgtccttcacttctacatccacacttccagggccagaattaagatcaagaccctgtcttccccatttccgattattgtcatgtccaacagtgctgcttccttcagggaggtttattgcatattgtcgagtatgctgagcaggtaatgcacctgctgggccaacaagcgtcggagcaattgtagggaaataaggaattcctccaggtgcagaattcgcatatgatgtagacccaattgaaaaccccggtgcttgaaggtggacactaggagtaaaagggaatcctgcatactgataagcaggagggtgaaacatcatagtcggtgaagttgaaataactggagtccggctgggatcacttccatgttggacaccatctgccatcgatgtgatgatcctctgggttccacttccagctgctgtctcgactgggtgaggctgttctcctctagaaggtaaaaacgactttatagctacaggagcacaagcattggcagaagcaaaccatggtgatatgttactcatttcagcactgttcattctcatgctagcgacttgaggtaggaatggtatgctactggtatttttagatgacagactccttggtgcatgttccgtaccagcttcatcaagagttggtccattattaagatcaaaatcccttgagctatttgcatcggaactagagaaactccaggtaatggtcttgataataatgggacttcaaccctgtggttagtgttagacacaatttgcccattctctgcaacttcatcggccctattcaagtcaagctcaaataccaacactacgtacaggaccattgcttcttctagtgttgccagattcagaaccagttgtctgaacagaactctgagagacgtcttcctcaagaaattgctcatctgcaacatttaagtcaatgtcaagtgctgggcggtgtttatctgcagcatcagaaactggaatgccaggtgcgctgagagtcatctcaaaaattttccttggttctgcaggacgaaatgcacttgtggctgctgaacctttccagccagtctcaggctgaaatcttagtaggttctcaggaggaacaaagggacctttagctgtagcagctacttttatcggagcaggtagcccacttgacataggtgatataaatggagaaagacaaggtaaattaattgcaaagaacacacagcaggagaggtttctgcctcagactgatgcacgtcgtctccaggtattccttcattcaagtcaaaatcaagcttggctgtagcacttggcctgatcttggcagcaaaagaagaaccatcatctgatgagacaaggtcctcgttcccacttgcatcatcactcgacttctttgagctgcgccttgcactacgttcagtatcctgtgagacagtagttccaggtcttgcatgactacttgattcactggaattgtcttttaattctttagaactaatcccattttctggaccaaatggtacacctgctggtacagctagttttgtagcatcagctgaagtggaagaaggttgttccttcttttcatcctctctcagcactgcgttaccaaccagcaaaccatcagccttattcacctccacggtcgaagatgaaaatgaaggctccacatccaatttaacagcagcactgtcaccagatcggtcatggcttctgaattatctggtagacactggcgattcttctgatctgttgactttaacaaaccatgagattgtttatctccaccacgtaattcacttgtagtagatggatatatattcaattttgcgtcaatcttgatatcaactggctgttttgtgaccgacttgtcaccatcaccacctttatctgtagtcctcacttcatgattttcagtcttagcaggagattcaacagccttaacatctattccaggtggagagggtagcccagaagatgtgaccttattgtcctttgcatcccctaggtgttgttcctcctttgcgaccaaacctgcaccaattttctcacccttatcagagatgattttctcagcatcatttgttggccctgcatgccgtgacaagcccatatcactttgtacttttagcttcccaatgttatctccttcacagccctcttcatttcctggtgaatttctaggtgaagcagatgaagaaatcaactcagatttagatatttctccagcaacactggcaagaagattcattgctgtatcatctccagcttgcaaggaatgactagcttcagagtacttgatttcaatcaaagcattcatagggttgaacgaatttctccccccattttcacttgagcaagccgcctttcattagcatctgagcaaacaactcgggaagcacatgcatctttgc

SEQ ID NO: 90798 - DNA, 694 bp, Oryza sativa
tcaagcatcagcagcagtacacaggagagcgaggaggaggtatctataacaataggtagcctcctcgcccaagcaaagaacaacagtgggcatagtcttggaaggcgcctctctcaattgggttcaatcccggtaatatacagtcatccatatttttctttgttccccccttggcatttgttcccttgaactcatcttgagctgtaccatgattaaatataggaattctctctcaattgtacataaatattccaatacagtactcaatataataactaatacgataattattacagtttttaactgcagattgttaaataaaaaaataaagttcttaatttacaatagtgtgccttcggctatgttttatgacaagttactaatgccctcatgtatggcagcacactcctcgagttaatggaaaaatccctaatcttgataatgcaactttggatcatgaaagattgtcggaaaggtaaaaaaaaaacagacctctctctctctctctagaacagtatggccattgcgcttcttatatttctcatttgtcctgatccttcttgacaggttgggaaattatggtttggccgagtttcaaatagagggtgatggaaattgtcaggtttgttttaccattgaacctaaatcatcatttcatttatagatacggtgccgcatcatctacactatttca

SEQ ID NO: 90799 - DNA, 1920 bp, Oryza sativa
aattaacaatcgccgagaagcacggcgcacacgggacgacgcaaatcgctctcggcgtcatgtttcttcatggcgccatgatcgaggaaaccgcccaaacgaggaccgagaatgcaacgatcgcgaacggcgggggccagacaatactagtcatggccgtcgccgcaacgacgacgacgaaggagatcggcgccgagataacaacgagagacaacaacaagattctcgggatccaggtcatcatcctcgtaatcgtacgccggagccaagcgacccatcgtcatcgtcatcatccgcgtcctcttcatcgtcagacagacatccacgaaggtcacgcgaccgccgacaacccaccgccccagcgctgggtgtagggctttcggtcgttccctacgtgatgtccgatggcctgagagattccgacccggggccattgaaaagtatgatgggagcaccgaccccgaagaattccttcaagtctactcgatagtgctttatgctgccggagcagatgacaacgcattggcgaactatttaccaactgcgttgaagggttctgcacgttcatggctgatgcatcttcctccctactcaatctcttcgtgggcagacctgtggcaacagttcatcgccaatttccaaggaacatacaagcgccacgcgatcaacgacgacttacacacgctaacacagaactcgggggaatcattgaggaatacgtttggcgctttaacgagtgcagaaacacaattcccgaaattatcgacgcttctgtaattcgcgccttcaagtccggtggtagagatcgctacactacccaggagttggcgacaagacgcatcacaactactcgaagattattcgagattgttgagcggtgcgcccatgtggatgacgcgctaagacgcaagaacgacaagccgaagactgggggagagaagaaaccagccgcagacgcctctgagtcaaataagaagaaaaatcgcaaaaacgggaaaaggaaagctcaagcggaagtcctcgcagcagaatacgtgaaccctcccaagcgcccagacccacaaggcagcgatacaaagaaatcatgatgccccatacacaaaacggacagacattctctggaggattgccttgttttcaaaaagtcgctcgagaagcacatggcgttcaaaaaaggcaagcgagtacgtgttatcgagaagaacgaggagacatcttctcacgaatcggattctgcgtacccagactccgacctccacgtctcacacatcttcggcggctccacaacgtactcctccaagcgggaatacaagaaagcggaacgtgaagtctgttcgacatggcagggggctgcacccaagatgaagtggtctgagcagaggatagagttctcggatgaagaccaccccaagacctctgttatcccaggacgatatccgattgtggtcgaacccactattcggaacgtcacggtagcgcgagttctcatcgacggtggcagctcgatcaatctcctcttcgccagcactctagatgcaatggcaattccgcaaagtgcgttgacaccaaccgatcaacccttccatggaattactccccaatcatcgtccagacctctgggcaagattacgttgcccatgaccttcggccaagccaacaacttccgaacagagcagatcaccttcgatgtcgctgaattgatacagcttacaacgccatcatcggaagaactgcacttgcgaagttcatggccgcatcccactacgcatatcaagtgtcaagatgccgggaccgaagggaacaatcactatttaggggaacgcaaagctggcagggtgcagtgcgacaggcggagcctcgacatggtcgaacaaacgcccaccccacccgccacgtatgagccaccggagaaagtgagca

SEQ ID NO: 90800 - DNA, 2468 bp, Oryza sativa
acaagtgccaccagttgatttggagggttgctccttcaagttggttacagcatttcctggttgcatatgttgcaattttgaagaaccagatatcactggactcgatttcgcagcagcatcggcggctacaggtttagaagtcaaggccttcgatgaagaaagctgagacactgggcttttcagactagactcacttgagccacttcgtctgtttccagcactagaaatttctggaaacccaggtttgcctggccaggatacagcctgacctgataccactggtttcacatcatttgacttcatttcagcatcaacgcgcttcttccaattttcgacaagacactttgccttcttctgtatctccggatttttatggcttcgcagatgattaacagacttcccaatactgcaactttgtaaagcagtaagattaataggcaatttcgccagtgcacgaagcagggccaggacaagatcttccataggcttatcagtttctttaggactaccagcttcaccagacttccctttatgagcttcttgaagccaatcatcaaacacaggaaggcctcgcagttgcacaaacctaccaaggcagtcaggactttctgtagctgcaataatatcagctagaattacccggccaggcaaatctatctttcgctcagttcgatcaagttgcatgagatgtaccagcttctctacagcttcagcatgtggaagtccacctttttctgttatctttgtaatttcagactttagattctccaccttaaagttgcctgattcgccatcctcagcctttaggggacgctcacggtctcgcttagctggatcagttccttgctcacccctgtccctcttcttccctttggaaagaccgcagttttgggcaccatcagaaccagacttttgctgggcagacgacggtccattgagccgctttggtgagcgcccacctgactgaactgctgcatgcatttctagctttgttctgtgtagaagccgatttacttcttcctgccgctcctggtcatgagttgaacaccttagcacagaaaacgattctaataaaggaaggtaactgtagaacttacatttatataatcctggtcggtaagccaccataaacacttgttgtcaatatcatacacgcgccgacacacaaatgaagaaattccagctggaagctcaacgcctttacgcaaaaaagcaactttgcaaggatgcagcagtgagacagcggatgtctcgtcctggtggaaagaatagaagatctcgtttggtgcggcgcacagctgtgttcccttgttaagcttgatgtcagctggtctatacagccaacttacacgtaacttgggaaagccttcctcctttttctcaatccaacgtatcaacccaatgaaagggggaacttcaacagcctgaaaaagagcgcagtcgccaacacggaattcacgcccgtcctggatattcaataaaaaaattatcatgtgtacaagggacaaaacacaattcatgtatccaccaaaataacattgggcatatgaaaacactgaaaaatgcatgttggcatagaagaaatataagcatacttgtataaagaaagaagaaagaagaaaatggtatcatggtgttgttgaaacatacaatacacactaaaaatcaaattgcaacagaaatagcaatagttgccatgccattgaatttgttcgatctgaaagtaaagatcatgtaaagttgatggttacataattcaatgcgagctgtctacgccaatacttgcacccaggcttaattgtgatattccggttgtttttatcttatttctaactttgaaaagaataattattattattattattatcttgtttttatacaatacattaatgaaacaagtattagaagatgtagagatagatggtaataaaccgtaagttacatcatgggctgcacacggatccaaaaataatgccacatgcaccccttagccatatattctttggatatatcatgcccagtgattatccaagaaatgctactcctaaaaaatagacaaatgaattgttcgaatggcttttgagatgcacacaagcaagaacacgccttcacacaaatcttatgtaggggtgccaaaaattgtcaaattgaactgtccaaaagactcaatcaaataatacatggaaaaccatcttaaactactttgatgatagcacgacccacccaatacatccatcaaatgcatcccatatttactcggtgaaaatttgctgatatgccacaggttaccattcaacgatataagtaactacaaacataagtttatctaggcttaaaaacaaaggcgaatttggtcacagcaacatgctcaatttcatataaatctaattaacctttgtaaacatcaaagcgaatcccatcagaggaggcacctttaagaaggaatctgatgaagctggacggggaga

SEQ ID NO: 90801 - DNA, 1882 bp, Oryza sativa
tttcgcatttttgagatatctatgccctttcatcctgggaactgggaagattttgttttgcattttgttgcataaattaactgtagttgttgaatcggtcttcctgtcaggtaaatctggcagactcttctgctagtaaaggggcaaggatacaagaagttgaagctaagtttactcatctgcaggccacatgtaaccgaattacgcaggtatgctataaacaatttggtgttattttgctgcgtaagattgtagtataaggtgatgcaaagtctttcttgagttgtagactactacctaatctgttatccatggagttttactttaattgtacctattccatatgtttgcacagagcaaccgttggttcttatttagtactttcctgtttaggagaaagatctgcttgaaaagcataatctctggcttgacgaggaacttaaagaaaaagtgaagaacttagctgaactaaggaaatcaaacatggatgaggaggctaggatgtcagcaaaggttgccgaggtgagtcctattccaaccttgacatgtgacataatgcaagcagaaagcaaaacctgattatgttggtttcagcttgaaagagagacttctgaatcatccagttccttgaggcgaagcaaagaacgggtttctgaattggagcaaagggtatcatatatggaaaaggtaaattgtcagatttgttagcttttgtattattgccatcatctaatttttgctttgctttgcttttatgatctaaaggagttgtgctcaacaaaggatgctgcagctgctaatgaacaacgcctggctgcagagctttcaactgtatggtttacctttattcccattaacccccccttgtttatttcacccttactgctcccactccctgcttgtttaaattttagaaaggaaatggaagaaaatgtgtgctgagctatttgtactagaccagcagatcagtccatcgttattgtatatgcacacggcacaccacaacttaacccatctagtgtatctaggatatttctttttttttaatggaatgcactgatgttcctctctataagccaagtcgatgacgcttttaattattgccttttgttctgtttcccttaaaaggtcatgaaacttgctgaacttcacaaagaaagttctgaggaatggtcaaaaaaagcgggggaacttgaaggtgttattaaagcattggaggtaatgcctttacttgtatttaattttgccccgctcatgaacatgaaaatctaattattcttattatttttttcggtgtaaaccagacacatttgaccaggttgaagatgaatacaaggaaaagcttgagaaggagacttcagccaagagggaccttgaaatggtatattgacttattattttggatggttttcttattgaaaaatcagtttgatattgtgagtttcttagttgatcttttggctttcatgctattcaggaagctacctacttaaagcaaaagcttgaaaagtgtgaatctgatctggagaatacaaggaaatctagtgaattgagcttcactccattggttgcatcagacccttgtgatctagcaggctcaccgatgaaagaaatgtattatttctgaaactgtatacttttagtctagcgagatatctaaagcaggcgctattagcatagctaagtaacactttctagagagcattgttcaaggctttttgatattaattgtgttttgctcattaaagcttatcttattgaatgatgttaacttctgtttgtgctgtaccgttgtaaacatgatattatctttgtcccaacaccaatagttcccaaacattttgtagtcattccttattgtgttgataagtactgatcatat

SEQ ID NO: 90802 - DNA, 3390 bp, Oryza sativa
  unsure (1)..(3390): unsure at all n locations
atcaataaagcctatttctaggtttcataccacgaccaaagtgttttcactcgacgatcccttactctgataacacctaacgttgaaacatatccttatgaccctttacgccgtctcgacaaggcctccgaggaacctaagggatcttcggctggggatgcccagaaccgataaggccttgtcagatccttcagagacgaaagaccatgtaagatctggtcgtgtaagagttctcgccgtgcgtattaaccaagccgtgtaatcggaaaccgagctttccaacttcacggctgggggctaggatcagagcttattcaacctaggcagatcaagtgtccaagagccttatcatccaagaaaatttctccgacgacaaggctgggggctagggagagtgtacgactcaaacagccgaggtcgttaactaagaacacactctaacacataacatccagagtaagatgcatttgtttaaggaatatttctttattcacataataattcttacttgttttttacatagatctcccactacattacactttttcctaagacatctatagcaggccacgagtattaccaagagggccaatgccagtccatagactggaataccttctcggctaacggcgtcatcgacctcgcaaggtggtctatctccgccggagtcctccgagaacgagcaaacccttcatggaggaattcgagatccaggcgcgggcggtgatctcgcaggcaagctagcacatgtcctccggcatatcgactcgctcgacgacactcttgttaaggcctcatcgatacgcctgccgatgccatcgagttgggcacaggccccgttgagccacgagatgtacccggcgccgattcctcaggagtgttgcggactactcgaagctccccgcatacccgggccattgaggtacagcaactctttaaatatgacgcaaaccacacctcgcgtcctcggagcgtttccatggcttgctctttcttcacggctagcatggttctcgagagttccgccacttcaaattttgtcttctaatattggatacgacgatcttgggttgcaagggcatcctcgagatctgctaaacataacgaccactaagacaacctggaaaccactaacccaacacgggttaaaaaggctactcacttgaggtggttgtccccatctcgacctccacatcaagagtttggtcctcgacgtcatgtgagacgcgtggttcaaactcaagtaccgggattatcgctagtgactcgggctacccgcgctgctgaacatcctcgtcaccagcatctctacaatcgacaagaaaaacttccgaaatcaacactgaacaaggatggtatcatacgcccgaaagcaaccagagttcaagatttgcaaattataaaaaatacaagaagtcctactcttcaaaaaggggaggacagactcccccaggtcactgacttcttccatcacctccttacgcgtgtcgcttgccgccccctgatccaagatatcacgcagatcgagttcagggcgcgacaaccttacacacgcgaggatgtgacacgccccggtgtagataccgttggacgtctcctccgcgatcctggccgaatgcttggaggggatttcccctatcaccgtcgccagctccgcaagagaagaagtcaacaagaactcgtcggggttcaccgggatcgtggacttgacgccgcactcctcggcgagctggtgaaggccggtgtaggtgacccgcagcgaaccacggatctcagagagattgtctccaagttccgacatgcggtcctcgagccctttgcgttggcgctcgttcccggccaccagctccctcatcttcgtgaggtcctcacaggcctcagccagttcccgcaccaaccgctcggcacgcgcgtttgccaccgccgtctccaccctcgcctctgagatctcgcggccggtgccgcgagcaccagcttcgagaaggcgccccatttcgacttggagctcttcctaggtgaggacggcctctgccagactacgaccctcagcgggatcgctaacagggccgcttggcgtcgcctcccgactcccgaccacgggcacgacatctgtcgacaccgtggcaggggatgcgctggacgttcctctggatttggcccgcgcagccttcgcccgcgcctccctacaaataaccacgaatcaaaactccatttgaatagaagacacgagaatccaaaagtctgtttactaacttctcgccgatcgtcacaatgcgctaacgtcgcggaggtggaggagacgcgtcggaagcctgcaagacaaccaatgtggagtgagaataaaccttccttgctacacaacatagcgacgaggtgaaattaccgagggagtcgctgccttgcggcgatgtccgagcacatacgagaatttcctcgccttggtcggagctttgccatcactggtggtagcagcgtcagacgcctccttgacgaccttctccttcagagatgccgccacctgatgatccgcgagcggtccgacgacatcagtcaaaggaagggcctacgctaaatcatatcataagctgatttgagcagagaaggcgggacgctatcgaatgaactcacattgattgcttcgtcgcgctccgtcgcacttttcacaaaggggtgcggggatgtcgctcgccgtggtcgggccgctgatcatcacctgaccaacacactgctccacggcttcgctgctcagacctgtcaaaaaggaatcaatttttgataagttgaagagtaacgcgagtacaagcatgtctaaatgaatgcgagaaagataccccgaggagaaacncaggtcgcgtcgtctggcccggaatagtcataagccggatgggcccgagcctggagcggctggattcgcctaccgatgaagtctgcaacgacttcatatcccaataagccctgttctcggagatcatcgatgatgtcgataaacggttggagagagggggtcaaggagggtttggcggtccagaccggaatcttgtccggttgttcctcgggaacaacgaggaccggatttgaatccttgatttcaaggtaaaaccacctgttccgccatttgttgcgagaagagggacattggaaggggacataatgcgacttcatgccatcacgaagtcggaacccgacgcaaccggataccctattggattccatccagcgcaactcgtagtaaaagcggaacagatcaagaaagggctctaccccaatgtaggcctcgcaaagatgcacaaagacgctaaggaaagcaatggaattggggttcaaatgcagaagagaaagcccatagaaattcaaaaccagcagaaggaattcggagggtggagggagaaa

SEQ ID NO: 90803 - DNA, 2124 bp, Oryza sativa
cgtcggtgccggactccatcatgtacccgacgatccgcacggggacgaggaaggtggacctggagtccgacgatgtcctggggatacagagcctgtacgggaccaacccaaacttcaagggtgtcacgccgacgtcgccgtcgacgagcagccgggagatggacggcagcgcggccgccgccggcatccggccgtggagtgggttcgttggattagttgtgccggcagttgtcctgctcttagctccgtagactttctagtccatttttcgtgcctcggtgttgccacgtccatctctggttctatttcttgtacgatagattattgttgacttttggacagattcttgtgtacataacattactgaagaattatagatatcaatatcatacatatttttttgatagagaaattgggaagtacttctcttttcttttatttaaagttacttctcggctagttcgtcatgctctggaaaatgagcatcaaaacgtactgtatgtcctgtttagtgaggtaattaaactctaaattttcaagcaccatggaagattccattgacacgttagtcgtctgtccttagcaattagcattcattagtagtatattccggaagaaaattctatgcggcggtgccgcaccagacagcccgggcaacaccgtgtaccctagtgacgcgtgtccaatccctgttgcaacccgagccgatgtccaatctcccagagctctacagtatcgagtcatatctacctgctgcatgtaaaatctaattcatttttttaacagtgctctatttgatgcgagatacataatgccgttacttttagacacatatttaactactcgttttatttaactttttttcatgattattatttatttttagacacatatttaactactcgttttatttaacttttttcatgattattatttattttgtggtgagatgttgtaatcactaaaaatattttatgcatgatttacatcttatgtatgtccacaaaatttttaaataaaataaatgatcagacatgtgttcaaaagttaatgagatcattattaaaaaaacggagggagtaatatacagggggtttttctagggtaatatacattttactaaactttattaatatgcctcaactggtcagaaattattttttcatttgaatagggttgggaaattccattttgatgacgtagaaatcacggtttgaaaagggctttgagattacatttttgttgacatataaatcacggaaagtttataaggctgcgttcgatcaactccaaaagagagaatttttagcgcacgcaaaacgagaaaacgtattagctcattattaattataaatttaaaaaatgaatttatttgaattttttaaacaacttttatatataaattattttaaaaagacgtattatttaacaatttaaaaaacgtgctaacagaaaacgagcaagatgaagtttggagtagaagaaaataactaggcctaagtaataatcttgctttgatagtcatgttctggtaattgtatatgcaaacgctgctacaaagtacgcatggaaaaaacaatttcatttatcaatagttcaagaaattaaaaatcgatagttataaaaagcggactatacgacctagctagcctcaccatttctaattatttgatattaggacatttcctaatatttacgtcttattggtagttataaaaagtatacataatctatcgtaatactttctttagtttatgttttcttaatctatactacatattgtatcatgtcgtacttatgatgagtctcaatttagtatttatttccgctagttttgctaagaaaatggaagtcccttagtctaaaaaacagtacttttcttaatttggtaaatgtcacgccccgaactagccccgaatggaactagcccgtgacgctccaaattaacctgttaatcgataccagtcccaggaaacagtgctggtatcataggaagacaaaatatcacagcaacagaggtctctttattttagagtaggattacagtcatgttgggctgcggacagatctcgagctcacaactgcattacaaaagggaaagcggaagccaagacatggaccaat

SEQ ID NO: 90804 - DNA, 699 bp, Oryza sativa
gtattttgacgaaacaacggcagatgtgcaccttcaagatgaagctttactgacgatccaagtcgttgagggggtctaagatccagaatccataaacactctccagaacacatgcattgcaggtgaggagccggacgggacatttcgccgagcaccccgcgttcattgtactctgaggaaaagcggcaagcgctggatgatgggttttgtttcagaatgcatgatgaatccggatgaacctccacgatgccaagttccggactggtcacctgctgatgaactgcatgatgagttttgttcaactactcacctctcacgggattcacctgctgctcccccaccggcaaggaactccatagctgcagctcacccctgcgatgcagaggggattggtggagacaggcgatgcagaggacggcgcggtggctacctagcgacgggagcacctcgtgcggcggggatcggtggagcagaacggcggcgacgacctggcgacgggaggacctcgtgcagcggggaggcggaggatcgtggagggcgagccggcggcggggatcggtggcagacatgcgatgcagaggacggcgcggcggctgatacggagcggagcactgatggcggaggtgcaggagcggaattccggcggagggcggaggtgcaggtgtggtgggagagcgatagggagggggggggggcggt

SEQ ID NO: 90805 - DNA, 652 bp, Oryza sativa
gttatcctcatatgtccaaaaccttgctaacattatggatataccttttaacttgttgcacaggtaagtgttgatgttcctgatgtacgcggaaggacagagattcttaaggtgcacggtagcaacaagaagttcgatactgatgtctctcttgaagtcatagcaatgagaacacctggctttagtggagcagacttggcaaatcttctaaatgaagcagccatattagcgggccgacgtggtcggacagcaatttcctcaaaggagattgatgattcaattgacagaatagtggctggtatggaaggaactgtgatgacagatgggaagagcaaaagtcttgttgcttaccatgaagttgggcatgcaatttgtgggtaagagataatctgcatatttgctaactgtgcttttgtttattacttgcatatcaaaattccgtgcaactattcatatctggaaatgtattctttgtagaactttgacgcctggccacgaccctgtccaaaaggttactttgatcccgaggggtcaagctcgtggtctcacatggttcattccaatggacgacccaacgctcatctccaggcaacaactgttcgccagaattgttggtggccttggcggtcgtgctgctgaggagatcattttt

SEQ ID NO: 90806 - DNA, 1092 bp, Oryza sativa
gtaaactactataaggtaaaacaacttttaacattaaatacgttgcattccaccgatgctctgcatcggtggcaaacttacgagcttccacaccggccgcaatgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacacaaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttagcataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtcgcctcctgaaccggtacctcctcaacgacag

SEQ ID NO: 90807 - DNA, 1800 bp, Oryza sativa
tcagctctataccctgtgcacccacaccacgagcaatggccccacggatatctataccagccatctcagcagaaagtaaagcacgctccatttgcccatacctacatagcatgaaacaccactggctgagtactacagcaatagcaacaaaaaaaatctcaccaatgcagttaactgcatgcaacagaatttttcacaagttttttttttaccttgctttaaaagtctcatatggggaataaatagctttcaatgtattcagcagaactaaaagatctgactctgaaaataaatgttggatgttccgagcaaaagtgcccgtcatgttgtgcaggtcgatcagtgctccaagatgcttattctgcaatttggtactttttggcaagtcacctgataaaacatctagtatacctgggtacagaggacataaaatcaatttattgttacgaaagaagtacgcatatgtggcaaacaagtaatatccttttttaattgaacagagaaaaataaaacatgtaattcaatcatgaaattagtatagacatacaaaaatgaaataatacgagaagtttatgcattaccttttgcaacagatctagtttcaggaacagcatctccagttgctaggttgacacgagagacaaaacttgaattcaactcactcatggtttcaccaagtacttttgggactagtgatttgtattcttcagggaaagcagtcaggcaccttcagcattagcattgtagaacatccattaatttttggtggagcaaaaatattgtccgaatgcagctaaaagatgctgccaaaaactggcttctgtttacaagggcaaacattgctgattcagaacaaaagacaacagggtacaatgaacataccacttccattcttgttcaaggtaaagtagtgtctcatcatagaaatttggaagccagctagcaaatgagagactgtttatgctttctccaccatacttctccatctctacccgcttagctctctgttttagatcaaaatcttcccaaagtttctttagaggcttgacatggatcttagtatattgcacctccagtgacttgaatctgccaatacgtatcagtattccacgaagatcttgcacagcatcgaccttccaaccaaaatttgtaggctttagatgaaatagagatgcctgtactactgtttaacaaatataaatgagattagtaagaaaaaccttgcggttagaaagtgcatccaccaaacgaggttgaaccatgtcatctagccgttcttccaatacttcaagctgctttctcacattagcgaactccgcaacctgaaagcaacttttatataagcaaaacaaatagcttctgcatataaactcagtgtactgtgcatgtttgtgtgagagagtacaatacctcaccaactgccgacaagcaatgtctcatggttgccagggtttctgcagcttttggaagatcaccactagaaaatacatcctcaacactttggctcaactgagctagtccagccgcatcctggcattccgaccaacaagctgttaaatctattaaaagataacctaccactgtgagtgaagcatttacttcagtaacatgcaccatagtccacatacaacttacctgtaatgttgcatacgccgcttccattcgttgtttcacagtatcaattcgtgctagtgcagttattgactctgcagatgaaccctcagcctgattgaagaaatcatcatcatcagtaatacagaatttatgaaatgtagatgggactgaatacctagttagttg

SEQ ID NO: 90808 - DNA, 1993 bp, Oryza sativa
ataattagtgaaactctggcacaaagcactccaataacgcatcacagacaagcacaccagttgcatcccttaccccagttcagagagcttgaggtgggcctcggcgtaatccgcaaagaaggcgtcctcatcctacatatcaggcaacaatcatctactttttaagagatcaacgatgatccatttctcttatttcttttattttaaaaaaaacaactctttagaaagaagacgagagaaaataatgcaaggatcaaggggtgtaccgcagcatatttctccaccagtggacggaaggctgggtcagccatgagggctttgtcacttggcagctgaagaaggccttccttctcgccactcacaagctcgctgttgatcgagaggagattttggttttcattctttagcatacaaggaaacaagctgtggctggctgtttatcaacagacaggatgcatctttaaaaagaatcagagatcacgcacgtgaagtaagagttgtcaaagatcaaagggttggacgtccaggctccctcaaagccagatctctccttgtggcatcttccctacagaagatgaagtgaagctgcatgaataacccttccggttacaagatatgagaaacacactagggcaattgcacaagtgtaccaaccagggtgtgaccaccagaaagagcaactatgtccttgtcactcaaacccatctgcgcagaaaagacctgccttaggtggtcagaacctggaccaacagccagaagaccatgacatattagttatctcgcatccacaaattggcacactgttaattaaagaacacacaggtaacatgtatgctccatataagaaagaagaataaacaggaacacaaaacaaactttagtaatgtggtttgcataaacagggttggaaaattttagtcttatgtaggttacacaacttacttaagcatgaaagaattctggtaatggacttgcaatatgaactactccatcagtagcacatacaaatgctggtcatagatctagaaaatttaatcaccaacacattgggaaatgcattgtcataggggtaacttaatacagaggaaatcttaataccttgtgtggcatcaggaagacggccttcaggaggaggctcaggcttgtcctagaaacaaacacatcacatcatcaacattcacaagacagtggagaattcagggaaaggaaacagcggcgtacaagatgacgaaagaaaagaattgacttaagaaaaataccatttgcatctaccagaagaagaaagaagaaggggggagagagagggagagggtttagggatgggaaatgtgattctgacctgcctgcccggatggaaggggacctcaggtccgccggtgacctcgacggccacaacgccagcaagctgccaatagagagggagagactccaattaagaggttgatgagttgagaggaaggaagggaggaagggagggaagtgaaccttacctggtagaagtcggcgtaggagaggatgggaagttggtccttgatggggtcgagaagcctgacggcgatgtcgaggccggcgttggcggcgtgggactgctcgccggggttcttcatggtgccgaagggcccgccggtcctcgacgacacatcgaaggtgccagcagagtgccacctgcagccagccagccactgcaattcaacatctactcctcctactctatcttctggaaattaatcagtagaagaagaagaagaagaaagttacgcgaggcggagcatgagtggggcgcagttcttctcggcgatgaggccgcggagcttgcgcttcgccttgcccacggccgccaggtactcatcgctcaccgtcgggtacgacttgctgcccatgctcccctgcttcttcttcttcccaatccgaatcaatcaatcaatccccaactcaactcacctcacctcaccaaggagggatgagatcttcttactagtatataaaggcgagg

SEQ ID NO: 90809 - DNA, 1723 bp, Oryza sativa
agtttggttccttggtccttagttggaaaatcaaaatgtatttcagcagtgaataactccttatccagatatttagtcatttttagctcattcaaattgaccacatgctaccttgtaataagcaagccaatgaagtcaagccaggatgtgaataagaaagcaaatattgtaagttacagctatgtatacattgcaaatattgtaagtcaagccaaacactgctctaaagttgtaacttacaactatgcaagtttgtttgccagctgttgatcaatggaaacagttaaaatttgaagtgtagcctactatggagcagtgctgcggaagacggatgtcggacagagagggtacggccaaacgtttaatcgttatgtggataattaatcggaatttgatggaaatttaacgttttataaatatgagtacatagttgataatagtttgccattttttgagatgtaaatgcatattgaacatattcttactatgtttaaaatagaaccaccatgaagtggcattaattcaacatatattaaagttcataatgcatagctgtgcatcaaacagtgagctgtgggtgggtagttgtcatgggctggggcgtgtgatcttgcccgattatacggacgattagtcaaaaaatgatggattaatcagtaatgatggtgattacatgttcaggaacgactaatgaagaccgtttcgcggacgggagctcgctgactccattttaacagttgtatcaatcgttttccacgacactgctatggaggcttctttcagcatggatatgctctactcaacatcatatcaccatctcacatggactaggaaaacagcaaatatccagtgttccagtactaacttctgattaatcctcaacacaacattgacatgataaggaaggaccacagtggccaaataggacaaatattgaagcactctaccaattcaggaaaaaatgagcatgtcttgagaagaacaagggcttaccatcttttctcatctctggaagtaagcctgatgcatgcttctcaacaattttcaggtatccatccgcttcatgatcagaaacattaaacagcacaatggacccatattggaacaccaccatatagtggcaatgactttcatctatgatgccagccttaaaaccctgaagaaaacacgcaggcgagaagcattagtgcaatcatacttgcatcgttactacaagcaagcaagtactttctctagcatggtttaataaaacaaaaaaagaagcagtcaactcattaggcaaaagaaaaaccaagttgcaaggacacttgaacataaattccggccgcattcagcccaaaaaatccataaaagcaaaaggaacgcttgtgaagctatgttgtataccactaaagcatgagtatgttatcaggaagagcagagtggagactgtctccattgaactaagcacaaactaataatggcattacaactgaacattgcattaactgaaaatatgtcattacaactgaacattgcattaactgaacaattttctcaattatagcaattccagggatagcattccaccaagttgagcaccggacatggaattgtgcgaaaagaaagagtagatggtgcgattggctaacctctgggtctcccttgacatcgtagtacctgaggacgacgtagttggtagcacgcgaagtgggggggatgcattgaaggaattctgggactg

SEQ ID NO: 90810 - DNA, 5914 bp, Oryza sativa
caagagacttatgcatcattttattgagaaggaaagggtctggtataaatccaaaaaatgaaaaacaaaacaacaaagaaactagaaatgtcaaatgtggtgggtggtggtgaataatgctgcttgctagcgggagatgcctgcccattggctatctctcgcaaaatgatagtgtgaccaagaaaagataaagcactctatgccttgagctgtgggatcatcactccagtccagcagcacttgatcctttttttctcattgcaggcattatattcaatttgctaacgactttaactgagatcactgatttatggtccccattctttgactaaaactcatttctgcattgtgcacttgcttgctgtttcaagtattattcatatttcttgtggatcttccattcgattatactcttgtttattcggcttctttgttaaggacagggagccaagcacactagagtaatattctgaatgcagactggcttttgtgacctttgtcggccccggttttgggtgcttcttcttagttgcaatacctcggggaagttctttccccttggggccaaggtttttttttaatgcacaagatattttatctttgttggtctttgactgagtgttattaatttatttctgtgaagtcatccctgctgaaaatggccagcaagcatggacatatctagaagatatgcaaaacagcattgatcttgttttgacagaggttgttatgcctggtgtatctggaatttctctattgagtaggatcatgaaccacaatatttgcaagaatattccagtgattagtaagtagctttcctcaactctacagtacaattcttgtacaaaatgttgcccttgtcatttatttactttctatgcttttagctgctacactgttgtggtttatgtgcagtgatgtcttcaaatgatgctatgggtacagtttttaagtgtttgtcaaagggcgctgttgacttcttagtcaagcccatacgtaagaatgaacttaagaacctatggcagcatgtgtggagacggtgccacagcgtaagttgttgttggtccagtttttcttatatattagatgttcaggcaaatccatcaagtactgactgctgcttcaccattttatggttacaatatgtgatgactctaaactaaagttgttattttcaaattcagtccagtggcagtggaagtgaaagtggcattcagacacaaaagtgtgccaaatcaaaaagtggggatgaatccaataataacaatggcagcaatgacgatgatgacgacgatggtgtaatcatgggacttaatgcaagagatggcagtgataacggcagtggcactcaagtatgaaacttgatctttttattccaacatagctttactactacctgttaacaaagctgtaattagaatgagaagaaaaaactgaagttaaaaactgaataaacctgtcagtaacaatgatttctgaaggcataaatgacatttttttgcatagctgataaatttattttagaatagtgggaaataggaagagttcaccatgtcactgtaaagtttttgaattaaccaaaccagtaaaataccatggatcatctgcatataacaatcttaatattgtacaaacacaacagatgaaacacatactgaagaaaatatagttatcgcctctcggatagtttacatgtgtgttcatgtggcactatcgttttgcttaactaataccaaggtgccaaataaaccagcggttggttcattgcattttggagcacatatagtatttataaatcttgatagcgtgtgtgtagaatgttccaccagaagttgatagcactgtgctttttgcatgttcaaggaatcaaatggattgtacaatacatgcaaccaaactttgatgtagggaatttctttgttttggcttggatgtccaacttatagtttctcaccagttggattaacttcttttccttgttctcccattgtaaacgtgaattgaacaatccttgccttttaagataaatgtggggtctatgctttatgctgccctttaaatttttgaaatgctaataagtagtttgcatgcatcgtgcttctctaaatgtcatcaagttgactaatatacagttcactatcaatcagctaataccactttattttatgtgtttcctattataaattgaacattttgtttccttaccaactagaaatcatagtacagatacatattgtatagttattttcggtttattcatgaatttgtgttagaattagactatatagacattgctggttaaaaagtactcatcccctaacactgtgggaagagtacaaaactactagtgtgttaacaccattggcctcttgacattcaaaactgctacccaatgaacacattccccatcaatggtccaataatcccgaagtctaaagtccttaatcaactcgtgcataattattcacttggtaaggaaataggaaaaggatggatgcacacaaatgttttgtccatttttgctaagcctccagtatttttacttctgtgttttgagcttcataatggtttccatgtcttttcttcaattaacgcttttgtcctgtattttgatttctatttgcaccatttaatgaatcttccaaatttgggtttttcctcttgatgatttttaacttcacatctcaattgatctttaaaatatgcctaattatttaatactacctccgtcccaaaatatagcaacctaagactggataggacatatcctagtccaatgaatctggacaacccttgtccagattccttggactaggatatgttccatccaatcctaaattgctatattttgggatggagagagtatcatctaattaattacctgcaaatctgcaatgctctgcttaaacatattgtatattttctatactaatttactatacttattatcaaaatgaaacgtatattaaaaattaaatatctgctgcaatatgtgccctcaaaactagtataaacatattgtatattttcttttcaaagttacctttaatttggcgacatgtttggattgataaaatcaagtctaagcttgcaaatttggttctcctgatgctgtatgtttgattccactaaatagattctcttcaatgacctaggcaagctgtcgtagtttatcccaaatgtgttgaaaaggttgttctgggtatcaccgtacagatagattgatcctgaaattcgtatgcagagtaaacaaaatagtcttatcaacatagataatgctaaacatcatatcatcagcgcactagtgcaggactgccttgacatataatggttgcctgaaatggcaatgaaataaaaaatcttttatttaaaaagcaagattcaattgtgaattagcaatagttggagaaatttagagttacaggatatggcacacgaggtgtacttgagaactgtcggtttgtagctagagatggctacgaatgccgccggggggtacctagcttatcggcggtggatgaaaactagtgtaaacttgaaattagtccacgtttcatgtggatgaaatctagtgtaaacttgaaattagtccacgtttattatgaaacgttgactacagaccctaccgagataaactgtatcttatgtgttgctgtcaagttctcttttattacagtgttgtggagtggggtaaaatttttttcctgtcagttagttatgaatcacataagattttgccactgaaatgttcagtgacatggccgatatgtcaatgtaagaaacaacttagaataaattccacattacaatattcagaaataattactgtagatcggatcactttgtgaagtgcatttaaactggttgctcatcatttttttaaggcgcagagctcatggacaaagcgcgctgttgagattgacagtccacaggctatgtctccagatcaattagctgatccacctgatagcacttgtgcacaagtgatccacctgaagtcagatatatgcagcaatagatggttaccatgtacaagcaacaaaaattccaagaaacaaaaagaaactaatggtattgtatgctcaactgattcattgtgcaactcgataaaacaaaagctccataacactgtatattaataaatttcaacatgtttttttttcagatgacttcaaggggaaggacttggaaataggttctcctagaaatttaaacacagcttatcaatcctctccgaatgagagatccatcaaaccaacagatagacggaatgaatatccactgcaaaacaattcaaaggaggcagcgatggaaaatctggaggagtcaagtgttcgagctgctgacttaattggttcgatggccaaaaacatggatgcacaacaggcagcaagagccgcaaatgcccctaattgctcctccaaagtgccagaagggaaagataagaaccgtgataatattatgccatcacttgaattaagtttgaaaaggtcaagatcgactggggatggtgcaaacgcaatccaagaggaacaacggaatgttttgagacgatcagatctctcggcatttacgaggtgcaaaacataatatcagtgtcgctagtgagttaggaaaccattgttaagttgcatactaactgttacttttgttgcaaggtaccatacacctgtggcttccaatcaaggtgggacaggattcatgggaagctgttcgctgcatgataatagctcagaggctatgaaaacggattctgcttacaacatgaagtcaaactcagatgctgcaccaataaaacaaggttctaatggtagtagcaataacaatgacatgggttccactacaaagaacgttgtgacaaagcctagtacaaataaggagagagtaatgtcaccctcagctgttaaggctaatggacacacatcagcatttcatcctgcacagcactggacgtctccagctaatacaacaggaaaagaaaagactgatgaagtggctaacaatgcagcaaagagggctcagcctggtgaagtacagagcaacctcgtacaacaccctcgcccaatacttcattatgttcatttcgatgtgtcacgtgagaatggtggatccggggcccctcaatgtggttcatccaatgtatttgatcctcctgtcgaaggtcatgctgccaactatggtgtcaatggaagcaactcaggcagtaacaatggaagcaatgggcagaatgggagtacgactgctgtaaatgctgaacggccaaatatggagatcgctaatggcaccatcaacaaaagtggacctggaggtggcaatggaagtggaagcggcagtggcaatgacatgtatctgaaacgcttcactcaacgagagcatagagtggctgcagtgatcaagtttagacagaaaaggaaagagcgcaacttcggaaaaaaggtagcctgttttcaattgcatgttttctgttcctttggttttagcattcctgtttaactcgtctaaattagctaaagaacatgttactggaagtagttgtcaaaagcatattactggaagtttctcccaaacgactagctaaatgggatcgggcatgaatataatttgtttatatactagtattatctgatttctaaaaggaatctcacaagataatcttccaaaaagttgcacgtttttggtcccatagccgtgttgctgaaatttcttgccaatgacatttcttggatttttctcataatttaatggtagctacttagagcggcaattcaattttactcttgaaacactgtcctttacttttcggcgcgggtgagtacaatttggataggaggctctttttatatatagagaaacatacatacatacatacatatatatatatatatatatatatatatatatgatgtgcttgatt

SEQ ID NO: 90811 - DNA, 2060 bp, Oryza sativa
ttgaaggagaaggagaagaagctgctacgcaaagagaaaacccgtctgcgcaatcttgttgcaccggtagttgcagagagccacttttctctgtcagaagatgatgtcgaaacagcatgctcgtcacttgatatggaacgactgaagagctctgtgatagcatggagaacaaagatacaacagaaaaggccagattactcagtggtgctctgagcaaagaaggctcgtctggtacttcaaatgaaggaaagaaaattcaagcaaacggcgtggatggttccaaagcaaaatccacctcttcaggtgagaaggtcacgcaaggcaatacactaagcaactatgagaagaaagaagagaaaccatggggaagggaagagatcgagttgcttaggaaagcaatacaaaagtatccaaagggaacctcccggaggtgggaggttgtctctgagtttattggaactggaagatctgttgaagaaattctgaaggctacaaagactgttcttttgcagaaaccggactctaccaaagcttttgactctttccttgagaaacgcaagccagcaccgtccattgcatcacctctttctgtaagaactgaaacagttggtttgcctactgagaaagcagctggaaatgcatcatccaaagcgcctgcacaacatgcaagcagtaaaacatccgacgagaaagctgctgctcctgctcctgctcctgtatcaaatggaacaccttctggaacagcagatccagaggcttggtcagaggcgcaagtgctggctcttgtacaagctttgaaggcatttcctaaggatgcaagccaaagatgggagcgtgtggctgccgctgtcccaggtaaaaccatggtgcagtgcaagaaaaaggttgcagagatgcaaaagaatttccggagcaagaaaagcgctgagtagaacaacatagtaccggcacaagtactttttgtggctagtggctgacaaaagcttctgtttgaacatcagtatcccttatatgttagagaatcatagctgcgtactcctgatgaattttgccagcatatcacggcctccagtggtagcaataattttggtttggagctctgtgagaactcgcattgggccttaaccggtgtcggcattctgcttacacaagttttttggtctaccaagaaagaagctgatctgctgttgttgatagctaatgttttggccttccccaacattaggtggactttctgctgacccttgggttgtttatgttcgagagccccttgaagagtattatttccttgcattggtggagtgatatgatctggtctggcacgacacagggagtgtagagaacagcatcggcatttatttatcaacttataagatagaaatatttgttacaacttgagaacttgctatatcaagaaaccatatttttgcctaatcagattcattattcatgtctccttgttaagttataacttgtaatgccagtggtaaatgcccttttgtgttgctcttgcgagaaaatgatagtagttcgtttcctgaaacagcactccacttgtttgatataatccctccgttttttaatatatgacgccgttgacttttgttacaacctttgactgttcctcttattcaaaaattttgtacaaattttaaaaatattagtcatgcttaaagttcatttagtgataaattaaaccatgacaaaagaaaatatatttatttaaatattttgaataagacgaatggtcaaacatgtgagaaaaaaatcaatgatgtcatctatttaaaaaacggaggtagtatatctaacttgccctctccttctggtaaactttttttgttattattcttatcactcggccccgttcggttgtaacgtgataaagaagctggaaactctctccttttttttaaaacttttttgttactattcttatcactcggccccgttcggttgtaatgtgatgaagattacgtgttagacacataaaaggagaaaacgagaaaactattagcggatgatatcattaattgatttttaattattttatattaaaa

SEQ ID NO: 90812 - DNA, 2111 bp, Oryza sativa
  unsure (1)..(2111): unsure at all n locations
aatcatttacaaacatatttgaacattgcaaactaacatataagaacaaacatgagaaacaaaagataatcaatcagtagggaataggccctcgcagtttgttagcgatatgtaagaggtggtcaatgtttgtgggtggatagctctggagaagctttaggtttgctgtgaaatccccggccaagagccgccttcgaacaagaattagcatagcacaacagattcgaagtaaggtggcctgcaataagataataagagttttatagtgcatttcaaaaaattctcagatggcatggaactaggaatggcagtttctaacctgaggtccctcaggatcacctaacagtgcatcccatatatggatgcagtcgcgaaacttgaattcctgcgtcaatagcaaggtgatccatctgaatgcgtaaaactgtggattaacctggaatatacaaagcattagagtaggagcagaaatacactgtaaaaatgtaacaagaaaaaagttattgaaatgcataccttggtcacaacctctaaatgccgccagagctcttcatcgtgccttttcaggagctgggataacttgctgattgtggagcgtatgcccaccacactgttgtcaagctgtttgcaaaagttatcccgaaatccactaagcagctcaacgaaacagaaaaatgcatccggctctgctgactcctgtttacataagaaattaaaaggtgtatgggcacagagttagccgatgcttgtattctatagataacatcattgtttctctccggtcatcacccatctagcagccatacttgcataataaaaaataaggtacatggtaaagctatctaacaatagtagtgaaatgtttctactttggtaacttcagaagaaaaaagaatgaataatagtcacttaggcagtataccaaagtcagataaagtacatgatacatggttccaacaggcagggaaccacttaccagtgaatgaattcaggaaatctgtatagaagaaatctaccacatatatttaagccttaaagccaaggaacttacatacgaaccaacgttcaacaattttaagcaaatagcgtcatgggaaaaaaaaacacttacagcattattttcttctggatcattcttgaaaacatagtagagtggtgccaaaacttcattcattccttgtacatatcttatacccggatttaattttgcaaatatggtaagtatacgctttagcgactcctgaagacaaacatatatcacatttagcctaactggacattacaaaagacaaaaagaactggcatcatatcagataataaatgcttacttgattagacaaggcatcagaagaatccccattgaaaaattgcatctcaggatgagtacgcttaacatctctatcaatctgctctatagtttcagattcctgaagtatcaaataacagtgtatatttttagtagctcaaacactatactgtacaatatattcattacaaaaattcaacgaagagctgcaaagggaccaagggagatctctcaatatcaaggagttgaaagttctaccatcaaattgaaccaaagcaaaatacagacttaacatgtggcagtacataaatttacgatttagtgaacattacctggaaaaattggttccagacactagttttcccgaggcttagaggatgttcatcatggacaatttctgcccttggaagcactccagttccttcagaattatgtctgttccctttggatatagtcatttcctccattcttcgagtaacttctgactgaccataaccaaaacatattattatgtatctttcttaaaaggagaaaactaccaaatgaaattgttaagatgtaaaacaagttggtaccacaataaaatactttagcatatccnnnnnnnnnnnnnnnnnnnnnnnaattactagttttaaatcagggcacatagtttctgacttgtatgtccatctctcataatgctaacaattgctatcaatacagacaatgtaaccacataccagccaatggttcagaactgaaatcatatatggataaagaacttacaggattaactagaagctcgtctttgaaagccactgta

SEQ ID NO: 90813 - DNA, 728 bp, Oryza sativa
agctccagtgggcattcaaccaggtggagtggccgacgaggaggagactgtcgcagccattgtggatgaaatggagagggaggattctgacacgagcgtgtagaggaaggtgattcgtcagatgaggagacggatattaatccagcagaataggctagtcaggatttttctgggctgatcgtctctgaagaggatagtgtgagatgggagtacaaagaaaatgaggttattcagggagcgatttatagtagaacagaagatatgaaggaggcggtaaaacattttgcagtgtcacttcatagagagttttgggttgccaagtccaaccggtcgcaatatgaagttcggtgtgttaaggaaaaagatggttgtccctggagagtgcacgcgtataaggggaaatggaaggattattggacaatgtcagtcattaccaagcatacatgttttctacctgttgttcagaaataccacaggaacattacatgtgcatttgtcgcatctgagatgtatgcgcatgtcatcgataatctcacatacgaaccaaggtcaataatccgacacatcgaggagacatacaagtatactattagctatgccaaggcctggagggccaaacagaaaataatagagatgagatttggaacatacgaagcctcgtatgacaatttgccacgtctgcttggtgttatcgaggaaagaaaccctgggagctcttacgaagtgaa

SEQ ID NO: 90814 - DNA, 4446 bp, Oryza sativa
caatgagctttggaagagattagatgagttgacagccaaatgcagtgatcagcgtgcagcggctccatcgactgccgttgatgacccttctcaagctcttggacctctcccaacggatagtccaactttggttgaagaactggattggagattcgaaaattttctcagtggattctgcatgaaccaaaagagaaatgggccaaggtgtatgacaccggtggtgctagatatggaataatgacaacaaatttggcagaagtttacaactgggtgatgcgcggtgtccgtggactgccactagttggcatagtggagttcattttacatgggacatgcaggtattttagggatcggttccaggcagttcttccctctatgccgaacaacagcattttgtttggaactttcatgcagaaaaagctagaggagttgcgtaaaaaggccatgaaacatcgagctctagtgcaaggtacccaacaacataggttcgagatactatgtcaagataaggcaggcaggggtatctaccgcaagagagtgaagcaggagtgtgttctcaaagccgacagcatatatcattgctcttgttcaaagccgaagctgctccacaggccatgcacccatgtcattgctgccgcagcggagtgtggcataccagatgcagtatatgtgtcgcagtactttagtaagcaagcaatatatcatacatggagcggcgagatttacgggttcggcatagctggggagtttatagagactaacgatgaagtactcaatattcctgacccatcaaagctccgaggcaaggctggaaggaggaggactcgtcgcatccgcaacaatatggacgagtcggaggctggcagggtgaagcgttgcagcaaatgcgatgaacgtgggcacacctacaagcattgtcctaaagacaaggagaaaccaagtgcggcggaggcaggactatcaggatcagcagcagatggagctcgccctatgggtgaaggcactacctccactcgaccacgtcctaggcgtcgtcgtgccacgtctggctacgtggtgtagttgcacgtcatcgttatgtaccattagtaacgtttgctttatttaaataggctgtactcttgttgtacgtaattattctcatgatttttttactatttcattaatttgcgagtcatcttttgttttacattactactttttgaattgttctaacacgaaacactatatttttcagagatggcacgtcaggatacacctcaactgttggatccggcgatagatctccgacaccggtctcaccttactgcggtgcagggggctcagcttgggacgttccgggcacagacatgaggtgagctactcacggttcacgactccttcgtcgagaggtacgaacagtatattactataaattagttgcgctgtaatcttttttgtaatgacatattaatttcttattgcaggctgcgtgaggccggcctcctaccgatgtgtcggctggtggaggctgccgccggccacgtggacccggccagacgatggactatggacaggtccctcctagcagctttggttgaccgatggaggcctgagacacacacttttcacttgccgtgcggtgaggtagcccctaccctacaggacgtatcgtacttgttggggctaccgctcgcgggagacgctgttgggccagtgaccacggctgcggactggcaggacgatctgatggcacgtttcgcactagtacagcgcgcaccgcacctcccgctccagccgttggcacaccaccgcaacaccggacctacgaagaggtggctgcttcagttcaccgtgagtgtttttgtaccgaaatgacaagcgtactacatatttattccacatgttaaggttcctaacattttaactaacgcttgcaggtcgatcagctacaggcggaggccgacgagtactcctacagccgctgtttggaggcgtacttgctctggctttttggctaggtgatgttctgtggcggtcaggggcacgcggtcgacaagggactcgtgcactacgccaggagcatcgccgacgccgcggtaggcgaggtgcctcagtggagctggggttccgcgttgttggcggctctgtaccgtggactttgtgaggcttgcacgaagacggatcccagcgcgacctttggtgggtgccctctctttctttctatctgggcagctgagaggattgcgatcggccgcccggaggtggaccagcacgcgtacgaggagtcactgtacgaggagcgaccagaggtcgactaccctacgatgggtactctgtggtgccgtcgtcaggtacgttgcatcgatcttctagctttgttaagtacgcaggccgcctacttctcccacgctgcagggtcagcgtctcagccagctgcgtcgacctcgcactcagcgcaattccagcagtacaccggggcttcctcacaggcagccggcacgtcgagtcagggtccaccactggaccatgctgggacctcgtcggaccgcttgctgtcttccaccgtgctcttcgacatcactgacttcgacttcgcttcaggctcggcagaggacgtcatcggcccctcacagctgggaggcgcaccgccggtgcagacgcaggaccaggcgcaggccactcctccgccagacactcgtgctacccgtgctgtgccaccggatcgtttcacctactcccaggaccacgtgcgagcacaggccggaggaccaagcgtggtcgcggcgcggggcagggccagtagagcagtcttctctttgtttatttgcttcactttccagtactgtatgcttgtgtaatgactacgttgttgttatatgtgcacgatatctttcggcgcatgcacgatacctttcggcgcatgcacgactactttctcccacaccgatgcagcctcctttattcgcgtgcgatacgagtatttgcccgccatttgccgcatacgaccaacgtaactttcggcgctgatcaagcatgcaactttcggcgccaatcaggcgtacccaccatgccccaccacgttcacatgtcaaggatatcactcaagtttttgcgcatatataagtcgccttaacgagtgaggcctcacaatctttcagaactcagtcacattcagtactctcttccccacttcttcattacaaatcctaccggctttcgtcaatggctagacgccggggtgttgaggatccaaactggcgcagcgatccttgtgtatacctactaccaccttggtgccagcgtcctctctgcctatgcggtgatcgatgccaactaatggcttcgaggaatcctgatatttgaggaaggcgcttttttaggtgccctaactgtgaccgtgaggtattttattatctgcaaatgcttattcattccgtatgggcaatcgctttattcttcgtaacactactctatttggcagacccgcactacggtttgcgcatacatcgagtgggtcgatacagaaaatcccgttctcgacctaaccacttgtttacaagaaggtcgctggtatttcgcatccgaaagtactgagcaatacttaaagagaaaagcggcttatgaacgacaatgtcgtgaacaacagagcgactggagggtgctaactacggcactccctccatgggaagcccgtccaagatgcaggtgtggtgatcgttgtcaggttcttcgttccataaatcctacaacattgggtcgaaggttctttatttgtccaaatattcttgacgacgatttcatggtaagaatattttgattacatgaatccttattttctcacaacatttactaactttgctcgctttacatctattctttcctcccaggaaccaccaaggagatgtcaatacagagaatgaatagacaccagaagggttctaactccacctagccgtgttgtgcagcttgaactaccagagcaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatgtaaccgcaatcgaaattgttgtatcatgttcaaattgtactactatttcttcatgttatataattctccttgtttaagtccatataatgtttctacgaccgagactgcgataggcctatattaattatccgagtactaatacgtcgaataaggtacaaaataatacctcacttaacatatgaaattgcgcaacaaccaacttcaatacatttttataacaatattaacaagttttaccaaaaaatacttctttattttttattaacattacatagaaaaatattttggccgtacttttt

SEQ ID NO: 90815 - DNA, 1306 bp, Oryza sativa
ttctgacttgtatgtccatctctcataatgctaacaattgctatcaatacagacaatgtaaccacataccagccaatggttcagaactgaaatcatcatatggataaagaacttacaggattaactagaagctcgtctttgaaagcactgtattgggaccgctttttctccagttcatatgcccacagcgcatgatcagtcggcaagtatcccaatagaagctgctaactatcaaacaagtcaaataaatttgtagtgtagcaaacaaggagaaagattaaagatttgtacattgtaagccagtctaaatttagtcacattcatagctatttaacctaaaattcttgcagtgaattccataatatcatttagcttaatcctactacaacagttctcttcatatataaaattatgtcagttgaaattaagttgtgcaatgacatgtaacacaaaaaatactgaaaggctttcagtgtaataatgctctgctcaaatcactaaatgcttgtatacatatttacaaactacaaatcatattctatttgtcaattacgaatcctgatttctcctaaatttattcaactaacaaaaataatgccatgagcagttgtttgtaatcctaatgcacaattatagagcgtatgaaattctaccactggcttcaaagcagtttgctgaaactagtaagaacttatctttatgaatcatggcctcatggcaatcgtatagtttggtccttaaaaactgaatgtatgggaataaaacatcttaagaacctagagaaatccaaacatttcaatgaaacaaaaacttgattagagacccattcacttcagaatagatataactgaaaccgcattccccgaacacactccatgatatctcaaaagaccaaggtaaaaaaaaatgctcctaatccttgcgtgcagcataaaccatgtatcaagtatcaacaccaaaccatatgattgatccgaatcaaatcacgccaaacccccatccatcctaaattccatcatttatgggttgtctacggctttccaaaaaacaaatgaatccaatgcaaggacagcatccatgagctgtgacgaagcgaaatcctagtattcgtaatacccattttactctagcatggtgacacacagtgaagtatgtgaagtaataagagtagtaaaataagagaaggcaagacgattccaccataccttccagacgacggggcgcacgccggcggcgtcgggcacgcctggcacgcgagcctccgcagctcagccagatccaccaccttcctgcccagctgcaattg

SEQ ID NO: 90816 - DNA, 610 bp, Oryza sativa
tttctgttgtcattgctcacaattaccatagtacaagcaaaaaaaggaatggagaagtgattagagtaacattcaaatgcaatcgacatggaaaagcaaagtcagaatcacaagaagaagaaacagaagagacagtagtagcagagagaaacagtaatgagattaaagccacaagttgtaactgtgcctggtaatttctgagagaaatttgatttggagaattacaagggttaatttagatcacaattataagatgagtccaagagatgaagttagattcttgaagtcacacaaaaatatgacaacagaagagaaaatgctgataaggacactaaaggaatgcaatattcccacaaggcatatgattgtgattttgtcaactttgagaggagggctgacatctttgccttatactaagaaggatgttagtaatgtgagaacttgtataaataaagagacaagtagcaatgatatgatgcaagttcttcaatttttcagaaagaagaaggagaaagatccaaagttcttttatgaatttgatttggatgagaataagaaggtgaccaatttgttttggactgatggaaagccaattgattggtacgagaag

SEQ ID NO: 90817 - DNA, 1304 bp, Oryza sativa
aactgagaagctgcttaccccaatatgaggcggcaatatactatcaggtggttcttgatgaagcatgaatcataaccaaattgccactgcagcataatgatacaaccctgttaatattttaccactttacaaatgaatgctagctcacagcgtcttatcatgccgtacgaatttcccagaaaatgttgctgttaacaaaggttgagacagaagtagttacccagaaccagaagaaagaagccaattcaaatgagttctgcagcaattagcaaaccaaagagtgtataagttcaggcttgcccttaatccttttcaaaagttaactagcaatgcaaatgtacctgaaagagaatgaaatggatcagccacaggagaaattctggtttcttgaaccaaaagagatcatcccgtggctttatccttggtccgtatgcattcatctttgcaccctctgctgttaaagttgctatgacgtatgcagctttgcgccaactagaagaacaagctgcaggacattcagattatggtcaataccacatcatacatgttacggattgtgcacgaagcaagctgcaacttacagtaacaggaagaatggctatccaaaagtacaagttcgatcctacaagaaaataaccatgtataatgctggataatgagacagaaatatgatagtagtgacgatattaaaagagtggttggaactttaccgttgatattgaataacatgaaagcaacaacaaaaccccacagcagcccactgcataaaaggattaaatgagtaagttttctgattatatatctccaatgagaaaaataaaatggaagtaacatccataaataagcagcgcatagacaaaattataagggtgtactattaaaccaacctcactccaacaatcttctcaaactcctcttccattgagcgtaccatgtaatcatggaaatcatatgttggtgcaagattgtgggtctgcaatcattcttaagtcaaacaagagagtacaactaacaaatttcagcacacgccaaaccagcatatggcgacagaattttgagaacaagaatattcaagaacaatgaaaacaatatatatctactctgttcaaaacagaaaaaaaatatgtatatccactcaacatggccatagaaaaacaactgcttaccattatgaaacccttgcggaggataaggtaatctgctcgaacaacagattgaccaaattgtgcgagaaagcaaaactgtatggtaacacaataaaaaaaatgttagctgtgaacacagcaaagccttatgcctcacat

SEQ ID NO: 90818 - DNA, 2003 bp, Oryza sativa
cacatcatgttctagatttgtttttttatgagacgaatgtgttatttctgttgctgatgaacctgccaatgtcccatgataatgtcctatcttgatccataaatcctctggaatctgaatgctcaaaaataggattggcatttgggtactgagtacggtatgactgaatttattgccaccggctgcattcaccagccggtttggcccataaaatccagcacggtggagtgggttctctattaagaaatctgtactacgaagcctgtatacaagagtggctttaccaaacggcaatgtagtacaactgttcatcaaccagtttttcagcagctaactggtcctcgtaagcaatttatctggtaagcgtatcgaccaatgtttgttagtagtgtcaggttcagcactacacctcctacatcatggtctttccccaacagtgatgagcctgtaacaagctgactcatggttgctggaatgctggtaattgcaaaagagaagaaactgtcatggtaatgagcatatatgtacttggaatttcacactaggagttcaatgtggaacacaaggtttttcctcactaatttttttacactgcaaattacaaatctgtacaagcatttacaacatctgaccacagcattggatctagtcagaattcacaagttctcttgacaaagttcaatctgctcctggggttagccacatcctacgacaaggaacatcctctgcatgaatgaataagacatgcgtcactctccgaaaacaattatgagtaggtcattatgagtagctctggttattttacatgagaatcataggcatagaagatgttgtccggagcaacaagaggcagcttctcaatgtacataaacaggcgcctaaggttctctctagtaatcgttgccatgtcaatgacatctcggtcatctgtgagcatccacagatcaccagaatttactcttttgaggctgtcacggcagaaggggcaggactgggatcttgagcgcctgcaacaaggatagcacatggttcaaagaatgcagcaatatcttaagagagttcgtaaccagtgaccacatagttattcatatagcagagaagctatttttaagttcatgtactgaagatataaattgatatgtatgtcctttgaattccttatgttcatgtaactggtaaggtattttatacataaacattagtactgtcatttacgtgcggtactacatgctttggtggcagagtttttgcagagctatgtattgacataagtttgggaaattatgaaactgaactgatgttcttaaggctgtttttccctttgcaagggatcatttgcttagtggggttatgccatagaagggatttcacaggagctaaattatagtgtcaaagaaaaagtgatctctgaaagaccagtaagagttaagcacaaagctgacaaccttgctgcaatgactgaaaaatatgcaatgtcttgctgtaataatcaggtacagatctattaatgaggttgcagcatagcaccatcttatttattgtgcagagccattcatacagagtaaaacagcgtgctgctattaacctctcagaaccaaaatggtccactatatctggacagagttttactcgtgttttgactaaactaactttgaattgaagaactaaacacatctcagactgttaccaaggaccaatacggcatcgattaaccattagtgatgaacatgacaaacaatttttgggatggaaggatttgattctcaccattgacggtaacacttcatgcacatagcatggctgcagttgggcaagacaaccttgttattcatctccatgcaaatcccgcactcttcctctctctcgacatcaatctcagaaacatgcctcttgctctcatcctcatctcttcttctgtatctctcagtacagattgccttctgcctccggtcatcgacatcgctgataccctttgagtgcatgagtgagggaaatataacagc

SEQ ID NO: 90819 - DNA, 849 bp, Oryza sativa
atttgttaacaatttaaataatgatcaaagttgtttttttagagaccatgtccttgtccaaaacgacaaggtattatcaatccggagggagtatgagttacaaatcgcttaggagcgtattattagagacgtaacggaacaactttcagcaagcaaaaagaaagcagacaaacgataggaggtagactgcaatagagaaagaaagaaagcagtagagcagacttcatcaaggaggctgaaaaacaaactcattttcttgaatgtcttccccgatctgctgggccgcttgttgtgcatatggctcttgttgcttgaagaccttagcatttatttgtagccaaacgtgtcaccaggttttgatcagaattcccactcttcgttttgattcagccttattggttccatgagctaaagccatcatccattcagcggtggagtttgaatttatcgcagtttgcatgccctgagctaccgccactaggctccaagtggttctaatgaaatcacactccctaaaaagatggtcagtgtcttcacaggcgcttctacaaaggggatatatccaatcacattcccaatggtggattagcagattttcagctgttagagctcttttgtgcaggatgagccagccgaagaacctttgcttgggtaatgcctgggctctccagttggctttgaaggtctgatcatgttgacaggtaatgaattggaattgatatgcactttgggctgaatatatacctttgctatttctcttctagattatgtagtcttcattttctgacgttagttgtgtttgagtaagaaggctgccgagatgcacaagctcttggattacttcaccat

SEQ ID NO: 90820 - DNA, 730 bp, Oryza sativa
tcctgcagccccgaattgtggtcaatctagcaacaggtgagtaattgtcaaagaaatcttcgccttctttctgagtatagcccttagcaacaagccgagcattgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttctagtagtctgcatcaggagatgcatatgcttctgaaattgacttaggagtgtcatccacgaggtacacagtgaaatcatcactaatggacttagccgtcctttatctcttactccttcaaggagcttcaccgacatcctcctcaggtgtatgttcagtttgttctggtggtgtgattgaactgggaattatttcagagggttggctcgaaccactatgtgtatccttcattgggaaaaaggctctcaaagaaggtagcatcacgagactccataattgtaccaacatgcatgtcaggtacctcgcatttaactattaaaaatctataggcaatgctatgatgagcatatcccagaaagacacagtccacagtcttaggtccaagtttgcgcttcttcgttattggtacattgactttcgccaagcaccccccatgtgcgcaaataagaaagtgatggttttctcccaatccatatctcatat

SEQ ID NO: 90821 - DNA, 734 bp, Oryza sativa
gatatgacttaattagaggaaaaaaagagagagataatttggaccatagattaatcatttaagaactaagtgagaatgaactatataagtatataggatatcataaaacataataaagatatacattgaaacattatgtaattatgttggatgataatttaacatgtttgtatttgaaaagctcttaaattataaaaactgtaaagatatatcatgtttgtatgatgtttaaatgtgatgattgttagtggatgatgatgtaacatcttgttaattagtgaatgatgatgtggcatcttgttagtggatgatgatgtggcatctttgcatgttaagcttaagaagttagtgggggataactttatagtaagataggataaactcttgtgcttatgcttatttgtaacatcccggtctagggcttaataggattaatagaatactcatatcaacaagttgcaacttcttttacagaagccaatctccaaagaactccagggttaagcgtgcttggcctggagcaatttgggatgggtgaccgaccgggaaattcttcccgggtgcacatgagtgaggataaagtgtgcagaaaagatatgtgttggtctgtgaggacagtctatgacctatgaaagctatcagatgtaagcgggccccggcctgggggaggcgggacgttacaaaatggtatcagagccaactctcgcggtttcacgggtgcgacaggcctgggg

SEQ ID NO: 90822 - DNA, 4506 bp, Oryza sativa
  unsure (1)..(4506): unsure at all n locations
agtggtgacgagcggggcggcagacgagaaaggagcagcgcacgtgcgcgggcgccggccgatgggaggagaggagcggtgcgcgtacacgggcggcggccggagaggataggagcggcgcgggcgtgcggggggaggtgtcgctgaccacgctcggggaggggtcgctgactgcggccacgtgtgcgggggaaggcgtcggccatggagcgcgcgagttcggcggcggagatgaagccgttgccgccgccggcctacccacccccttgccagcctcgccggccggccgccccgctccgacacgccagtcgcccgcttcggtcgccggccgcccgtcccactcaaccggccgaagagagaggatagagaggaggggagagtagtgaggccctgataggctgtcaatgtcatcgtccacgtggcatgctatgtaggtaagaccacagtcaaatgaggctttggaccgggatgatacattaaaccaagtttagagatctcgatgctcgttttgcaagtttgtggatttaagtaaaaccttgttacaagtttaagtactactagtgtaatttactcttgatttttcaaggtaaaattctctcctcgttgatcaatcaatccatccatcttcaggagtagattcagatcagattttgagtgagaacccagatcccagattatactacttagtatcattttatttgattgtatgatatgttattgttttaagccaatttcattgacacaagaactaaaacggctggcaatactggggcaaagcaaacctagcaagacagcaataacactggtatgccgtttgcccacccgactagccgaaccgagcaatagctcaggctaaccagcaaataaagcatttctaacatcacgcgtttattattccagttcatctacataaacagctgataaagtaactgaattacacttccacgtaaactagattacaggagtatctgaataatataaaaaatacaatcactatacgctgtccacatgaagtacaatgtagcacaatcgaatggagagtggtatataacaatggaagagccgggctaaattatacacacagggacattgccatttgcagttttgccgcaaatcaaaatgtgtagcgcatacgatcatatacactacaaatcaacaactgtaagcactggatccacctgaaagacaagaacaggagcaatatgtattaacataaatattttcgatacttgtgtgcagtgagctaaacagaagcatctcactactacacctgaattttatttggcgaggattggagcaccacatgcagcctttgcatgtttgtcttcagcgaacacaagattcccacccacaaaggtggacagtatcttccctgaaagctgctttcccaaatatgccgaaatattctgcaaaaatgtgaaataaactttacacatagaatccagacttcacatataaaatgtgatcttcaatttgtagcattttctagctgattgttgaggaagaggtcaaaagttccacatggtccgacattttatatggaaacaagtggaattctaacgggttcgagttagaaagcaaacccgatgcttatggtagacaggatggctgtcatcaagatggaattgagcctcaggtttccataccacaatatcagcacggtatcccggcagaacagcaccctacaaattgagtttaatttctttttagcaatatcagcatgtactgtatcgagtgagacaacagatgatgatataacaaagatgaaaacattaatcataaccattagctggttttaagnnttacacaagtgtcatccagtaagaacagtagtatggcacaatgatgccatgcattttgctaaaaaagatgacattagcccattacctttttctttaaccctgcaagcatagcaggcctttcgctccaccatgatgccagttgattcaaactgataccgtattttttcccatgcgaccatgttacagggagaacaaactgcaaatgttcataccaaactaattactactatgcaagcacaatctggaggccttcacacttcaccattatgattttactcaaaatgtttttcacgggccagcggtggaacgttgaccaatttgtattaagattaggggaaaataaaatcgttacttggcactcttggcacggtacatttattcatatgcactaaaaaacttacctgcaaagatgatatgcctccccatgcccttaagaagttaccttcctccatgagtttgagatcaggagctgatggtgaatggtctgagctcaacatgtctatgtgtccatcctaatgttagccatataatagttggccagttacgctataacagtttagtaaagttcaacaaaccaatcataataagaagaatggcgtcaagcagagcttcccagagattatctctgttggttgaatcgcgtataggaggagcacatttaaagcgagtatctccatcaggaacttcttcagctgaaaacgccaggtaatgaggacaggtttctacactaacccttgcaccattttgttttgcatcctacaaccatataaaaaattggagtaataaatggaccaagaaaaccataagtcatttgaataaatcgtactccactgtgcataagctttttcatcaacaataaataatcagtttagataagcaatgtaaaatgttctcggcgattgtgaatataatattcttttgtttggttgagacagaactttctttcatgacttcacaaaaacagatgaatcattaatacgttctggtctgtccatttgataatgacatcataccttaagaagcccaagagaagtttttgcatctgagagatgaactatgtgaatatgagctccttctgaccgaccccctatctccgtgtctttcatcgcacgttgcagatctttgatcgctgcttcctccctagatataaatggcaatagaattagtgaagtttgaagttgtgatcagctcaaaaggaaaaaaaaaaggtgttaagttgtgagtacttcggttcttttcagtgatggctattggttaagctttttttacacgattgcatactatgtactaaaacagcataatgccatggtattctcattgatttgttgtacatatgctttccagacagccatatagtttaaaatcagaattgtgcattctgattaacacacagactagactatgattcactcaggcaatttttttttcgcgaacgcgcaaaaggattgcacgtcaatatattagaagaatagagtttttgttacacgacgcactcagccagaccggcctatgccaaggactgagtgcaataactcaggcaataactgactcaaattaccatgctggtggtctagatttaagatatgtcgtataggctttaggatctagttcaccatcgatcccatcttcattctgaacatcgggtatgcgttctgcatggataagtaacggccttttgtactttgccaatgtaaccaggccctcctacagtacaaaaacaggaatatgaactcttcagggagttgataagctgaattatggaactcttgtggtcgcaaggtaataaataacagaattgtcaaagcagcgcacctcaatatgagttgaatttgtcatggggaagtcatttatacctgaggggcacataaatgactaaatcaagaaaaaaaagatcaatcagtgtatcattctatcatttgcttatttaaagtaaaatagaataaacagagtgacatgatggcatgataaggacgttacaatgacatgaaaaggacgtgaataaacctgtgggatcctagtactaaccaaacttactttggagctttgcatgcctgaaactaaggcttctttaacaagttgagaagatgaataaacatgtagaacaacagaagttgagtgattactcttgtaagtatgaacaaaccttgagccctaagacgcctgcatttaataggctctctagtgcacttggattgagggcattctctggaacgaggcctccccagaaccctgtttgagaacagcagacaagtcaaaaaaggtcggaccatgaaacaagtttagatgcagaattactgttattatggtggatgagctgtttttacctcccttggttctctacttgctaatgtgcaatgatactgaaacgtgtaactattgcattgcaacttacctacatcaacatgtagtttatccttagctgcatccaactgataatcaagcacgtaatgtcagtgttgactaaagagaaagcaggtagtagcaatttgatgctttatatactgatattggtacgataaagaaacactgaccttcagcttgagagtttcttcagaaacagttgacgggtagctattaagaggcatgtccactaatgttgtaatgccacctgaaatgaacaaaccgtgaaactttgagcaaaaagtctgatctctttctgttattgaaaagaaaaagaaaattgattactccctactaactcggt

SEQ ID NO: 90823 - DNA, 2739 bp, Oryza sativa
cccccttcattcagtggaatatagttaaaatttttaattggtaacttgcagtgctgtttgtgtcaatgctagctgcaatgagtcatgtactcgtgtttacagtggatcgttggtgcattccttgctcagaagtttgtgttgtttctgttggtgccctaggagcattttattcttctgttgataccaatctgtgtgatttagggctaagattcattccgattttgattgcacatgaaaaaattttggcttaaaattgctgatcactttgttttctagcatagcttagcttacttgccataaaaattctcaggcataagtaaatgtacggaaatatgctacaaagatcctgttttggaagatcaccagtggagtgcatatatcgatcggtctccaggacaggatagctactccttggtgagtttgtgatctgtttgtacaattcttataatttccatattccttttactgaaagtactttggtaagtgataacccattcgatggcatatgtttgtactgtatactgctgtcacagcgaaagattaggttgcattttgctgaccgaaattataatcaccctcacatgattacttgatcataaacaggaagttatagttgtcatatcttctataagaaagtgcatatatttaccatctgttgcatgatggaatagaattaactgcactagttgattttgagtaagagttgtttgttcaagattttgtatacctttcacatgattatcacagtaaagatcagtacatcagactgctgttgtatggtccgtagtcatcatactacaagtttattgggttgcagtaacataatactgcattttgctaatgctttggtctgatgtagataactagatactgttccatacactaaccagaatgcatgggtggtttttgttatagatagtttgctgttagtatgaacttgttggttagctgtaggaaattgggaacggtcattgacagtcagtttattgaatagtctactgctaatatgcagagtaatttatggtaagttcgtcggaacattctcattgcaatcctttttactgaaaacacggagtattcagtagtctattaagctccctaggcaaatcatctggcaaaacaaggaattgctcatgatgttttttgtaacatattgacgtttcttgtcttcaggagtgcttcaatgcttgtgtttctggatgtggatatagggtatgtaataaaactctcaagaatggcatataatttgctggtcataattcaatccttgtttccatattcaccactatttctcttttgctgtatgatagtttgacataccagcggagaaagtggagcaaatcaaaccaaacaggccatccaagccaccaccaccaccacctcctgcagtagagcgggccacgaattcagaacctgctgtgaagggtgaagacgtgccttgcacatcagcataatagtaatctatgcagccccaaattttgtgtaacttttggtgcttctttccctcatactgcctccttttttttctcttttctgggctgtttctttgcaccatgtgcttgaaattcgcagtccaccttaggctgggctagatgctaacaagatcttaacgataaatcccaaaatcttatttatattttcatatgcttgttcatccacattgtatgttagtatgctccctccgttcctttgtggatggcgccgttgttaataatacttatagatggtttatcatatcataaacgaaagctttgtgattatatttaggatgcaacacacttggataatatagaatcatttgaagtgtaaatgatctttttattaaaaaaaagacaagctctaaagttttactatgaatagtgcccggtgccatgtgactaataacttactccctctgtcccaaattagatgtcgttttgattttttttttgcaatgtttgacaattcgccttatttaaaaaatagtgcaaatataaaaaaagataagccatacttaaaatacttttgataataaaacaagtcatatacaaaataaataataacttcataatcttttaaataagaaaatggtcaaacgttaaaaaaatgataagtattttggaacggatgtagtattaatttgctgtcatcagaagataattacacaagctaaaatcgccacgaacaggaggtatacagggtagataaaaccagtagtgcagcatttgccatagatgctactatcccctgacgatttgctctccagcagcagcatggcatgtcttctcctgcgacgccgagacctccacttttcgagggcgtcggggaggggcatgaccaagagaggggacatgaggcggaacacgagcaacttccgcagggggcggaggtggaagaggccgagctcgacgcggcgctcgcggtaggctcggaggacggcggcgatggcggcggtggcggcggcgatgtccgggaggtggcgcgcgtaggcgtcccaggtgcggatgccgtcgacggcgtagatggtttggtcgaagatgagcaggtgccaccggagccacacctcccggcccagcggcgtcgtcttcaacctctcgccatcctgcatggacatcgtgccccccggggttcgcaccagcagcctgaatcgcttcctcggaatcttgaaccttaacgccgccattgttcttgctcttgctctgctagctaattcgtcgacgcgcgctctgtatgattttcttttcttttttttttttttta

SEQ ID NO: 90824 - DNA, 2510 bp, Oryza sativa
cagcatgcaagggtaaattatctgggcagcaggaagtattcctggcccatatggttccacatacttacaataactgcagaaaataatagcgcggcaacttttgtgtaagaaaacactgatagatatttagacaaaggtgaacaagtcttgcaagtgaaagaatgcctcgaatatatatgtaaacagtagagataccttgccattcttttcatggtgtattttctggaaacatccatagcaaatggccagtagtcgacagcgtgatgattcaattcatcagaaaaccatatgatctctactttgtcaaggtgcatgccaactgccttccacatcatgatattgtagcggataatagcctgtattttgtttaggttacaggtgaatctagggttccgctgcggaaaccaatctgctatcaatattttaactgtacagccagctctaaccattttgttgacatagattgtcttcataataccctgaaaatgataacagaccatgacctagttatctgtgagcagtgtttgaaatgcaaccagagaattggatttgcataggagcacataaaaattagagatccacgtctgaaccatggcatagaaatcaagcttcttgtactactacaaatatactactggtattatattagtaccaccattatgtttttatgatatttcttggttcatacccctcttgatgagtttcatcctagcctgcccaacttgtccttaatatcaggggctaatggcagaaccaccaccaccactattatcttttatactgtactctctccgtttcataatgtaaaactttttagcattgtccacattcatataaatgttaattaatctatacacacatatatgtctagattcattaacatctatatgaatgtgggtaatgctagaaagttttacattatgaaacggaggaagtagtatagatatatattttctaagaccgacataaccttttttcttattgttgttgctatacctgctctatgcccatcatggaggttggctcaaaccaaacacagcagatgggattaggcttcttcttcagtaatacgcgtagctcatcctcgcatatgcactcctccgcaatgctcctcagaagtgcaaatttctcatcaaatcccatctccatggtatccctataaaacaaagaccaaattcacatgtgatgtcattactacaacttgaggggaaacattacgatttgtaaattttccctgatcggtcgtcaatcaatatcgtggcctgggacagttgaactctagaatataataagtggggaatttgagtatttgcccgcccctaaattcgtcgcatgtttaggtttaaaccccaaaaaggatgaaactgatgatttgccatattttgaagaaaaaaaaaatctttttaccaaaacccttttccaatgcgaaaagaccatgttcctgctgaaaggagaggatagagggcgtaccgacggagagggagacagcgtcgtgaaggggataggaaagcggctccaccgttgtgtagggagaagacggcggcagcagcagcgtacggacagatggcgttggcggcgtaggaagaaattacgaggaagaaatttggttaggtcgacggctggttggaccggcttgctttagacttggagtttttcttttagtgggctccatgccattataatttattagttttttaaaaaatatcattactactcgctccatcctaaaatataagcattttaaaaagttgagactgaatgatgtctgttttatggtttaagatggtaatttacaccgctgctatagtttaggggtgtaattcggattatttcctattttcaacttgtaaagcaaacattcctcggttgtgtgggacatcgataccagtgcatggtgtagttttttttttctttttaactttttactactatattcaatgaaacttcacgctatctaactggcggttcgttaaaaaaataaagctaacataatggcattaaatattgacagattttataaggtcaaaaattgttgcccgtgcaatagcaggctgctatatacgtgccaactttgatggattgatcgaccatcaatcaaccaaactaataatatatattctcaacccaccatatatatttattcatagacatgtataactatacatatgaggccatatgttgatgctgcgtatagtgtatcttgatacgttattcatacaatgtatgagtcggtttttaaatccgtttgattttaaaaatacaaatctatatttgagccaggttttaggttcgcttttggaaatacggaaggagtcgtataagatatatttttaaaaaactcgcatgctaacttgagatgatcaggctcttaattgcagcttatgattttctaaaaagtatatacccaagtgaatttccacattgaatttcatcttaactaaattatataacaataataagattataataacattcacccgttacaatgcataaatatttttttatagtat

SEQ ID NO: 90825 - DNA, 572 bp, Oryza sativa
ccccggcccggcggagtctggcctcctcccgagcggccacctcagcctgggaacccggacggcctctgggcagcctcctcggcttctcggagacggtccgcggcttctcgccggtcagcttcccgcctccgggcctccgcggtcgccgtctcctcggcctcagaccggccggacttggaagggcggggggtgggggggggaggggcgacgggatctcgctgaggcggaagaaaaaccagaagacaaaaagaaacgggtgagtgaaaacttgccttgggagacgggagaatgaatatggccgcgatgggcgcggggacgaacctgcggggaggtcggctaaacgaccacctcgggggcgagatgaggttcccccggcatggcacaatcccccccatcttgcggagccgtttcttcttcgctccccctcgggctgcggcgtcggcacggcaccctccgggcgcctgctgctggcacgcaccgccccgtcccctcggggagatgggggaggggtgccctcctgcttcctcttcccccgggcgtcggcagggcggctgccccccgggcccccgtcg

SEQ ID NO: 90826 - DNA, 1495 bp, Oryza sativa
cgcctcgtctacggcgatggcggtacgccccagggcgcgctccaggctgcgggcgcgctcttgcgtcacccgcccgtcgtccccgatccagagactccagcccgacgttggctggatgacgtggccgacttggtcatgacggcgcagcagcgactaggcgccggcgggcggtcctccgccaccgaggcctctggcgcagccgccgccggctccaagtcgtcgaggcggagggcgcggcgagcggcggccgttacccgccattcgtccgccattccctcgtcaatgcctccaacccaagaagatgtgcgtggggggccggatgcccgcctcgatatcgagcgccagcgcgacgctcgtcacgccgcccgcgcaacggagggcgcttcctcgtccggagcgccgcttcggtctgggcactggtccggccccccgtgtccccggttggcggtgccggctgtcgagcctttgtggcgagccttcggaacgtccgttggcccccaaggttccggcccaccatcaccgaaaaatacgacggaagcgtcaaccccgccaagtttctccagatctacacgaccgggatcgaggccgccgggggtgacgacagggtcatggctaatttcttccccgcgtcggtccactcttgggagaatttgtgccaagcagttcaccacgaacttccagggcacatatccgcgcccaggcgaagaagcggacttgcacgcggtacagcgaagggacgatgagtctcttcgctcgtacattcagcggttctgtcaagtccgcacaccataccgtgcatccccgcacacgcggtgatctacgcgttcagggggggcgtgcggcacaaccgcatgctcgagaagatcgcctccaaggagccccagaccaccgcgcagctttttgagctcgcggaccgtgtggctcgcaaggaggaggcctggacctggaactcctccggttctggtgtggcagcttcggccgcccccgggtccgccgctcggtcagggcggcgggacaggaggaggaagaaggggtcggcccgtttcgacgacgagggtcatgtcctcgccgtcgagggcgcttcgcgggccccccgaaaggggaggcctgcgagcgacaaaaagaaggaggccggcgctcccagcagggagcgcccgaccggcaagtggtgtaccgtgcacaacacctccctccacgacctcgcggactgccgcgcggtcaaaagtttggctgagcggacgaggaagtgggaggaggagaagaggcaggagcgccgtgagggcaagaccctggcggctcccgccggcaaccggcgaggtgaggccaagcagaaggccatcgccgaggacatcgacgatggcgacgatgacctggggttccaggagcctgaggccaccgtcgccaccgtcgatgggggagcgtgcgctcacgcttctcgccggagcctcaaggccatgaagtgagagcttctggccgcgggccctaccatgaggcg

SEQ ID NO: 90827 - DNA, 1469 bp, Oryza sativa
tgacttggttgtgaagacgcgcaaccaagagaccttactctcggatctagcggaaactttcaaaagtctccgctccgcccgcataaagctgaaccccgataagtgcctgttcggcgtgcctgcgagcaagcttctcgggttcttggtctctgcccgaggcatcgaggccaaccccgagaagatacgagctatagagcggatgcgcccccccagcaagcttagggatgtgcagtgcgtcaccggctgcatggccgccctaagtcggttcatatcgaggctgggagagaaggcactacccctatttaagctcctcaaacgctccgggccgtttacctggacggaggaggctgagcggaccttcactcagttgaaagcgtacctcagttctcccccagtcctggtcgccccggagccagatgagccgttgctattctacctggcggcaaccccgcaggtggttagcgcggcgttggttgtggagcgcgacgaggacaaccctcaccccgtgcatccccaccctgtgtcgactcgacccgggagagagcagggaggagaggcccccgagccgaacggcggcccgaggcccccgacggccggagctggccctccgcctgcttgtccgacggtgccaggcgcccccgacccccaggatggccccggggccactgcgggaaggccgcgcctatcgccctctgaccccgaggtcgtcagcacagaagccgagtgcggggccgcgaggcctctcggacgaagagcgccctggagatgcggcccctggcgaagaggatcggccccgccgaaaggtgcagcggcccatctacttcgttagcgaggccctccgggacgccaagacccgataccctcaggcccagaagatgctttacgctattctgatggcttcgaggaagctgcgccattacttccaggcgcatcgggtcacggtggttacgtcttaccccctcggccaaatcttgcataaccgagagggtactggacgggtggtgagatgggcaatcgaactctctgaattcgatttgcgctttgaaccacgccacacgatcaagagccaggccctcgccgactttgtggcggagtggaccccagctcccgagcccgtctccgcccccgaggccagctcgggccccccgcagctgcctcacaccgcctactgggtgatgcagttcgacggctccttgtctctttagggcgccggtgcgggggtcacgttgacctcgccgagcggagatgtcctcagatatctggtccgcctcgactttcgggcgaccaacaatatggtggagtacgagggactccttgcgggacttagagtggcagctggactggggatccaccgcctcctggtgttaggcgactcccagttagtcgttaaccaggtctgtaaggagtaccggtgctttgacccgtagatggacgcttacgtgtgccaggtgcggtgtatggagcgccat

SEQ ID NO: 90828 - DNA, 2246 bp, Oryza sativa
ggcttgcccagccgtcggcgcgacccgaccccctaggggagacggacgcgcctgaacggcccctgaggcccgtcggagtccaggcctcgggacccgagggaagcgctcccagctcccctagattgattgcttggatcactgagatccaggcatacctcgtagataagactctacccgaggaccgcgaagggagtgaacgcgtccggtgcatctccaagcgctacgtgctggtggaagggaccctctaccggcgcgcggctaacggagtcctcctgaagtgcattcctcgggaacaaggcgtcgagcttctcgccgatatccatgaaggcgagtgcggagcccactccgcctcacgcccttggttggcaaggcctttcgtcagggtttctattggccgacggctctcaacgatgcggtcgacctggtccggcggtgcagggcgtgccagttccacgccaggcaaacccatcagccggcccaggccctgcagaccatactctttcgtggccatttgctgtctgggggctcgatatcctgggtccgttcaggcgggccccgggcgggttcgagtatctgtatgtcgctgtcgacaagttcactaagtggcccgaggcttatccggtcatcaagatcgataagcactccgcgcttaaattcatcaggggcatcactgctcgatttggggtgcctaacggtatcattacggataatggcacccaattcactagtgagctcttcggtgactactgcgaagacatgggcatcaagctctgcttcgcctcccccgcccaccctagaagcaatggccaagtggagcgcgccaacgcggaaatcctcaagggcctcaaaaccaagaccttcaacatcctcaagaagcacggcgactcgtggatcgaggagctgccagcggtgctctgggcgaaccgaaccacgccaagccgagcaaccggggaaacgcctttcttcctcgtctacggcgcggaggcggtcctcccatctgagctcaccctgaggtccccttgggtcaccatgtattgcgaggctgatcaagatcagcttcgccgagacgacctcgactacttggaagaacgaaggcggcgcgcggccctacgagccgcgcgataccagcagtgcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggtgtcccccggccgggctccgttcggctggccacgggcgacggcgcagagctgcctaacccgtggaacatcgaacaccttcgtcgcttctacccctagtgggggtcgggcgtcatgtctcgggctcgggccaaccccgcaccccccgggcgtgcagggttggccgggggctaccacatgcatatccttatcttttttctcttccgtatttcaataaaagcattttcgatttcctgaggactgtgcctgtgccatcgtttccttttgaagaatcttggcttgagttagcacgctcgtgctcgaccctgccctcggtggcccgggccggctaaaatcgccaaacgaggcccagaaccgagccgtgccccggggcgtggtgaactccggggggggaatcggcaaaggcccacaatcgggtcatccataaccctcggtcaccacgctcccggcctggccagtctcgacatgcggatctccccaggcactagcccccacccgcgccgcttgaggttgggacctgggcacgagccctcgttcaagccaagacacagaaggaccgcggcacagaccatcctcgtctcatacacacaacaaacataactgacgcagaaatttcctctttacttgattacagattaaatcagtctatacaagaagggggcccgaaggcctcggaagaagaaggaaaagctattaagattggcgggggcctgggggctcactccggcgcccccgggccgtcggcctcgtcgccactgtcgtccgcaccgtcgtcaccgccctcctcgtcggagtcgagcgcgaacgcgagccgaggggccgtaccctcgaagctgtggacgatgtagtcggcggcgtcccggacccgcgcgcgcgcgccatcctcggttccgggagggaactcttccagcgctgcccacggggagaagtcagggtccctggcctggtagcttgccagtacgagctccaccgcccccggg

SEQ ID NO: 90829 - DNA, 3230 bp, Oryza sativa
acgtggcggactccgcggtgcgcgccgtcatcgggagcaggttcaagaaccgcgccgcgttcctgcggatgctggagcggaggatgaagctcctgccggcgcagtgcttgccggacctcttcccgtcgtcgcgcgcggcgatgctcgtcagccggatgccccgccggatgaagcgggagcgacaggagatgatggatttcatcgacgacatcttccaggagcatcacgagagcagagccgccgccggcgccgaggaggacctgctcgatgtcctcctgcggatccagagccaagacaagacgaatcccgccctcaccaacgacaacatcaagaccgtgatcatcgtaagccgagctcagctcgatcagctacctccccacttaaaaagttcaatttcctcttctttttgtgcaggacatgttcgtggcgagcagcgagacggcggcgacgtcgctgcagtggaccatgtcggagctgatgaggaaccctagggtgatgcgcaaggcgcaggacgaggtccgacgagccctcgccattgccgggcaggacggcgtcaccgaggagagcctgcgcgatctcccctacctgcacctcgtcatcaaggagtcgctccggctgcacccgccggtgacgatgctgctgccgagggagtgccgggagacgtgccgggtgatgggcttcgacgtgccggagggtgtgatggtgctcgtcaacgcgtgggcgatcggcagggacccggcgcactgggactcgccggaggagttcgcgccggagaggttcgagggcgtcggcgccgccgacttcaaggggacggacttcgagtacataccgttcggcgccgggcggcgtatgtgccccgggatggcgttcgggctggccaacatggagctcgcgctcgccgccctcctgtaccacttcgactgggagctgcccggcgggatgcttcccggcgagctggacatgacggaggcgttggggctcaccacgcggcggtgctccgacctcctgcttgtccctgccttgcgtgtgccgctccgagaccatgagcgatagattgctacagtatcatttggaaatggataagacatacagaaaaaaaaagaaggatcaactggatgtcatcatgtcatcagtatatatacagactcatactctcatttggtgatgtttcaagtgttatctgtaacttttaaattactgggttttgtcatcatgtaacatatttaacctagcattgaatttgtggaggggaatgagtaactcaccagcggtggcgacaacgactttcagattgtagcatcagcgtgttaaaactccgacagagaacttggaattccactacaagaaacttgttaatccatgacgaattcttggtgacggattcataaaccgtcactgacagaggcaatccgtgacgataatttgttttccgtcgtggacgtgcactagtggatattcttggcccgttaactcgtgacggttttatccagatcgtcacagtgtgtgattttaaaatcgtcacagtgtgacgataatcaaaaggcatttcaaaacttgttttgcttgaaaaggatttgaatttgaggttcaaatgaatttaaaaaaatgaaaagctacactctctcttggaccatttctggctcactctctcctcttgggctcgggccagcctccctctcgcgctctgccccttcagctgggccagcggcccattttccacatgggcagccaagacaggctagccgcaggccaccctgcgccttgtaaaaaaacaagaaacaaaaaaatgtagccctctaggggactcgaacctacgacaacacgcacagtattcatgaggaaaccccactgagccactgaagcgttttgccaaacgacgtgcactgtattatatatattaaactgtagcaggtaatggacctgccacctactcgtggtgttcatcataaaattcacgagaatagctgcagatttttacttttaatgcgtgtataaaaatttaaattagtttatctccctcatactaacttcaactttaattattcttttttataaaattttctaaactcatgatctatccatttattgtgctattacaactattatttttgtcatactttcatgtgactttgttttatcaattgaagatttaaatttcaaaaagtggcaacttcaaacaacattttgaagcagtaaatgattgcaaaacaaatcaaacccaaaagacaaattttttttgaactaaattattttgttactaatttgttacttgtatatgttgcatatggtaaaactgaaaatatttgcatatatatagtgtgcgaacaaaaaatatttggagcttgtaggaatttaacctaacacctatagttatccagcaacattcatagctacttcttttagttgattatgtatgcactcacttatacttttcactacaagaaatatattaaaagttaaagcaatttaatcaagtgaattaatcaggaaactaaatttttcctttaaaaatcatggccggaaatatttttgtaaaattctaagcggtctaaattattctctaaaattttccgtgaattttcggagctcaataactagttttaataccacaaaattcatttaacctattaaaataaatggaaaataaattaaaatatctctctgtccttgggccttttttggcccaagtgttactctctccctccctcagcccgcagcctttctctccctcctgggccggcttcccattcccctcttcttcttcgggctgccagcctagcccatttgctcccccctcgccgagaagtccattttagctccctcttctcaattaatttcaaaatataaaaaatccgagtcaaattttatcatactaaataaacttatgtgaaaaagttatcaaaaacaaagttgtataacttaattagatctatcaattttattttggttatttctccatctgactttgattgacctatataaaatttgaattttaaatataagaaaaatcaaataatttttctggtagtaaataatttgaaatgaaaaaaaaatgtcaacaacaaagttgtatgacttatcaagatctacaacttttgttttggtcattttgctatatgacttcatttcaataatttgaatttgaatttcaaattatgacaacttcaaacagcagtttcaaatactaaatcatttcaactgaaaaagtcatcaataacaaagttatataa

SEQ ID NO: 90830 - DNA, 1717 bp, Oryza sativa
ggacaggaatgtagttgtggaggagacagctaagttttctgagctgaagcttcaggcacgttcaatatttcacatctgattctgttaatctacaattatttcgaaaatctgatggctaaaataactagtaacattgttctattgccgtacatttgcatggatacagccagagacagaacagcgtccacataaggtcagcttttttgttgataaaaagagtgctcaggaagtgataaagtctctctccggtaatatggagaaatgcggggtgaggcaacattcgacttgatgttagcttgtttcaattttggataacttaagaactatttatggtttcttttcgtattatgttaactgctatatttcttgtaaacagcttgatgttaaaataatctacagtggtggccaagaccttgacatattacctcagggcgctgggaagggtcaagcacttgcatatttgcttaagaagttaagctcctgtggaaaaccaccaaacaatactcttgtttgtggggactctggtaatgatgcagaattatttagcatccctggtgtacatggtgtcatggtcagtatacaataaatttcatgaagtgtctaacaaagttcatgccagattgaatataagtttactgtaactgcaatctttttttaaatttttcaggttagcaatgcccaagaggaattgcttcagtggtatgcagaaaatgcgaagggtaaccctaaaattattcatgcaactgagaggtgcgccgctggtattatcgaagctattggacacttcaaactaggacctagtgtttctccaagagatgtggggtttccttatgttaagcaggaccatatcaaacctacagatgctgttgtaaagttttacgttctctatgagaagtggcgcagggctgaggttccaaaatcagattcagttgtacagtacttcaaaaatatcactgtaagtacatcactgcccagtgtgatgtttcttcaaaataatttgtaacctttgtcaaaatcagttttatcttttacctcaaaagaaattatcagaaccttctaattttggaaaagaagttatatttccaattaataaagtgaactgggtctgacgtattatattgttgagttaactgattttttatttgtttttggtttgtcttagcatgcaaatggtgttatcattcaaccttctgggcttgaatgttctctccatgcctctgttgatgcattgagttcatgttatggtgagaaacaagggaaaaaataccgaacatgggtggacagactatttgtctcacagtctggttcagacagttggctggtcagatttgacttgtgggaggcagaaggttagtccttagaattgtgtagaatgagtgaattagctcttatatgatattttttacacttcattcaaatttctttaatgttttacttacacaatttagcttgttcaatcatattttttcacttgtaggtttctctagacatgtcacttcaatctattaattttgttgtgtgttgtagtatatcctcgtacacaccagaaattatatgaaggttttaggcaatagtttatgaaaagattgacaacatattcaactctgcatctgtacgtacaaatgtcataatacattacacatatgcagtctagtgcaattcatttgtaaataaaagtaagaaaacatactcctcaataaaaaataatttattttat

SEQ ID NO: 90831 - DNA, 1157 bp, Oryza sativa
ctcgatcgacggcactcctgcttcagggcctcgtcgatacgcttgccgatgccttcgagctgagcacaggctccgtttagccacgagatatatccggccgctgactcctcgggatccccgcgaggtactcggagttccctgcagacgacggccatgactgtgcaacaactcctgaggtacgagttgaaccacaccttgcgacctctgagtgcctccacagcccggtcctttttcacttccaacatagtcctctcaagttcggcgacctcgaacttcgtcctccagtattggatgtgacggtcgcgatcagcaagcgcactctcgaggtctgctcgacaagcaaacaactaagttaagctgttctcctcttttgagagcacggcaagttaagctaatccagatagaagagcaaaggagatggaaacaaaaagaaccaacctaaaggagtcgtcgtcatgcatgtctccacgggcagattctggtctatgtcgtcttgcggcacatacggctcaagcgcaagtgccggaatgattacaggcaactcaggctgcccgcgttgctggacatcctcgacatcgacatctctacaaacaacaacaaagtactcggaatcaaaatgccaaagaaaactaaggtgataactgcacacaccaaggcagttggaaccaacaaattgttttacaatgcatgattgattaaggagtacaggcgaaccgaagtcctactcttcaaaaagtgggagaatagactctcctagatcactgacttcttccatcacgtccttacgcgcgtcgttagccgtcccctgatccaaaatcctttggagatcgagctcaaggtgcgccaaccttatgcacgcgaggacatggcacgtcccgatgtagatcccgttggacgtctcctctctgatcttggtcgcatgcttggaggggatcgcctccatcaccgtcgccagttccgcgagcgaagtcgtcagcgagaactcgtcgggattcaccggatggtggtcgtgacccgcactccccggcgagctggtgcagaccggtgtaggtaacccacagcgagccacggatctccgacaggttgttctcgagctccgacatacggtgctcaagcccctgccgttaccgttcgttgccggccaccagctccctcat

SEQ ID NO: 90832 - DNA, 657 bp, Oryza sativa
tcctgcagccccttgtatggagcaacgcgcggaccaccttgccgcggcgtccaagcccgcgggcggcgacgagaggctcagcacctccgtcccggccgccccaaggcggcggatggtcacgtgcgacgaggtcccggtcaaggaggttgtcctaggcgacggcccgtccaagaccacacgaatcggtggtcttctggacgataaataggaagacgcgctcgtctccttcctgcgggcaaacgccgacgtcttcgcctggagaccggcggacatgcccggggtccccagggaggtgattgagcaccgtcttgccgtgcagccgggcgcaaggccggccggcagaaagtgcggcggcaggccccggaacgtcaagccttcatccgcgaggaggtggcgcgacttctggaggccggattcatccgtgaggtcatccatccggagtgactggcgaaccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaagaaaaaa

SEQ ID NO: 90833 - DNA, 970 bp, Oryza sativa
ggaagcttcgaataataattgggtaaataaaaccaacaaagcaacacagtttatccatcgcacaagtccgtcttgtacttgctttaactccttcgatactccgactcaactccttcaacgttggaacccttcatacctgtggagcaaaactacgcataaaccactatatcgaactaatgacagatataagggatatttactaaaatcgataacctgaacatataaaataacctatagcagttcccttactattttatacgtaactcacaaaccgtctaacggaatctagcaaataatataacttcggacatctagacaaaattgtctacaaccttcatgttgagtgaaaaatcagattatgcctctgaaaatcccagattaaggaaaacgaatttgctgtcctgatttcaggacccggtcagcagtactatttctgttgtttgtcctaaaccgtttatcggaatcgagcgaaaccagcggcgttagaaagatatcgtcgatgactacaaactttatttaggacaactaacctgaatcgtgaaggtttaatgtcagttttgaaaataccgtttccagcccataaccaataatctcagaaattgcacaaactgccaacgaattaattcctattgaaatcttttacatctagagactaaaagaaagtccaattgcagagaaacactactttgcaacaaatttccctaatctgcgaaatcgctgaaattccccaaagttgttctaccttttccttcccttgttactcctgttcaactgcttcctgtgctgtctggagccttctcgtctctgatcgatgcagcagcgtcaagcagcaagccacgctatagcatgagcagcagcaggaacgttagcatgcacaggcagcggcaccaacaccagaacagatccaattggcggcagcattagggaaaacaggaacagcagggaagaacacagcagcagctcaccaagg

SEQ ID NO: 90834 - DNA, 707 bp, Oryza sativa
cagtacataattcatcaaagcctacacagcatacaccataaaagttcacaacccataaagtttttacaagcaacagtacataattcatcaaagcctacacggcatacaacataaaagttcacaacctattaagaaatagtaaaaatagtatattgtcaacggtgggtacccgtagaccagatatagagggtattggcgtacgctggtacgatgatctacgtaatacaacatcaaggaaacaagagacaaagattatactggttcaggccccttaataggtaatagccctaatccagttgatatgggattatatggagagatccaaaaattacaaagggaataatagaactcgatgataccgatgagatcgtagtcgagttgattcaactagatcacccgacgacttggctcctgtaggctccggctttgtaggctgtggtcgttgtattggctatgagattcgatgtgttaggtcctcccggggggtctcttttatatcgcaggtcaggtggtctccaagtaggactcggagacatcggaccctgcacgatacagtgatgacccagtcctatacgggtaggaacctttccattggtggacttcgtgatgaattttcttagcgtatacagagaacgtccgtacacgcgcagatgtaccatattgtcgtatagtgtacatccaagggtagagggtataccttatccgta

SEQ ID NO: 90835 - DNA, 1440 bp, Oryza sativa
ggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaaaacagtgacaccaatcaaaggtaatgaagttgcataaccatggaggcggagaaaccagtcggcaacagtcaggtcagctagcagtgaagatgtaggcgcccaacaacaacaacaaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagccgactatgatgacgaagtttcccatcaacggcagcagagtaggctatgttgaagaggcttaacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggctgattaattgatttcttcagcttgacataaaatttgtcaaattttgagccttatatttgtgtagcccccgactctttggttagttgagaaacaactgaacatagagtcgagaattatagcttcttgtcgtcgagtagtcattgcttgattgaagatatgtgttgaaggtgtccaagtagaaatcttgaatattggagagtcacttgttgtagtaaaatatcatggcattgcatgccgagatgtcgaggttcacaaagacgtcgtggttggtgaagtagtaaaacttgcgaagtagcagcaatagagtttgccggtgccgaagataataaagatgaagtcgctccaccatgatgacaaagttgtattgccgtaatgaagtgaacacaagtcggcggcaacagaagcaaaccggtagtgaagacgcgtagttgtgaagataaaagcaccaatcggcggcagcataatcagtcggcgacggaagatgatgatgtccatcagtagtggtagctgtataaaccagacgtagaggtaagggcactagtcagcaccagacgagacgaccggcgatgaagatgtagatgcccaacaacagctgcataataggccaatcaacactgg

SEQ ID NO: 90836 - DNA, 1044 bp, Oryza sativa
cggagaaggcaacccggtccgtgaaaagttagacgcccaccacgggcagcataataggccagcggtgcagccgaaaacaccagtcgccggcgttcaaggtggccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaagcaccagtcagcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcagcataataggccagccgtgcaggcggaaacaccagtcggcggcggtcgaggtggccggtcggtgacgacgtagacgcccaacaacggcggcataataggccagacgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaattgcggcataaaggccagccgtgcaggcggaaacaccagtcggcagcggcgaaggcaagccggtcggtgaagacgtatacgcccaacaacggcggcataaaggccagccgtgcaggcggaaacaccattcggcggcggcgaaggcaagccggtcggtgaagacgtagacgcccaacaacggcggcataataggccatccgtgcaggcggaagcaccagtttgcggcggacgaggcggccggtcggtgaaaacttagaagcccaacaacggcggcattaaggccaaccgt

SEQ ID NO: 90837 - DNA, 866 bp, Oryza sativa
gaagtcgtggacgcccaacagcggcggcataataggccagccgtgtaggcggaggcaccactcagcggcgacggaggcaagccggcggtgaagtcgtagacgcccaacagcggcggcataataggccagccatgcagacgggaacaccagtcggcggcgacggaggcaggccggtggtgaagtcgttgttgcaatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagtaagaaattaatctgagattagaaatcaatctaatatatattgataacaaattgaaacgaaaaactcaagtcgagcagtgaggctggatcatgagtgatagccggcgacgtgccatgcaacatgtataagccccggcaactaacagctaactcgatgttctttcggcatgatgccatcatcggaggtagccggcggagcccatcaaccatcatacatgcaaacaggaatcgaatcctggcggcctgtgccactcctgcaacacgtccatctgcaaggaaaggaagagaggagcactcggacacggcaagggcacccaagtaggcgacgatgatggccgtgtttcgatctcatccagtatatgaaattcgtcaaatatcaggaaatcaaacaatgattaaaaattaatctaatagagattaaattgcaacggtagacccgattgaagatttgagccatcgaaattgatgagattgatctcggggtttcttctgaagttgattccatcgcacttttcgacaggtaattcga

SEQ ID NO: 90838 - DNA, 1598 bp, Oryza sativa
atggataatgtgcactggaatatggattatggggaaaacagatcatgggtccagtacaattagaggacgttaggtgcaaattatgcatggggttcctgttccttccgtacctttcttgggatcatgaacccacagaagagattccacagcgtgtagaatggagcagcaataataggcgcaacagtgtggttgggagtgatcgccgttgtcatcatgccatagaaagtgaagtacagcaaggtgaagtacatgaagaacaggtaccacaagaacttcactgctgtccactcgaacgagcccaagctgtagaaaatcgtgccgtagataagtgactgcacaagaatgtaagggaactccactgtaacctgcatgccgaagaacagttcgattgttagccttattatggtactactacgagcatcaaaacatgatgagatgacaggagtttttgacagggaaaattaccagggagaatgcaaaaggcagtgccgagtacatcccagctgccctctctctgtacgagacaaatctttcgatggaaatcacaggttgaacagaggtggcgttagtgattcctatgaagagtactgctgcgtacatggcacccatggcattgaatatgtcatgttgggtctccctgtcaaacaaagccacatgttcgctataaggccagccaagtacaggaagaaaagtggagacagaatcatcagtggacataccttcgagacccaaatttccagcagattgtcccgaacatcaaggaaatgatgacggtgtagaagaatcggaccgcagtgtattgaggatttctccagtacgacaggttctgcttccataagcaagcagcatattgagcaaagaatggttgggaatacttggtggcaaaagtaagttcttttgattctcttcttggtctgctcaggatatcaaccatttcttgggtctgcctggaatgccataacataaacatgtttaaggaaaaagagaccaagatttatagaggtgaaaagggtcgttgtgtttactgaaataattttgactgccggtagtattcagcaaaatccactccaagaatttgctccatttgagtacttgtgacttccaacatccatgcagcaggattatagccatccctgattttaggaactcctggaattgcctgtttacaaacttgaaagtgtaaggacagttttttcgcgaacgcaaagtgtaaggacagagaaacttgtataagctatcatcactgaggaaacacattgtgcagattgtacctcaaaaaactcgaccagattgcgtgatttcgagcccaagggaccagcatatataagttgccccccacgcttcatgaacaaaagctgaccagcatatgaatgagttaggaaagggtgctggttaaatgttagtacatacttgtataagaaaatttcgcggtttccctaagtagcacaatgaaagttcaacagatcaagtgtaaaagggactagtttctgttcacatccatcattgataagaaaactgattaacatcaaattatgaacgattattaaaatctgtactgttgcttcgaaaaaatatcaaaatctgtgctcaacttgtta

SEQ ID NO: 90839 - DNA, 1167 bp, Oryza sativa
tcctgcagcccgaccactacagcacccaggatgaattccctccagcagctaccaagcgcgagcaaagaacaagaaagtgctgattcaccaaaaaaaaaaagatcctagaaagaatcactttgtttgtgattgcaagtgtttaaaaaagtaattgtacccgaattacggtttcttcacatacaaccatacaggataaatggccaaaaaactgctttatgtattatccttacatttagcattagaagaaggtaacactgcatctcacaccaactacctcagaatagtgactaatccaataccaatacacgcaaaaacacagatcagctggtgtacacttacatttgcatgttcaagtccaatgttggatcagctggggcaattgcaaatgcagctttcaagctctgcttctcaaagtagctgaaatgatgcaagaaataaatgcaagagcatgtgctactaaaaaggaaaaaatgcaactctagacaagaagtgctgaagtatcaattgagaaagtagaaccaaccgtgatataaaaggatgagttgaaaacataacttgcattactgaggccatatagcaactgcaaagaaggaaacgcatgcattacataagagaaattattacaaaagaaaattcatgacgtcaaccaatgaaccaaagctacctatttccaagatttacaaggccagtataaccagggccgtataaaagttcggcatctttgccactttcttgtattctattccagtcataatttgtgttgtgatcaagctctctttcagcagtagtcatctcggtctgcacaacaaaagggtcacatcaaatagcctctaaactagacagatagacaagcatataaaggggaaaacacagtatgaacatgagatgctacagaatatattattcccatgaaaaagtactaatctgttactatcacaataaaaaaagcaagtcatattgagcagagctaaattatcgctcataaatgtcatcgaaaatgatactactcaccttttggagtgaagaaaaatcaataccaaaatgtgacaaatgctgcgctaatagtggatcttcaacgctatcatcttctgggtatgagaaaacgtctgagctgtcacagaaaagcttgtatgaataggtatatttaaatataaaacaacagtaact

SEQ ID NO: 90840 - DNA, 886 bp, Oryza sativa
taaaatttgacacttggttcttgctgcagaatgacactgctattgggccctccaagttcaggaaagacaaccttgcttttagcccttgccggacggcttggccctggactaaaggtgtgccttatcacatcaatccgtcttcttttcttcgattctcgccgctcaaagatgatgagcaaatctcttctatatgtatacaatcaaccaactctgcatctatcacctgctgacaagagtactagtgtctcaaatagcatgaaaatggttttctggtcaaacgctcatccttctcatttcagaaatactatcgaaaaataaatactacttcagtgctataggcctgtgcttattctgatcagtgcaagaagccttttaaccatgcggcattattcaggactatacatttttactgactaccaacacccaatggattgcaggtgtctggaaatatcacttacaacggccatcatctgaatgaatttgtgccccagagaacatctgcttatgtcagtcagcaagactggcatgcctcagagatgacggtcagagaaaccttagagtttgctgggcgctgtcagggtgttggaataaagtatggtaggtcatttcaccacaatgtccttggtgttgttccttacctccttggtagtttgcgctttgacgttaatcaatatgtagatatgctcgttgaactcttgaggagagaaaagaatgaaggtataaaacccgatgaggaccttgatgtgttcatgaaggtagatcacatccagctttatttggacacacactacctgttttgttggtgattgtctcatgacactgtttgtacttaatttttcaggcattggctcttgaggggaagcagacaagccttgtcgcagaatat

SEQ ID NO: 90841 - DNA, 670 bp, Oryza sativa
ccttgcccattcccctgtctccagagcacctagctgggcacaggcagtgaccacactgaccatggtgaactcatctgctctcaccttgcaaatctgcatgtaacggaatgtctccaatgcgtccctgaacctgccaacctgtacatagccatcgatcatcgcggtccatgcgatggtgtctctttcaggcatatgatcaaacaggtccctggcacgatcaacctggcctgacctcacaaggccagaaattaccgacgtccaggacgccatgctcctcatctgcatgccctcgaacaacacccaggccgcgtccatgtcgccgcactcggcgtacatatcaaccagagcgttctccaccctctgatcaggcaacaccccgctctcgaggacgcgcttgtgcacctgcatccccagcagcaggtccttccctttcccgcaagccgagagcaccgagacgtaggtgaccgcggtggccatggcgctggctctgaccatgtccacgaaggagcagcaggacagctcgaaccgcccgctcctgttatggccagagatgagcgcgttccacatgaccggcgctccccctcccgtggcgaggcacgccgcctccagcaccgcgcgcgccgcggcgccgtctcccctggccgcgtacatgacgatcagggagctcgcc

SEQ ID NO: 90842 - DNA, 678 bp, Oryza sativa
agcaatccaagaggtcgaatgtgctgatgcagccttgaatgacgccgatgtagatgagacaattgcctgggccgacggaacattggacttatcccttcgtcggagatcgaagacgatgcagccccgcgtcgggtgccaagttccgccggaacataaaaaacaaaagtagaagtaaaaagggtagcgatgcaccaaattgtattgatcgtagagatagattacatagaccccgggtgtacatatttatacccatgggttgatacaagtccttgtcggataagaaagaaactaacctaaagataaaaggaaaatataaagtccttatcggacactaaacacactttcctaaagataaaaggaaactaacaaactattcttaattaatagataaactgccatgccgcatcctttttaaactcgttcaattagggataagcttcctttagtagattgatttccttaaccgaatatagcaggaatccgactattggcgacttgataactcccatcggctgattccgagatgctgcagccgataatgattctaagccgatgacgtctttgccgattaccaaatttcactgttaacaccctttgaatcacagggtagaaaaaacagaggaataggaaaaacacaggattctgacaggaattaaaatgtaaaacaaaggattgcaa

SEQ ID NO: 90843 - DNA, 572 bp, Oryza sativa
tgcttctatactaactgtagctttgaaaaatggcagcaatttgcaaaccagaacatcacattaggggaggcaatactcactggatatggattattcaaggagaaatactggttctggattggggttggagcattgtttggttatgcaattgttttgaacttcttattcacattgttcttgactcttctcaaccgtaagtttgtgctaacttcatggacccagacaacttagaactgcaatcaaaatagtttctcattctcacaactggtgctccttcacagctattgggaatatacaagctgttgtgtccaaagatgatattcagcatagggctcctaggaggaagaatggcaaattagccctagagctaagatcttacctgcactcagcttcattgaatggtaatgctagataatgaatccctgtacttacatcacaattcatttttacccttttactaagtcttcatattaactgtgttccagggcataatctcaaggaccagaagggcatggtgttaccatttcaacccctttctatgtgctttaagaacatcaactactacgttgatg

SEQ ID NO: 90844 - DNA, 1052 bp, Oryza sativa
acatgtaggtagaatgcttaatttgtttaaacaccaacgcaacaactaggtgcattatattcagttattcacttggcagaagttaagcacaaatcagtgtagtaattaactaactagcaagcaagcttgcttgacagaattgtcaaacaagaagactgctaattatcatcttagcatcgttgacaatctataataatcaaataatatcattgtctagttacctattggaaacttggaatgtgttcaccaagagcacgcaatatcggaaagtaatttgtcagcacgaacactttgtgtcacataagctgaacacacacacaagaagtgcagaaatgtgaacaaagagctataagaaactaaaactttattgaacttgtagtagagtacatttggatatcataagaagaatctgaagatctaattaagaagaaataaagaagaagaagaagaagaagaagaagaagaagaagaagaagaagaacatcataaaaacctaagaaagcaacaagagaagactactgagtaattaagagaggcgattgatcgatgaggtgtagcagtgtagctagctagctcaagctggcgtcgcggcggaggccatggccgacgccctcgttgacgccggcgacgagctcggcctcgaagttggccgacgacatggacggcagtcgctcgtacacccgcgacccgaggtgctgcagcttcttctgctgcgtcttcaccgtcttgctgatgatcttgtagttccaccgctgctgcacgtacaccgccgcggcgagcgcgacggcggcgagcgggatggcgacgtcgccggacctggagtagaagtcgaggctggtgttcacgaactcgtactcctccgcgaagtaggggttgatcgccggcgccctcacgtagtcgtacacgtgcggcagcagcctcaccgccgtcaagccggcgtagtaccccgtcttcagcggccggcagttgatccgccacaccacgttcccgatcacctgggggagcaggaacatgtcctgggcgagcccgatgtactcctccagcgtcaccgc

SEQ ID NO: 90845 - DNA, 2924 bp, Oryza sativa
caagtcggactgacgagccgaggaaggtggtaccctctctcgtcatagacggtagcagagacgagacatgttggaggatgcaattggaacccttgcgtcgccaccctcttctcatctcctacctcgtcaccatcactgcacctttctaggtttggctcgccaccatagtcgcttggatgattccttcgatgtgggaggagagcctcttgttgatcaactacaccgccttggggctattatggccgtcgtacacgccgacaaggccaccacctgcgcctggtcctcgagtgcctcgttgacctgggccatggcgacaaagtagtctcccaatgcaggaagagaagagggtggggacaaagcagtctcccactgtagggagagaaggaggggaataaaggagagccctgacacgtgggctctacctgttgatgctgccaacataccacgtcagtagaaaccgtttctaaaaccaacaaagaagtcaatttgaaccggttttcgaagatggtagatgtattatacctggttttacggttgagggaagcaattcaatcaggagcgagagtgaggaagtcatgataaacttattccttttctgagacggctgttaaatacggcctggcccataatggtccatcactagtatagctaaaactgtattcatgggcctgcagttgattgcaggctaaaaccgctgtaatactgcgtaatcatcaaagttcatttttaaaagtgtaataatcaaagttcttgcaaataaaagagtcaaccgagttgatatgtttgtctccaaaaatattctcctatagtcaaaatatggtgaaaagggtgttatttatgcgaagaattaataaagaactaaattgactttgaccagtagacttttataaaacatcaagaatctgaatagccatcgcaaaaattcctgaaaatcgatgcggctgttgcttttcaaagtgtcaggattgcttctacagcggtaaagctgcaatatattccctggacgataatactatatgacgtttcggacaaacaaaataacttgcgcttaatggattttagctgtcggaaatatcaagtaatctttgccggatggagtacttaggctgcgttcagaaccctatgttcccagcacaagctgtgcacacgaaaaacggaacggtccattagcgcatgattaattaagtatttactattttttttaaaaaaatgattaatatgattttttaagcaatttcgtatagaaattttttgaaaaaatacacctattaacagtttagaaaaacgtgggcgcgaaaaacgagaagagaagttggaacaaaggttctgaacacagccttggtaccaccaagcatatcattatcccattggaaaatttaatgtcatatgctatatttgtgcataccaaaacataacaactactattaattagaaccattcacatataatcacattaattgcagaagcaaaccctgcattatgcattattggtggctcttcacaattctcaacttaacaacaacaacaaacataatctcccaaacaattacatctagctcatatttaatctctccaccatcacataattttgatatttactactagtactaccggattattaaatcaggaacagctgagagtcccaaaaaaggaagaaaaacaagagggagaaaaaaaaaccagcaaaagcaaaagcaaagtaaagccctcacattatccatcgatccatagttccatacatatgcatcacatcaacgagtgagacaagctcaagctcctgctccttctctggtcggctcggctcggctcggctcccgttctccgcgcgcgcgcgccaacaaaaaatcacttttccctttttccaggtgacgctaattaatctcccggattagcgcgattaattaagctactagctagtattattactaatgagtaattaattacgacgcgtggtgatttgattggttggtttggttgattaattagtagttaatcgctcccgcgctcgtggtggtggtggtgttgatctcgtcgttgtcgtcgtcgccgtcgacggcgtgggcgttgttggtcgccgccatctcgtcgtcgtcgtcgtcgtcctcccgctcctcgccctcgccttcctcctcgatgctctcggacatgtcccttccggctccggaggcggcggcgccgccgccgccgccgctgccacggcggtcggagtccggggacccgagcctcgccgacgccgacgacttggcgctgtagggaggggccagctgctgctgaggcggcagcggcgggggcgggggctacggcgcggtggtgcaccagggcggcggcggcggggtggtgctgcaggtggtggtggtggtggtggtagtactcctgcgccgccaccgccgccgtgtagtgcggctgcgtcgccgggtgcgcgccgtagatggccggccccgccgcctgcgtcgcgtactccggcggcacccagatgcctcccagcaccaccagctgcggcgtcgctgccgtcggcggcgccggcgacggcatcggccgtcttgtgtgcaacctgtacttctgcccaaacaaaaaaaaattcagatcaaaatgctcattatggcattcatgtctagcaatcagttaatcatactgtcttgtagtcaatgatcaatttaaacagtatttaattaagaacgtacgtgagatggatgaattgcatgatgagatgataattaccctacctggagatggcttttcacctcatcattggtcaatccatcaaccttcatcagctcgcgaatctgcttcggggtcgccactttaatttgcaaagaacaaaacaaaaacgcaagctcaagattaatttgtttgttgtcttttcatctttggtacggcatgtaatcatggtgttcgatcttgatcgagttacatgtgtaggtgta

SEQ ID NO: 90846 - DNA, 534 bp, Oryza sativa
caccagcatcggcggcggtgccgcccacttcccgccgctgacgttccagcggacggtgcacccgatggagctgtggagccggttcggcgtcaccggcggcgagccgctgagcttggcgtacagctacaccaagaccaagcaggccggcgagttcctccggcgaagcgagccgttcgacttcggcaccgtcatcgccaagtcgctgctgagctacccgaggaaatccggcgacgccgccgacgagacgacgagcctctccaacctcgccgaggagctcacgctccacgtcgccgccgtgccggatccgttcccacgcggacgattcgagcggccattccttcagcttgaggtgctctcgctcggatcgctcgtcggccgggcctcgccggcgacgtttccggggacgccagctgcggtagggcaaagcatggcatcatcatcgtcgtcgacgacgacgaagctggatgcgacggctatcctcaacgtgtcggcggagctgacgatctccggcgacgcgtacgtgaacgtgtcgac

SEQ ID NO: 90847 - DNA, 1176 bp, Oryza sativa
catatcattcttctgaagatcacaacactgctgatgaaatcgcttcagacgagcaccaaatgcaaagcagaattgatgatgagagctgcaggaatgagatcaccgaatgctccgatgagatcgtcgaggtcggtggcgatggtgctactgagcagcaggacaggtgcaggaacagctttgagatcaaggagaggggagaggagaagaagatctggttcccaaggtctgacagctccaggggtttcaggtctctgccttcctcaccttccaagatccttggaatgagaaggggtgtggagtgcatgagcaggaagcccaaggtggtcggcgacgacaatggcagatacggctatgaagattcagtgtccacaagcagcagcaagttcctcaccaggtgcaagcaagccatcaagaaagcagtgaacaaataaacaattctttgcaccatgatgcagcacatttcaacctgtttattcttcaaatctgtgtgtttaaattcgtgtcaaattgctagttttgttttctgtagctgaataagttagtactcaagtgaggcatacatagctttgcagagttccttctgcaactagtgagacagacatttactgttcatggtcactattatgtgatcatactggcgttgtacaactatttgttgatttatttatgaagagaaactaaattcttaagtccatttcgtcctcgaccaaaccagaaatcttatatgcttccctctctttttagaacatcacagatttatttatgcactcaagtgagcagatttatctgaatggtttcaccacaaacaatagttcagacagaaaggtaactgactgtaattaaaggtagtaaaacagattaacgacccacttagccatcagctttggcttcagaatttcagatcctctcatgacatcgacttgcgccatttcggcgtcggcgtcgcggcggcggcgccggcggcgccgcccctgcccttcttcccgctcgccggcgtccgccgctcgatgccgctctcggagtcctccacccgcgcgacgtcggcgctcatgccgccgaaccataacgtgctccacttgaagaacccgccgccgccaccgctgccgcctccgccgtgccgcctcctgtccgtgctcagcctgtccacctgagcctgcagcgcgctgcactggacct

SEQ ID NO: 90848 - DNA, 1076 bp, Oryza sativa
ggggtttttttttcactttctagaagtccggcaaccatcttacacgtttgcttcatggcctgcctatcatccctccttttaatcattattaagattctatttggtgttttactaatagtttttatatgtcgtatcaaccgccaccactctactcttttataggcttgttacttaatttatctcatcgtatgttttatatggtcttttttttcaatagtctttatttttatcaccaattttagttatttataaattgtattcctaattgaaatattttttatttttcttattttagaatttattttttaaaaaaattatttaataccatatagcattcttttaatatttttattttttatttttgaattttagttgtttcaaaattgtattcttacttgaactctcttttagtttttctaattttggatattattttatttctttattctgaattttaattaatctcgtattgggttattatatggatccttcttttaatattgcttatttttaattccgaatttcagttaattttaaattgtattcctacttgaactcttattttctttttgctaatttcggattttatttttatttttattccgaatattaactaatctcgtattgggttcttatatgtactcttctctcaatgttccttatttttaattccgaatttcagttaattttaaattgtattcctacttgaacttttattttattttctaatttcggattttattttatttttatttcgaattttgattaattttgtattgggttcttatatggacacatctttcaatatcgcttatttttaattccgaatttcagctatttttgaattgtatttctacttggactctccttttctttttctccgattaatgtgagaatttctagcttccacagcgaacgtggtgcctcctttcaagactgttttaataatataatagatagattatttttcttttttcactaatgcgcaaaatgattacatatcaatataatagaagaagaagaaaagtaaaatagaagaagaagaaaagtaaagtttaattacacaacacaagcag

SEQ ID NO: 90849 - DNA, 2644 bp, Oryza sativa
acaacatcctgatgcaaaatgctagaatctggtctggctttattgaaaggaagaaactgtataccccttggtatacgaacaggtaccttttgagcatttcctgatatgccagcaaggtttttaaggatggaatgatgtttgataggaacagaggttgcaggttcaccactgtatactgttgaagttttctgacgacttgtttgctcttggcaatttgctttttcaggtactgatgacgcattagatttctttgcatctggtgtggacggaccttctgcagttggtatctgacaacgagtgcaaagcttgcttaattcacagcatttgctaatattaaaatttaaccaggctataacaccaataattaaataagagtgaatgatttgttaaattacgtaccacatgagaaaatttgcatttatcacctctgatgcacattccattttccataaaattgtggcaagggtactttgacaactcatgatcataagggcaatcatctcctttcaaacaagaaccacgtgcataatgcgtgcagggctgtcaaggcaaaaaaaaaatcaggataaaattcgcaaaacctcaaaaggacagatacaacaggaagtttagtaccaatacttggatcaagatttgggtacacttcagtttatgatttagcactatactgatacgtattcataacatgtgcagtgcgaacctgttctgtgcatgctttaaagttcaaattcaatattgatgtcacattttcatctaaaaaataggtggtatgcataggtgcgtacaaaatgagctcatgcttgcgtgtgggcagaccacatagaatatatccacacatattaaacagcatacatgcatcttattataatacattatgattactgcaagcatgtgataaacttctatgaaatggataccttagattttgtcaaaggtgtcgtatcatgggagaacttgcacaaattgccctgcaataaaaaaataagaaatattaggtactacatccgtttaaggttataagactttctagcattgcccacattcatataaatgttaatgaatctaggcacacatatatgtctagattcattaacatatatataaatgcgggcaatgctagaaagtcttataatatgaaacagaggaagtattttattaaagtaaatcctgtgaaaagcatttttacagtctttgtaacatatttatatagaaaacataacacatatacaaagaataaagtggacatgttacatgatgaaaacaatatgattatataaacagtgttcatcatggtctaagctctcaggcagcacaccagcgcctaatcagcaaatagacagacctaggcagggctaatcgttaccaggtgctatctagtggacactgaatcaaaatatgcatcctatgctactgatatggctaatcactaaattacacaaatataatcagtgtgtccagaaaatcgctacaatatgtttcaaggccagggcatgtgctgtgcagtttacaacagcaaagaatataattttttgtcgatccaaaagtgaagcagatgatgactaccatctgtctgatctgagagacagactcacctgctggcacttcccatgcaagtagaagtggcaaaccttcaccactttaggctttataactggttgaagtttcagtcttttcaccccttcggcttcccgttgcaatgctctcttaattcgattagttctctgcatattaatagcattgaaagcaaatcttaatactttctataggtaacaaactatactgaatgcacacgttcaaaacaagtgtatactatagcaaccaaatggtcactgagatcagaacataccgtcttcttagctattctctcctctgtcaaggtgacgcttcttgtgtttccatgtttgagagcctgcaatattaatatagaacagactgaaaatccatacttacgtagctaagaagaaaatcttaacacagacgaatcaattgtattgtatattgttcttaaaaatcttgcattgtaaattgactgtgattaacttgaagttacaaagaaagtcatgaagtgtgaacactcgaactgcattcattgtactcaagcaaggtatgtatgcgatgattaaaaaaagctactgaattcagttaatatgaaacatcaaacaagaattaatcaaaattgtgcataaacaatgaagcaacaaaacagcgtatgggtaccaaaaaaagagagaatatggcaagcttgtacgcatttgtggttgacaaagaagctataccttatcatcaggcaaaggtgtctcattccaatcgagaacttcatcataactgactgcttgcgccctggcaacatgcatttgagaatcacccttgctattacatagcatgttccgtgcagtgtcgccatttcctttttgaggtatcaaatgcaaattgctctttaagtcatggccacatgacccatcctcctctatccttctgctatcaaaatcctcttccaattccacatcatcttgaagctctgaattgccagaatcatctgcatctaaattctgcgtgtcgccctcaatctctccttcctcaaaaccaccaccaccatccagtgacccatgatctaaactgcacacagatctgtcattgccaatcc

SEQ ID NO: 90850 - DNA, 2408 bp, Oryza sativa
atagctggctttctgggccttttcttgaccttaaagcaatgctttcggaacgtctctccacttggatcgagtgttattattattaacaataatattaaaggccttgatgccagcattcacttgttcaatgaaccaaattaaccacttcattttgaagtgttatatcatctacataaacatgatcatgttaaattttagttccttcagttttttattccctccttttcatattataagacgttttgagtttgtcctaagtcaatttcttcaagtttgaccaagtttatagaaaagcataacatctacaacaccaaactagtttcattaaatccaccatcgaatatacttttaagtatatttgttttgtgctgaaaatgttgctgcatttttctataagcttgattaaacttgaagaagttttacttagaacaaacccaaaatgactaataatatggaacagagtgagcattatgtttacgggtggtaatgggcttggcccatgggtcctttcacagcccaattttctaggctaaaatgttgggccctttaccacccttaattctgttaggtgtcatacatcaggaattcaggattacttgcaaagtggcaagttctaccttgtattaaaatgcagctgtcatgtgtgtgagcactgagcagcaaccatgaaactatagcagcagctttgttggttgtcatctaatctcctatttgcaaatcttatttagcaacctggagggatatgatattatctggttgagaatgtctatctccaattgttaatttgttaagacaagctctaaatacacggacctttcttatgtaataaaagatggagcaaatctaagtcccaaccccctttgtccgtcccattatctagtctctactctattcccttctttagcgaaaccagctccacctgctttgtatgtatcctggtgtttacttcatcatgatctaaggatccttacagtggaacagtaaggagtcaagggtatactaacaaagtggaaagttctacctgtcaatagtagcttccaagttttaaatgtgaacagctctggaactgttcttagaatcagagagcaattatagtgttttgaacactaaggaagtaaggatttctgatcagatactcagacctcaaacaaaagggcttcaaattgaggttatgtacgttactgagtttctggaatgttatccaagcaaacagtactacgaaaagaaacggtcatcgggttgaagaattaagcaccttatttcttgtttgcagagcaaattgataatttggggattctctgaatcgctgggattaaggaagctgaagttggagcacaaccattcaaacattagcattaatggcacactaaataatcaaaataaaaaaaatgatcttcaaatagaattcaaatgaatgcatactcattaaactcggttttattaaggaaaccatggccatctgcatccgaagcattgaaatgctcctctttccaccatgggaaccccagcgaattaacctctcctgcaaatcattaattaaaacacttactccaaattgtctcatggattcgcttccagccttattgaactcgttttgaactcctggacagataaaaaaaccaaaacaaaaattgccacattaccactcgattcgttgtgctgagcccggaagtccccgtaggagacaaccccgtcgccattcttgtcgtagagctccatctcccgagcggagcggtggagctggtcggctctggactgctcgaggttccacctggtgagctcgtcgagggaggcgaagccgtcgcgcggggcgaggtcgatcttggggaagagcgcgcggatgcggtcgccgaggttgaaccgctcgtcgtcgttgatgaagtcctcgtcctccctgaggaactcctcccattccctcatgtgctcgtccgcctcccctccgccgccgtcgccgtgcaggatgcggtagtgctcgcgctcccactccttgtcctccagccgccgctccagctccgcgatctccgggtcgaagggcgccgcgtggtggtggttctgctgcttctgcggagccccgtttcctccggtgggtgcccccgcgccggccccggagagggaggggttcctggggtggagcttgaggcggcggtggaggctgcggccccggtgcgggatgctgggtgagtaggaggtgaggaggagcaggatgacgagcgcgaaggtgacgtagaggaggagggcggagaatggggacctccgccccgccgtggccgacggcggcggcggcatcgccggcgagatgggggtggagatcggaagtggggtcgggggctgagagatgtggggttgcgggttgtgtgggtcggcgattttggactagtgcgactgtgcgagggcaaggagtgacgtgg

SEQ ID NO: 90851 - DNA, 3303 bp, Oryza sativa
  unsure (1)..(3303): unsure at all n locations
aggtggtgttcgccggcgtcggtacgccggtgagaggtggcggcgaggtctcccggctaggcggcggcagatctggcgtcgccgtcgccggatctggcaagccctccgattttcggcggtggaggaggctgctgcgacgtgtgggcggcgacggctcgcgcagcggcgcgtgggcggagtcggtgctggcggcggccgctggctccggtggtcgaaggccagcgctgacggtggccgccgtctccggtggtcggcaaggtcggggctggccggggtctccatcccgccactactctcttcctcctccctctccacaaccaccctcttcttcccccccctcccctcattcccttattctctcttgtgatgtccctctcctctctgtgccgtcggcacaagcgaagcagaagtggaggtttccttcctcccttcctctcgccatcgctgctaccagttgatctctgctgccagttgtccaattgctctgctgctcgccccagcgctcctctctctctgcgctggtggtatcttggaggtggttgccgtagtcgtgaggttttgtcccgcgaaaccaggagttcctcgccggagacatggttgacaccgaggtcctgggttcccctgactccaactctcagctcctcttcaggccggccaggtctcctcccctccgtgatgcttctcccttctgttggccgtcttccagacctggccgtggagtctttcggtggttgaggagaagtgttcgtccttgaaggtggtccagtccgtctgaagtcagggctcttatgcctcgccagtgcttcatgtgccctgtgactatgtggacctatcttagtgccgagtttggagcggtgtgtttttcctcttcggtgctgagcttttgtgttaaggcggagtcgaagctgctgcatcgggtcagccgatgagctaggcaacgacaactcttaacacttttgctttggcttcttggaggtcctacaccttttgagggagtcctaggcgaaagccctgtctggtcttccaggatcggcgacatcgacgcctgcgggtgccgtttcctccttggaggtgttgtcttgtggactctttctccctttgggtgaaaacccagtccagttatgggcgggcgtgggcagcggcttctgtcgttgttcacctccttggaggcttcgtcttgaaggtcttgctcctctctcggttacttctgtggttcatagttttgtcacgggttttttttgtgtcttctgtgtaaggttttgccggttttcccttagcaaaccgtgcagttgtatggttttctggcccggtttcccttataaacagggtcaactctcttcttctaatatatccggtagatctcctaccgtctactgtttcaaaaagatagtttgattgacttgaggaagggtgtgacgctcgatgatctaaaaacatatattcggtatagagaaaatggggaatgaaaagaatagaaagagagcgaaatagtgtggtgatagtaaaggcatgtggtttggagatgagatctctaaaccctgcgaagtgagagtagcaagcgggggaagaaggatcgatggagcagcggtcaccgtcgatggcgttcctcgttggcgtcgcttttgtggctaaattcgtacacttgccctttacttggggctgcaaaccaagattgtctgcttgcagaagaattagtgaataaatccatatacacaaactatgtagaatacaccttcagatttcaagtgcattttgagaagaatcacacaattaatccatgtatatatgtgtaatcttattaaaagaggcaagaagcaggctgcttggactgccaatgattgtagtctgagcataggcagtaagaaaacatcaatttaatgggactgtaggtagcaagtaatacaccacaaattacatattaactgaaacctcggttatgttatggccaaactgaaaacataatacagcggctagaagtaagagtagaattgagtggaaaatttacccatatcatgaaatccaagggatgtacgcaaattgtctctctctgaattgatactaacaaaaaggtgtcaaaacagggaagaagcccatgagtaccagagcacttagtaagcccaattacaccaacatcgcaatgatctccaactgtccaaggctgaaaaagaaaagatatcacattatatgttaaaaaccaccaccatcaccaccacaaacaagtgagaactgtgtgccttgaaaaggaaaattacaacattacttgattaccaatagtcaggaaaaaaatatgtatttcaagggagagaaacactaacaacgtccatgaccaacaaaagcctcncanttaccatnnntctgtgggtaaccttggatnnaagcctcaagcaatggagcaaagtcaccatccatgctgaacatactgcattttatcaacaagaagatcatctgagttggttacgctagccattgataccaaaataagtgatttttgaatgaagaaatttacttggaaatataacttgtctatgtgcgaaaaaaagaatattttccattgattaatgggacctgctagtgtaatcacaaacatagtttataactaaatcaattagtgcttaacattatgacatgtatgttacgactgggaagtgaaaaaaatacccatggatttttttttaagtcttacacttactggaggatgcgaagcaagcagagtttaatctcaatgacctccgattgtccaaggctgaaaaagataagagattacattatatggtataaaaacccctaagagcacaattcacattttcaggttaatcaagctaagccattaaatgaagcaaaaccaagcatcagcgcgcacctataacataaacacagatatacctcaaggatgcccgttgggataaaaatttggacgggtaaaacatcacaaaggagatcaaatggcagctacaattaggattgccaataaattaatactcacatgggaaatgagcaatgaaactacacccgcagtgatccagttgagcaccgtgaaattatttaggttacatgcagatgaaactgcagagcatgaaaacaaaaaatgaaaattaaatagcatatacaacatctgtaggaagttcaaaatatcatataacagcaaagaatcagctatagtacatgcagccaaagaagcaagctatagaaggggcatgatttaaaataatggtgttagtattagtacctaatggcacaacggttatcatgtaagtaaatcaatattcctgtcatgcttctgcttgcctctcacctgcaaccttt

SEQ ID NO: 90852 - DNA, 950 bp, Oryza sativa
acaacagcaacaagaggaagcgcagcctcccgggcaacccaggtgcgttcttgtatagctagctcctcgatcgatccgggctccgttaattttctcggcaattaagcgaaagcaattgatcgaacctatatatagacccggaagcggaggtggtggcgctgtcgccggcgacgctgatggcgacgaacaggttcgtgtgcgagatctgcgggaaggggttccagagggaccagaacctgcagctgcaccggcgggggcacaacctgccgtggaagctgaagcagcgggggagcaaggaggcggtgaggaagaaggtgtacatctgcccggaggccagctgcgtccaccacgacccctcccgcgccctcggcgacctcaccggcatcaagaagcacttcttccgcaagcacggcgagaagaagtggaagtgcgacaagtgctccaagaagtacgccgtccactccgactggaaggcccactccaagatctgcggcacccgcgagtacaagtgcgattgcggcaccatcttctccaggtccttcttcttcctccctcctcctccatcttgcttgcttccatccatccatggcgatcgattgcagcacttgcactcctactgccttctgctcagatatacctgccttggctggcttgccgtgctcctttctcattgccactttgccagtaatccagtgttctcgctgccgcctgcgctttcagttggcacagtgacgagtaggaatcgaagcagcctataagatgagcgtttgttagtgttaacacacctgtaatcatccaataattagggcagcgatagatataccggttgttgattaaccagcaacaaccatgtgcccatccctgccgcgagcatctagccgaaaagatttgtgaacagtggcaactagtacgtagcttagctagctgctcgctgcagcagcgaaacaaaa

SEQ ID NO: 90853 - DNA, 3860 bp, Oryza sativa
tgcccagcctgacgcagaccacgacgacatgactgtcatcgacacgctgtccacgcactccgctgctccgccgccggattccccatcgacggccgcacctccttccttgccgtcggctgcgtgttggtgtagtccggctgtccagaccaccgcgcctccttcctgcctccgccacaactcccatcgcgagcggaacctcgccacgccggcagacgacgcagacgtcgcggcgcacggccaagccgttggcgccagcctcaccgaggaagtcctcccgatgctggaggaggtgtgatttatggcgggggtgctccgccagctgctccggccgccgccactctacctgccgcccgcccgctccgccactccatcctatttcaggcgtgcacgggagggagagaatagagaaaagaggggaaaaagtcgagggttcactgacatgtgggacccacgtgggtcccacgctaactcagctgctacatcggacaaaaccagtgtcaaaaccaccgagagacctaaagtgaacggttctataaattgagggatgtcatatatctggtttttcggttgagggatgattttgtaactcgattacaagttgagggaccttcggtgtactttttccttctcaaaaacaaaatttaaaatgtgaatatcatttaggaataagttcacttcgtgaccctcaaaagtgatcgaaatctaatccgtgaccctaaattacaaaaccggatatctcgaccccctaactctcgaaaccggtgcaatttgactcccttgttttggaggacggtttcgctgacgtggcgcctacgtggcggtattgactcggtcttctttccacgtggcgcttaggtgatgttagaaataaaaaatatatgtgggactcatttgtcattcaccaaaagtatgggtgggacccactgacatgtggggcccacgtaaatcattctctcctcatcctccccctctctctttctcttccgttggcgagcggcggccgtgggatgggggccagcggcggagatgttccggcgaaacagaaacgacgaggaggagcggtgtggcgacgaggagcagccgcggagcatgattccggcggcggcaggcgggtgcctttctctgagccgtggcatagagactggagaaattctatatcagttcttgattcatctcaccggtgattgtcatgcaggcatcaccgctgtatatctcggagatagccaagatccgctgtacatctggctgattatcaaatataatcaagcttagttactaactaatggcagatttagtttaattgtatagtaagagctgtacctggatgctggattggagttatggcaggctgtggtggcgcgagtcagaaaagcagtagccgatatcggcgtggacgaacacccaaagcagctcgtcgtgataattgatgccggtcgcttcctcctcgcccccacatgcgttccacctcttcctccacccggtccaccgcgtcctccacgcctgcctcaccccgtgggccgccacgacgcgctacctcgaggccgatcggcctccactgcgccatcgccatctccgccgcaggaatcatgctccgcggctgctcctcgtcgccacaccgcttgaagaaggaaggagagcaagagagaaggggtcgtcgtcgccgctgctccagcgcccgccctcccgcctgccgccgggtgcgctggcaacgtctccgcggggaggggtgggggaggccgacgacaacccgcgggagaggggtgttggtgatgccgtctgtggcggcggccaaggcggtggccggcggcaagtcggcgcagactccatcgtccgtggagaggagagaagggaggaggaagatggggaggagaggattatgtgggctccacatgacaggggctcccacatttttttccgtgtgtatgacaaatgggtcctacacatatttttttatttctaataccacgtaagcgccacgtcaacgtcacgtggaaagaagaccgagttaaaaccgtcacgtaggcgccacgtcagcgaaaccgccatccaaaaccacccagggagtcaaattgcaccggtttcgagagttaggggttgagatatccggttctgtggtttggggtcacggattaaatttcgatcattttgagggtcacaaagtgaacttattcctatcatttacagccagaccggcccaacctagctaggagagcaggctttgcatggcccagttctggcccatgtttagattcttgaaataatctattggcagcggttggctggagaatttgcatagacagatcttcctcctttcgtgcaagacatcgattgttaattagcccgatggaattgacaaagatttgggcaagaaaagttgcgatccttgcaaggtgttggattcgacttgtataacttgaactgcacttctttcatattccttcgttaacagttggttactagtcctaattaattcagtagcaattgcccaaactaaactttacgacaaatctccagctagacacaaaatgttcttttgaatgaagcggtccataattactgctagatagcattgctcaaagctagacggcagtgatttcttttgaatgaagttttgcaaaatgaaagagtggacaattgggcatccttgggaatgttggtaggactaggaatgcagctggtaaatcttgatagaaaacaagcacatgttttgtcaaagaaagaaagaaagaaagcatgctctgacgaaaaacaatcaagcagagaaaaccatatataacaagatatagagctagcctcatcgccgaaatgcagcggcactagcctaaattacatctctgctcaactacaacgatcaccttctcccgaattaactcagcaatatggcagtattgctccatccctctccaagaagtgtctgcttggcctttgcaattgcagtgtgtcttttgctcccatgctgctttggtagtgagtgcctcaataattctagttcttcttggttttctgcatgataatcttcatgctgctagctagctagttggtgccattgcataactacattaggatacagcatgcatgtcagcaacaaactctgaagttagccacagctttctctaacattaacacgatcgttattaatttcatcgtcgcatatgcaggcaaagctgccgtggaaatgttcgagaaggcttgccattgcttcgacgatcacaacgtaagcacatatatatagctataaacagaatcaagttaattaattaactgttaactgtttataatcaagtgtgtttcttcatgcatgcatgtcgcaattgatcattgaaccgaattaataattttgaatttgcaggtgtacagcgagtgcaaggaggagcttcggctgggggtggagggggcgttccatgtggggaaggagagcgtggacgagtactgcggtgggccgtgcctgatggagacgaagatggcgctgcagtgcgtggaggaggtcgcccacgacggcttcaggttctacagcggcgcctcgctgcccgcggtcaaggccgcgctcgacaccggctgcagctacactcctgacagaggtaaattatagtatattaatttagtccaacaaattatatattctcctttcctgaaaatatttttttttaaaaaaaactctcaagatcacgtgcaaaaaaaaaaagtttggacaacaaaaactataataggatatctctctgtgtaaacatgagtgtttaaattgtttaaattctattgacgcgcacaaattaagaaaatatatagaccgcagcatgaaatttctcaaatgtatatggaaaaaaacgattttataaattattctagtataaaattacacattt

SEQ ID NO: 90854 - DNA, 2196 bp, Oryza sativa
tattatgttgtatatgaggtgatcggaacatgagatgaaccgatggtcacccatcccaaattgctccaggctagtatcagagccgccttgtatagtttatgatctagatcagtgcatatagttgatgtgcgggtgtagtagatgagatttattatgttgtatatgaggtgatcggaacatgagatgaaccgatagccgcatagctttcataggtcatagactgccctcacagaccaacacatatcttttctgcacactttgtcctcactcgtgtgcacccgggaagaatttcccgatcggtcacccatcccaaattgctccaggccaagcacgcttaaccctggagttctttggagattggcttccggaaaagaagttgcaacttgttgatataagtattctattaatcctattaagccctaggccgggatgttacaccctcccccttaagagagatcgacgcccccgtcgatcaaccctaggccaggaacgtcctctcttggccacgtccatgtgtccagtgccagcgcatgtgccatgctgtgtaaccactcccggtctacaccagccatgcgcaccatgcctgcgcaactgcgacacacgcgcccgtgaaaccgcgagattcggctctgataccattttgtaacgtcccgccttcccccaggccgggcccgcttacatctgatagctttcataggtcatagactgccctcacagactaacacatatcttttctgcacactttgtcctcactcgtgtgcacccgggaagaatttcccggtcggtcacccatcctaaattgctccaggccaagcatgcttaaccctggagttctttggagattggcttccggaaaagaagttgcaacttgttgatataagtattctattaatcctattaagccctaggccgggatgttataaatgtctagtactcaccaaggccaagcgcgattgtgttcatcggatagtccgatgtccactggaactgcacgccaatgagaaaaaacgagccaatgagattgactcggcttcggcataatttgattacgccgttaaggttttcacatagcgaatcgtagatgagatctatgtaccccgggactgccgtgtgcgttgccccttagatttcgcttggggtttttatatctatcttacctttattgctgttatatatttgatatgacatggtaggatagattccctcagaaaaattaagtgaaatttatgctctttcaataattgcacctatttcggttgtgatcataagtgatgggtttgacatagcaaagtgtcactttttatcatgataaaataggatagatgtcggacatctatatgcggagattattggtttacttgacaagggtatcaaaacaattttggaccttggggcataggttgggttggacatggagatgtcaccccaacaggacatggagatgccctcggccggcaccacctcgcgccgccctcgactgctgcgcgccacactgcgctggctcttggtctgagagtgagatagatagagagagagagagagtgaaagagagaagactctaagaggagaggaagggaaggactagaagataaaaggataggtgtgaaaaattttaaactggtggagagagaaggaagagggaccatttttacatgcggaccacttaagcgtccgcatgcaaaaatcatgtgttttttaaactttaaattgatttttatgacattaaattaactcatatcaaaaagttgtcaaaaacaaatttgtagaatacattgagatctaccaattttattttggttatttctccatccgagtttgattggactatacaaaatttgagttttaaaatataacaaattaaaataatttttcgggtagtaaatgattttaaatggaaaagtcatcaatagcaaagttgtatagctcatcaagatctacaacttttgttttggtcatttttatatttgactttgtttacacagtttgaatttgaatttcaaaatatgacaacttcaaacaatatttttaaatactaaacgacttcaactgaaaaagtcataaataacaaggttgtataactcatcaagacctataacttctattttggtcattttttcatccgacaaagtgatttgcaagattgtttacaaaatgtacctctcttatatagttttataagaatatataagagatgta

SEQ ID NO: 90855 - DNA, 1743 bp, Oryza sativa
ccgcggaacttgatcgccgctagatcgtacgtcctgcgattgggaaaggagcagaaaaacaaaggtaaaaggagcagaagcgagaaatgcccaaaacaagacgaatccaataccaaacccgtccatgctgctcttcttttgctccccttgcctctctctcctccttcctccttcgttgagctctcgaaaatggaaagaacgagcaggagacgaggaggcttaccatatgtgcgattcccatcgcccggtgcggcggtagaacttgacgccgcagtactgcgagctgcgcgaccgcggcccgcgtcggattgggcgtcgcgtcgcccgcctgcgcccagcccgccgccaccacgtcgccacaccatcccgccgccttttcctgcctcgccccaccggcacgaagggggcggggaggacggcgagctcgcgcctaaccacacctcctcctcctccgcctcaacactcccagctccctccctcccacctcaccaccatgccccaccgcggcggcgcggcgtgggcgagcgctgcgcagtacggccggcgtcgggaaagggcgccgacgacaaccatgcccgctgctagggggccaccacctccgccagccgccgcgcgcgtgcccgcctgccgccaccgccgctccgcgtctctgcttcgccggccggcctgcgagagaagagtgagagagagagatgggagaaaggaagaaaagagggggagaggggggttgacgtggcacgctgacatgtggggcccacgcgccacgtaggtcaaaactgggtcaaaaccaactaaggatctcgggtaaccggttttgtataggtaagggaccatgtatatctggttttggggtttaaggacgtttttgtatcgcgctgacaagttgagggaccttcggtatactttttcccatgcaaaaatgagctcatttttgcatgtggccctcttaagaggcccgtatgggaaaaatcgatttttccatacgggccacttaagcggccgtatgggaaaatgaccctcgatttttgcagacgccactagttatgatccgtttgcaaaaatcatggggcctcgtgaagaaaaataacttttatagtagtgtatctatgtttttttttttttttgctttatctgcctcatgatgcactcgtatggacgaagaattagcgcgaaatcgaacggaaacatgatgaggatcggaaagttaccgattttttaagtagttaagatattgtccgtagtaggtaccaaagtttctataatttctgtaccctaattcagtttttttttttttttttgctattccgatacattttgcgagaaaacaacgtatgcagcagtactttattttctaatttttgcgacgaacattgaattgacattgacgtagtaggggttttaatctctatagagaatcaagggggcagcataccccaaataaatggaaaattaatcagctcgtatctgatacgggtgtaaacgatggtaataaggtcgtgatatccggcctgctatctggtgccatgcatatttctcagcatttacagctgacgatcgagcacaaaatcacagggatgcaacgatataatatcttaccatgtgtaggcaaataatcagtacgccttcccacagccacgcccgcctataaataacgggccggcattccaccgtagcaaatcatccattctcacaagcatatagccactatcataacaaaagcttcaagaattcgtagctcatggc

SEQ ID NO: 90856 - DNA, 2067 bp, Oryza sativa
gcttgatgaagcatggtgagcacataggagtttgagcacttaaagtcagtgcatatagtggtcagaatatacagtggatgcatcatgcatgcaggggaatgatggtaaaccggtgcagattttgtgcctttctctttgtgtagctttactcggacacttccaggattcagggagttgagaaaatacttgtcggcaacgaaagatctgctctctgcttttagatgtcgtaacggtttcggattgcttgtttggacggttctgttatctgaggcttttgattggtctctcgttgttgttttgcgcaccttgaatctatcagtacctccaatcaaagtggggctgggagcttcacatgtgttgagcggaattgttgggaacttatgagatcgtgcacattgagaatggaaggaaagcatgcagcgtgctatttgctgttgcatgaattcgttgatgtatgataaaagcattagcatacatgaacatgtgaaaaaagccaacagactttgtgatgtccatgggtgtagtatagtgtgggtaatacttccaagcctggatttctgatgttattggtacacatttgctgaacctaaattgcctggaacatcagctgacgtacatgctttgaattcaaaaaatgttttagctgcattcatggatgctggcatatgtgtggcccgttatgctctgaagaatgccagcaggtcatcctatgtacgtggccaacagcattggtgcattgataatgcacttacttcgtactttttactgttgaatttgcatctttgtcaatagaagtttgatgagtagcatattttctgaaatgcttatgtctggactaaattgttttctactataccaagattcttcagaagctaaggtttattacatcagttctttgttctatcattactaggtagtgtaataattggaagcttacaacagattgctcagagggaaggttttcggggaatgtatcgtggtttatctccaactattctggcactcttgcctaactgggcggttagtctttacccttacattatagctccacttactccattgatgagatgtttttaaattctatgtaaaaagcaacgatgctaatgataatgctataagttgatctgcatgcaaacccatgtatggcaccgagtagagtagtacactacactatagatgaatcaagtgtctatgatctattgtggagctaatagtatccttgtggatttccaggtctattttactgtgtatgagcagcttaaaagcttgctttcttccaatggttagtgttttaccctgcatatgacttacttgacagcatatcatttgtcagttcttatgtggtatcgtacattcattttgcagatagaagtcatcacctgtccttaggggcaaatgttattgctgcatcatgtgctggaggtgcaactactattgcaacaaatccactttgggttgtgaagacaagatttcaggtatccttggaccacaacttgtctggaccagtagtcgatccaagacgcctgatagcataattgcaatttcaaaatgctgcataccaaatattttgtctggcctatattaggcaagtgtttaaaacctgtaagcaattcccatttctttcctaatgttgactgatggtctttacacaggctgaatgcccatttggaatggagctatcattaattataatcacttataaatatgctgaatttcttttagatcttttacctgtccatactaagcagtcaacatctacatgctatactcagacaaattgattcaaagattttattttgagtcatatcatcatctgtatccttttcccttttgtagacccaagggatacgagctggggtgatcccgtacaaaggtacacttgctgctttgaagagaatagcacatgaagaaggcattcgtggactgtacaggtagctttccatggaagtccacagatgcaagattttacaccgtttgatgataatatgttttgtgcgctggctgatatttttctttttcttttttataaagtggacttgtccctgccttggctggtatcagtcatgt

SEQ ID NO: 90857 - DNA, 662 bp, Oryza sativa
tcactagccccatttcctcccacattcttgctagtagcctgtccaagtttagctgcaaagaaatagtttatgttaaattcaagataaagaaccacaaaatggaaaagagaaccaattggggacagaaaactcaatacttctgcgtgcactgcggttttcaagatgctcacatcacacaaggcccaagggaagtaccagaaataacttgagaaggatataaaggtccccatcgtttggcatatgcttatgcttatcagccaaaatttgaattttcaatgttaaatttggagctgattttggggttttttcatcgaagtttatttttcagcctttgcttttggatcgataagaacacatatataaaagttttattcacaaactgctactcgtttgcaaatatgccatttggcatattctgaaaatatgccaaacgatggcagccaaaatttaactgagagagtaaacagaagatatataacatgcctgcaaattgcagctgatcacaagcgaatttggttgccgagcaagcttatccacatcatcaataccaacaacatcaatcttgttatatacataaacacattttatgtacttccgatttccttcaataacatcgatgaagtcatccacggtagcatcctcgcggaataacacctaaagaa

SEQ ID NO: 90858 - DNA, 3293 bp, Oryza sativa
ttattaatccaagtgataatatttcagcaatgtgtactaatttatatgtacacgtatgatactggattattggtggtaattaacaaagaagaaagagagagagagagagagagagagagagagagagagagagagagagataatgtggcatttactggacctttcgaagaggacggcgagcggcgcgacggcggcagcgccgacgaggttgcggtagacgaggaggacgagcggccgcgcggcgccggcgccgagcgcgagctccgacaggagcagcgtcaccgcggtgaacacctgcaccatcaccatccccaccggcagcagcaccgccgccgcgcccaccgccgccgcctgctcctcctcctcccgctgctgctctactaccgccgcctcctgctcggccacgccgaccaccacgacggcggcctctcccgtcctcgccggcgacgccatgtatattttgctttgctagctatagctagagctaggggcacgatcgatcgatcgatcgacgcgatacgaaatggaaattaagaagaaaagtgagacgcgacgagtcgatcgaggatgggagtgtgcgagaggcgagcgattgattgagcttgcggtggtataaatagcggggggagagatcgagagagagagagatgatatatggggcgcagaaacggacgaaggtagggatagatgggttggtggctggaattgacgtggcggtatatcagtatcagtgtgtgcatgcggcatgcattctcccatcggccggtcaacttcaactccacctgtccatcagtggaactggaagtgcgtgtggaatgcaaccggctaccacttacataccattgtcagcattgttaccatgtgtctagtgtgtaacgtaaacttcattcgcagattgcagaagtcaacatttgtcccgaaagcaaccatcaggcccttgttcggttacacagggattcattccgggccggttatgataaatataacaagaaatttataatagatacaacaagagaccaggaatatttattccgggtcaggaactaatttacttatattaggtataacaaaacatccggattagttccacacctcttgactagtggattgattccggtctattattgtccctatcatgagtaaattggttcccggcccggaataaatctcggtaaatcgttgtatatatcctaaatttcttactatacttgtcattctcggcccggattgaatccttgtgtaaccgaacaaggcctaagagtaaattttatagaatccaaactattatatggtccaagtttcttaaagccgtataaactttggccgatgacacataacctcaagtattatggttataacgttttacaaaaccacattactaataattttgagtttggtataccatgtacacttttcagttctacaatcacatctcaaatttatgagcattttattcattatataaatgttacattcatttttttatttcaatacaatagtatgtcaaaatagttaacggtgtggtttgtgaaactttaggagtatataatacctatagtttgtgccacatgtcaagatacctgtggttttgtgcaacttggactataataggtgtgtttaatgaaatttattgtatctttaatttatacatagtattcttctaccatgcttggtccataaatcaagaagtttaattttatccttcaatactttacctacttaaccaccaatactatatattttcctattaataagagactctttggttattttccttcctcgccgaagttctcttaggattctaatattcaacttacttacttcattcaaaacataagcactttgaggttttgcgcatggattatgaaagtaggaagatttgaatgaggaatagtatgattggttggtatgaaaaaatagacaaataaattaaatagatgatggttgtgattggtttccagttaaaaattcgcattgacaaatatttgattatacagtagccaaattgatacgaaattaaaataagagtataatgcattggcagcccttaattaaacttatcacgtcatgttatctaggttcttaaactttgaaaatgcacatctaaatcccaagactatatcatataggttcaaaactatcacatacccccttcgagtgctcgtgtggctaacacttcactcatttaatgacactcaatatgtgaacgtcgacgtcatgcggatactcaaaggggcatatcccagccactaatactggagaggactatggatcggacgtccaatgttttgcataacgtcggacagtgttgcatgacatttgtttcaaagtgtttcacatgtttcatcttttgatgggaaaatatttcaacacaatatggagaaaaaatgattcatcatatgaaaaaaatgtttcaactgttgaaaaaacatgtttcaacataaaaaaagatatatgtttcaacaattttaaattatgatacacaatccaatcaatactgaaacattttcttacaacaaatgaaacaccaattttgacctactgaaacatgcagatgattaaaaaaacaaccactgcaacattttagtctaaactaatgaaacatccaatatgttaagctgaaacatataaaaagaaaaaagcagcctagatatatttattcttcttctccagtggtaggtaggccaccatgttgatgccgggatcgatgccaccccccactttgcttacctatactccatgaagactctctattgccttctcctattgttgacgaagatgaggccgagctcaccacgccattgtcaagcaagctaacgctgagctgctcccttcatggccggtgtccactcccctggatccggtgccccttagatcaacgtaatagctaattcgacggggagacgacgctagtgagatgccagtgggtggtggatgtcaatacgccgccctaccgtgtcccggctatgcggcggacaacaagatgagttgtcgcccttgctggccatcggcgtaggtctctctatagctagttgctccggtgaatatggggacagaagagaggaaaatgaatggttggaaatgaggataaggttgactgccagggaaaaaagatggagagagtggttaggtgggaccaactaggcacgcgtcatcgaactcaaagggcgcatccttggctagtagattggtcagaggtctgacgattgtagaatagtcctcgatgaaccttctataaaagctggcatgtcccaagaagctgcggattcctttgatgttcacgggaggaggaa

SEQ ID NO: 90859 - DNA, 1883 bp, Oryza sativa
ccgacaacgatcctccagcgattatgtccagatagaatgcagactccttatccaaacccgtatggaaatgttgaagaagcacatacccgggtaaggacagggttggtccagactgcactaaattagtgaatctggaccaggctgcaccaattgattcattttcgatctgcttaaaactgagaatttctactcgtagggcagtaatacgagtaactgggaagaaggtaagacagaatttgtctcacaacttttcccaactaccgtttacacatccaacggtagaggtgtaccattgctttgctctctcttaaagagagaacgggaacaatttccaccgcacagtttcttgtctcatgccacgaatcttaaggcacgagcagacttgttcaaagtctcgcagatgatggtagggattttctagatcaaacccagaaaaaggatttttccctaaccatactgattagttcgggatgaatttcatagccagttgtataaatgggctctgatgaaggaggtggctcatagaattcaccccgaggagcagacagctcaaaaagcggttgctccatggtcgagaagagtttgacaggaatacttctttaggatagcaggggtagatgtagaattaaaaaaacaaaaaggatacgaggatgaataaggtacggaaatgatcagcaaccatttccccggaaacggcgccagaaatgcttgttggtatttcttatggtcacagataaaatttgcaagcgcacagatataccgatgtagcacttcccctacggagtattccaagggtatcgaatccaatggaacgtgtgtgatcagatcttcctccggttcatccaaggacaccaagcaaatgataggccaggatagagaggatttactagtgagaaacagtgtctagggaaagcttaactttaatcctaacgcaatacttcaggcactggcaacccgctgttcccagatgtcgctctactacgtacccggacagggaggacttaagtgatctcgagggctgtcaccacctctacacccacctcaaacgtactgtgggatacgcagtaattactggataacaattacttaaacatcacgtctaagcaattactgtctactttagtgtttataactcaccaaagcaatcactatatttagttgattatagtgaacaataattccgtatgctatttaggaactaaccaagagataattctcacaaaataaatctaaattactcaagaagaatattatattgaattcagagtaaaaaatagaataaaagaaataggagaagattaccgacaactccggaattcttccgactcctactctactctcttccgattgtaatatacaatatagtacaatagagcctcttataatttagctcaagcttggaagtgtgtgtgtgaagtgagagagtgaagcctttatatagaggtaggtatgacggttgtgagaagctgaaatgtccgaactgccccgcaaccgccattaggagatgatcaagaccgtccacgccaaaccccagcctggatggctgagattaggagatgatcaagaccgtccacgccaaaccccagcctggatggctgagattgtggtccggccgaacctgggctgggcccatctggcttggctcttggcccatgttctcccctgatcctcctctattcattcttcggtattttggctgattcactgatgttttgatgaagttcacaacccatccttgcagggatacacatttctcctcactttagtctgattttcctcccaacatcggggtttatcgtctgcatacaaatatataccaacacttgtggaatatgtgagattaagcacatatcactatgttggatgttttattatccgaactt

SEQ ID NO: 90860 - DNA, 529 bp, Oryza sativa
agaacgtacgtgagatggatgaattgcatgatgagatgataattaccctacctggagatggcttttcacctcatcattggaaattccatcaaccttcatcagctcgcgaatctgcttcggggtcgccactttaatttgcaaagaacaaaacaaaaacgcagctcaagattaatttgtttgttgtcttttcatctttggtacggcatgtaatcatggtgttcgatcttgatcgagttacatgtgtaggtgtactgtaccttgggcgccgccgaggatctgaagagcattgacgaagcggcggtgcagctccggcgaccagcaacggcgcgccttccggtggggctgtggcggcggcgggacggcctgcccgtccgatggcgtcgacggcggcttcccgccgttctgggcttctctcgatctcgccacgacgccgttgtcgtgggcgtacggcttcttgtcgacctcgccggcggcgatggtgatcgcgtccgccgccttctccagcgggcgcgagcgcgagctccggcag

SEQ ID NO: 90861 - DNA, 694 bp, Oryza sativa
ccactttcttgtattctattccagtcataatttgtgttgtgatcaagctctctttcagcagtagtcatctcggtctgcacaacaaaagggtcacatcaaatagcctctaaactagacagatagacaagcatataaaggggaaaacacagtatgaacatgagatgctacagaatatattattcccatgaaaaagtactaatctgttactatcacaataaaaaaagcaagtcatattgagcagagctaaattatcgctcataaatgtcatcgaaaatgatactactcaccttttggagtgaagaaaaatcaataccaaaatgtgacaaatgctgcgctaatagtggatcttcaacgctatcatcttctgggtatgagaaaacgtctgagctgtcacagaaaagcttgtatgaataggtatatttaaatataaaacaacagtaacttcagcagcacatgcccttgataggaaggttgctttaggactttaagaatattctttgttaaaactaaaataagacgaaagcaaaatatttcaatggaaggttaaaatatcagtgtaaattacttttatagtagctaattgggctgtgtgttataaattatgaagtacgagcagtatgtatccagggaacaactctggaatttaagaacgagtcttactgattaaagtgaatattcaataataattgcaata

SEQ ID NO: 90862 - DNA, 2965 bp, Oryza sativa
atgataaataagcatcgatccgaaggttaaagcacacatcggctggaggtccgatgtcatgaaatctacaagattagattaaacagtgaaacctttgttgtcatcggcgaaatccaacttatatgtatgtgtaatccttatgagccgatgcaacgtccagataactcaccggctgaaaccccgatgaaacccttattggcaatcaagaagcaggctagagattatggttctaagcacgacttagtagatcaaacttaaccgatgcagcactaagtatgaaaagaaacataatatctagatttttaggatggtaaatgtctgagctaatctaatctagcaacgcgatttagctgatatcggcagaaaccctaaaacgagaagcagccgatagagctaaattgatatgctaggactagattaatagagacatatgataaataggtaggcaaatatatcatccaaactagagcaatccaagaggtcgaatgtgctgatgcagccttgaatgacgccgatgtagatgagacaattgcctgggccgacggaacattggacttatcccttcgtcggagatcgaagacgatgcagccccgcgtcgggtgccaagttccgccggaacataaaaaacaaaagtagaagtaaaaagggtagcgatgcaccaaattgtattgatcgtagagatagattacatagaccccgggtgtacatatttatacccatgggttgatacaagtccttgtcggataagaaagaaactaacctaaagataaaaggaaaatataaagtccttatcggacactaaacacactttcctaaagataaaaggaaactaacaaactattcttaattaatagataaactgccatgccgcatcctttttaaactcgttcaattagggataagcttcctttagtagattgatttccttaaccgaatatagcaggaatccgactattggcgacttgataactcccatcggctgattccgagatgctgcagccgataatgattctaagccgatgacgtctttgccgattaccaaatttcactgttaacaccctttgaatcacagggtagaaaaaacagaggaataggaaaaacacaggattctgacaggaattaaaatgtaaaacaaaggattgcaaaacacataaaaaaacaggaatggtcgtttgattggagcgcagtaaaaacgcaggaatcggatgagagagatagactcaaaagaatttttccaagaggttggagctcttgctaaatttcctccaaaatccacatgcaatgtgccattccataggaatttcataggatttggaaagcttcaatcctttgaatcaaataaccaaataggaaaattttctatataatttaaatcctataaaattcctatataaattctttgatttaaagcggtcctaagtaagggtggggaggttgctagctccatgtcgaacagaaagaagcaagagtctcgagtctcccactaggcgagggaaggagacacaggtggcacccctggtggccgcggaatgacggttgtgcccctggtggcgaggggtggcgtggggggcaggacggtaaatctgcagtggagggggaggcgactgggcggtgagctgatgagggaggggggcagactggtcgctgacacgtcgtcggcgagcgcattgaccgttcctcccctgccacccgccacgtggcccgtcgcctgtcacgatgtcacatgccccgccctactgtcctctcctgccctgccctaccggtacgtgctccgtctgtcccttaaaaaaattccatgatattttgagacaaatgaatactccctccgtatcaaatgtttgacattgttgactttttagcacatgtttaaccgttcatcttattcaaaagaatctgtgaaatatgtaaaactatgtgtgtacatgaaaatatatttaataatgaatcaaacgatgtgaaaagaataaataattacttaaattttttaaataagacgaatggtcaaacacgtactaaaaagtcaacggtgtcaaacattatgaaatggatggagtagtatttacgcttttaatcttaaaataaaccaagtcttgtatatgaaaataatactgatagatattatcttcgttccaaataggtactccctccgtactcatcaagatagtaacacagtctccaaaacacaactttgacttattgtttctataaaaatatttattgaaaaatgatatatgtatacttttatgaaagtatttttcaagacaaatctattcatatattttttacatttttaaactcaacaacttaagagttattcatgatttatatttctaaggtttgactcaaacattgtcctaaacgacttcctttacgagtacggagggaatatatgttagtgaccatgtcagagaaatcctttctatagaaaagaggggtaaaaaggtaagaatattatgctcgaattggatcaaacatctatatatatatatatatatatatatgcttggtttgtactcataatatactgtggacaaatattgtgaaatggggtagatttatttgacagggagaagtagttctttttcttggtttgtgctaacaaagtataaataagctgcggaaaatattgtgaaatggaggaagtaattaataagatagatattatgagttatatatgtgtgtgttttgtcataaaaaataatcaatatattggatataaacattaatttaaattttcattacaatactatttgatttttggcaactcattctccatctaattaatagtacaaaacttgtgtcgatatacattattgaacctaactaatatccctcgcatcctccatgctctaccccttcctttccccacttgcttcatcccttgcttcatctactccacttattacatcccctcgaaaatttggctccatcgagatattttattcttttatttatagtgaggttg

SEQ ID NO: 90863 - DNA, 1934 bp, Oryza sativa
tgcaataacagctcaggcttcagggtaccaactgctcaataatgcttgctaatcatttacttctcttttttttttttttgggggggggggggagtgtggggtggggatgggaggtttggagcgcaaaataaataccatatcagtcttaaatacagcctataatgtgtgatctaataggatttcctaccatgcttgaattgtgtttaccgcctttgtttttacctaactattttgcggtcttcaaattgcaactttgaccattaattcttattgtacactaaaatgtgctaataaaaactattatattactttcatattattcacaataaatctatccagcatgtagtagctgtttgactaaatttccgtaatcaatgctatcttgatggttcatactgtaatggctgtttaacggcaattatctctagcttctgttttcctgttagcgtgtgtgtattgatttgctttgatcaattgtttttaggcaaattttccatggatcaactggtggcgtgtcaggtactttgcaacaggttcaggcccggaaccaacaactccaggcatcaacacaggtagtcttatttcagatgtataatctcatgcattattgtctataactagacgagtcaaatttgtttcaggaaataaaggtagacacaaatgctgctgtacacatgagagctgcaggggcagatggatcattaattggagtaccaggtttttttgctttgaactctactaatttttgttgtttctggctgctaactggaaattcttagacctgctgtactgtttattcatgtacttagtgccattgtttgataccctgttgtctggcaggcgctaacccagcagggaacaatttgacgttgaaagggtggcctcttactgtgagttcttcacatcattccttaactggcattctaagctataaattaggagcaagtttgaatacagcaccttctttttttttttgtttttatgatgttttaccatttgattataacttttcagggcttagaccagcttagatctgggtttctccaacagaaatcttttatgcagtctccccaaccattgcaccatctacaatttctcactccacaacaacagcagcttctgcttcaagcacaacaaaatatgacatcttcacctggagagatggacagcagaaggcttcggatgcttttgagtagccgaaacattgttcctgggagggatggtcaatcaaatgcctacacggaagttattcctagtgttggcccttcattgcaaaatatgtgctcacctgtgcagcgcatggagacagatatgctgatgaaggtaagtttcacttgtatgttttactatattcatgcatttatttatttgcgaggatacattggatgtaagtaatagtaccttgtaaaccaccgggttatgcataattttgttctcaattgatatcttatatgtacatagattatattgtttaattcttgtcagtgatcagtaatagaatttcatttaaatttatcatgcttgttcttgttatgttatgttgccaagtttgcataacacagtaccatttactttctactatagcatagtgattaaatcatgaaaatatcggtcttggtccttgtgtaatataatcttttgaacagaggaactcatactatttggatttcataatgatctagctgctattaatacatgctcacatgttttctgaagctacctttttcaagataacttctacatctttggttttcgaccttaacacctcgtcattatatgtagtagaagatagcagctatacagcagcaccagcaaagcagcaatcagcaacagctccttcagcattctttacttagccagcaaccaccaatctctaatcaccttccaggccagcaggaaaaaatgggagctggaagtgttactattgatggaag

SEQ ID NO: 90864 - DNA, 2399 bp, Oryza sativa
ctggtctcaaaaggagatgccttgtaggatacactgtttcttgatttatttgtttccaatccctttgtagggaggatcaagccagctgagatttcaaccacgtcatgggggatatcttgcagtagcttcggagaatgctgtctctatacttgatgtggagactcaagcttgccttaggagatttgaggtttgtagagactttctaccttgcagttggcacgtgcattctgatcttctaaattcactgaggttccagtaacatatataccgaccaacaaatctatgtgcaaggatgtatttacttttcaaatctcgtttttagagtgagttttggatactgcaaatctatctatttattttgtaattagctttgtggtgttcatttcccttgatggttagttgtccttgcttggttgtttacatattttcaaagtcgcatcgtgctagctgtagccagtgttcacttccatgttaatctttagagtttccgagtgatggtaaccaatcactttaatctgtcctctttattgggaactgcagggccacacaaagcatgtcgattcagtatgctgggatcccagtggcgaatatgttgtatctgtcagtgaagacacggtgaaggtgtggtctgtgaatgctgggagcgatgatcgctgcgtgcaagagcttagctgtaccgggagcaagtttcactcgtgtgctttccacccttcatattcatctatgcttatcattggttgttaccaggcaagtactttatattcgtggatctcttttatgctcatgcgtcacgattcattcaaaactaatctgcactgatcatcctaattcctaagtagctggttaaaaatgactttttctagatcaactcatgactactcactcacactgaggatcattccacaacttgaatttcagtacatcattacacatatatcaagttcctcaaatattccttcatgatacacatgcaattattttgaagatttactgcaatgaaatacttttcctatttaagaacaagcattcggccatagagaccacttatgttttcaccgcggttcatgtttacaatgcctgtagtacgcttacctctggttttgtgtttgaatgccgcagtctcttgagctgtgggacatgtcggagaacagaacgatgacgctcgcagctcatgacagcctcatcacagccctggcgtcgtcaagctccggtttggtcgcttccacgagccacgacaagttcgtcaagctgtggaaatgatgtgctttcaagctagccgcgccctctaaccctcttctaaggatgggcctttttcttcctcattttttggtcacaccatcagctctgaagagctattgtgtgatgatggtataaacactctatatggtataatatcccccacaaagtagctggctactgaatgactgatgaaaatattgctatcctagtataccttttgctgaccctgggaaagtagcattttgtacagaacatgaactatgctttagtattaatcatagtctatctgaactactgaagtgtttatggtctgaattctaagaagttattctgctgcatctctgctatgaatatgaagaatgtgatgaatgtggcattctcgtaggaatttcaagggactttttttgtaagaagtatgctcaattccagcaagaaattggaaattttcttactgaattttacaaacgtggtttcgtcacggatgcttggtgtctggggaaagcaatgaatcggcatctctggcctgcaataaacgaatgtatttgccctgtttgcatgttcagtctttgcacggctcttagattccccagcctgtccaaaaatacccatgacacggtttgatcgatcgattgcaacacaaatctgtgaacagatcattggttcctgatcagagatgttcagttacttctctgaacattgatttttcttcttatcagatagggaatgtgcatctttctctctgatcttcagtttggaagaacactgcatcctgtagggctttcacaatgatagctacacctacatgggaatttttgagaagagtcatatgcatcttcatcagaatgatcagaggtaaatacaatgcttagttgttgcaaccatcatcacaggtttaacaggttctcagattctgttttgtttagtttaccacttgactttataggtttataacctggagaaaaatgtatttctcgttcataaagtgaggaggataaaatgccgtccgagtagatggaaaatactggtttagtaatccaaaataatctagaggttctaaccgtttctaaaacaggctgggtggaatgtcatctaatccaactttacagaactttttatcggttttgagtagcggaaatgcctatccgtataattatcaggag

SEQ ID NO: 90865 - DNA, 1541 bp, Oryza sativa
gctatcaaacatggtgtaaacatggaatcctacccacatgtttggaagtttaatactattgtggatttcaactcagccaatattcactgattggatgcacaaattctttaacttctattccttcaattctatgcaattttaaccactggtcactttcaatatgaatcgagaccctgtctggaataatggaattactcacgatatagttcaatcctatggaatctgaaaatgtttggcgttcctaacagggcccaaggtcgggagtaccatatacttactatacctgctaagttttctgatacataatgtgatcagcagatctcattttgatcctattctcattttttgatacttacagcctgaatagtacttttggacacacttttgaatactcctaatttttatgttccatattgatagggacaagaaggaatacaccctcgtatgtttaagacagttattgctgcaaagcatcccgaattttccagtatgaggcaacaggtactttggacctggaatcacacatttttggttgaggagctacttatttgaattttcctttgcatcattaactgcaattttgggtacaattttttccaaatagtcattttaactcatctctttgtccaggatgcgcttgatttcttccttcatcttattgaccaagttgatcaggcaaacaccggaaaccatgagctgaatccttttacagggttcaaattcttcattgaggagcgtcttcaatgcccttctggaaaagtctcctataacaaacgttctgactacattctttctttgaacataccgttacatgaagctactaacaaaggtgactttaaaacctttttccctgttgtattataaagttagtgcatatatccttgacacctgtgagatatgcagagcagctagaagcatttcatgagaagaaagctgcaatggatttggatggaaaggaagtgtaagttgttcatagctcatgcactgtctaatgagcacgacttatgtttcactttgcttccataaaacaggtctaatgaggaaattgtgaggcctagagtcccactggaggcatgcttagcaagtttttcaggcgcggaggaagtgcctgaattttacagcactgcattgaattcaaagacaacagcaattaagtatgcatatcttcattgccatttggttctattatatacatggaaatgtggtacagccttattgattgaataagaaatatttcaaaatgcaagcaaactcatatctgtggcatgttcagtttgtaaaagactgaatctctcaaacttgccttatatgtaacttggctagctgtaattcaactcaatatagcagatgaaatgtaatgcctgagcaattcaacattaacacattactgtgactgggtgtactgctataatttagtcgtactatcttaagaccattaccgagacacttaatagggaacttccagtccttgtttttttaatttctcagtgtgaggtgtcatgaccttggtttttatttttgaacatgattcctctgcttat

SEQ ID NO: 90866 - DNA, 1117 bp, Oryza sativa
tccatgatagttgatcttttacattttcttgtacagttcgcaatgttgaatacctctcagaaagttgatatttgcttattttcatataatgacctttcaaaactgtcttagggtgttcctttcccgttgtctgcaaccaacctttttgatcggaggcttatgttttgtacttctaatgtgatagggtggaaatatcgagagagcaacagactggatttttagccaccctgaggcttttagctcagtacctactgattcttcaacaagcaatatggaagatgatgatgcacacataccagatggaagtggcagtaagtttttctaccccttctgttttactgtttctagtgccaagcttccaatctcatgagctaatttcattaacattctgaactgttaatgttgaatttgtagtttgcaacatttgaaagatgactttgtacatgccctgagcatttctgaataacgatggcacattatcgtcaagaaatggatgtggatttacaattatatgacccatgtcccatctaagtttccaagaaaacttacttttttaatttttttttcttttaagatatatgtaaagaaatccatggtagtgaatgattagccaaaccatataaaagtaagctccaaacttgtctcagactgtaggtgtttccaaaccattgggttcaatacttctagatggttgattatctatcttcagtatgtgtgtgtgttttgcagttcttggtttattaacattgctctatgctctgcaggatacaaattgatggcgtttgtgagccatatgggcacctctacccattgtgggcactacgttgcccatgtcctcaaagacgggaggtgggtaatattcaatgatagtaaggttgctgcctctgtcgacttgcccaaggatatgggatacctgtatttctttcaaaggatataaagcattagcagctgaaagacttcacaggcaagaaatacattcgctcgctgacttgagtcttagttatgggcacctatgatcaaaagcacggcggatagtcggtgaacttgcatgcagatggacttagagcgagtgttggtcacatcctgtcgtgctgacttatagggggatccactagtt

SEQ ID NO: 90867 - DNA, 907 bp, Oryza sativa
tagccttatataggaatatttgcttctatactaactgtagctttgaaaaatggcagcaatttgcaaaccagaacatcacattaggggaggcaatactcactggatatggattattcaaggagaaatactggttctggattggggttggagcattgtttggttatgcaattgttttgaacttcttattcacattgttcttgactcttctcaaccgtaagtttgtgctaacttcatggacccagacaacttagaactgcaatcaaaatagtttctcattctcacaactggtgctccttcacagctattgggaatatacaagctgttgtgtccaaagatgatattcagcatagggctcctaggaggaagaatggcaaattagccctagagctaagatcttacctgcactcagcttcattgaatggtaatgctagataatgaatccctgtacttacatcacaattcatttttacccttttactaagtcttcatattaactgtgttccagggcataatctcaaggaccagaagggcatggtgttaccatttcaacccctttctatgtgctttaagaacatcaactactacgttgatgtaccagcggtatgtcagggggaggccggtttatatggctgaaatttcttttaaaaatctatgtatattgattcataatcaagttttgcctagcaggaattgaaaagtcaaggtatagtagaagaccgcctacagttgcttattgatgtcactggagcatttaggccagggatactaacagcacttgttggagtaagtggagctggcaaaaccaccctcatggatgttttagctggccggaaaactggaggactaatagaaggaagcatcactatatctgggtatcctaaaaaccaagagactttcactaggatct

SEQ ID NO: 90868 - DNA, 1584 bp, Oryza sativa
tgctgcatcatggtgcaaagaattgtttatttgttcactgctttcttgatggcttgcttgcacctggtgaggaacttgctgctgcttgtggacactgaatcttcatagccgtatctgccattgtcgtcgccgaccaccttgggcttcctgctcatgcactccacaccccttctcattccaaggatcttggaaggtgaggaaggcagagacctgaaacccctggagctgtcagaccttgggaaccagatcttcttctcctctcccctctccttgatctcaaagctgttcctgcacctgtcctgctgctcagtagcaccatcgccaccgacctcgacgatctcatcggagcattcggtgatctcattcctgcagctctcatcatcaattctgctttgcatttggtgctcgtctgaagcgatttcatcagcagtgttgtgatcttcagaagaatgatatgctgctgcaggatcttcttgctgctgctgatcctccatgagcatttgaagccacttatccacagttcctttgccggtgtggttcatgtttgcgtcgccttcggatcgaccgacgccttgccgatgaatcacattattctttttcaatagcaccgatttctctgcaggatatctaggtgttccatacatgccagttactctgtaaggaggacttggaggaactgaggatgtccttggcactgaaactgtctgagatctttcagtctcagactcacattgcaccatggctgctttgcccttgccattgccatctcttgacctcacaggagtgctagttgcccttgatccccttgatgacatggtcctttctctccttctgccgcgctgccgttctttgatcgccagatgctccagcttctccctcactgatgctcttcctctctcagtgtcaactgtgttgtcttccatggacctccttgggaagtttatcaccttgaaaggtgaattcctgaaatttcccattgttgaagtttcacctgcaatttcctcttcctctagggagatgtatgcatctgaagccctctggtcctcctccaggaaaaccctcagctcctgcttgagagggtttctgctcctcagtcttattcctggaaaatacttcaccctttcactgtgcctttcttctaagctgtgcctttcctctagcaatccatcatcgtcaacacgataccgcttccttgcttgatcggtgaaaggcttgatctgcttctccagttcatccttctgctggtacttcctccggagctcggtttcggatgagtcacacattgctctctgggcctcgagtctcgccatgagagtgctcgttgcagcttggttcatcctaagctgctccttgtacacaacagacctgcacattttgcaccacaatcaacaattagcacaaacaatcgacattgaaatcaactgcatgagagttcttggctcttgctgcatagattcatccttactggtgcatggcgtctctgatcatcttctccagcacagccttgtaattcgactgagcctccgccaagcggcggcacttctcgacgcgccgccgcctcttgatgaggagggcctccatgtc

SEQ ID NO: 90869 - DNA, 3864 bp, Oryza sativa
  unsure (1)..(3864): unsure at all n locations
gcatctgggagagaggaagccgggtggcgaagcggcggcggcaatggcgccggggacgaaggcggaggcggcggcggcggggaggagggggtgcatcaggtcgacgcgggggccgtggacggtgcggcggagggggcgtggcggcggggtgacgacgtcgctgcggcacccgacggcgcgggagcgggagaacaaccggcagcgggagcggcggcggcggcaggtggcgacgaggatctacgccggcctgcgcgccggcgccgggtacgcgctgcccaagcacgccgaccagaacgacgtcctccgggcgctctgcgccgaggccggctacctcgtcgacgacgacggcaacgtctcgcgccgccacgacgaggtcagagcgtgtgtgttaatttgagttcatcgatctcttgtcttctcttttgcattcattttggacacaagaacatatattttgtgtttagttcttgaatttggcacaccaatttggtttatttcctcatcattttcttttatctcttgacctaaggcccccatcgtttgacgttatatttgcaaataaaaaataatttgtgaataaaacttttatatacgtgttcttagtgaaaagtaaataataaaaaataaatttcgatgaaaaaaaaactccaaaatcataaagttgaaaatttaaattttggttgataagtgtaagtataagcaaaaagatgggcttttagtaactctgttgttaattgccaagaaaagaaaaactctgttttctgctatggtccttttcagtgctatgcatgacagtgtgctggtctgtactgcatgctatctgtatcgaactgaacaacagcaacagcaaaaggaataataataaaatgtcaagatcacattgttctagtactagttatgatagtaaaaagtgtttttgtcttttaaaaaagcaacataactggtcactgtaattttcttcatttgtttctcttcttgaaattgttttcagcgtttagccggcgccggcgccggcggaggcggcagctccgatcagctgcaggtgtcctcctacagtggagcaacagaggcagcagtggctatccagcatcaggagcaggagcaagagatatcactcgagctgacactctcattcacctacatgtaggtagaatgcttaatttgtttaaacaccaaccaacaactaggtgcattatattcagttattcacttggcagaagttaagcacaaatcagtgtagtaattaactaactagcaagcaagcttgcttgacagaattgtcaaacaagaagactgctaattaatcatcttagcatcgttgacaatctataataatcaaataatatcattgtctagttacctattggaaacttggaatgtgttcaccaagagcacgcaatatcggaaagtaatttgtcagcacgaacactttgtgtcacataagctgaacacacacacaagaagtgcagaaatgtgaacaaagagctataagaaactaaaactttattgaacttgtagtagagtacatttggatatcataagaagaatctgaagatctaattaagaagaaataaagaagaagaagaagaagaagaagaagaagaagaagaagaagaagaacatcataaaaacctaagaaagcaacaagagaagactactgagtaattaagagaggcgattgatcgatgaggtgtagcagtgtagctagctagctcaagctggcgtcgcggcggaggccatggccgacgccctcgttgacgccggcgacgagctcggcctcgaagttggccgacgacatggacggcagtcgctcgtacacccgcgacccgaggtgctgcagcttcttctgctgcgtcttcaccgtcttgctgatgatcttgtagttccaccgctgctgcacgtacaccgccgcggcgagcgcgacggcggcgagcgggatggcgacgtcgccggacctggagtagaagtcgaggctggtgttcacgaactcgtactcctccgcgaagtaggggttgatcgccggcgccctcacgtagtcgtacacgtgcggcagcagcctcaccgccgtcaagccggcgtagtaccccgtcttcagcggccggcagttgatccgccacaccacgttcccgatcacctgcggcagcaggaacatgtcctgggcgagcccgatgtactcctccagcgtcaccgcccactcccggagcgcgtgcgcctcgccgcgcgcgtccatgtacgacgcctccgacctcaccggccgcgccagcacgctcacgtagtgcgccgcgaggaccaccgcgaagccgacgaggtgcgcgccggaggtgtagacgaggaccttcttgtcgctgggcacgcgccctggctccagcggcgagcgggtgaggaggcggatgcgggagcgccacaccttctgcaccagccggagcgtgaggaggaacgcggcgaggatgaggatcttgacgacgcagtcgatggtccagtagagctggctcttgtccacctcgtacgacggcggcggcgtcgcgccgccgtcgccgctcgacgcggcgatgcgcgcgaacagcgcctccgcgccggtgatgagcggcacgctgtagccgactgcctggacgcccagcatcaccaccgacacgtacggcatcacgtcggtgtgggactgatgtacatgagctggctgaactcggcggcgatcgccgccgccagcgtcacgacgcggaggatcccctccacgctccgccgcgacaggatgtcctgccgctgttcccggtacaggatcggcagcgtctggagcgccgtcgcgttgaaccgcagcgggtcgtcgccgccgccgcgcgtgctcgcgatgtgcaccttcgccgtcgggttgatcagccaccgcgccgtcgtcggcgggtactccaccctcacctcgatcgagcagtccatgccttcctcgacgccgcccatcgccgagaaggctcgccacggcgcctggattctctcggcagccgtatganggtacatccgcgccatcccaccgggttgtactancgctcttnccaaggacntagcgtcnngnacactgttcacntgtacgctgtcntgcccggagtantcgtnncagctcctcgccgcacatcgttgaggaantacgccgtcgcccatctcagcnnttcgttcggtcagtcgacganncngantgantgantgcccantgcttatgccccctaccagncagcnntggcggtcccccgggataacgttcgcccggcgaggcnnccggcccgacgagcnngatctcgagcgagagcccaccctcaagctgaaggaanntggccgctcgaatcgtccgcgtgggaacggatccggcacggcggcgacgtggagcgtgagctcctcggcgaggttggagaggctcgtcgtctcgtcggcggcgtcgccggatttcctcgggtagctcagcagcgacttggcgatgacggtgccgaagtcgaacggctcgcttcgccggaggaactcgccggcctgcttggtcttggtgtagctgtacgccaagctcagcggctcgccgccggtgacgccgaaccggctccacagctccatcgggtgcaccgtccgctggaacgtcagcggcgggaagtgggcggcaccgccgccgatgctggtgatctggcccaccgtgatgctgcggcgagtggcggagaaggtggtctgcaggtagaggcacacgcgggagtggcacgccttggcgccgacgccgaggcacgccaccatgcagagctggccggaggacgcgcgccacacgccctcggcggacatcgtcgcgccgccgagcccgctgcgcttcgccgccgtgtacgcgtgctcccacggcgggacggcgcg

SEQ ID NO: 90870 - DNA, 2941 bp, Oryza sativa
aacgatccatgaagatatctctcttataaaccagcttagagatgaggaacttggtgagggacataaggaaaatatcgatgatggggtaaaacctgtgctaggaaagaggagtatggataaatctctccttggcccaggatatgatggaccttcgtttgatgttctagttggaggtgatagtaagaggagtaagagtttgtctctatagacagcaaagtcgatccacctgacgggcattccaaaggaagcccgtcaggagcaatgaatattttaagctagaactgccgaggatcagggaggcctcggacagttcaagatcttgtttgcctagtgcaaacacacaagcccaagctggtttttttgtctgaaacacatcaaaatatagaaagagtgtgtggcttaaaatagagattggggctgcggaattgtgtagcagtgcctggagaaggaacggggaggggggggatggactagccctcttttgggatgacacagtacaagtggatcttctatcctacaacttcagatatattgatgtgctcattaaggacgaaagctgccctgtgcaatggcgatgcacctttgtgtatggtgagcccaaagctagcgaaaggcataacatgtggactcttcttcgtcgcatcaaatcaaattctactgctccatggtgcttagtgggcgactttaatgaagctatgtggcagtttgagcatttttctgaccacaagagaagggagaagcagattatggatttccgggaagtcttgtcgcactgcgatgtgtttgatttaggtttcacgggtgccccctggacttttgataacaagcaaaaaggaaggaataatgtgcgagttcgactggatcgtgcagtagcaagccagagttggtcttctctctttcctgctgcagaagtgattcaccttactgtgtccagttctgatcacagtcctattcttctccaagcctcccgagtggatcgcatcaagaaaggggatcggtgtctgcggtatgaaattatgtgggagagggatgagcatctgacagatgagattaaatctgcttggcaactacagggacatatatcagacttaggctcagtggcaagccgcttaaagtctgtgatgggagcactgcagacttggagccgtgataaatttggttaagttagcaaagatattaaagaaacaaggaatcgattggcagagcttcagatggcaggcaggtgtgctagtgatcaagactatctcgatatatccaggaagctggatactcttgtatagggaggaaatgcaatggctgcagagatcaagaatctcttggttgaaggaaggtgaccgaaacacatccttttttcataggaaagcggcttggcgccacaagaaaaacaagattaataggctgcagagaagtgatggaacctggtgtgataagagggaggagatggaagatatgacatcaaatttcttcaaagagctttacactaatgacccttctgtcgagccagaaccattacttgatttggtacagcccagagtcacgtcggagatgaataagctgctttgtaaagaattctctgatgacgaaatttcaaatgctttgttccagatgggtccgttaaaagcgccggggccagatggttttccggcaaggttctttcagaagaattgggatgtattgaaacgggacattattgcggctgttaagctgttctttgaacagagaagaatgccacaaggtgtaaatgacactgccattgtgttaattccgaaaaagaaagagccaaaggatttgaaagattacagaccaataagcctttgtaatgtgatttacaaggtgattgctaagtgtttggtgaataggatgcggccgttacttcaggatgttatcgtgccagcgcaaagcgccttcattcccggccagatgttcactgacaatgctctcatagcttttgagtgcttccatgccatcaatcggtgtaaatcggttgagtctcaattctgtgcttacaagttggaccttacaaaggcgtatgatagggtggattggagatacctagagggagctcttcttaaggttggtttttgttctcaatgggttcagctattgatgacatgtgttacctctgttagctatgctgttcgcttcaacggatctatgcttgaatccttcaaaccgaccagaggcctccgacagggtgatcccctgtcgccctatttgttcctctttgtggcagacggtttatcaacggcgctgagtgaagctgaaagatcaggacggttacaacctctaaaagtctgcaggagagcccctggaatttcccatctcttgtttgcagatgatagcctgttgttctttaaatcaaatatggaacagactaatgtggttaagagtgctcttactttgtatgagcaaagcacaggccaactcctgagcccggccaaatgttctttgatgtttggaaagcattgtggggatgctctgcagtctgacatcagatcccttttgcaagttcaacacacttcctttgaagataaatatcttggtctgcctacaccgatgggtagactgaaggcaggaagacaccaatctttgaaggagagatttgagaaaagattaacggattggaatgagaaatacctctctatgggagggaaggaagttttaattaaatcagtcctacaggccattccgacctatgtgatgagtgtgtttaagcttccagcagggctctgtgaggaatatatgcagctgatccggaaattttggtggggagaagaccgttagaaaaggaaagtccattggatctcgtggcagcaactgattaaacccaaaggacaagggggaattggtttcagggacttaaagctttttaaccaggctctgctagcttggcaagcatggcggctgatccagtttcccaacagtttgtgtgctcaaattt

SEQ ID NO: 90871 - DNA, 1811 bp, Oryza sativa
cagatgtcctattttcatcctgcagcgttccagaatggattggatgtcacaatgtcccaaaaaaaaagaaaaaagaagcagatttcttttgccattatttgcacataataattaatttactgtattaacccatgcaattctggtaactttccaaagcagttcaacgtacataacagagcatgttccaaagtaaatcactgcagcatggtaactatggcagttatgcctggacatttttaacagtgaattgttattttgtacagtaaactgcaaatgtcagtatgtcatgaacatggaatgaaggatgtaaaaaatttactactcataaagtacaaacaatgtgatgccttttaattaatacagtaagaagataaataaactgaccttgaggaacatctccagcggtacatcaaaaatgtcatctacctcatcgacattaagaacaggcttaaatgcttctatatctgagaggatgccaacaataggaacaaccaccagaagatgctgcaagaatgtttaaagatttgtatttgtaacaccagaaaaaaaataaaaaaagatttccctattttttattgatgcattgcaacacagttttctctgatctaagaaaaaatttcagtttcgatgtaaaagaagaccgaaaggcattgcacctttgacaagaaatgctctaaagaggcaacaacagtgaccaaagaaggatcaagcccaatctcctcctttgcctctctcagtgctgttgctgcatcatcagcatcaccttcctcagccttccctcctggcaatgcaacctcgcctgacaatctcaaatttaggcaagaaacttagttaagaaaaagcatagaagcagcattgggcatctatgagcatccatcaacactttggggtgtagttgaagcaagtttagataaaatgagccagggcagactacatttggatcagctcacctgaatatgctgactcaaaccaagtcagctctctagtagagccagaagctcaatttataactcttgtgtaagccaaacctatcttgagaccatttgtgagctcaagtccccaaactcaaaatctataacaagaaaatatatgagcaggcttggtttcaaaagtatttcagaaagtcagcttgtttcatttcacttcagaaccaaatctcaagttgctcaaacaattcctgaggtgaggccaagtcgcttaaaatttgtaaattctgatgcaccctacttgtttttctcaagtagacaccgaagtaagaaatgctatgatgttcctagtataagtccaatcatctgtacaaattgtttgttcaaaacattccacaaaagccagttggctaataatgttgaagtggacaagacaagagagaaacaactatatcatttgtaaactaacttcatgaatgaatcacccacatggtagaaactagaaagtgactccctatcatatttgtgaactatatattaacaccccccccccctcacccccaaaaagaaaaaatgtttcaatctgacataatactatgataaaattatcacaaaactacagatttaactcggtgtatcacaaaactacacatttatgatgaagtgtcacaaaactacatgtttattaactaaattaccacaagactacaagtttagaaccaatttagtcagaaagcaataatgtttatagctccaatataacaatggtgctagggatctaaactccaagttgtagttttgtgattacttcaatattaaatatgcatttttgtgatacttaaccttaaaactgtagttttgtgataaatttgatgctaaatctgt

SEQ ID NO: 90872 - DNA, 3414 bp, Oryza sativa
aacgggtggcttgcttttactcgaacttagtagatgcagccttttgatcgatcttaatccgcgctaattaaccgaacagagaggtcgttttcttgtttctcctcggtacggcttggagaactgtttggtgggtcctgtatttatagcatgaatcatcaactctgatccgagacggagtcgatcgatttgctgtctgcatagcgctgtttaattaatctgttaaaatcgagtcagagacgaatcatctaaagttaatccgattcggaatccaagtagtattagtaaggatacgtttccttcatctgcgcatggtaagctagctatcgatatcagcacatcccgggaatcatgcgagctcgccttcttggcaaagttatcagtatcatgatatcgtatggcctgtctgagagcttaagaaataattaattggtagccagcttctgagaatctgaaaaaattaggtttcctagcttctgactagactattttgtggattttacaactacattttctcagaatctggatcaaaagttgaactgtttagaggagcttctgattatagaaaaactgtagcagctatataagcttccccaaacatgtccctagtatcttcctgtactaagattctaccaatcccacctaggcaactgtagcagctatataagcttccccaaacaggtccctagtatattcctgtactaagattctaccaatcccacctaggctgtgttactgtttggaggtgagagttggaaacccatctcccatgcacggaaaacggagcagtctattagcgcgtgattaattaaatattagctattatttttcaaaactggatcaatatgatttttctaagcaactttcgtatagaaactttttgcaaaaaacgtaccgtttagcagtttgaaaagcgtgcgcgcgaaaaaccagaggggagagttgggaaaagagagtaccgaacacagccctagtatcctacttttaaagcatctcaatcatactattcattttcacacgatctaacgaaatcttaggtactactacctccgtcccaaaatatagttatttttagcacagtaccttattctaaaatgaagctatttctccacctacctttttctcttaaccaattacaatactacgattctaccaatcccacttagtatcctaattttcatatataatatctcaatactattcattttcacacaatgcaacgaaatcttaggtattactgcctccgtctcaaaatgtagctatttctagctcaatacattgtcccaaaatgaagctatttctccccccacttcctcctctcaaccaatcacaaccattctccttcacctactttttcttttcaaccaatcacacactttctccaaacattctcacatatcttttaatactcgtgtcaactttaaaaatgtctacattttgggacggcggaagtatctcaatattacgatcctaccaaatattatttaaaatcaggtagatttaaaatattgtgaataaaaatgctcaagtttacataaaaaaccaattaaatttatctaaatcaatattatatgctttaatttatacaccatattatatatatatatatatataagtattttctaacatctgatagtatcccgatactatggtagtattatgatactacatataaaaaaagatcctacctagtatctcgatactgattatttggtcggtggctcggtggtttcagcccatcgtcgcatgctcactaggaggtttgacggtctcacacccccctcccccccccgaatctatctattatctatccttttttcctatatagttggtacccactatagcattaactcctataaagtttgctccaggttaatccacgtcctcggcgcatgaaaagccatccgatcaaatccacatccagcatcaactgttgtttgctctcttctctcatcaagctaactctcgctcccccacccataagacgcccatcaaggcctgtgttttttagcctttaatcttcccctcccatccattgaccttccagaatatagcaattttctctccggcagcgaaactgtcgtcgtcaaaaggcatccgagtggtcatatttataattcatttattctcctttcacctaatgtatattttcataattcaccccactaatccttgcgatcctcatatatatcatcgttgatctagctgctgataatctgacatcctctacttccaactacccacacactagctacctccctccgctctccatggtggctagcgcgagtgggttgggttgaatcgtccaagagcaacggaggagcaaggaggaggaggagccatggcggctgggaagaagaagatggccgacaccatgctaggccgcgttgggctcacctcctggcccacagagtagcacggtcgctatgtcccgggggcgacgtgggcagcgaacaagccgcgccgcctccgcccttctcctccacaccccagcctagtcgccgcccaagccgccgccgatgaagccaggcggctgcaaggacggcggcggcggggctccctctccctcgctcgtggtcaaaccggatgggacgccggcaagacaggagctcaggcttggtgctggcgacgaggagaagcgcccggcggcggccagatccggcgccgtggaggccggatccggtcctccatggcgggatctgctcggcggcggggttggaaggtgggtcgggggcggcggcagggtttggcgacgggtcaggggcggtggcgacctggcgtagctggcgacgggtcgctgccggcgctggctcccctagctgcgcacgaacgctggcggggtggcgactggcggcagggagggcaacggcaacagcggcggggagggcgacgacgaaggcaggggcgcgcggcgcctaggcggcggtggttgtctccaccgtgtcggcgccagttcggcgagctgcccctctgtgcttctgatttctgtttgtgctccgcagccgctgtcctcactctccgaagccgctgtactcgctggtccctcaacaccctcctcaccctcatctcccttcgttgccgcttccttaacggtgcgggcgagaaggtctgggagcagccgcacctggctccggtgacctgctcggcaggctagccggctaccttggcagatgcaagcctgcagtttggatttggggagagagggtgaaagccgtgcacacccccggttgtgtgatcgacggcgacgccttttggtgccatatacctccctggaggcattgattctagtctccccaaccaaacctacaaccatctgctcggtgctctattcgtcgatggaggcatccgtggatgtcactttccttgctgaaggcatcgacgcaagcgtgccccctcctgcttcgcccttttgctctc

SEQ ID NO: 90873 - DNA, 1475 bp, Oryza sativa
tgagaatggtaagctcattttacctctttttcgctgcccgagtggatcgcaagttgtattgcgtgggttgcgtcccctgaggcgcgtcgggaagctgtgacatgtctatctcctcggcgtctggtgcgacgtagtcctcatcctcctcgtcctcatcgtcatcgtcgtcgctaggtggagccggcgccttcccctttcccctcccttgcttaatgcgtgacgacgacgagccaccaactccttcacgctcttctatcctgatggagtgtcgagcagtacttggacgcgcggattgaggtagtggtggtggtagtctccccggttggtacacgtcgtccaatccaaccgacctgcaacctaatcttgctgcaagtttccggcacctttgacgaactttctgcattgcaaaaaaaaaaagaagtttgttaggcatatctcaagtaatgcaaagtgctaaataaattttacctctaaaacattgcggagcgtgttctccgtgtcctcaccacccctcggagcttggagggcatgccccatttcattcacactcctgaggagctctctcgactgaaagcgtgaaaagatatatgttagggtctagggtgcaaatggaagtaactttgacaaatgcaagaaaacttacgactctgtctctaagtggggcgtgctccatttgatatccaactgtagtccggacatcatagggattccgcccctcatcggagtcgcggtcatcctctatgtcggcttccgtccaagtagggcggaggaacagtctatatgtcctatgcagccaacgaaggtactctgagaaaagatgattttggtgtatagtctcgatgtacctatcgtccttccggctgttctccattcatcaatgtatctattatgctctagcccccagtctttcaccttctttgttctcaccctgtcatacctagacaagtagaaggtgatgaaacagtagtgagcatcgacaagggttaaatggtacaaaattgaacattgacaatgaaagcaaacaaagataagaaatatttacttgtgtaattcaactccagttgagatgtcctcaaccggccaatcttgtttcttcccgaactgtcgcatgacacggtgcggaaggtggtactcaactgcccagaaacaaatcaatgggcactggtacatgaaatagtcagagtctcgattgcacatcgagttcagggtcaggcttgaagcctcatttgtgtggtatggtaaccactcaatctgcaaaagttgaagagatgtcgttggttagtatctcaattaaagaagtaaatgtctaactagaagtgatattggaagtacttacatgttgaggctgcaagcagtccatctcattgacataatacttgtatgccacatcccggtgagcatgtgcagtggcagtactctcaaaaaggtaggccactgtcttctccatgtctggctcattgtagggccaaggagtg

SEQ ID NO: 90874 - DNA, 5282 bp, Oryza sativa
ttcttctcccatactttcttatgcttgttgtaaatgaacattgctgcacgagcatcctcaatctataagagtatcaaaatggccacgaaaattagtatttagtacaagcataaatgatattgacaagaaagtttagtcaaatgattacaagttttcgctgtacaagtgattaaccatgtgaaagattactagcagtaattcaagagtaatcagaagtacattttaaaatgaataaacaaatctacattgcataaagagaaaaatattatgtataacttactgggcaatgctctttctgttgtattttagcaccaagtacttgagcagtaagatctttcagtgatctcctcttcccttccctaatataacaggagcacatgtcaatacaatgttgagcaatcttaacaagagcacataatatagaaaatatatatgtcaagatcatctaaccttcgaaaaacctcatattctgaggtatcccttatgtccttctttgggtggcctagtagcaaaacctggaaaatgtttaccgtgttacacaagaacacaaagtgcataaataattaaattatggtcattgacaaccttaagatcatggtgcaaggcatgcccaacaagaattcttcctttgatcagctcagctacatctttctgaacaacccagaaatctttggctgcagtgttgtacaacattgttgcataacccatataggttgccatcctctaaagaaataaaatcatgcagtgccagtttagtgatgtttacctttattcatgtgcttcggtctaatcccactaatatgggtacggtagtcaacaatccgctctaccggtcttgtatattcatcatatacaacgttaccccaagagttaacctagtaaaaagcacaataagattaatgggtgatattcaaaagaagggtatttattataactaaacttcttcataaagaggctagaattctcttcagctttctaaatcaaccttaagtccacagcaatttacagattccatgaaatcctttgatgcttcaaccagtgaaatcaatccaacactcaacatactaagaaataacatatatgtacattcaaattacgaaagcaaagcaggaagtaactatacattggtttttgttccttctcaagaactacatcatgcccattgctccccatcagtaaaagaaaataagagtatgggacttccttagttgcttccttccttcctagagagtagagtgcataataaaatgatacaaacataacctctcctcgacgcattgttagcattaccacatagctggtattacagtttaatagtgggtctcatagtttaactccagcttctttgttctttgataaagataacgaaaatgggtacacaaatcagcagaatacttatatggtacaattaatcatgccatgcccatttgactgtaatattacaaatcatgaatttcaagcataacccttaaaatctcagccaatgcatgggaaccatttccatagcacagcacaaagactaggtgacaatattgccaaacaaactagtcactacttagtgaaaataaaaattgaactggctactggtgagaaattcatgtttcttactatatattccttgcaaccaaataaggccataaattcaatcaagtaaatgatccatctgagttccaaagttaataccaatacatactagctaagcccaacattttgtcattacccatcctcctattgtgaatagtccaactagaatataatccaaatcaaactctgtactcaaaacagttgcaatctcattgccagcaaaacacaaatcacgatactaccttctttcaagattaaacagcttatgtcgcctcctcaccattttcatcaaatcgtaacaacaaactccgaaactaatgctcgcgcatatccttgactcccgaactatactgagctgattaatatatactatgatatttagctcattcatcattgctgtgcgcacagaatacaaaaggatgtatggaattgagatttgggaggacggtgcttattaccaaggtgactctgccgagggcgctcttgctgccgcctgcgccgaccccgaccatctcgcaatccacagcgaccgccttcgtcaagctgccaaaaccattccccatccatccggccatccccacagcaatcaaaatcaaaacccaaagcatctcaaaagcggcagcacaatacaaagacaagaagatgcctcctcgcgcggcgtttgctctgatggctcacctggtgtcgtcggaggtgggcacgagcttgacctccgccgcctcctcctccgcggcgggctcggtgggcgcgggggccggagaagggtggtcggggcggtgcttgcgcttgccgagggtggtggcggcgacggggcgggggagcttggactggagctgcgcccagttagggtttagggtggaggcgccggctgccttcggcttgggcttgggtttccgcttcgggctcgcggcggcggcggccgccggtggcggcggagaagccatggatgatttttgcggcgcgggggaaccgcgggatttggggttttctgctctcaacgagggttcatttgatttttgtcttgattttatactgtaatcctgaaggaaatattttgcttccaccttatgcacttatataaagctatactccctccgtttcacaatgcaagactctagcattgcccacatacatatagatgttagtgaatataaacacatacatatgtatagatttattaacatctaaatgaatgtggacaatgttagaaagtcttatattataaaacggagaaagtaatattctcttatcaaacatttttacctttaccaagattcattgaaggctcggatggcctaatcaacaaaaaagaaacaaattttaaattttcaaacttaattttgagatattttcaatctaattttttttcagcattagcttttaagttacctagaacacatatataaaagttttacctacaaatttatttttattccctaataagccgttttagcttattagggaaaaagccaaatgatggggccgcaattgtttaaattttaattaaaataataaaaaccaacatcttatagccaacgttaagtatgtcttgtgacatataatcacacattttatagtctaaatatttcttaaaaccccactcttaacaaatatcaactaatttcagaatatctaaaacaatactttttaaagcagtggagagttaaaccaacaatataataaagaaattggcaattgcaagtttcatatatactctatatttcaaaaattgaagcaagtgacatttactaaatgtgtatttaaaatgtataatggtggggttttatgaaactttataaccatagtttatgtaatgtacatggtactttgtgcattttcgaccactaatcctcgctttttctatctgttggttccctctcaatcaatttcaatatctctaaatatatcgttggatacgatccggctctggtaattttagggttcgcctctccttacttcttagctcctcttcttgaccaacaatgcccaaatgtgttctactttaaaataacactgcacatgacctgtttggttgatatactcaacttgcctaagatcgtcataacttttataacttgtcaaaaacttcagctattataacttttgtttggcattaaaatggtgaagaaaaaatcctgtcataagtgtatcactgaagcaaatggatgcctaacagcccgtgatgattcatttaggcaaaaaatcaagatttgatctaaaagtaatcctgtttaggacacttgaaaagttgcacctgatccagattgtccaagagagcttaaaaggttagacaggttgggattgacttggacagagagaacacttaaaccttcttgaacagaagcaagaggcatcctcaaaatctattgatacaagtagaataggagaacaagtcatggtatcgcggttcaacattttacccattatttcatttagaaataaaaccactatacacaaacttaaaaaatccaaatagaaacatgagctaccacagttttgcaacttgggaactacgtaccccaccagcatatacaaatttggggaggcccaacccagcatcaagatagaaagaaagcctgtcaactgtcgctctcactccatgtatgcaatgttagacggtatcatatcttacaaaaagaaataactcttatgcaaaatatttgtacaagggaacatctcagatgagaaaagggatcactcataagcattttctaattcaggtcgaactgtctgttgcttctaattttctacttccaaaacctccagaactggtgtcattttcaggtcaaaatagatcctgatctctgactactgtaggcattcctctcaaatactccatccgtcccaaaaaaaaaaaagacaaacccagggtttccgtgtccaacgtttgaccgtccgtcttatttaaaaaaaatatgaaaaaaattaaaaagataagtcacacataaagtattaatcatattttattatctaacaacaatgaaaatactaattataaaaagattttatataagacgaacagtcaaacgttaaacacggaaacccagggtttgtctttttttggacggatggagtatagtagcagtggtgtataatcaactgattagacacttgagatcaagaaaacatctcaaactcgttgggctgggaaacactctcaatgccatggatcaatttcctccgtggacctacagcatcaagacccatatcttttagctggttcattgtaagggaaactatctgatgcatccccagcttttcactgtccaatatgtcaacaaaccaccacaattgaaaagccaattcttcagcccaccaaatccagcaatccgtctctcgagaagtcgtgctcgtattatcctattcgtaacttgggacgaaataactggcagctcttcctttataaatgtttccaaaagaatttcctgctttctcatattctcatgaaactgtccttgaatggaagcatggtttgctttcacaacaggggcaacaggacggcgtgaagatgtagcattttcctgagctttcttgatgttggtagcaactttgatgccctctggaagtggctcgtgagctttgttggtagtcatctgctttggatgcttctttctcgcagcatcacagttttccatgctctttttggctaagcaagctcttgttcaaaacttatttttgcatatcatcctgaagacttg

SEQ ID NO: 90875 - DNA, 1416 bp, Oryza sativa
gatgacatgacgtacatccaaaacaacttttcatgacctgatggaacactatataattaatgttatgtttgtaacatgcaataagaacagttagtggctgtgtcgtacatctttgttatgagaaaagaagttgtagtcagtacaatgcatgaacactggaaaatccaaagtcccagctggctcataggcattaagctccaattatactaacctccacaatagaagtcagggttggctcaaaactccaaagctaaaacatcaggtaaggccagattcagggaaccactatttacatagccttgtgtatgaagaaacaattaatgcattatttctttctatttaattgttcctatcagcattatgcatggactttcgaggaaaaatgatgcctagagaacagaaaacaggaactaaaccaaaagttacgtgctcaaaacctaaaagcatattaattgaaccaaaagctattcaatactcacaatgttcaggctcacaacatgcaaaggggcatcatagaatgcaacagcagtcaattcagcaccagtccacttgtttaatgtgatcttaggaccagaagctatcagcagatgaccttgaagagacgcaacagctgatacagcacctttactctcttttgagtagacttcagtgacctgcaattagtgtttacatgttatcaaatcaatcgatacgtaacggaagtaataacctttttcccaattgcaataatgctccctcacagtaccagattttgagaattttcacttttcgtgaaagagaacagaagcacacgtcctctagcagctacatcctccccaagaacataagcagtcccaatggccaacagggtctcattttccttggtggttgtattctgaagtaaaaatgcataactgttcagtgaataatataattaaacctacagacatgtgtacctttgatcattaaattttcaaacaagataaatctcaagcatagaaatgacatggcaaccatgcatttggaagaaaagaagatagaaaaaggaagtaatgatgactttattatagctgacagtttatgctaacagctccataattgaattataaagggtcaaatatagagtatagagggcatttagtttgcaaaaatgtgcttgtgggttgctaaaatatggtgtcttcaaccagacaggttcacttggtttgtcacagaagttcatatagtttggtttcaagtgggaatgagaaaagacgcatacatgtaatgtaacaatgcgcacgttagagcattttcaaacaattgcattggaattgtggacttcgtctcccaatgtccaccaggtttctccagctccaaaatgcggacctcaaattcatcaacagtatatgtcttatgaagggcatcagtgcttgtaacatcgttatccatgtgatg

SEQ ID NO: 90876 - DNA, 2208 bp, Oryza sativa
tttcagctagtacatggaaaagcttgtacctccaggatgggataaaaccgggacaacatccattttgattcttctcctatccgctcctttctgataccatgccttttctaaaatttgtagagttaagtacaattaaaattactatggttgaaaaggtacatgacaacaaaactaaaagcctaatgaaataacacaagataccttacgtagatcaaatttcagagtaaagccacctgccgaagactttttagaatcatgcccacaaaggcaacgcatattactcactgcaatcatgtcatcagcagataatcctgcgagctgcaaagaaaatgggttcttgctgaatcttgtggtattagtcagtatatagtgtagcaactgaacctataagcttttgcaataactatttctaatttatctactgtggaaaaaatgaatgaaacatagacctttggggaaaaaaacataaatcaagccccccatcagaacataggaaaaatgcaagtttagaatcctaatttttttccctttgaacccctttggatcgaaggaatggtcccatgaaatcctatgaaattcttaagttcaatcaacgggaatttttgaagacttctagcatgatgtttggacttcaaggaaaatttccttacttttggtgctgcatgcgctgaatggaagagaaaaaagtgtggcaggtgtgtatagccattttggcttcaaatgaaattcatgtcaattgatagcatacttatacctcaacttatttagtactacctccgtttcaaaataattgtaattttagattgtttagcatatattaaggtttgagaagaaagactatggtgccccttattaaattgtgtataggtaagagtgggagggtagttgaggtacaataggaaaaattttgaatgagaagtgattgatgggacaattaatactgtatcgtgacaaatatttttggacaaatttaaattctagaaatataattatcatgggacggaggtagtaggaaatactgatgtactccctccatactcgtaaaggaagtcgtttaggacagcgacacggtctccaaaacacaattttgacttgttgtttctataaaaatatttattgaaaagtgatatatgtatacttttatgaaagtattttcaagacaaatctatacatataatttttgcattttcaaactcaacaacttgagagttattcatgatttatattttcaaggtttgacttaaacattgtcctaaacgacttcctttatgagtacggagggagtattaccaatcaatagcacataattacatcaaatttatatcggtacagcagtttacactgaaagacatacatccatgtgattaataaatatatgcctatcctatatacttatgtgactacttcaacctgggcttcaactgaagatttgatattttgcagaatggaccaactgaaaacatgtaatcaaaataaataataaaagaactagctgctacaggtagttcatcttttcaatttttaattgtttctacagcttacattgtactttggttttttgaagtccccaatgtgtagatctccagattgaattttttttttttatgcttatgaaagcacaggcagagcttcctatgaatatggtgtcaaattgccgggcttcaacttcctatttttcatgcttaaattatgttctgttagggacaaggtcaatgttgctctacacagagagtccaccattacatgagacctaatttttgttcactgtacatacacagaccaagtaccataaatattacgttgccttttaatcaaccccatttgtcatgttgagataacactgatgttttcctaaatttcttacgcatgatagtattttctgcagcaacgcataagcatcatctagcaatcaggcatgcatgaatcttgaggtgcttgttcagtgacaaggcaccattcaagttggtaaagttttattttaaaaataactgagcagatttcatgatagaaaagtaaagttacctgcatcaactttgcacccttatcacttcgagttttatctggattgatggcagcataaaccataagcaaacgcagcttattttcacgactgatatcctgcattagatccatgaaaatattaatattatatacatacaggtaaaatattccaataatttgtccaaatagccattaccaaatgtgtcc

SEQ ID NO: 90877 - DNA, 4941 bp, Oryza sativa
caggcattggtagatcacatattggcagtgatcattgcatattgacaggcggacaaggcagggaatgtaactactaacctcaacatgaagcgcaagcttgtcaatttgatcactgtactgcggaagagcttgaaccattttttgcaactctttggttgataaatctccaccatttctgacaaatataacacaagcatttacattacaaaaagaaaaggatcctatcaacagaaataattaattcaacataaaacaaatctttgaataccattaactattcagtatggcaagtataccaagaaactagatgcatcagatatttaggctgtcattgtacgttgcagaaagtattaaattctcactaattgaaaaaccaaaataaatggaacaatcaagcaaacaccgtgtctcaatgacaaatagtaggaacttaaaataatcttattgacacaaatggactaaccctttgggaatcagtgcagtagtccatggttcaatctgaatctgagctatatcaaatttacccgctattcaccttagtaatcatctgttgaccactataaatgtttctaaataaccaccagaatattcatggctcatcatttcaatgaatagataataatacatcaagtcatcaacaaaagctaacacactctggcaaacagcctaggcaggagcgaagctacattaacttacccaggtgcacgggacacccagtgttaatcagtttccagtagtatcgttgcatgccctaagagagggacaccccatgggccaagcataggaacacccgtccaagccaaccagctgagagcgcagcctaggaatgtctccgttcagcagatatcgctgttcagcaagataggcctgggcaaggatcaactcactgagaggctgagactgcgtagctatgctgtcgtctggagtgtcttaagcctaccaggtgctatcgtttttgcattcctggtttctttgaattatcccatgttcaattatctgtcctacacaaccaatatttatttatgataaacacttctataactaaatatctgtctgcatattattagaaataagattaaaatgagctatgtttgctctcaaagcctataaatgatcacgttaatcgaaaaaagcaaaactatactgtcaggtcctgttcatttttagctttttgtctggattattgtcgcagattatttgctccacccttctaaaaataaagcttctcaaaaaagaaaaaaaaaggactaaccctttgggtataatccatgtaaataatccacacaaaaatctgtttccaacagggccatatgactactacaaaaaattgcctaagcaatattgatgtataagttatagggaacacattgttttagggacttaggaaacatgccgcataccagacacaagccataagcgaaaaatagcgcacaattagtgatacatatggggcacccggttatttttgttctgggtttgctcctgagcctaggttttgcaatcatttgcacaaaaaagtaagcataataataaatgcaataatgcatttaatataaattccaacatatgttgttgtaatagttgcagaccacggtcagttagtattccattcatccccctaatttgtgacaattacatttattgaacaaaccttgcttgatgtagttgagcagctttgttttttgatacaaaattggtcatcttctcatgcaatctttcactagcctgcaatattgactccatgatgcattaatgaagcatatagataatgtttggagacaatggtgacagtctcacattggctatatgtacatgccgaagctaagccatattggatcatgatcctccaacaaaacctccttgttctcagtgcctgaaccagacttgcttgggacctgttgtttcatggtcagcattcaagagcacaacagaactgaaaattggtaaacaagctactacaaatgaagattttgacatgctcacctgttgtacatacttgttgccatccatgcagagtagatcatgacacatggcatcataggtccattcgtgaataattggtgcgatctgaaaacattaaggaaacatgagaacaaatcattgcttcattcaatgtggtagtcagtcaaactaaaacactaaaaaagggaaaattgcaaaaatcaccccagaaatgacttgaagtttgacattccacctcatacctgatctattgatcggtctacgataagtaattcacatgtttcagtctgagggaattcaggtatcatagccttaaatcttgcaaggcaattccacacaccagcagcaagctttgtgggtgccaaatctcgtagtgttgtcaaagtagaagcatcaatcgtcctggcaacacgatagtgcacacgaggaaattcctaaaataattgaaagcaaacaacttaagtaaaatgtatggcacaaagaagtttttttaagccaaaagtttcttaagaaaatagacacccaaacaaatattagcaaaacacaacaaaataaaatttgaatgactcgataagtcgtcaaatagttcttttacttttttagtaatatttttaatggaaaattgtaagtatcgggtttcaaattcttttgctaaaatagcactcactcagcacgccatatacccaagcagaatgccgactagccctgtcgacacgtggcgtgctgaaaaggtggacatgtgtccggagtggccgtcaccgagacaggtcctcttggcaaaaacacatgctgacaggtcatatccgcaaaccatttgccgatagggctacctggttaccagcaggccgttggcctcctcccatgccaacagatagcgaggcagctgctagcctttcaacacagtgaatgaatgtgtacccatgcagtgctattttggtaaatttgtttgaaaccctatactattttagcaattctccttttaacaaataatagtaaaatatatttaaaaactctcaaattggatcctgttttgaggaataattcttccatatgtgtatcagtggataattggatggaacaacctatttgtttgatatttctttaagtttgtttcctccattggcagaaaaacaacaacccaccacatctgcagtgtgcatgcttaattttttatagttccaggcttgcagaagacatgcgttacaattaccatatgtttttcctttctcattctttaacagtatattaatttcttacttatcaccaactgttcttttcatgtttaaaccataagaacaggaaaataaacatttaggtatatagacatgtcaagtagcataaaatgggaaaacagtaccctcattgatgcgaatactgtagcaatacgagtggccatcatgttaaggcaagagttatacttgagtgaaccttctgcattttcactaaatagctcttctagggccttgtcatggtcagttgtaaagccctgtatataacaacaatagattcactgaagccaaatacaaaattttatgatgaactaaatcaataaggagaaaggattgatttctttatggtttaaattaagtcattaattttttttaatctaaagccagcagtatcaaaaggctatgctaatatacctggctatcgatagcaaaatattccagattcatctgcaagcataaagcacaaatgaattaagaggaacaagtgtaattgcaatgttgaaaaatgagaacatgcaaggaacagataatagttaaactgacctcactgagtgcacctatgcgtgctctaacatttgaatctttttttatttgggccaccaactctctttgtacgggtgaactgaaaaacacataggctctgaaacacgtaagtatcgtgtccaaaataaaccatggttggtaaggtgtctccagtgttaccaggaatcagacaaaccggtttaaccggttgtttaccggtttgattgcacagcggtcttttaatcgaaccagaccagtaagagcattggttccggtttattctggtcggaccggcagtccagtccggttctaataactatggcgacaatcctaccacgatccaattgattctctcgtgtactctccccttcctgtatttgcggatctattgcttcctgtactaattgtcttcccctatgttccttcccaacgcttacatcccctgctgttgtactcttctatgctcttcctccccaggcaccatctgttccttcccacacttacatccagttgtgtactagtgtctaagccgtcgcctcgccttatgccttgccgctaaggcagtctagggtcgccttaggttgccttactgccttaacaaccatgaactaaacttggaagtgatacaacatgcataaacaagtaaatgcacaggacacatacttcttatacagtggtattttccctgacatgtcggacatgaatatgcgaatgctgcatcaacaccataataaattggttagagagtttgatggacaatacaactttcaatatcagcagcaaaccattgacatatatgactggcagttatcaatatcagcaggaaaccattgtctatctatatttccacatatgtttttcagtggaattaaatgaaagctccagcacaaattaaaggataaaaacaaatttaacacatcatatataattattcactaacaaatggaaaaattcggttttgtgcctactatcaatcagtaaattatttctgtgatcaatcagtaacaatggtaataggatgtggtaactagtcacacttacttttccttagttggttgaatgaaataaattgcatccatcaatggtaatggttgcctccgcatgtataagtcctcaaccactgcaaaaaaaaaaaaagaagcaaattctcaaatgtatatagatagacaatatttctgcgaggaaaatttcaaaaaactaaagataaattatcataacgatacagggg

SEQ ID NO: 90878 - DNA, 836 bp, Oryza sativa
cgtcctcgcgcgcgaactcccccttcgtcttcagtgacagggtccccctgtacaccgacccgtacttcccggcgccgacgaggttggcgtcggcgaagtcgtcggtggctttcgcgagctcggcgtacgtgaccctcgggtagtagttgccgttgagcacgctgcgagcggcggcgtttccggttctcgaactcctgatcttgcggcgccaccggagcaaggcgaacatcacggcgaagcaaagggccgccgcgacgacaggcagagcgatcttgaggaagagatgagctcgtcgtgtggagttgcccggcgccggacatggcggcaaccgtagccgcgccgcgccgccgcagagcgcggtgttcccggcaatcctcagcccggtcgtgttcgcgaacacgccgtggactggaacctggccggcgagacggttgtaggacacgtcgagctccatcagcgagctcatggtctcgaggctcgccggtatgccgccggacaggtcgttccgcgagaggtacagctcttgcagtcccggcatcccgccgagctccggcggaatgctcccggacaacctgttgcccgtcaggttcagcctcctgagccctttcagcccactcagagatggcgggatgcttccgacgaacacgttgcgggccaaatcaaggaactccaagctctggcagctctccagctcggtcggcacctcgccagagaagcgggttcccccgacaacgccatgaacgcgagcttcgtgagctggccgacgtcgggagggatcgggccgtccagctggttgtccgacaagtccatcagcagcgacagcgacgagagggtga

SEQ ID NO: 90879 - DNA, 593 bp, Oryza sativa
gggaatggccatgattcagagattgatgagtttgtgaagatagcttttgcgtgtatcatggttcacccgagggagaggttctcaatgtaccgggtttaccactctctgaagagcattggacagggtcgtgatgtctcagagcaatttgatgagttcccgctggcctataacaaggatgaatcagataccatgtaactaatggtggtggtcttgcttgggattgtgaaccgccctcggtcaggctcaatggatgcttctttgtgtagtcctgctacttgaattgatgaagagcatgctgaggcaaccatattggcatgataattattgctggatgatcaattcgatgcttgcctcatctcctgtcgagataatcgtgtaagctgtaagattttagtctgtattgtctttttacattattgctagcgcttgtagtatctcgctttatgcctaaattctgatatgaccttccttcttggaacaacttgcctccttccccaatctcctaagaacaatattggcagtgaacaaaattaatcttgaccaatttatctaaagtttacaggaatgtttcgctctgtcatgtactcatgttc

SEQ ID NO: 90880 - DNA, 1577 bp, Oryza sativa
tctatctttgcgggttcattgtttagtattcatactaagtgctctagtactaggactccggataaagaaggaagttcctacgcaagtattagagtagtaattaataacttagacgtggtgtataggttagagattacctttgtttgttgtgtatcccacggatttgtcagaggtaggtggcaggtggtgacagccctgaatcccgtcctagtaatcctccacattcaggcatatcatagagctatagccggaaccacgctggcagaccagcaggggtcggtgcccgaagcaacagatagggaatgacctttacttagcttagataattaaaacacatagaaagtcctctctagcctagcctgcttaccatcagttgttatccttggatagtcttagccttaggtagattacatatgttccctgagttcaatatccttttggggtcatctgaaggtgaagtgctacagcggtattccgtgcgcttgcggatttatttgtggtcgtaagaaataccaacacacatagaaaggattagagtatcataaagatgtaagtactaattccgagaatacaatccgccataacaagctttacctattcgtcagagatcgaacccgatgcagcccaactcgaaagcaaaaactcgttgaaacaatgaaattaaaaaagggtggcgatacaccgaagtattattgaactgtcgtcctttgatcacaaggtgtcgggtcctatttatacccaaagtacataatatatccttgttggacacggctcttatgtctaatacaatttaaaacacgaacaagtcccctaggcggactattaccaaaaatatctctaagaaaactaaaaatatcataattaatagatacaattactcattttcaagactccaatccttgtgtggtaatggctatgaagtgctttgatagatcccgatgatagatgtgggaccgtctttttcaagactgattgcatcggcttgactccgttggatttggcgccaacctatatatggcagccgatgccgctcgtggccgatatgcaccctactcttcttaaacagaattcctccaaatcgactttgattctagctttgaatctggcccatggcattaccaaatttggtcgttaacagatctacgatccgatcacaccattgtatttgtcgtaattaaatctttacaacaaagatattgcatggttatattgtaatgaaaaaaaagatgtgtgttcaaccattataattcaatatttcctatgtcatatagatatgtttcccattgtgttccaaaaattcacacaactacctccctcttctctttctcctgcttctctccattctatccatcaatgcatggatttagtgagctttacaatgatttttcttctaaactatttatcaaatctatgatccaatatcgtaccatttgtatttgttgtaattaaatctttagaacaagatatcgcatgattatattccgacaaaagaaaaatgtacatttcaggacattaaagctcattgttttatatgtgacagcaacatgttgcaacacacgttctcattgtttcacaaa

SEQ ID NO: 90881 - DNA, 1163 bp, Oryza sativa
tgctttttgaactttttgattcctgtcgaaaacatcacacccacgtgtgacattattggcattaattgacaaaagttcgtcgcgtgaatcacgaagtgattttttgccacgaacgcacccaatacactccaatatgttcaaaaatcatgttttggtgctttttgaacttttgcattccagtcaaaaacaccgcagccacgtgtgccagtattggcattaattgacaaaagttcgccgcgcgaatcacaaagtgattttttgccacgaacgcacccaatacactccaatatgttcaaaaatcatgttttggtgctttttgaacttttgcattccagtcaaaaacaccgcagccacgtgtgccagtattggcattaattgacaaaagtttgccgcgcgaatcacgaagtgattttttttgccacgaacacacccaatacactccaatttgcccaaaaatcttgttttggtgctttttgaacttttttattccggtgaaaaacttcgcacacaagtgtgccaatattggcattaattgacaatagttcgacgcgcgaaacacgtagtgattttttgcaacgaacgcacccaatacactccaatatgtcaaaaaatcatgtttcggtgctttttgaacttttgcaatccggtgaaaaacatcgcatccacgtgtgccaatatatgccaaaagaaatgatcagcaaggatatcctccgtcttcttcacaccaaagtgtcccatcagccctccaccatgcgcttcctgcaataatagcatacgcacggagctagctggaatgcataacttattagctctaaacacaaacccattggtgagaacgaatttgttccaagtccttccctccttgcaattcaacaacacatctttaaaatcatcatcgtgcgcatgttgctcttttattgtttctaagccaaaaattttgaagtcaagttgggatagcattgcgtaacgtctagacaaagcatcagcaatgacattttcttttcccttcttatgtttgatgacatatggaaaagattcaataaattcaacccatttagcatgcctacggttaagttttgcttgacttcgaatgtttttcaaagattcatgatcagagtgtataacaaattctttgggccataaataatgctgccatgtttcca

SEQ ID NO: 90882 - DNA, 1380 bp, Oryza sativa
tgatgggccatcgagcgatcgccggccctatggccccaaggcttgatgggctggaaaggcttcttcggtcctcgcgggggcgaacttgccatggcaaagtcgtcttccttcggcaggtactcttcgccttacacccttcgtccgagacgcctctggcttgacaaggtactcgcacgacccctcgcctctcgctgttctcgctccatagtcttcgccatgggtttcggcagatttggtcgaagggcctcatgccatccttcgaccgtgcaaaccatgtggtatggtatgcggcgccccctttcgaccgatgctcctgccgaaacctacaatgttcttacgaataaagtttgttatttgcgcggcctgtactattttgccgctcttcgcctcctgcagtctgtggcatacatatatatattttttacttttccccggccgaaaagaacagtattgggctttcccttcgtgggcttttttactgtgctgcccggtcagtgggaatttaccgtttctcctacccttgcgacacgtggcgctttattactggtgggtaggcgaaccgtcgctcgggtgagctatatattcccacccctctttcctttccaccgccacacttgacatttttaccgcgtgcgctctcttcgtccgttcctttcttccatagcatttcttgaaccctcaggtgtttcgcccattctcttccttcgccaccgcatacacgccattcgccatggcccctcgcaagccaaaccttgcttcggcgaaagggccggatcccggccgggtcgatgacgacagcaccgccttcttgggggtttctctcgtggatgacgtcgagctggcgaagttggtcagctctggtgcgttggttgaggggcaggctttcgccccagggaaagccgtggtgccgaagcctgtcgacaatcggacggtggtgttcgccgtcctttttgaggcggggctacggcttccgtgcaacgtgttgttgccggagatccttcgcctattccaggtggagcttccacagttgagcccgtcggcgctagtccggatctccatcttcgactgggcgtgccggacctccgggtttgagcctagcgtcgagctcttcggcaccatatttttcgccaccgtgaactcaaagacggtgattaccccagcttgaacaaagaagacagtgttcgggagcgtgaactttaacgttcgccccgagcggtccgatctttggccggtgaatgctgccatgtcgaggtggttctatcacaccatccccttcgaggctggttccgactcgacgaaagccctccggtgccggcgtagggcgattgcgccgaaccgaaaaccctagatcgccgtggggggcgctatggaggcgcggtt

SEQ ID NO: 90883 - DNA, 1712 bp, Oryza sativa
cctccccgggcaaacccccacaaagccgacgacaatgcaggaccttcgcgaaagcgaatgcgcggacaagtgaagcttgcccctaggaagcgaatggttcctgcttcgtcgtactccgacgccgacgacgaagacgatgccgaagagcatgacgcgaggaggaaagagaggaggaagaggaggtggaggccgtggccgaaaaggccgcgaacgaggcgatcaaagaccgcgtcgacacccctggctatactcctactcccagtccaggtcacaaggagaccggggtggagtcaaacagctccccccttcgacgaaaggatttggaaggggcgaaggccctagttgcattttcgtcgggcaaggcggtgaaaggaggtcgggtcaagaagatctctaaaaagaaaggactcgttgacatcgctcgcgttttcagcgacgacgagtcttctgacgagacttcgactttgcccgctggccacagtctggacctttcgactgctccccttcttccactcggcgttgctggggcaggcggtagcgccgccgccggagcttcagcctccgccaaacggatcgtgacggctgcagcgagggtctttgggagccctctgcgtgaaccagctgtttcgccgttggtcaagacgaaggggaagggtgtggccgccgaagcatctgcctcggaatattcccttgcggcgccccacttcgcccctggtgatttcgagacccgggcggaccttattccctttgtggagggagtaagcaatcttgtcctacccgccggtacctcgagcctgttcaccgaactgaatgagttcgatgaggggtgttctgctattaaaagcttggctgttcaggtacgctttttctcccttcttcgttttcctctccccccttttttttacatcacacaattaacattttgttctcttcgcccgctcttatcttgcctccagatccttgcggctcactgttcgacagagcgaaccgtgcgggcccgtcttgacggatttaagaaccgtcttcgggccaaggacgacgaaataagccgcaagaacttggaggtggaggccctcgcgaacactctcaaagaggtgaaagttgaagtcaagcgccttcaatccgagttggagaaagggaaagaggccagggccgaggtcgatcgcctcaaggccgaactggagaaggggagagaagccatagcggaggttgatcgtctgcagaccgaattgaaggaggagaaggcccattccgccgtgctgactgattactataacctcactgagccgaagatggaggctcttcgcctgaaggttagcaaggccgaagcgagtgctgtggaggagtcgcagtggttttcgcgggagatggtgaaaactaccgaatccgcgagaacggcctgccaaacgctccgcctcgcccttactgacatgggcgcgaaggtgtgaggggtccctgctggctggtgattctgtttcggactgcgccaccgcgtacggcgattgctgcgtgcgtgtatcggcggccttcaccttgggccttttgcaacagttcggctgcgagcacgtcgccgagttccctaactatgcgaagggggactaggagattagtgcgcgtggcgaaaacagttctggcagaaggacggccggtccgctgccaaggcgcgcctttgggagcaactagcaaaggcgaaggtggcagaccagtgcaaa

SEQ ID NO: 90884 - DNA, 2437 bp, Oryza sativa
gaaacaggttattttgaatggactatatgaagaacaccatatggaaaaaccgaggacggttttccgtgaagaaggggaggatgatgtgaccatggctactacgaatacatccgttgctcacatcatggatgaacaacaagatatcaagttcgagtcctccaagtgccaaaatccaattcggccacctgctacactgctgacttcaaacggccgccgaagctccatacgacctccgttttcagcccgtgagtacttgatggaaagctctcggagtcctctttccaatgcatcaagcctcattgccaaattccatctcagtcggcagcaactgaagaaacaaggtgctgtgacacctgtaatgggcctatgggcttgtaacctcatttgggaccccggcccaggtggggcccatgtggggtgcgccccaagctggtggagcacgaccctaggcacccctaggtcgtcctcccacccctatatatagctagttaccccttcagggtttctggggttttgttagattaaagtttagccattgctacttgcttgcagcgcgcgtgtcggctagaccgtccgtctgcttgttcttcggaaccccaacttatcatttgtattaaattcctatttgcaatatcagattgtttttatcttgttcttgcttgtttcttcgatttgcttgcaggaatagggttgatctgcaccggcaagatcagcaacccacggagaggtgtatcgatcgctaaggcgcaacacaacgtctcgtacggttgtagtcggatcgtcaacgtttctcccaaatcgtagttatcacaactcactgaaagatcgggccaacaacagccttgagtgtcgagaggaactcagggttcatcagccttccaccaacttggagtcggttcggattagcaagcgccggaaccccagtgctttcgcctttcttagacccaggagaatatcttcgtattccgctgcgttgttggttgtgttgaactgcagccttgcagcgtaccgaatcggcacaccattcggtgaaatgagcactgacgcaatgccttgtgcgaccacgaaccgtcggagcacatcacccagaattattcgatgagctcgggctcaggggcaaataccggtgtccattcagctacgaagtcagctagcacttgagacttgatagcagtgcgtgcaacaaaatgcaagtctaacagggatagctctgccgcccacttgctgagccggccggtgacttccttgcctcggagtatttcgcccaaagggtactatgatggcactatgactttgtgggcctggaagtagtgcttaagcttgcgcgaagccatcaccagggcgtaagtgagcttttccatttcaatgtatcttgtcctcgctccttgcaatgcttcggagacgaaatagaccggtttttggccgaactctgtttcctggacaagggtagcgctgacttccaccggcgaagcttctaagtatagtagcagttcgcttcctggtgttgggcttatcagagctggcgggctttgcaggtattactttagctcgtcgaacgctgcttggcagtctggtgtccaattaaactttcccgtgccccggagggtcttgaagaagggcaaacctctttcggctgcttttgagaggaattgactgagtgccgcaattcggcccgcgagcttttgtacttcatgtatgctcgatggatgattcatttgctgaatggcatcgattttctcgggattcgcctcgatgcctctttcagaaacaaggaagcctaacagattacctgcgtgaacgccgaaaacgcacttgtcaggattgagttttatgcccgctgcacacatggtcgaaagccttgcggctttttacgacgatgtcatcgacataggcttccacgtttcgccccaactgcttgcaaaggaccttatacactagcctggcgaaggttgctcctgcattcctcaggccggaaggcatcctgaggtgacaaaatgtgccgaacggagtgatgaaggatgttttggggatgtcgagtgggttcatgtggatctggtggtagccggaatattcatccaggaaactcatgagttcgcagccagctattgaatccacgagctggtcgatccacggcaaagggaaatcgtctttcggacatgccttgttcaggtccgtgaagtcgacaaacatgcgcaattcccgtttgacttccgcaccagcactagattcgccagccactccagatggtcaatctcttgaatgaccccggctctgagaagtttctggacttcgacttttgctgcttcttggcgatcggcggacatcttgcgcaacttctgtttttttggcttggtattcggtttaactgccaggtgatgcatgatgagatatgtcgaaacacctcccacctcatcggggctccaggcgaagatatcaa

SEQ ID NO: 90885 - DNA, 629 bp, Oryza sativa
cgtaccaaccacaagccagcgtgggcaacggctttatcttttgtatagcatggttcattacggggtgccagactgagaagcggcgagaagtccgtgggggtcgctggggagtccatgcctttggtttttgagggggtgattataatccaggaatggtgcactatggtgagttgtgttgtgcgaagggtattgtcacgatttccccctttgcagtgccgtggtggtacttcggggcatggcaacatgtgtggaatcgtgtcttgtgggtacagtggtacacctctggccagagtaaaactattcgaatagccgtgcccgcggttatgggctggttgagcaatatttttcgtgattagtctcacacctctcacaaatagttattgatgcaataactggtaataatttgtttagctcctggtttggagtttgtgcagcattggggtgctgttcagtgttgattaaaattgatgattaattactctactgttttacttctcttaaatgtttgctaaatgctgcttttgcaaatgagcctatattatgccatcctttggtatccttgtgcacttgcatatttgctgtgtggcttgttgagtatgtcatatgctcattcttgcaataatcaatca

SEQ ID NO: 90886 - DNA, 1330 bp, Oryza sativa
tagagctcgccgccgcccaccattcgtcgtcgtccatcgcgtttgctagtaccggtgagttcgcgtcatcgtcctctacgtgtagatgactttagatagccctgccgacctctctatcgccggcaaggtcgttgcccgtgaaattgcgcgatgatgacgtcagcatgacgtcatattttctttttccagttttttttctagatgcaaatagattaaaacttcagaaattcataactaattcatcgtaactccgatttgagtggttcaagttgctaaatttttctaaaatcgagatctacatgttaaaaatatccacatgtattgtttatgcttgtttttgtactgttttgttgattttgttctttcgctttagtttccgacgttctgaaggagagcgttttcgttgaggaaggttcagaagcgcttgatgaagctcaaggcaagtcacacagatcccaaacgaccctttgagcatgttgaacccatttaaagctaatgttttatttcaacttatgcattattttcgaatgtcatcgggtggtgagcctttcccaattaattattggccgaagatgactttattttcctatgggttagaattcgattagctagaaccttatatattggtttggttcagctaaatgctatatagatataattgcttagccatgcttagaaacattagctcattaatggggtgaatcatattacattattacttatggttagatttaaatgtagcttacgatggttaatcgtgttatgataattaattgataattaaaacttgtcaatggtgggttgtgagcacatggttttgaagttcgtgctcatgacaattaaggatcggttcgcgagctactgttgtgagacattaaccgtgccaaccacaagccagcgtgggcaacggctttaccttttgtatagcatggttcattgcggggcaccagactgtgaagcggcgagaagtccgtgggggtcgctggggagtccatgcctctggttattgaggggatgattatgatccagggacggtgcgctgtggtggattgtgttgtgcaaggggtactgtcacagttcctatccgagatatcgtggtggtattgaggcgcatggtaacatgtcgtggagctgtgtcttgtgagtacagtggtacatctctagctagagtaaaactattcgaatagccgtgcccgcggttatgggcaagttgagcaatgtttttcgtgattatctcataataattatggatgctataactagtaataatttatttagctcctggtttggagtttgatctgtatagccgggtatggttgttcagaatggt

SEQ ID NO: 90887 - DNA, 614 bp, Oryza sativa
atttaatcatgccacagttctagagtgtctcatagcaaatgcccacaaaactagtcacacgaccaactttgccttgtgagatcttacctcttcaagaactatggcagacatcaaagcaatcaatctgttacggtttaactcacgaccacttgaatcaacagcagcagacctgcaaacggcacaattttagggttgtgcattacgaacctgtataatttcaatggctatatattttatacctgtcaacatcagtatcaaatatgatgcccaagtctgccttgttatcggccacagcttgtgtaatggctttcattgcagttttgtcctcaggatttggaatgtgatttggaaacatgcctgaatatgtaatttgtaaaatgacaggcaagacgagactaccggcatgaagaaaaggtgcagatattaccatcaggctctaggaattggctcccagtagtaatagcgcctaacggcttgagtaccttatcctgatccaagaacaacatgaacttcaaacaaaaaatggtgcattgctgaaaaacaattaatggaaatatggaagtaaagggattaccacaaaaaagccacctgctccattccctgcatccacgact

SEQ ID NO: 90888 - DNA, 2021 bp, Oryza sativa
tgagcatctgtttttcttcttttgccccgtctgctcttcctccagatggtctacaccaggaatggtagccgtacaacaggcgagggcagcaacggcgaagagcgcactgatggtgtgcatcccaacagcgatttcggcaatggtccgccaccactccccgagaatccgacccttgcccaagtaatggctcatcagacacagatgatgacagctatgacgcagcaggtgcagcagcagcaccagcagatgtaccagaggatgcagcagcaagccgagcagcagtagcagcagtttggtccccctccccctccgtccaaactgccggagtttcgacgcattagaccacccaccttctccagcaccaccaaccctatggaggcgaatgactggctccatgccatagagaagaagctaaatctcctacagtgcaatgatcaggagaaggtcgccttcgccacacaccagctccaaggtcccgcatcagcttggtgggacaatcacatggccacacgcccaccaggcactgaagtcacttgggcagagttctgtcgcagcttcaggcaagtgccagatgggttgtggcacaaaagaagagggaattccgggcactccaccagggcaacaggacagtgacggagtatttccatgagttcaatcgcctcgcgcgatatgcaccggaggatgtccgtaccgacgccgagaagcaggagaaattcctagcaggtctggatgatgagctaaccaatcagttgatatctggagattacgccgactttgagaggctggttgacaaggcaatccgccaggaggatcaacgcaacaaaatggacaggaagagcaaggcggcgcagttccggtcaaaccaagggagccaccagcgaccgcgcttcactcccggacagcagagtggacctaccaccctgatcgtccaccagcaccgccctttcaatgccagcaacttccatcagggtgccagtggcagccagaaccaccatggtggtcagcccaaccgcagtgcagctccgcgcccacaaatggcactagcacagtcagctacgtccgcgcaagccaagaaggagactgggacaaagccagggtcctgcttcaactgtggcgagcttggccacttcgctaagaaatgcccgaagcctaggcgtgccgagccaaggtttgtccaggcccgtgtcaaccacgcatctacagaggaggcacaagcagcaccagaggtggtactaggtaggtttcctgttaactcaatcccagcaacaatactttttgattctggtgcaacgcattcgttcatttcaaagaagtttgttgggatgcatgggttaataagagaggaacttagcacaccaatgcgggttcataccccagggaatagctccacttcggttcaattcagcccttctataacaatagaaattcaaagatcaccatttctggccaacctcatccttctcggatccaaagacctagatgtcattcttgggatggattggctgaccaagttcaagggagtcattgattgtgcgaatcgcacagtcaccttgaccaacgagaagggagaaacagtagtgtacaaatcaccagtctcaccaaagcaaggggtctctttgaatcagattgaggtggaaatcccagtggtcaccgaggagaagaattcgaggaaattggaagagattcccatagtctgcgagtacccaaaagtgtttcccgaagacctcactaccatgccacccaagagagagattgaattccggattgatttggcaccgggaaccgctccaatttacaagagaccgtacaggatggcagccaacgagctagcagaggtcaagaagtaggttgatgagcagctgcagaaagggtacattcgaccaagtacctcaccttggggtgctccggtcatttttgtggagaagaaggacaagcaaagagcatgtgcgtcgattatcgcgcactcaatgaggtcacaatcaagaacaaatatcctttgccgcggattgggctgcaggaat

SEQ ID NO: 90889 - DNA, 568 bp, Oryza sativa
catgttggcgcacggaaacgtgtcgtggggctgtgtcttgtgggtacagttgtacacctctgatcagagtaaaactattcgaatagccgtgcccgcggttatgggcggtcaaccagattcactgtgattagtctcatcctagtttagtctaatgaaattggatagtataggtggatggttgggcctgtcgcaacggggtatagcgttggacagtggatgaataatattgattaattatcacgactgtttaattcttttaacttctgtttataaatgctcgctttatgcaaatgaaccactctagctctcctttgataattccctgcatcatacccctattccggtatgacttgctgagtacagtgggtagttctcagtcttgctctattttccccaaccccagagtacgagtatgtgtcagatggtggtttctccgaggagtaggcttcgtccgtgccgtcgaggatgcctgtggagtggtgttcccgctgcagatcaagtcaaggcttagctccagttatctttcatttttccgctgcatttatgtaagacttttatgatgtttgta

SEQ ID NO: 90890 - DNA, 1088 bp, Oryza sativa
accctcggaaagtaaacgtcgcaatgctcgaccaatatccacaagaaacagaggacaatctcgtccatctcctgaaggcgcagcattacaagacgttcatattgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactctatgtagggcttggtatcggttccgtcatttggtccgcggcaaatggagagaaagacttaggcggaagttcaaatttcctgtgaatacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcggggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtata

SEQ ID NO: 90891 - DNA, 676 bp, Oryza sativa
aattcctgcagcccacaaaatactcaaataatttgtagccagttttttttttttacattttgtatctctttctagttaactggcctattttcttgttacattttttaggtggttttgcgaccaatatcattggaatgacttctacggtggccagatcacttgctgatgatccagatccaagagatattatggaccatgtaccaatcggaaaatggatagtatacctattccttgttggtatgacgggagtgttaataaatgtgccatttaaccaggtttcttctttcactgattgatcatttttttttaattttagaagtttctacttaacatttctaagattgttttgcattattctcatccttaaacataattcataagttgatttccttatactgcaggtcatgattattgactacaaattactatttccaacaggaacagttatagctcagcttattaatagctttcatacccctgaaggagcttacgtagcaaagtaatgaagtcttgttttcttagtaaaaaattgacagattgaatttcatttaactatattcatgattttgtgcactaatatttgcatgtaatccagaatgcaggttgcgaccattttcaaagtattttttggcagtttttcttggtctatgttccagtggttctatactgcaggcga

SEQ ID NO: 90892 - DNA, 588 bp, Oryza sativa
tgtcaacagcgcagccttcctgtcttttcccaggctagcgcttccacatgttttatggttgcaaagcctcattataataatccgcaaatctccatataacagcattaaacttcggatgatcatatcttggtcatacgaactctgaatcgacccgttcaagtctcctaatgtttgttataacctaaagaaccctgtgctttctttttatgtattgttattgcttctttataggcttgtagctttgcttgtgtgcttcgcgtagctttcgtcgttccggaggttcccgaagcgtggttcgtggtcgtcgccgaaggttcggaaggccgttctctctgagcaaggcaagtcacatcatctttgaacatattgaatcccagtttataaaattattttgatttaaattaatgcattatcgctttatttaaattcccgtgttatcactgttttatttagccatgcctatttacctttgttaagaccttattattgctattgttattattaccttggttccaaaaccccccccccttttaaggggggggggaaaaaaaaaaaacccccaaaaaaaaaaaaaaaccccccccccaa

SEQ ID NO: 90893 - DNA, 621 bp, Oryza sativa
aggtcagccatgcttaaaggattcaatgtgcctcaaggcaaatattatctcgttgatggtggatatgctaacacgccatccttccttgcaccgtaccgtggtgttcgataccatctgaaggaatttgggcgtggacagcaacgaccaagaaagtatacggagttgttcaatcataggcatgccatattgcggaatcacatagagagagcaattagtgttcttaagaaacggttccctattttaaaagttggaacgcatcattctattgaaaaccaagtgaagattccagttgccatagtggtgttccacaatcttatacggatgcttaatggggatgagggttggttgaatcaccaaggaagcaacatatctccagaacagtttattgatgtccctgaaggtgacgatgaatatagtaatgatgtgatgtcccttaacagtcaagtagatgatggaaacgcggttagagatatgatagccctaaatatgtggaatgactacagtcaaaacttgtcttaataaatgtgagtcttaactggtctcatgaaatattttgcttttgtatttgcatcatgatgtttttgcatgcttaaatttgataacggttttttttttaattcg

SEQ ID NO: 90894 - DNA, 1834 bp, Oryza sativa
cggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcacgacattccagggatatgagatcaatgggtacacattctacacgagagcccaagacatgaagagcacgaaccaaaacagcgctattcgtgtcgatgccatgggacacgatggaacaactgccacgtattacgatgccatcgaggacatatgggaacttgactatggtcctctcaaggttcctctgttccggtgccaatgggttaggttgactggtggaggcgtaatgattgatgatagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcatgattattagaggtttcaacaagtttaaatcatgtatatgctagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatattggaatttttattaattataagtcatatatttgcttattacgatttatccacttaatttattacagacaaaaataatttttcgaagtaattgtcattaatttttgtactttaaataatattaatgcattaacttctattttataaacacatatgtaagcgaaaatcatatgcagtgctataatctttagtcccggttcttaaccctaaccgggtttaaaaagaatttcgaaatagc

SEQ ID NO: 90895 - DNA, 1735 bp, Oryza sativa
acgtagctgaatcatgtgcctcgggagcatctggagtcgtggccgacgctgaatggctggcagtaggagacaccggagccttaggaatcacaggcaacgatgacggcgacgtgacagcagctcccgatcccgagggcgacgacagagcgggagaatctccgcccgtatcatcatgatcttctgtgaactccggatcttgtgtggctgtgttgaaatccagctctatatgatctgtattctctgcattttcttcagcaaaagtattagtatgttcaggattatcaagcatatggtcatctcctattgttgtacccctaccagtactatcatccgggttcagaagtgtaggtggcagcaataaaatctcagaccgtagtcttgcaccggcattagagtggagggatgcaaaaggaaaaacattctcatcaaagacaacatcccttgaaatatacactctaccagctgctacatctagacacttgaaccccttgtgtaaattactataacccaagaacacacactgtttggaacggaattgaagctttcttgcattatatggacgaagattgggccaacatgcacaaccgaagacccgaagggatgtatagctgggtttttgatgaaataaatgctctagaggcgtttcatattgaatgactttacttggtgtgcgatttataagataggtggcagcaatgaaagcttcatcccaaaatttcaaaggcatggatgcatgagcaaggagagataacccaacctctacaatgtgtctatgcttgcgttctgcagaaccattttgttgatgtgtatgaggacatgaaacatgatgactaatgccaatcttagtaaagaaatcatgtaacttttcatattctcctccccagtctgtttgcatggcaatgattttgcgataaaaaattctctcaacaagctgttgaaactcatggaatttatggaatacttcagatttttgcttaagaagatatatccaagtaaatttgctaaaatcatcgatgaaactgacatagtattttctgcccccaacagagtcaggagcaggaccccatacatcagaaaacacaagctctaaaggaaaatttgacgcacttgtagatttgagaaagggaagttgatgactttttcccttttgacatgcatcacacacacctaactcttttgactctcctagacatgggagattattatgactcacgaccttttgaacaatttgccatgagggatgccctagacgactatgccatattgagacagtgggcttgatagctcctaagacttgcttggatgaagacgtggaggctggtagaggatagagtccattacaacagggtcctctaagaagagtgttcttcgtgatttgatccttgatagcaaaaaaccgagggtgaacttcaacaaaggcatgattatcaacggcaagacgatgtgcagatataagattctttttggttctaggaacatgaagaatatttctcaaatatagattgcgtgtaggggtacgaatagtagattgacctatatgcttaatatccatacctgaaccactcgccgtgtggatttgttccttgccgttgtatctgtcacgggttgtaagcttctcaagctcattagtgatatgatctgtggcaccggtatccacgtaccagttcgaatctacaccatacgaggcagccgctgcaacccttgcgtccggcacaaaggagtcatcgtagcaatg

SEQ ID NO: 90896 - DNA, 2922 bp, Oryza sativa
acagaaggccgacgatcatcttccatgcatgagccgctgtgtcgacgtttgcgacttggatgagaatctccttggagatgcttgatagaaggaaaccgaggacctgttggtccgcagcaatccatgcctcatatgccggattggaaactttcttggttatttcacccttttctccttccttgacttctatttccgccgatggaacttgtgttgcaccggtcagataaccttccatacgtgcgccgcaaatcactgggagaatatgcgtcttccatagcgagaaattgttcttcgtcagcttttctgaaatagcttggccgaagagaggattcacggcagcgccggaggaggatgccatcgctagtttgatctagtcgtggcgagaaggctctgataccatgtaaaagtgcgtaaccattctcacctcgtctcgaagcagcgtatgtatatttatatgttgttgagaagaaccctcaacgtggcttacaagattgaatcagtttggatccgattacaagagataaaacattgtttcatgtgagaaacaaactctagacttatctctaagcctatgcaaatctaaaccatattatatctctaataaacacctcgtccgagaactcgtcaggtggctcaatcttctcctccgcctccgacgacatgcccgccatcatcgccccccgagacgcttgatctctctgctaacttgaatgcaaaaaatcgtgcgctggatcaagaactgaagatctggcagatcgatgagaaaccccaactccttgcctgtcacgcccagaaattcccgaatagaattccaagcagaatgtgcattaaaatccccgtccaggaccggccggggtacacaaacgacaatgttaacattcagatccatgtcttacaaacatcataaaagtcttacataaatacagcggaaaaatgaaagataattggagctaagccttgacttgatctgcagcgggaacacaactccacaggcatcctcgacggcacggacgaagcctactcctcggagaaaccaccatctgacacatactcgtactctggggttggggaaaatagagcaagactgagtactacccactgtactcagcaagtcataccggaataggggtatgatgcagggaattatcaaaggagagctagagtggttcatttgcataaaggttcatttgcattaaagcgagcatttataaacagaagttaaaagaattaaacagtcctgataattaatcaatattattcatccactatccaacgctataccacgttgcgacaggcccaaccatccacctatactatccaatttcattagactaaactagggtgagactaatcacggtgaatctggttgaccgcccataaccgcgggcacggctattcgaatagttttactctgatcagaggtgtacaactgtacccacaagacacagccccacgacacgtttccgtgcgccaacatgccaccacgacataccggaaagaggccgtgacaggacccttcgcataaccccctctaaccaagcacaccacacctcaagtttcacccccactccttgcaaggcagtgggcagtcccctctcatgcttaggtgaatccggaagagacagaggccgtcgtagggcccgccccgctccatcacgcccacccttgcctggatgcgtcagctagaggaaagctacactataagcccagccgttgcccacgctagtttgtggtaagtacgataagttcttccagggcatcccgcgaaccggtccttaactgccatgggtgcgaccagcaaaaccatgcacccacagcccaccatgtgattcattttaattaaccaacaccaaagcagtggcactaatccaacaataccattagaactaacagtctaaacattaataggatttttcccattgtgtactagttgaactaagcatggctaagcaacccctagtccaatctctagtcatgttataacccaagctaacaaaggaacatggtacaacaatagcatggctataacaataggtaaacaccccatagtaacattataaaacgatgcagtatttgaagaaaaataatagagcatttgcaatataggatcaacatgttcaagtgacaagtatgacttgccttgctctgttgttggaggaacctcggcgactatttcgaagtacaccggagcgtcagaagaaccggaatctaagcgacatacaaagcaaacaatacaaacaggctataagactactgaaacagagaacaaaaccatttttaatggatgctacacatttttcttgatttactgagacttgaatgggcttaaacggagcacggatgaattagttatgaattttggaagattcactgtatttattactataacaaaagtccttaaatcatttattgcgcaataaatcccagggctgacgtcatcaggggggcggcgccgacaggcggggcccgcatgtcagtggcgcacgggggccggtctaccgtggaccgggaccacgcgggtggtccaccgccggtccacgggatcgacggcccggatcggcccggggccgatcggacggtgcggcggcggcctggcttggctcggctcggcacaaagccggccggccggccatggcaagggcggcggcgcgcgcgcgtgttgctggcgacggcaaccggcggcgggaggcggcggcgcaaaggcggcggtgcacgaccggggcggctaggagggagagggaggggaatagaggaggagggatgcctcactgagagtggccggcgcggaggagaacgacggcgaacggcgacggcgagccacgggaggacaacggcggcgggcggacgagctccgggaggccctaagagaggaaaagagagagattagggggagggagatggaccacggcgatcagaaaccat

SEQ ID NO: 90897 - DNA, 2180 bp, Oryza sativa
ggaaaaagaaggaaaaaggatttttcctgggattaaaattgcatgtgcttaattttaattggttaaaattatttcaagagctctaaaaattccactaaaaatcttgttagcgtatttcggcatgtaaaactcaagaaaaattccacatgccaattccgattattatttgcattaatttattaaggtttactcttgcttgacacaggtattttcttgagaccatttaaaactccaatttaggcttgggaaagaacttcggggtgtgacattgcctctccaatataaatggcaaaacttcttgttctattcggtcaaaaatctaataacagaaacagagtcagcaactgaagaataaccctcgttctaaccggattctaaacctttgcacacaattctttttcgtaatcggtgtgatctctatcaagattacaagataaactaatctactcctagcttggtgcatggcttgaagatgatcgatcgtgtgacgcaccgcggctcaccgtggtaaactgcaacggcttccaagttccaactaacctcgaaccggaaactgtattttcatattaagagttcttaaaagttatcaactcaaagcccaaccgtcaaagaccgaaaaccaaaaggggagttggttaagcgcgtgccgatttcgagtcgggtccatggggcccacgcaccttcgcgtcgccgactccgtcggcggcggacgcagagcttaattcattttttctcttcaaattcctgggtatgcacttgaacgaatttttcaacaaattttaaatcacatttggaaaacccaacattctactaaaacattaaaaccttggactaaaagtttaaaaagaaacaattctaatatcgaaactttcaactcaaactagaagtttcagcttaaattaaaaaatatatacttaaaaactaaactcaaaatttgaaatttaaatttttcaactgatttttaaaaatctttcatatgttaatttgaaattttcaactcaacttatttatttataattttctagtagaaagttatcaaatgctagaaaggagaaccacacggtgcaggaggggttgcgcgaggaatgaaaaccgttcacggttagcctagggcgttcacgttgcaggatacatagagttatgtggcagcataccatgtagttacatgatgaggttatactataagaacactagctgtaacatcataaaaattaatttaaagcacacaaaaaaaaagaataatttaaacctttttttcccccaaattgcatcatgtatggggatgtttactgtgaagagtgcatatatagcttggaatctatctcggaaaggtcttgtccaggcatcttcgggcaccgcaacatctcgtaaaagggaggtatggaatagtgtgtggaatgccaaagtgaagggcactgtaaagattttcatttggaagctggtctaggacaaattgccaacgtgagagaataaagagagaagaaaaatcgaaaggcaagggatgtacccactctgtggagcaaaagaaaagaatagctaccatgcaacagttgaatgtacaaaagctaaggtgctaagggaggcttttagagcagtctggcaccttcgtgaagaggacaaatttgcatagacaggaccggattggttactgatattgttggatgctgtaaataaagaggaaagagtgcacattatgtatatgctatgacgggcttggtacctacgaaacgagttgattcatggtgatggatgaaggccaatagcagtatcagtgagcttccttgctagctatgaggaggtgctgcttcgcatctgacagcagctggacgacacataaggaaaaaagccaatgtatagcgaagcccagaccgaatctcataaggtggaaaagcaaacaaacaaatgcacggctccacctgaaggctcggctaagatcaatgttgatgctagattcagggcagaaacaagggacgcaagtgtaggagtaataatcagtgattgcagaggtctgatcctacttgatgcatgcaagacgctacaccgatgcagttcagtagcataggcagaagcgctggcgtgcttggaaggcatccgactggcgattgaatgggtgcatatgcctgctattctagaatctgacaacgtggaagttgtggctagcttgacaatgaaaagctcat

SEQ ID NO: 90898 - DNA, 3062 bp, Oryza sativa
tgccggcactatcccggccgtcatctggatcctcatgccgacgaagcagatgacgacgctgagcaccaccgccacggccatggcccgtggcgtcaccagctccctgaattccggcgatggctgcttctcgaacaccgcctccaccgatgtcgctgacatgggatcgccgatcatcgcatccatggcgattaaagctccaggtcaatggaggcaacctcctggagggtttttgggttgtgttgtgatggcacaagtgggtggtctcctgggttggctctcctaggaacaatgcatgggttggtctgaattgggaggtggtgagggaatgtagtgtcgctgtggagcaaaaatagcgtctgtttgttgaaccgatttctctgattctgttccttatttctatattgatgaaacagatgctgctgagggcaacatacctaatgtttacagggtggaaacggttacaatgagtgtccagaaagtagttttaaccatttgctttaagatttgtacgaggtctatcaaaactatgctaggggttaaaatagaatagaaatttgaattagaattagaattgatggatgtgacatgtagaataccaataatttcgcactcttttgcacacacttcaaccattgatcaactcatatatgcttaagaacacatttgttaacgaggtttatagccaaagcataaatcttgacactctaattatggatgctactcctcaatcaatagtacacctaactgctataggcctatgacaatgctgccatcctcctcgtgagtgcctacattgcattttcgtcaccatgcatagttacattgtggtgtcctctatatttaaagagttgatacgttacaagagtcaaaagctaaccctaccctatcacctgtattaatacaacactttgcatagaaaaatatgctgagaaactcctgttgagtaccacaagcttttaagattttgtactgcattatgttagaaaacagtgaacatttgtggaatagtagtataattcatatttcaactacaactttattctgtggcacttaactataacaagcatctcttacatgttgcaaccaaagctggctcacatgtctacttatgtcaattacatgacatatctatatgtaaaatacgatacgtgcatcattatttacaatgatcaataatgattcatagaccacttaatttccaccgagatgtggtaaccaattaaggagtactaacagtcaatcttaatttgatgagtgcatatattaacttgatctcaacatcgatcggtcatgtcttgggtactgttcctcccgagctgttcaggaatgagtccaccacctcaacctcttgtccactgggcaagaacttcatgcacatcggcggtagcaccttgaacatgttgagcaacgccgatggcagcgtgaagagcccctcgccgcagatcaagcccgctgcgacggcggccgacaggatctcggcgctcatggtgtcgatcttcttccagaggagcagcagcaggccgcccaggcacatgtcgagggtgaagtacgacccggcgaagaacggcagcgcgatcaccgtcatgctcgggatgtagaggtggagcctccaccccttgagctgcgagaccagcaccagggcgtcgatggcgatggtcaccaggacggcgatgacgcagagctcgacgcagtactttgggaggcccttcacccctcccatgccgatgatgcagatggcgcggtacagcccggcgtaggggcacgggtagacggagtccttggaccccagcggcgccccgggcttcgccgccttctcgaacgcgcggaagatgcaggggctgaccacggagctgagcgccacgccgaacacctgcccggcgatcatggcgcgcggcgacgtcagcgtcatgtgcgccgacttgaggtcctgcatcgcctgcgacgagacgtgcagcgacgccatggtgatcccgctgacgaggaggctggcgacgatggcgcccggcctggcgatccacgccgcgaagatgaagggggagaacttggcgtaggtgttcgacaccgaccagtcggtgagccccgtcgcgtaggtgttgcagaagccgaccacgggtatggcgaggtagagcacgccgacgtggtagtacttgatctggtcgaacatggccggcatcgcgaccatgctgatggccgtccatgcgacgtaggccgccaccggcacgaacattgggatcttgctggacaagaacatctcgatccttttgcgttcgtcgtagttcatgctagggttcttgctgatgtagctggccagccctgacgtttgctgttgctgttgccttatatggtagaagttaattgcagctgaagtcacgagtatcagaaagtttatcaggccgtcagtgacgatcagtgtcacgctgatgaacacctgccatgtaagtttatatccattggagaaaaaaaaacaagaagtttagaatagttcgtgtcactagtgaaaaactaccaaaattaatatggctttcatccaccgcatgcatatatctggaaattatatcagaaggtttgttcaagttataaattggatacatggatcatgacaaaaattctaatatactaggtattactatacttgataccttcatatgcatttcaattagtactactcccccgtttcataatgtaagtttttctagcattgcgcatattcatatagatatgagcaatgctagaaagacttacattatgaaacggaggaagtagctattaatttgggggacaaaattctttccgtgcattggttagtacgtaccacaaaatgagtgagataaaatcttattagatgatccaacaattgatatgatcttattatttacgtatatatatctttattgtttctctgagttcctcagttttgaggcttggagtttaagaactctcgtaactttcggctatctgtggataaagaggtaggtcggatttttatccattatattaagaaaagaaatgtaccttgtatccattgagtccgtctaagtttgaagggctagggctgcaggaat

SEQ ID NO: 90899 - DNA, 9513 bp, Oryza sativa
tcttgcattcctagactgagtacccgataatttgagaaaattcaccgttgcttgaatcacccgaagaaattaccaccatagcactcgctcttcctcttcagtgacgcagattccatatatccccatcatgcaaaccccgcagattctggatatatcctgtactgccaaacagacacgttgacaccctcaacgattttcccccgcttttcccccgctattgccaaggaccccacgcactgctgtacacctctgcctgagcctccaccttctccgatcaatccattgcgaacgcctaaacctagttctcaattactgttgttaattcacgatcccctttttcggcttagctagataacctgagtctaaattgactctgtcatctcttctgccacccggcctccaacgagttcatcgactctgagttgagaacaactcctcaatcacaccgtaaccagcgacaaacaaaaaaccgcactgttccgtctaccatccgacctcctcgcctttggctcacgtactgtgccatgcctctacttagacggaccaacacagtttcgactaccaattctggcgcttgattggattcggtttccgtgcctgcccagccaccagccaccatgtagttgcctccaagacaacaaaaatattcagatatccctgctttgcattaatggccaccatgattctcatgcatgtgcgcacaccacgtccatgcatagcttcctatgacagcccacaatccaatgctcaagcaatctcatatttttgtcttccttactgctacgtgccattggatggtacttgcacatcttgctcagaacccctgtgtgcagccctcctgcgtgatgcgcataactgctccctcggacaccatccttgtacgagctaccgccgcctccgttgaccagagctggcctgcgttgaatcccgccggcacctacacgacgaccacaccaagccgtgttcctaccactagagttcgtcgaaaacaaaaccgctccgacctccaattgaccgcctgtcaatctagccatgagccgaagccgacaaatcaccatgctgtcttctcagccgccaaacgacccgaatgctatgtctagccatctccatgtcgaacgcagctcatcgaaaggcccgggccatctccatgtcgaacgtagctcatcgaaaagcccgggccacctcgcctggagtgttcgattccaccaacctagaacgccgatcgcgtctagcttcaatcaaccccgagcatgaggccttacatctccctgttgaaagtagctcaccggaaagttcgagccacccgcccgaagtgtccgatccaccgattggatcgccaatcgcttccgccgccatcaacccaagcactatgtctggtcatctccctgttgaaaatagccatcgaacggttcagactgccgcctaaagtgtccgattccaccgatcaaattccgtttatcgccgccgtgctccaccttgcgtctatgtctgtccctagacaccttgtgtagtcgtcacggcgtggagcacctcccttgtacctctaccatggatctcccgcaggctctgataccacttgttataaaaccggccccgaaatcacatcggaaaccaaatgtggaagaaacgccataggagatccaaacacgataacgacactgaggcatgatatttgataacggagttcagccgaagccttcatctccggggcactgattatgggcgctcctccccgatccagcatattacagcgtatccgagttacaacgactcacggccggatgccgctggcagccgctccctctcgctatgctaagtcgccgtgcggttacaacaagcacgcccctttatttatgagagatcctaggatagagtccaactcttactctagtcctacacctagtacaactccaagtcctaaactataaccgactttgtacacatattcgagacaaactctaacaatcaaggcagcgatcttcagcggacaccgctgctaggtggcaacccaacggtggtaggggggcggttaggtgcgagggggaggcgcggacgcggggtagcccgacgcacagggaggggtggcgagcggaggcgcagatgccatgtggagcacggggtagggggtagcggggagaagttttgcatcgacggggattttgtgaggacagggaagaggctgtagccatggcgatggagggagatggaggcatatggtctcgacggcggcggtggatcatgatggaggcaggacaatggagcggtggagatggaggacggcgcggtggagggagacgccggcagtgggtcacgtggaggcagcgtcggacgcggttgccatgattcggcaatatccgcccgcacgaagatggtggacggtgatgcggtggcgaaggggaagagtggagaagcggccaacggcgaccccgcctctccggcatatcatgccagcgtcgcgagcgcacgaggaggcggcgacaaagggtagggcgagcggtgaagagggagaagatggcagcggtggaggccgtcgacggcggcagagacgtagtagaggtgtcgttgggagcagtcggggttagatgcacgttctttttgtttttttttttgcattcttttttccttttttggcgttctttttttttccacgtttctttttttccgtgcgtgacatgcatggtccgccgatggtgtggtttctttgggccggatgacaggtgggtcccacgtgatatgtggatccaagattaaaggattgaagatgaaactcatattttttatattagtacagaagaaatcaaaagaatagcatattaattctaaaaaacaagaatgacatagagatgataaggatgatgggtgtagactaactaggaagtctcgagttcaaatcctatacaacacacagatgcatctttcgtgtagaaaaaagatggtgtggggagttcaaatcctacaaaacacacggatgcgtatttcgtgcaaaaaaaaatggtgtgggttgcaaccaggggcggatccagaacaaaataatagttggggctaaacaaactaggagaaccttcagcccccatatcatatggatctatacaaataatttttagtgagggcttagagcgatctccatggttccagtggtcccagtggccgtagtggggtctcaagacccccacgttaaatccgccactggttgcaacttggatgtgtgagtgtgtatagatgcccactaaaattcaaaatacttttttgttttgttttggagcctaataaaatgaaaatatagaaaaccattttcacaagtagatattaaggcatccacctttgagaattttttaggcgggcggcttaagtcgaatatatgtgaaaatcgatttttatatatgaaccaaccaacctcctataaaaattttggagtttaaactttctaagtaaccagaaattgtaagaactaagagctttaaatcactaccacagaaaatgtcattggtgccggttgagaaccccacaaaggtgccggtttttctaaccaacaccatgaagatgacactgattagaacactgcacctttgaggtatacgatttgcaaaaatcaaagcaacccaaaaaaaacatctaaaaatctaccaaaaaggacaactacacatcagcatcacacaatcaacaactgcacatgggagcccgccggatctggcggaggggaacccgctgtgtaacaccctaaaaattcgacgacaaaagctaaactctaaaaatacggatcttcaaaaactttttaaataaagttgcatcatgccaattttgttcgattattttattgaatttttatttcggagtttataaatcgcgaataatggataattagttaggaataaaccctgaaaagtaaattgactaagtaaataattaaagtacaatttaaaataatatttagtgaggatagaaatgagtaaaatattattacgactatatttgtatcaattaaattgaaaagtgtcggaataagaattaactctaattaaattcaagaaaattatataaaaataaaatatgggtaaaattaatcaaggatggacccattggttggaataacacaaatattgagtgaacttcatttgtacaaaaattaaggtttatagaatcaattttaaataaataaataggcttaaatcgggtaaatagaaaacggcactattcatcggccgctaggtgttcgacgaggtcccctagcctaaccctgccccgctgccgcgccgacaccgcgcccgcgccccacgcctcgcgccgcgcaccgccgctaccgccgtcgccgtcgccgctcgcccgtcacatcgccttgcgccccgtgccgccgctgccgcgctgtcgccatcgccgtcgcgacccgcctcgcgccgcgcgccaccgctgccgccctgtcaccacccgtcccgtcacgcgcgcgtcccatcgcccgccgctgcgccgcgcaccgtcgccgtcgccgtcgccgtcgccgtcgccacgtgccgttgccgtcgccgcctcgagccctacaccgccgtcgccatcgccgtcgcgccgcgccgtcccatcgccgcgcgcgtcccatcgctgcctcgcgccccgcgctgccgcgccgccgtcgcctcaccctccttcaccgccccctctctctcctctctctcacaccctataaaacccccagcccttctcttctcccccacacccattcccgtccatcacctccctttttaccgcggcgccgccgtagtgccgccgtaccgccgccttcatgctgccgcgccgccgttcccgtgccgtcgttcccgtgccgccgcgccgccgttctcgtgccgccgtgccgccactcccgcgccgccgtgcgccaccgtcgctgccgccgtcgtcgccgctgctgccgccggtgagccgccctccgttcccctcgcgtccaccgccgccactgctcgggtgggagagagagccgagagaaagagggagaggaaaagagaggctggcagagagagagaaagaaagagaggaaaagaaaaagagaaaaaaaaggaaattagagggagattagggaagtttagaaaatttaaaataattggaattttataggttaattatagtcatagaattgcaaaatttaatataaattatggattattcttggcaatttctataaggaatcaattcgcgataataatttagatgtagttaataactaaacaaatagatgaattcttatggattattatagattatttttttgggtaatccctataagtaatcaattcacggtagaaattcggatttaattcctagggattttagccgtgtattatatttaatcatctagtcatagactaaattaaatcatataatatttctaggatttcgtccgatatttagctcgcgataaaaatctctaacctattatatggatataatgctcgggtagattaaattaaaaacttatgacaacaaaacatttatacccgcaaaatagtttgaatcgaaattgggtttgccttagttcgcgaatagtaaagttaaaataaaggaatcaactttcgcattcgactttcatttggatttatttggattttgtttgaattctaatcgaattcaaattgttctttcgcacataattatagagaccgagggagccgcggatccgggtgaaggccaagacccgcaagaccttgagcaaggcaagtcatcactattccttgaacatgttgatcccaattgcgaagttgttttgtttacaaataaaattgcatgcaattatgaacatcctacttgtaattatgccatgccttgattattgtttaccccttattccttcgtaaccatgtttacgtatgagtctctagtcaattatgacaattgcttagaaatgctattctagaatcatgcatactcatatttatcaaatgctatatgcttgggcaattacctttgggaaggtaattgagatgcggtatgtggagacatgagcgccacattgccatgatattgatgacatgatttgtgaaaggaaaataaagttaaacaactgttttcgactggggcggctggaggatttgggtggtgtccggaaaaggctagtgccgtccctggtcaattaaggaccgagccatgaagttaagcatgaaacgaccccccgtacaaccgcacttctcgtatgggtatagacctagcggagtagatagctgagcggaggcagtatccatgcgtagtggtcttcttttaggtgtgtgatgtggcagcagtctgctggcagatgcccggttcggatggccaggtgaatggcggatgcccgttccggatggtcagaggctggcttggcaatactacatgaggatacccataagagaacaatcatgatggactgggttcaacgacaagaagcaacgtaggagtgtgtgtttttcccttcccgggagcgccagaactcctctcactgctagaaacgtatgacgcctagagtgcatgaggatgtaaagttcatggagcgggtactgccaatgcaaggttatcaaaaagctttgccgtgacgcgtctcatgtgttgggatgaggctcatgtgttgggcagtcgcggagtgcgggtaaagtgtacatccactgcagtgtgagtaaaccaaatctattcgaatagccgagctcgcggttaatgagcaccgggacatgtattacacttggctagactctaaattctttaacttgagtgggatggaatattgcatgataatttttatgctgatagagccacttcctgagaggcgggaatgtggacgtccttagaaaatcataacgactcaatggcgggaagctatccttgggatcacaatggatggtggacagaaccgtcattgtttattatgaacaatggtattaaaacttgattagtctttgctaggtcttaggcttgtgaaaagaattacaaaacttgctttgcgcaaatgaaccatagccatcctttgaaatcctctatcatgtgcatcattgctgtggtggcttgctgagtacggttggtactcacccttgcaaatataaaatttattagaagcgggagatgaagcttcggaggatccctatgcctactaccaggagggagatgaagacgaaggcgcccagtaggtcttagtacggtcgttgcctgtggcaatggcatgccgctgcttaaattctgctgccttacctatttctgcttttggatgtattccggaccgcttggtccgatgatttaagactatgcctgcaggcttatgatgtaataattcgtactacacattcgtgtatgtgtatttggtatttcagctatgaattcgtatgtaccagactacttgatccagggaaatggtactgtttacacgattgattcctgttataaaaacgggggtccacacgctgctaccgccacctcccgccgtcgcccatgggagcccactgccactgcctcccctcttgccggatctggcggaggggagcccgtcgctgccgctgcctcccccgctggatctggcggaggggagggcaccgcctgccgctgccgcctctcctcccgtcgtcgcccgctactgctgccgccgccgctgcctcccctcgcgccgaatctagtagaggggagggcgccgcccaccactgccgcctctccgcccacctcgctcggctcgtttgatagggtgtcggttttattaaaaaaccggcacctataatataatatattataggtatcggtttttaattaaccgacatctataatatatataatatattaaagataccttttttttaaaaaaaaggcacctagaagaaccgacacctatagtgtattaaaggtgccttttttttcatattttgaagggagaaaagtactatagataccgattttagctattccggcacctataatgccgacttgtatgtgcctttttttaagtagtgaataaatatttaggtacataaacaatctcaaatgtaaaactttcatctacaaagttataggtctcgttgatctctaccgttttgatatagattgtatctccatctaagatctttttttttaactctccatctatgatcttttttttatctctccatctaagatcttttgaaactcacaacactcggcgaggccagtgttgagctgtgcccgtgccctggccacgccgcttcacggccatccgatcagccctggccgatccggaccatcgatccccgcggactagccgtgtggaccgctgtggtttccttggtctagggtggaccgacccgctactattctaacaccagctaattgcagcttcaaaaatatcttacactgccgattttgtacacatgctttacacaaacttctaataagattgatacatcccacatgattcattacaaaaggataccaaacacagatttattgaaacaaaagcaagtaaatccttgtcaccttagacaaaaacttaagcaaacaaccagctgtaacattgctaggagatgttaacaaacaaacaagtgctgtgctgacgcacaaaaagagaggacatatatatatatatatatacatagtaaatttgtttggtgctccatggtgcccgggcaccattgttgaaattgagtatatacctaattcaaatgagtatgaaactttttcaattacttagatattaacattagctactttactaactagttcaaagcaagtttgaactgaatttgaacttatttttgttagattttgattctaggtatatagcatccatacatataattagttaggtatgtaatcatggattgtgaaataaagttaaatttgagttgttttgttgataggtataggtatgaatcgagttattataactaggtatatactcacaatttgaaaattttgaaaaatttgagtgattttttgtatttgataccatggtgcccgggcaccatggtgccccatatgagtgtcctatatacatatatgtatatatatatatatatacatatgtatatatgtatatgcatatatacatatatgtatatatacatatacatatatatgcatatacatatatatgtatatgcatatatgcatatacatatatatatatatatacatatatgtatatatacatatacatatatatgcatatacatatatatgtatatgcatatatgcatatacatatatatatatatacatatacatatacatgtacatgtatatgtatatacatgtacgtatatgtatatatgtacatatacatgtatatgtatatgtatatatacatatacatatacatatacatatacatatatatacatatacatatatatagggtaagactattctacacccgtattctatacccccttcctcatgttcccccttctttctctcgcttcccctcccccccttcctcctgttcccccttctctctcgcttcccctccccctcccgatctctctctctttccctcctcccgaccactctcccgtcactccccctccctcctcccgatcgggctgcaggaat

SEQ ID NO: 90900 - DNA, 1132 bp, Oryza sativa
ccagcctgataaatcattgcaaataagcaattaacccatcagtattagataacaaatataggaacttttaacaaaacatacggtatttgatgatatagcttgataaggcagacttgtttatttgaatcacaaaaatgttaataattgtaaaaaccaaaaagtggagacaaatgaagcagaaacaaacctctcgaagggcaaatgaagcatggcaacaacaataatcaaactcaataccctggcctatccgattgggcccgccacccaaaatcaacacctttttcttattagttggaacagactcacattcatactcatacgaggaatacatgtaaggtgtattggcttcaaactcagccgcacaagtatcaacccgcttgtatgttggagcaacttctagtgccaggcgccttaatctcacatcagtttctgaagaagatgtcgcaaaggcaatctgcgtgtcactaaaacccctccgcttcacttgatagaagtcatcttttgacagctgatctaggccccttgaaataaggaattgctcaacatccactagctccttgagctcagtaaggaaccatttatcaataaagctaatttcatggatatcctgaatcctcatgcctttcttaaaagctgcataaatagcatgaatccgatctgggttaggtacccgtaaactatattttaacttttcccagtcccagtcaagttccttgatgggtgcacaaccccatcctgcaaagccagtctccaatgaacggacagccttctggaaagactcctggaaggtccgtcctagagccatggcctcaccaacagacttcatctgtgtggttaatactggctcagacccagggaacttttcaaatgcaaaccgtggaatctgcatcgtaaatatatggtaagtcaggaaagaaggttaacagccctgcattaacttacaggtacaaattctgtatgatgaacaatgtgaagaacatgtctgagtcatcaactttgagtttgtactataaccaacaaacatgcaggtttagcaccattattgctatacgggcatgggtagttttgtgggtacacattggcccatctatatcaactaaaatgcagtttttctagttcatgttgggtattt

SEQ ID NO: 90901 - DNA, 1553 bp, Oryza sativa
atctgtgtccatccctaagcatcattgcgagtaattgcatcattatttgctggtagagcatattccaatttgtggatgtttaaatgcattaaagtagttgattactatgctgtgaagtttggacagcaggatagtatttctgagaaggtaggtatcacatcttacatgtacagaatatgcacttcatataaattctcaatttttgcattacagactggatacccaagggaggttggaagtactactggaacaattatcattgtataagcagcgctccaagatatgtggataatgtagctcaattgattgtgatattttggatctttatttgactaatatttagcaaagttttacagttgcatgggtaagatgataacaaagcaattgggagcacaccatgcaaaatggataaaagcatataccaaaacaaagctagtcagtactgagttaaataaacactactaggttagtgacaggtaaatgctagcacagtaatgcacagtttctttgacctaccaaactattaaatacaaagatggaatgaagcacatcaggagtaattgaagttatcattttaagtgatacaagtgtgcttgcaaaatcaataaccacccattgccaagcaaagggaaaggcctgccaggccgaattagtttggtactgtggtcatgtccgcattgcagaccctaactattgcaagcatttttagcacaactaaaggcaagatagcttctaaaataaggatgaaaaatgcaacaattgcacagtgcaccaaatatcattgcccaagaaatcttagaaacagagggaaaaagcaaaccttagtgaccacgtagtcaatggaaggctcaaagctagcaggagtcttcttcgtaatatcatttggaatctggtccaaagtataacctacagagagctttgcagccatcttggcaatcggaaaccctgtcgcctttgatgcaagagctgatgacctcgacaccctggggttcatctcaatcaccatcacctccccatcggcagggttcaccgcgaactgcacattggaacccccacactccacgccaatctcccggatgatcgccacggagtagtccctgagcctctggtactccttgtcggtgagcgtctgcgcgggcgcgaccgtgatggaatcccccgtatgcacgcccattggatcaatattctcaattgaacaaatgatgaccacattgtcagccatatcgcgcatcacctccagctcgtactccttccacccgagcagcgacttctccacaagcacctgctgcgtgtgcgacgccgccagcccggcacggcaaatgtcctcgaactcggcccgattgtacgcgatgcctcccccggtgccaccaagcgtgaaggccgggcgaacaatgagcgggaactccccgatgtcctcggcgatggagatgcactcctcgagcgtggtgccgatgccggagggcggcgtcttgaggccgatgcggtccatggcctgcttgaagagctggcggtcctctgcggcgcggatggccgggagggaggcgccgatgagg

SEQ ID NO: 90902 - DNA, 8235 bp, Oryza sativa
gggacggggaggggcggagctgggtcggggcggaggagagggaggtggccatagcggcggcggcggcggcggcggcggcggcgggtgaggaggaggagtggggcggaggcgtggtgggtggtggggaggtagggttttttgtggagatgagagtgggggggtacccgtgttaagggtttaacccttctactaatttaatttttttattgtgagctttgcttacttaaaattggacacctatacggtttctggtgtccacgtttcatgttcgaattataaacgcgctcaaacttaacgttctccctccgttttataattttcgtttcatattataattcgttttaatcttttatttcgttataaattcttttagtttaactaaacttataaaaaatatagtactccctccatcccataatataagtgattttgagcttttgcttacactgtttgaccactcgtcttattcaaaaaatttgtgcaaatataaaaaacgaaaagttgtggataaagtactttggataataaagtaagtcaaaaaataaataaataataattctaaaattttttgaataagacaaatggtcaaaaagtgcaagcaaaaactcaaaatctcttatattatgatatggagggagtaatattttcaacgcaatataagcatattatagtaatatattaaaagttagttttaataaaacaaatttggtgatgtaaatattactattatttttataaatttgattaaacttttaaaaaattaaaacgacttataatatgaaacggagagagtaggagcatacttctatcatatttgttttcgatgtctgaaatttaattactgaaaccgccttttgtcgtgaccttttcttttattttgggaaatttgatcccggagacacaaactggctgtctaatttgacttcgatacggatttgcagggtgtaaatcagtgatttaataatagcccggaacgtaatttgggatgtaacctaggtgtaacagtatataagaggataatgtgtttttttagaacagataatgtgtgttcacatcatcggcttaaaccataggaagaagaagagagggaaaaagaaaaggatgcggacaagttaaaaacgaacagaacagacaaaacttttgtgttttatgttccctgtaatagcatagaactagatagatgatgactagactgagaatatcttttttatacgatgctaatagcatcgcctcaatgggctgataatcagtttcattgtcatgctatcggggtgatgcagggtgtaattaacgtaaatcatttaatatcacctggttattgcgtcactgcttgcttggtgccccatcagtggcagagccagagacgccatcaagcccaaacgattaataacatttttggataatcgattaatttatataggtattaacagctatcgataatagagacggtagctaacaaaatccgggtagtcgtccgagttgttcgagaggtgccctccatagattaatttcctgtttagcttggttttttttttctctgctcttggttcagatatctcaacataagaggcacagtgaaccaaacaacagggcagaactaaagcaaattcagtcacactcgagtgcaggataaaagttcaggtacaatctctctgataacacagttctactcctacgattgatatacaaatttaatctatctaacaatgataaagcataaggatgtgaataatctcagtactaatgccggttttttgtgtccatatagatacacttaataattgcatgaggtcgatgtttctgatgacgatgagtcacgatttgtggatggttttggtttaaagaaaaaaatgagcacgcgattggcgccaatcaacggtggacccggcgagagctcatgccataaagcaaagcttgacggcccagataagatggccgctggtccctcttatggataagccaaaacaatgtatgcaaggggcaacttggacctaatcgtgatatttcgtagagaaaaacttggctctaataatgtcacactccaattaccgagcaaacaagccaatcaggagttgacagaaatgcaaggcctacctttgctcatgacccaattgacaagagagaagagtcccctacttttgtcttgccctgtggtatttaatactccttctattttaaattatttatcgtcctatgtctttaaagtcaaatatatttatatctgactgcaatttagagatccatataatatagcattacaagatttatatttttagattctctatgagaaatatttgcatgttgttgaactatacggatctctcgaaattgattgtcaaagttataaacgtttaacttatgacaaagctaaaacgataaataatttgtgaaggagaaagtattgaatctttaagtggataggctcaccacgacatgaatatggtgttgtctattgagacgaacaagttggatcacaacgtggttggtgggatgagaagggaaaggatatgggttgaagggagagatcgatgcaacgggagagatgcctcatacccgcactcccctcctccaaccttgctgccacgtcctctcttcccctcctagcccagcgccgtgttgagggcggctaccgggttgatggcggcgtcgacggtgttggggttggtagttgggttaattgtggcgtcgatggcgtttgtgtcctagtcgagggcatctccgtcggctgggttgatggcggcgttggcggcggctagtgggtggaggaggagaggtgagagcgttgggtgtaagcggcgaggtggtggctgcctcacctctcttggttagtatacattggacacactttacactgacatgtggggccagtgtgctgactcaaccagtcaacagagtcaaagatgcaatgctggacgaaaccgcctcctaaaccgcccaaggagtcgatttggaacggttttgtgagttggaggatgagatatacccaattttgcggttgaagtatgcgattcaaccatgcgcatgagttgaggaaggtaatgtagagttattctgaaacatttctcatcggaaataagttcactttgtgaccctcaaaagtgattgaaatctaatccgtgaccctaaaccacaaaactggatatcttgacctccaactcttaaaaccggtacaatctgactctcttgatggttttggagggcggtttcgctaacatggcgcctacatgatgatgttgactcagttttcggtccatgtggagttgacgtggtgtttgtgttctagaattaaagaaatatgtgctgggcccatttgtcattcgcactaaaataatgtgggacccactgacatgtatggcccacatgtcattcctgtttccttcttcctcttcctttttctccattctctctctttctctttctcccatttctcttcgtcttgtctgcagggagaaaatcggcggcgggcgctcgagggtccaagaggccgcggtggcgagcgggaagggaggcggtggctcggcggcagcagcggcgtgtgacccactgggagaatttctgcattccacaaccaaattccaatgagaaaccaattatggcacaagatatggattaccaatgaaagctacttaaggagattgagcatcgcgtcgttgattctaagtacctcgagtccaagaatatggaaatcaactcttccaggctcaccggcgacgcccgccatgaatcaacctgcgaacacgcgaaatcttctcatttcacggcgtgccgaaaatggcaaggcgcagcacgagccatagcgccgtaactcgagcttggcctcagactggagcgtcgtgagcgcgcatgggaagctactggactcgaggaatgcggcgaccgcggccaccacagtgggcctcgtcgtcgcgtcggggacggcggcagcggcgagcccttggaggacgaattggtcatgctcttctccttcctcgagtccttcatggctccctcttccgtctacgccgctgctgccgccgagccgccgccgggttgctgcctcccctcccgctcgccgccgcggccgcttggaccctcgagcgcccgccgctgcctgcagacgaagacgaagagagatgggagagagagagaagggagaggaagggaggaggaagaggaagaaggaaacgggaatgacatgtgggcccacatgtcagtgggtcccacattatattggtgtgaatgacaaatgggtcctgcacatatttttttaaattctagaacacataagcgtcacgttaactccatgtggaccgaagactgagtcaacatcgccacgtaggcgccatgtcagtgaaaccgtcctccaaaaccgccgagagagtcaaattgtaccggttttaagagttggggggtcaatatatccggttttgtggtttagggccacggattagattttgatcacttgtgagggtcacaaagtgaacttattccttctcttcgtgttgttataaatttggtccaaccctcactgggctggtcaggggcttggcccaaatctgggtccccgcggcaatcactgcaacctcaaggatttgacaactacttggaagttggaacttggaagaccagtcgcgcgtgggtacggttgggctcttgccacgtcctgccacacactgccgccccggtcctatcgatcgaagcgcgcgcgcgttccaaactgcgacatagggtagtacgcatgccgcgagcgatcgagcggttgcagcatgaattgggcaaaccaacccatgcacgcacgtagccacgtactccaacgtgcgcctccgtcgatcgccacctttcccggatcaagtacgagcccacgcacgaacgcacgcacaccactaggacagtccactcccactgcccttctccccctatatcgatcgcgcgccaagccgcccccgcccatgaacgcacgcgcagacacacctgcggcgctctctctctctctctctctctctctctctcgataccaatgatggcgacgacgacggtaacgcaccctgccgccgccgccgcgctcaaccacgagcgccacctcctccgccggctcgccgtctcttctcccacgatcctccacgccgcgtgggtcacggccctcgtcgccgtctgcctcgcgctctgcatcacccactcccgcaagccgctgccctcctcctcgtcgtcgtccaaggctgccaggcgcgagcgcggcgcctcgtcctcgacacggcgccgttccgcgccaggggatgagggcagcagtggcggcgtgggaggctcctccgccaaggccgccgccaccgccgccgccgccgccgccgccactgccacgacggcagccgaggtgtccccgacgccgagcgacgtcgctgccaaggccaacggccgtgtcggcgagactcaggcggcggcggcggcggcggagggagcggctgtccccgtcacggtcatcgacgtcgggacgcacggcccgatcgcgccggcgttcccggcgcccgacccgctcccgccgcggcggagcctgtcggcgaagcacatgcgcctcgcggagcggctcgggtcgcggatatggtcgacgcggtgggggcgggacgaccacgatgacgatgacgacgaggacgcaggcggtgacccggccgccgccgccgacgagggaggcaccacgctgtggacgaagacgatcatcctcggcgagcgttgccgcgtcggggacgacgaggacgaggacggcggcggcggcgcggtggtccggtggaggagctaccggccgaggcagccgcggtcgctgccgatgacgcggagcaactcgttcgccggcgtgggtagccgtagcctgcagctgcaaggcggcggcggcgcatccaggccaccacctgccgccgacgtgcccttccatctaggtcggacagctagccttcctgccaaggatgaactgtgacgtcgtctcacgaagtcacgaggctagactgctatagagttctcaaattaatgttcttccattttgatttcttttatatgtgacaccaccatgtttcagtgaaaatgtatgcagtatgcgtagttgaaaactttggcacagttgaaaaggtagaacttctattttattttctaaatcctataagtacataatctaagcgagaatctagattatcctttcttaataagcttcgtgcatctttataaatcttactagattatttagagtaggtggggattctggataaaagctaccaaaaatttgaaaaaataaccattttagaaaacttatatgaagattgaatcgtggtaaaaaactaatttcataaatgaatcttttgtccaagcgctaatcccgataacactgagctaagcctataacatctcagcgccattaatattggtgctgagattctattgaggtgacgaggatttgccaaatcaagcttagcttggcgctgaatccttcacaggatagaattatgtccatgcattcatttttagaaaactcagcgcgactcagcggtggaggtagccctattccggcccccctatatagctcctttgttcgttttctctcattatcccctatttcttttttctttttatctctttatccactattattttctcttttttctcctatctagtttcctttttcgttctctctttatctgtaaatttatttgttatgaatatagaaaaatatgaaagaagtatatatatggtaaatttaggaacttaaattatataatataatgtttgcattaatacttataaatcgacacccttatttttaggattttttttgttttctctcattatttgtaaatttatttgttttctaatttgaaaaaaacgaaagaagtaatttttttaaaaaaaaatatatggcgtttgtaaacttctttcattctaaattttaaaagtttgaaaaaatatactataagtcttttccatataaatattaggagagtgttctttccatgtgaatattaggatattaagagaaaaggttaaaagattaatgttttttcatacaaatataaagagggtattgggaaagtacagttcttttcatatgagagtaagagaaaataataaaaaaagaattaacagagtaaagttctttctaatttaatgagaaaaaaaataattaagagagttacgttctttcgaattttcacgggagagtaaaataaacaaaatgagaaaaagaagattgagattgaggagaaaaaataataagaaaaataactagagtggggagaaaaaataactaaaataagtagtatggcgctgagctcagatgatttggcaaattctcgccatatcgggcataatctcattgtcaatattagtggcgttaagatgttataggtcagcaccatcagggttgacgttgagcaaaatgttcatttttgcaattagtttttaccacgatttaattttcaaataaattttctgaaagtgtcattttatcaatatttcggtaaacctataagcctccaaacaagaccttttaccagctgctacacatagaagatatatgtaaaatgaggttagctattaacgtatgattaattaaatattaattattttaaatttaaaaataaattaatatgatctttaaaacaacttttatgtagatttttttttaagaaaacataccttttaagtggtttgggaagaaagtttttctcgctgctgccgaatgcacgtacatgctctccagtctccagacgcacataatattaattgggaagttttcatcttaattttcaattaaaacaaatgattgtgttcttacgtaaaatgttccaacctctccttactattcccgcacacactctttccgaactgctaaacaatatttttttaaaagaaaatcctataagaaagtggctttaaaaaatcgtaataatccagtttttaagtttacttagctcatgcttaattaattatgcctaatctatcgttctgttttttttggcaatttagtccttttagaaaacttatttcgaaactaaccctcaccaaaaaacttcaacaaaaaaataggccatggactcagcaccaatccgttggcgcaaaggtccaacgtctcagcgccaaatagtacggcgctaaaatttgccacgctagcagagttgattgtggacgtggctgtttggcgctgaccccatgtatgtaataagtagacattgtgctattctttgtcatgatttattgatagtgcagcggttgaaccacttg

SEQ ID NO: 90903 - DNA, 671 bp, Oryza sativa
atctacaatgttgtcctccttaggattttcctcaggcgtttgatcattgtgttttatcggtgcaaagtgctcatggggcatgacagtttctttactagaagtgctaggtgtatgtttcataggaaattcattctcaaataatgtagcatctctggactcaagaattgtaccaacatgcatgtcgggtactctagagtttactattaagaatctataactcacactgtggatagcataaccaaggaacacacaatcaacagtatttggtccaagtttccgctttttggctataggtacatttaccttggccaaacagccccatgttcgtaggtatgagagatttaatttcttcctttcccattcctcgaatggtgttactttcttatgcttcattggaattttattcaggacatgacacgcagtcaaaactgcctcaccccaccattccttggaaagccccgcagtgtctaacaaggcattcaccatctcagttagagtacggttctttctttcggccaccccatttgattggggtgaatagggaggcatcctctcatgaataattccaaactcttcgcaaaagaatgcaaactcattggaaaaatactccccacctctatcagacctcaaccgtttgattttcctttcaagttggttctctacctcagctt

SEQ ID NO: 90904 - DNA, 582 bp, Oryza sativa
ccctgcttgattctttgtcatgtttgttgttcctggaaataagctcaaaattgttgttccttaggaaaaggctttgatgaaatccgatcctccgactgctctacgtcgttctcctcggcgacaacaaagccaggctgccgggggcccaaaaatccagctcgatgcctgaggaagcactgccggcccgactggtcaaacaggttctcgaaagaggaagatgatcttaagcgatgatgatgacagtgaccatgagtcagccggcaaacaacctaaaagggctgctcccgcgaagaagaagaagacatccagcgcccaatgccaaagatccgaaggtctttcaggtataaacttgtcataatattcataatcatgtttactgaaatcaattaataatatcatcttgtacctcaggaaaccatcgtacattgatccgaccggtaagggcactgacccagctgctaattcagaaacggctggggaagaaaagactggctctactgatgctaccaaggctgatacctccaaggaaaaacctccaactggcagtcagtcggctactggtgaagctgatgctgacaacga

SEQ ID NO: 90905 - DNA, 1566 bp, Oryza sativa
agctccttagatgtagtagaaatctttaataagttaagaactgctccagatgtgtacttcaagaatatcaaagaggctaggaatatgggagcaagcatggcattggctatgaccaagtctctgtaccccaaaattgatgttgacgccattgacggctttgcagcaaggacaagtgaagaagatgcactttatctgattaatgatgcctagaaaactgcggagaaaattgctgtagatgtgctggataggtttcagagtactagccttagtcctgctgcgtgaattgcgagactgtagacggtgagccacgattcggggtttgtctttccatcatacttctcgataccagtcggtttaaagccggccggccaatccactcgacgcaggttgcttgtgacagctgccactccatcttcatcatcgtcgtagcggtccggtgtacggtgtcatcgattgcctctttctgctcggcggtgattgattgtgtcacgtaggtcgacgggctgtcggtgacgtggcgatcgaggctgttcagcgcggcgctctctgttcatgcgttcttcatgatccctgccctcgcgattagatcttgatcccgctatgctaaggctcggttggtgataatcttgagatcggagaggtggaactcagctgccagttggcgtccggatgctctccgagttgacaggaactgacgctgcaatcattgtctttgtctggttgattatgttaagaacatggttgggtggatcttctatgaggaggatatccaagagtgtgatcgtcgcaactgcgttttgttgtggagtgcgaaaaactgacgtggcttcaacatcttgctgtccaattagatctcgtgctcgacgtcctgatgccaaggcgcactgtcgtcgctcctcaacttcccatgccaatcgctcgcgctcctactgctcacgctgcagtcgggcttgctcttgggcttgtcgctcttgctccagccgaaggcgctcggcttcctgtcgtgcacgctgctcagcagcttctcgttatcggccataaaaacaccgaaaaagagaggagtgtagttgtcttcatagtcttcatcaaggtcgtcaaaatcgtcgaggttgttgaagtcatagtagtagccgaagtcgtcgtagtcgaggatctcggtgggttgacgagagtcgacaccgagagagctaaggtagccatctaattcttccgtggaaactatcctaagtggttgaagtatcacgccgacttccctagagccagattgaattgaggtcgaggccggattcaatctggacctatggggagaagacgctcttgtagtaaagacagcagccaaatcgtcgggcagcttcattaggatcgatggataagtcgccttgtcttgatctggttgtgaagaagtagatgagatctcgtccgagtggtttgaatccaactcggacaagatagtcttggagtagatctcggccgagtccaggaggccgaacggggcggagatggcatctactcccgactagtttaaatccaagtcgagaagagaaatcttgccgaagttgtcggtga

SEQ ID NO: 90906 - DNA, 1544 bp, Oryza sativa
ctaaccacatttattgcggtttggacgagcgcgtcacgccgcatgtagcgcagtgcagcgcgctcgtttatccggtctgtgactggtcacagaccgatcagatcgtgggttaggtggcgacaggcggtctgacgcacgcctcgccccatcccgtcaggatgagagcctccgagcactcgtccctagccgaagccggcgtgttagctcctggagatggcacgttggtcccggtcagatatatgccaggcttcatcccaaccattacaagcaagatattgtatgaagaagggcgaacatgcagattgctagactgacacgtggtggacaagaatgaccgatttgtgaccggtctgacactggtcatgtcgtcggcagacaaccatgttcccacgttgcacctgcttccggcggagtggaggtaggtatgggtcatcccatcagaaggtcattcggacagcagccattgcaagtctccgcccatttatgaagagatgacagggtgatccccgaggtcagacgagtgaggacgcgtggccacactcaaaaacaagcagtgtttttagctttctagagaaggcaagccaagtttgagtaaagataggataaagtccccaccaaaaagagagataggtagaggtggtgcatgtggtatccccttgagatataaaaggaggaccttgcccactaggaaaggggggaggatctgaggagaagatcccacgagaggaaaaaagggagaagagggtttctagagtaagagctctctggctctccagctctttgtagcttcttcagacacagatccaccagaacacaggagtagggtattacgcttctcagcggcccgaacctgtatacatcgcccgtgtcttgtgctttttccattgtcgcgaaccttccacagactaggagcttagaacctcaccctgagcccccggccgaaccggcaaaggggggcctgcgcggtctcccggtgaggagccccacgctccgtcaccaaggtaatcaagaaatagggtaatcaatgcaaactagccataacaaaggaataggttcacaccacccggtgacattcaaaaataaatgcacagttgaaataaatagagaatttaaatataggatcaacatgctcaaaggaattgtgtttgggatctgtgtgacttgccttgcaataacaggtcttcaattaatcttcttgaatacttccgatgcacttacgatccttcgaaacgacggaaacgccaagctaacacgtaaaacgaggaaaaagactagtaaaaaccaaataaacagcacatgtagagtaaacaaacatgtagatcatgattttagatgaatttagagacttgaacgtcctcattccgatttcatatgaattaattacgaattttacaagatttaattccaattaaacctattaaagaaaaagactattccacattaattaaaccgtttacaaatgatttataactgagagaaaagattaaagcaaagtacagaaaagattagattatattggtagatgacatatgataaaaagaacc

SEQ ID NO: 90907 - DNA, 3073 bp, Oryza sativa
cccaaaatatgttgcaaagcgaataatagtaataaaagtacaagatctcaatattgaaataatgcagtgttcatctagtcgctaaacgctagtcggacggccacctactgactagcgactaggctgattaggcggcgactagacggattaggcaaattaggcgaattagacgttttttctatttctttcacacaaaaatacttattctagacattcggtactcggtaaatataggcatttaggcaaatagcataaatcatagttaagttcagaaatcatcaagtccatacaacgcactgacactgcacatgaagcattgggtttagtacaaatctatagggatagcgaacacatcagtatagctactgtacatgtacatcataattcataaatcataactttatagatctgaggggctggagctaggagagaggaagaaaaatttatctggaactggaagaacagaggaggtgaggtggtggaggggagcctgatcccctgatggcctgatttagggttggcgtaggctgcttgggtggtttcatgcttgactgcttcaatcggcgtgtttgccaccttccattgacagcaaggatgaaggatgagagggagagcaggagcagcagaggagggggatgaacgtggagcagcagaggaggagaggtaagaacgtagcggcacgatggaagatcgatgggtgcggcaacgaagtcgtcgctcgtgtcggtgtgaaaaagaggtaggcagggattgcgctctctctccatgctctcaaataaggcaacctaaatccctttctataccgagtcggtcccacgtggtgcttctaaattttatcatgcccaaattttgatttctatcacctagtcgccgcctagacgcactgtcccgttgtctaattgcgcccaggcaccgtcctgtctaggccgtctaggccgtctaggaccgactaggaccgtctaggcggtaaatcgactaattcactgcctagggtgtaaactggacaaattgtcgctgactagcgattaatcaccgtctagacgggctaggcggttgtttaggcgaacattgaaataatgtcacgatcacatgaatctaaacttccaagaaacgagttcgagatcattactacagacataacccagaaataatgcattactacatagattgtgaaatgaggaacattattggaaagtctaatcaaatcatttagcgtggtagctcagctgaagcaatgaactcatgctctaggctatagcatctttggctcagctgatccgatgcattagcacggtgaacagccgttgtctgtgtaacattgcgcaaggactgtaatgtcatctctacttgcttcatggtaggtctttcttcgcctcggggactcaagcacatctccgcaagcaaggtaacattgttaatctcttcctctgttgcttcttcgtatatcttagtggtaacaatctcacttaatggccttaccttcacctcctcaagaaaataaccggccaaattcaactttaagccattctcacttgtaaaaatcggctctttcatgagaagtagctccaatagtaccacaccaaaactatacacatcgcttttttcgtttagacactcagtttgacaatactctggatctaaataaccaaatgggccttgcacctttgtgacaatatgggtttgatcgatagaaaccaatcttgacgtaccaaaatctgaaactttggtagtgtaatttgcatctaacagtatattagaggacttcacatcacgatgaaaaactgatactgaagctgcagagtggagataatagagggctccagcaacttctgtagcaatccttaaggtgtcttcccaagacagcaagctaccattactcgaattgtaacgcaagagttcaaataatgatccgttggaaataaaatcatacaccaatagtgggacctcagtttcaagacaacacccaaaaagtttaacgatattccgatggttgatccgtaaaagaatagcgacttcatttatgaagtgagtgatctcaccttgtttgatcgtcatagactttttaatggccacgacacgttggtctgataagatgcctttgtaaactgtaccgtgtcctccttggccaagtattcttgtgtgatcaaagttgtttttctagctcttctaaagtgaagatactcattctatcagtagtggtttcatcacacgatattagttgttctaggagaagtccttcgttcttacgaaaattcttcctacgtagccgcttctggatacctttcttccatttatggaagagcatttttgcgcttaagccaggcagtagaattccaaagccagcactaagtccaatgacgatacctaaataatgaggcagccgatggttatgcatgctttgctagtacattatttactttttttttaattttctttttctgcatggtgaaattgaatggagtacataactcaccaaaaagaagatttttttgctttttcactgaagtgcaccgctttgttttgtcattgtactctgatttagcagggcacttgatgcaagtgtagttaccgacagtattattgcatatttctggacagatgcctggtgcagtggagcattcgtcaacatcggcaaccacgtacatgttgcagtaattaagacgtgagggattttagcagtctaagacaagagagaaaatatatttgtaataaggggagagtataacaatatactacctccgtcccaaaaaaattgtatttctagctgtaaggttttgttccataaaaattgtatttctagacatgtggggtccaacaaattgattcatctagataagtttccttaagttctcttaacttgtaatttaattatgctaattatatgggttaattatcttaaacttccttttaatcatttgtatatatcgaatgtgtgcatgcaatggattcattaaataaggtcatcgtggttattttctaatcctactgatttgtcctaaattagctagaaatgtaatttttatgcgacggagagagtaccaatatatatgttggctgtgtccaagtgcgttaa

SEQ ID NO: 90908 - DNA, 3048 bp, Oryza sativa
atgcttgcacttgcacctataaccaatatacccatcacctgtgttgacggccaaacacgtactgttaacgctgacacatgcatatccggtggtattctgctgcgcctctttgcaggtttggtttgtgatggcaaaatgcagattcttaaccacaaagtcctttgctgaaccatcggagactctagcactagccgtaccatccatggcaaggaactcctcgtagtgctcaccggccaagataatgagcccttcgctgatatctatgcgaacaagcttggtcggtgttgacggctcgtcggtgtatcttgttgcccaccacaagaggtcagggtttgtactcttgttgtctttgtagtaggtgcatctgagcaggaaatgctgatttgcagagcagcctttttctaggccaaatggatatggaacgctgatatttccacatgacgggctacaattgttcttactcggaaaccgatcatatcttgcgtccggcaatcctgcattgagaaaaccatgatatgtcaacagcaataatttaaaattgatgctaattacgtactgtacatatactattgatgctttgaacattaacatatatatgttaatttatcgttcccaccgtatattttcgtaagacctacgtactttgatttcgaaaggtcagattttataaatcttgaccaacaggcagtcaaattacaaaaacatttagtgtataaattcatgtttataccaacatatttcaatttcaaaatacttttacaaaatgttggtattatagatatgagggattttactgttctcgaaaagttaccgcgagagttaccgtatttcccaacgtaaaatttaataactctcgatgccttttgtactagaagacaacaaatttatactaaaaaattagtacttttttttatctctcaaggactataaaattactctacagacatatacagaatatatatatttttcataaatcaatagaaacattattttccttagaagatttttgagagacatagatatagatagaggtgtaaaaaattataagcatgcatatacctacatcacgccggcagccattgggtgcatacgggttcccttgatacccatcggtgcacttgcataagtaaccagcacgggaagctgtaaagctcaagttatcatcgcaccggctgtgcttgctggcacaggcatagctgctcttgtcacgcttggcttcagcgcacgtcgaatgatccacaatggcccacccaagtcgcacgccgtcgttctcgattctgacgctgtcgacactggttcgctggccttcgccgtgttcatgccgatggacaaactggagttgaaaaccacggacgatgggaatattccgttggcactcaccctcgtcactggtgtcatcaatattggtaggctgggtaagcgaacacaagattatcctcttcgaactgtaggcatcgagcaagtatacatcaaagttgccatgtccgatggttacccttgcactgtcacgtacggagaaagaatcgccaggtaccgtccatgacacattgtacagatcgacaccagatctcatagggatgtcaagtgaaaagttcacatagactgcttattataaaaaaaaaacaagttagatgactaagacataatgatgataagaaaaccaatttagttctgattgaaagttattttatggctgtggcttacatacgccaaaggcatattgggatggataacgagccatctcggctcgtttgtgctgattatcttaacgagccagctactgtgtcacttgaacattcttaagcaagtgtgaccagcttgttgctcctagtggttgccaccaagcttatagaagagctttatgccagtggtctctcggagacggttgtagggatcaagataagacaaccctaggaggggattgtgaaggggtttggagatcgcctacacgcaatttagttagggaagactaaggtaaaaaaaaaaaaacttgtgtaaaatattgcctgtgtgtgtcacacatctatctacatgaaaccattaccacatgattaattgagtactaactattttaaatttcaaaaatagattaacataatttttaaaagtaactttcctatagaaatttttttttaaaaaaaacaggaagcatacgcgcggaaaacgatgtgctttctcttgaaccaccccacgaactaacgcagagcagataattcctcccaccactctaattgattatcataaacttcttttgacacacatagacgaccacacttaccccccaaccccacaacccccacatagagctacgcacagtggcacacaatagaaacatagtacgtacgtacatacgtaccatagccggcggccccgatgctgttgatgacttgggtaaagccatcgctgaggaagagcgttgggggctgcgtggtggtgttgcaaacgagctggaagtcatggccccgggcgcagccggcgccgatgccgaaagggtaatcgaaggtcaggtcaccgcagctcttggcacagccagcgccatagccacctccggcgccagcgctggtctgtgcagctgccaccgttggtgccccagctgcacatgacgaagctggtaggagcagcgctagacatgccagtagcacatcaacgacgacggcagccatcgtcgtccagcctataacacccagttagcttacgcctgtggccttgaaattaactccgaagctctagctcgtcagtatatatatctatcttctgcatataataggaactttcctagtaggttgaggtataatcctggatcttcctaatatgttggatgtatgccctctttatgggaggaaaatatttactacaaataaaatatatagtgaaaacctgaaaataatcgttgaatttagaaatagtaaaagtttttactcttgattacgcggataaatttcaaacgtccatttttatattcaacggttgtttttaggtttccatcacatatgtgatttgaataattttcctgctttgtggtcgcgtggacctgtagttgtcggtaca

SEQ ID NO: 90909 - DNA, 2248 bp, Oryza sativa
ttaacatcaactcagcacgttgcttagcatcaaaattcagtttttcagaagatggtaaaggcatcaaatcaattggagcacgaggcaacaaaccatacacaatctgaaatgggcacatttttgtagtagaatgcaaggaacgattataagcaaattcaatatgaggcaagcattcttcccacatcttgatatttttcttcaaaacagccctaagcatagtagacaaggttctattcaccacttcagtttgtccatcagtttggggatgacaagtagtagaaaacaaaagtttagtccccaatttagcccacaaagttctccaaaaatggctaagaaattttgtgtcacgatcagaaacaattgtggttggcacaccatgcaagcgaacaatttctcgaaagaacaaatcagcgatatgagaagcatcatcagttttatgacatggtatgaaatgtgccattttagaaaatctatccacaaccacaaaaatgctatcacgccccctcttggtcctaggcaatcctaacacaaaatccattgaaatatcttcccaaggaacagtaggaacaggaagaggcatatacaaaccatgtggatgtaagcgtgacttagccttttgacatgtagcgcagcgagcaacgaacctgccaacatctcttcgcatctgtggccaaaagaaatgactagcaaggatgtcatgtgtcttcttggcaccaaaatgtcccatcaaaccgcctccatgcgcttcctgcaacaacaacaagcgaacggagctagctggaatgcatagcttgttagctctgaaaacaaacccatcattgatgacgaatttgttctatgttcttccatccttacaatgcagcaacacatcattaaaatcagcatcatgcacatattggtctttgattgtttccaggccaaaaatcttatagtcaagttgtgtcaacaaagtgtatcttctagacaaagcatcagcaatgatgttctccttccctttcttgtgtttgataacataaggaaaagattcaataaattcaacccatttagcatgtctacggttcagcttcccttgactatgaatatgcttcaaagactcatgatcagaatgtatgacaaattccttgggccacaaataatgctgccatgtttctaaagttcgcacaagagcatacaattccttatcataagtagaataattcagaacaggcccactcaacttttcactaaaatatgcaacaggttttccttcttgtagcaaaacaccacccaatccaatcccactagcatcacattcaagttcaaaagtcttattaaaatcgggaagttgaaggagaggtgcatgggtcaacttatctttcaacatgtggaaggcgttctcttgtgatgtgccccaagtgaaaggcactcccttctttgtaagcgcattcaatggtgcagcaatggtgctgaaatcctgcacaaagcggcgatagaaccccgcgagtcctagaaagctccgcacttgtgagaccgttttaggagtcggccaactctgaattgcctcaaccttggcttgatcaacctcaatcccctgcggagttacaacatagccaagaaaagaaactctatctgtgcaaaaggtgcacttctcaaggttaccaaataaacgtgcatcacgaagagcattaaaaacagcacgtaaatgattaaaatgttcacccatagacttgctgtaaatcaagatatcatcaaagtagaccaccacaaattttccaatgaaaggacgcaaaacctcattcatcaacctcatgaaagtggtgggtgcattagttaaaccaaaaggcatcactaaccactcatacaacccaaacttcgttttaaatgctgttttccattcatcacctaagttcatacgaatctggtggtaaccactacgcaaatcaactttggagaacacaatagagccactcaattcatcaagcatatcatctaacctaggaataggatgacgatatcgaatggtaatgttattaatagctctacaatcaacacacatacgccatgaaccatctttctttggtaccaaaattaccagaaccgcacatggactaagagactcgcgtacataccctttatcaagcaactcatgaacttgacgctgaatctccttggtttcctcagggttggttcggtatggcgcacggttcggtagggaagcacctgggatcaagtcgatttgatgctcaatgccgcgcaccggtggcagccc

SEQ ID NO: 90910 - DNA, 4045 bp, Oryza sativa
ccccaattcggcttcaacccgatggagctctcttcaaaacatatctttcggcgttagtctttctgtttgtttggaggttgtaaagaagataaattgactcaggctatttcttcagcttagaactataaactttgaggtacccagttttgaactaccgcagacttgtttcatagctttcaactaagcggcagacccgacgcgactgacggataatccaacgttaatagcaggtctaattccgcgataaaagagctctgtttccaaacagatttgtccatctgtaatggagatcacattggtggggatataggtcgcctcggggaataccaccagtagagtctgcagaaggtgtcgttcaggccatcggctgtggttcagaagtgggctcgacctgctttgggatggatgaaactgaacactgatggagcactgaacttgcaggatggagttgcgggtgcaggaattgttgcacgttcgtttgtcgttggggattcattgctcgttctgcggttataagtaacgtagccagccaaatttctaggacctatatcattaccaactccagacatcacagtttttccaaaaatatggacctgaagactggcttctccgaccttccacccgatcctgggcgatcccttatcgccactagaaatttgaaaattttgaaccgtgccactccatcacgttttccgtcaccctcctggacgtgggacccacatgtcagttctatcttcctccattattcctcttctttcttccccatctcttccttcatccccgcgatgggagcaccggtggtggtgaatgcagaggagctcgcgggggcgccggtgggagcgccggtcggtgcagactgcagaggcggtgggggtgaccgcagacaaggcaagggcggagggagcattggtgtctagggcatcagtgggcggagtcggaggagactgctgccatttctgtacattcaatgtactctactgatagaggaatacataaagttgaacataataaaataagaaattgaaagatttcgttgaaattgttcgtttggaaatttcccgaaaagctaattataggttcttctctccatcggaacaatagggccgttatgcttattactaaacttgttgaagagatgaaatagaaccaaggtctatctttttgatcagagattaaatcgatcatcagaattaggccaaaaattaggatacattctgggaaaatgaaacttccctggaagagaagcaatccttcttttttttttgtctgaatattcagttaagaccattccaaggctccttttcgccatgcataaactaaaccaacaactaggataagcacaaaaatgaaagcttcgataaaaacggatatacccaatacgtcgaaactcattgcccaagggtagagaaagaccgtttccacatcaaaaacaacaaaaactagcgcaaacatgtaatagcgtattcagaattgtaaccaagcccccccccatgggttctatacccgattcataactagaaagcttctctggtccttcacgaaccggagcttaaaagtgctgaaatccaaaatgctaaaataggaataaggcttgctattattagaaatgcccaaaaaatattatattcgtgaagcagaaacataaatgtactcccattaatgtggaataggcggaactgaattagtcaattcaagtcagcattgtcaatttatacagaatttctctcttttcctcggtgaaacaaggatcggtttttctcaaaccaaagggcttagtttagcccaccatgccgacgaggtccccggtcgttattgtgactgctgcttgtccaccatgccgactgatgcagtgctgcttgtcccatcaagccaaaaatgacgatggactgagacctcgccactatcacgatgagcttttgccaccgccaccgaaattgctcgtgccgcgactactgttgcttgctctgccattgttgtgactgttgcaccatggactcttgtcctttgccgggatggaggaagcggtggccggggacctcgtcgggggagcaggcagcggggccatcttgggtgccgggatgggggccactcccggggcctgcacagcggccgtgacggcgaggagggtgacgatgatggcgacgacggcgaagcgagccatcagagcagcgtactagcgatggattaattgaggagagggtccttgctgatagcgcacccctctagctgccgctgccttagccgcgcatcatggaggtcctcggcaacggtggcaaggatgggtactcagtcgtcggtgatgcctcctccaccaccacctcctcctcccttgaacggtgacagagaccgcgtggctcaccggctccgagacgaggtgctcgacaacaacgacgacgcaggcgcagcctggcccgacctctctaagacaatgatggagacgacggagacgacacctcctgccgcatctacggtggtggagagagaggaagaggaaagagaagagagggaagggaggtggggcccacgtgcagctgggggctaataaagatttttgacggaaaacgtgatggagtggcatggatccaatttccacaattttcagtgccacgtagccgatatactgaatagtagtgacatttttttgaattgacatatttgcagtggcatgaatccaattaacccagtaagtaaagataccgatatagttgaactgcctcctttttccttcccgcacatctgatccaaatctctacaaaacaagaaaacagacaaaaacgtgatttgcaatcaaatatacaagctattacaagaacaacggatatacaagctattaccagaacaaaggatgtaccttcacgagcatgagagcgtcgaacacctcgcgatctagcgacgcagccctgagaaacaagaatcacatactaggtgccctccaacgaagtactaccaagaatcggatgtgaaggtaggctggataggcacctgaggatgcgcttgatctggggaggggagaacttagcgaggtccataccccactgcacggcgcgacgagcctcccgtttcaggtcgttgcggctcttcctgagggcctcgccggcgccgtctccggcattcgaatcgtccgagtcttcgacatcggagggcaaagggcccgcggggcggagggcgcgcggtagagataggcggtgcgaggaggacgcgagggaggagaagagacagctcgggttgagggagggaaggagcgaacgccgcagcggcgcggccgcggcggcaacggcggcggacgccatagggtggtgaggactgctgattttctgcggttttggacgggttggtagtgggcttatctacttggtagaaggcctacgacgggggaaataagttcatccgaggtccctcaacttgtcaacaaatccgactttcgtccttcaaccaaaaaaccagatacaacaggtccctcaactatcaaaaccagtgcaaaccaagtccattggcggtttggaaggcggttttggctgacgtgacgccaacgtggctagtttaacttagtctttgtcccacgtggcatttgacgtggagcttatgtggcaatttgaatccaaaaataataaacccgtggccccacatatcagcaacaaacacaaaataattaaaaatggtggggctcacgtgggccccatatgtcagcctcacctcccttcttccctatcccctctctctttcctctctcttcttccctctcccttctcttcaacttcccttcccggcttcccgcaggcgagcgaggaggcgccctcggcgacctcgcgcgccaccgtcgcactccaccttcaagccgccgcgttcctccggtggtcaatccccatcggcgaggtccccgtcgtgcagtgactcatcaaggcggcaagcaacgtcgtcacaggtcctcgtcgtcgccggtcacctaccagccgctcgacccctggctccaatcctccgccgccccatcatcacctccctctcccgcatcctccccacctccaccttcctcctgggctgcaggaat

SEQ ID NO: 90911 - DNA, 721 bp, Oryza sativa
taggcaggacaaggttggtacacatgttcctcttgtatatggccttgtagaccctttttaaaacactggtttgaatatcttgcacatgattctcaagtctaggataaaaatgttctaggtacgtatcaaagggtaagaggctcttgaagaaccagcagctcatggaagagctggaaaagtcactagatgacaaagttgagaaggagaagcttgtcgaaggctttctcggttacatcatttgttcgacacaggtgatttcactttaaaatcataatctgttttcagacaaagtaaacggtgataaactggagctcattacattaagcaacgattttgtttgcaggaagcagtagtactcccaccgtttgtggcattcgctgtcagaatgaatcctggtatctgggagtacgtcaaagttcactctgatgatctttctgtcgaaggaatcacaccgtcggagtatctcaagttcaaggagaccttatacgatgaaaaatggtatgcatatccatgatccactaatccagtacgtagtagctaatgcgaacatttccatatacagattgaagaagaacaggagcctgaaacttgaaaaaaaaatggtcgatctgaccatgtgcatttcagggccaaggatgacaactcactggaagttgatttcggtgcccttgacctctcaacaccccatttgacactgccctcgtcaatagggaatgggggg

SEQ ID NO: 90912 - DNA, 1292 bp, Oryza sativa
agagcgtgtgcaattgttccctgtcatcaagatcatgcatttttcatgtcataccaaatcatggtaacgttggtcctaaaaagggataaccaccgtacgtgcagccatttgacaagccggtttcacctgagtgacacatagtttgttagacaagagggatgccaccaagttgccatcggtgtagttgccaattatcaagtccggtttgccctccaaaatgtcgagaattttggcacaagagtcctgaaattacgttggatggaaacttactataaagatcacaggcccgcgcaaagggtatcagtaactcatagtaattcatagctgacaaacctgcgcatatctctctagataaggatagatgtcaaaccgggacacccactggcgcaaatccttgccatcttcagtcttgaatggcacacgtagtatatgtgagtattttgtattttcaactggttcaagctccacattgcattttgtgcctttggcatctggtatcagtcttgtaagctgcaggaatatatatagtgcccactggtttagctaatctattcgtcattcatatcatctcatttatatatatatacctattcgtcattcactatatttcattgtacaggaatatatatatcgtgaaatcaatgaaatttaccacaagaattttcggtgttacgtgcagaccctgctgcttgattctttgaagcagctcctcttccatggctctgacttgatccaatatgtagacaacctatatatttcacgaaaccattctttagagttttgttaaccgataattaagttgtgaccatatttttaagagttataatgattatgcgcgagagattccagaaaaccggtaagttgggtacctgaccaccggtatccggcaatccaagaaccttttcttggccgaagtaaccatgaatagagaagatgacaatgttgaatatggatggaaccctgctgaagaacttctccatgtttgtaggatctggtgcctgtagcacttcagacagacaatttagtgtttctttgcacctctccgcagtgtcaccccatcccctctctaacccccactcctgaaatctgcaagaacacataatagagaaaacttaagcatgattacaattttttttgtctatctacaacttcagattaaagtacttcacctttgttcaaacttcaagtaaggcgtgtattttggcagcccactaacgaaaacctctgcaagtagcagtgctgtctgaagcttgctcacagtgtcgatggtgtcattaatcatcaacttctac

SEQ ID NO: 90913 - DNA, 785 bp, Oryza sativa
aagaaagaatcggtctttggttgagatggctagaatgatgttggatgattatcacactcctagaaaattttgggctgaagcggttaacactgcatgctatatttcaaattgggttttcttgagatcaaaacttggaaaaacttcctatgagcttcgatttggacgccaacccaaagtttcacatttgtgttttttttttgttgcaagtgctttgtcttgaaatttggaaatttagataagtttgaagcacgctctaccgatggaatgtttcttggttaccccgcacattctcgtggctatcgcgtacttgttttggaaactaacaaaattattgagacttgtgaagttacttttgatgaggctagtccaggtactagaccagaaactgcaggtacattgtcacaggttcaaggggaggatggtcgtattttcgaagatgagagcgacgacgaggtcggcttggccggtcagaccgggcgccaggccgatcagaccaccgacacacctccggtcagatcagcacaggatgtctggttagaccggccagggtcgtcgggttacgattatgttcatgctgatcgggatggtcctccagaggctacaacttcgaccagtgagggtacaaaacgtgaaacaactttagaagtcgccactcctttgcatattcaacgacaacgttcgccgaaacaaatcattggtaatataggtgaggggactacaaggtctatggtaatgactcatgatgtttgtacaaattctgcatttgttgcttctattgaacccaa

SEQ ID NO: 90914 - DNA, 2087 bp, Oryza sativa
cgggtgactcacatttctattcggtcaatgtacttggcattaatttttaatgggcatatggagagaaataaattgttacggaaattaaatatgcctattaaaataaagatttacgtggtatttacttaaaggggtgttagctagccaaagataatttagcaaaaaaagaattagaatggtagtaccaagtgctgattttatttgcatgaagagactatccaacatctattctttgaatgccatgttgctattagttttttggagaatcgtctttatttcatttttgttgcaaacaccagataattttcctcaagtgttaggggattggctagtagctatgaattctaaagccatggaatatattttgataggagaatctgctttatattaggctttatggctaagtaagaatgatatggtttttgacaagactccaactaatatgcatgtattattcagagcaatttattggctttggttctggggccagcttcaaaggtgtgacgagaaaaagaaaatcatatttgttgcatgccataatttaaagtccatagttatgcagtttttcactcgctttggatagacatttagccatagactttaactttgaataagttgctatttttctttggttggtgcggttgagtcggttttttatctacctttgtttatttctcgtgtgtttaggttttgtaataagtggtatagcttcaattgaagcaaatgttgggtggtattacccattactatttttttaaaaaaaaaacgtaaaagaaactagctagtggtggttcatcatctgtcatttgtcactcctagacacgcggggtccaccaacagagtagtcaccccttccccttgactgctaggccttgtttagttgggaaagaaatttaggtttggttgtcacatcggatatatggatacacatttgaagtattaaacgttgttgtcacatcctgcttttcgtttcaggatttataaattatttaataaattattaatagattttatattaaatgttcattaatttacgagtgaagttaaatgtgggaaatccaatttcctaaatataaagcatggttggatttaatatttattaaattctccatgattaattatactctctgaaattttcttggatttttcagagctcaattcctaaatgatacaaagaacaattcagtaattagttaatcaattaatgatctaattataattatgttaagtacttttcttgtttaaaaatccttaaattataaattgttgtttaaaaggatttttagaaatgattttaaaagcctaaaagagaagatctaattttaatttgttaattctcaatataaaattgggctagataaaattttgttaaatacttctcttgattctttagttcctagatttttctgggatttatttgagccaaggaagtatttttaataaatggaattacatttcatgaataatttaaattgaaaaaggttttaaaatttccccttttggctttgggccgaaagtcggcccaagtctctctctctttctctcctcggcccaagttggcccgcagccgggcgcagccgcccgcgcgcgctctccctcccgctgacaggtggggcccacctgtcagacccgtcgtctacctcgtgctgtcgcccggccgaaccctagccgagcggcgccgccgatctccttccaaattcgcctgcccctttcctcctccagccgaattgtttgaggggaaatgatcctcgagatctcttccttttctcttttggaaacatcggctaatttcgtttggaaatcatcggattcgatctcgaatcggattcgtctgtctcccccgaaccctaaactttccttctcgccgccggtcgccgtgggcctccatcgccgctcctagcctctataaaagcacccccgagacctcctctctccgccgccaccctcgccttagcccgctgccgtctgtagcgccgcctccacgtgagaccttgcgccgctgtcgccgccgtttgtctagctgtgcgccgccgtcgctccgttcgtcgtcgtcgctcgggaaggccgccgttgtgatcaccaagtcg

SEQ ID NO: 90915 - DNA, 5797 bp, Oryza sativa
  unsure (1)..(5797): unsure at all n locations
ccgaaattcaacccattgtactgacaaacccaagatgccgcttctgctgacaaatcacccattgtaccaaaatttcacgaatgccacgacacacttgagctcgcacaatcgcagccggctgaggcaccacacgcccatgatctaagagtggcagtgggggtgtcgaatagggcggatcaccatgaaatggtttcatcagactgacgtgaaaaacattattcaatcgagcaccagcaggcagccgcagcttgtaagcaacatcgccgatccgctcaagcacttgataaggcccataaaacttagaattaagcttagaacgggaaggcactcccaaagagaccgcagaacgccgaagcaatcgcagccacaccgaatctctagtatggaaggccaagtcacggtgcttggcgtcatagtatttcttataaacctgttgagcctataccaatcgatcacgaatataagccaaaaaatcatcccgattacgcaaaagctgatctacggccgccaccttggccgtacctggctcatatgattgaattgttgggggattcctgccatacgacactttgaaaggtgtctccttcagcgacgactgaaaagaagtattgtaagccactgaagccatttgcgaggacgatcaccaactagacaatggagatacatagcaattgtcttgtttaatgcctctgtttgcccgtctgactgtggatgaaaagctgaactcatgtgcagctgcacatttgctagacaaaaaagttcttgccaaaagtggcctgtaaaaaccggatctcggtcactgacaatggataccggaatgccatgcagacggacgatatcatcaaagaaagcggcagctactgaaaaagcagaataagggtgcccaagcgcgatgaaatgcacgtaccaccgacaaaatcactgacttgccatgaaacttgggaaatccttccacgaaatccgtagagatgtccgccagactttgcacggaatcggcaaaggttgtaacaaaccagcggtgtgcaaatgttccactttgttcttctagcaaaccgtgcaggcttgcacaaactcctggaccaccgcgcgcaagcgaggtgtatgaaaatatgtgccttcacccgatgcagtgtcttctgtatcccttcatggccggcattgtgggctgctgcaacgacagtgtggaggtgcgccgaatctggcggcaagtatatcttcccaccgaatgtcaggagaccatcaatctccccccaaggcccctccactgtacaagcatgtagttgctgccggagcgcctggagtgctggatgtgctgcattctccgctcggagcaggtcaaacaactcaaatgaggggggcggaaagcgccatagcctgcggcacaatatcggcatcacggcgggacagggcatcagcgacagtgttttaacagcctggcctgtactccacccggaaatcaaatcccagaagcttgctcacccatgcgtgttgtggaattgttggcaagcgctggtccagcaaaaatttcaggctataatggtcagtatgtaccacaaatgagagaccccagacgtatggcctccaatgccggactgcttgaaccaacccgatgagctcccttttgtaagcagcgaggcgagcatggcgtgacgctatcggccgactgaaaaacgccctggtcgagcaccttgatgcaggacggcaccaaaccctgcacccgacgcgtcacactcgatgatgaagggctgcgcgaaatctggaagttgcagtgttggggcagacgtgagagcgtgttggagcgcccggaacgtgcgctccgcatcatcggaccaagcgaacgctgccttcttgaggaggcgtatgagggttgccgcgatgacgccaaacccttggatgaaacgccgatagtatccggcgaggctgaggaaaccgcgcaacgctcgcaccgaacgaggggtcggccaatccaataccgcctagactttctgtttgtccacagacaagccttcgccggagatggtgtggcccaagtaggccaccgacgtgaanccaaaaaacacttgaggaagaggcggtgctgctgcaacaaggagaacacagcccggatgtggcaaaggtgctccacccaggaaggactatagatgaggatattaaaaagagtaaattgtattggtagtacacaaacttgttaggtgggtgcaatttagtacgtaaacttgtaaaatgctcgtttaggtacacgaacttgtctagttcatgcgaacgaggaccaaaatagcatcgcaatgttaattttacaaagctgatgttgattaggatgtgacgtgcatacgtgtagtgagtatgcattagacatataatatttataaatttgatatgtactttatccttcatcatggaagtgatgaatttcatatatttctaacccttatatcattgctcgtttttttatcattttctacgatcactatatcccattctatttttattgaagaggtgtttatctaatagcaaccttcttagatatatgtttacatagtatcctgatgagcccctaaatcagtaagattagtcacgttgtttccttttctccttcctccgcacacaccagacaagttcatgtgccaaaatcagcattttataagttcgtgcactagattgcacccacttgacaagttcgtatatcggcgatgcaatttactcttatcaaaaaatacaggtacgaaccggcggaggaacgggtgcaggacttcgttcatcaatgcttggaacgtggccagtgcattggtgaggccgaatggcatgacgaggaacacgaacaggtcttgatgcgtgcaaaatgctgtcttctcaatgtctgccggccacatacggtgtgatagccggaatgcaaatccagcttagtgaagtaggaggcgccttgcagctcatcgaggagctcctccaccactgagataaaaaatttctccttgacggtccgatcgttgagagcatgatagttgacgcagaagcgccagctaccatcctgtttcttgacgaggagcaaatgcacggagaatgccgaggagctgggtcaaatgatgccttgggagagcatgtcggcgcactggcgttccaactcgtccttctgatgttgcgcgtatcgatacagccggaccgccactggcctagaatctgggaggagatggatgtgatggtcgtgattgcattgtgacggcagtccccgaggctcgacgaagatggtggcgaactcctccagtagaccagctagcacgtcggggccagagcacgcgaacgcgtgttcacacggcttgtcgatgggggcgccgatgctaagccaagtgatctggcagccagcgcgcgtgagagtcagttgcaacttggtgaagtcccatataatctgaccaagagattacagccactgaatcccgaggactgcatcaaatgtgtctagtggaatcacaaagaaatcagagaagaatgcttcattgccaacgaggaacatcacattgcgcgcgacgccagaacactcgaggcgatcgccgttggcgatgcatacccgaagaccatggcatggactgaggagcatgctggggtcggtagcgacatcggcgttgatgaagttgtgcgtggacccggagtccaggagcgccaccagtcgctttccgttgatggtgatgtggagctgcattgtctcgctcccaggaagacggacgcccgccatggcatacagggagattccagggtccccatcctcagcattcggtgggttggtttcattgtcgtccgccgaaggagcgtagagccagaacaagcgcttgcaacgatgccccggcgtgaatttttcgtcgcagttgaaacaaaggcccgcctcacactgggattgcatctcttctggcgtcaaagtgcgccgagctacgcgtgcagcccggacaggcgcagcggcacgcgctgctgctgctggagcggctggagcagatgctactgctgctattggggcaacgtgtggcgctgctggtgacgcggctgggcgagttgctggtgcgcgtgcgggtggcttggccggttcgattgggaccgggtcttctatctgcaccctcaactcatatgcacgtgccaaactcattgctgtgtccagcaatgcgggtgcctccagctcaacgtcgatgcgaagcttgccctgcagccctgcggtgaataactctattttttgtacctccataagtgggccagcacggctgagaagcgacatgaatttctcctggtagtcagcaacggaaccagtgcggcggagttcggcgagggtccccaacttgttgtggcgaagagggggcccgaagcgcagttccaccatctccttgaagcgtctccacaacggcgtgccgtaggcttcttcagcatgcgtgtaacactcctgtgcctcgtctgtgagatggaacgctgcgatccaaatcttctcatcctcaacggtgtgctgtccatggaaaaattgctcacaacgacttagccaagtcattgggtcccctttaccattgaagatcgggaaatctcacttgtggtagcgtggaacccgactgtctgttgtgccgtcatgctgatgctggtttgaggccgagggtttggtgcccacgatccccttcgtgtcgacttcagcgatcttgttgtctaggcggctgatggcgatggtgtgatcagccatcgttgcctccatccgcttaagttggtccataatggcggtcagctgcgacgctgtcacctctatgtttgacggtagtccagacatggccataggcggacgaacgtgctctgataccaagttatcacgcccgggcaacggtcgaagattatactgatggaacgaaggaggccgcggtctccgctgacgtagttggcgaggtatggtgatgaactggtatagaagaaagaaagaaactggcaaggaggaagaagagaattgagggagaaaacacatataggagattagagattgatttaacttttccttaattcctccttaacgattacatctctttaaataaactctaactctaactcttatccaaacaaaccaaaaccaaaaagattcaagaagtctctccttcgacaccgtgcgcctgctgccgagatcgtcgatgatacggaatatccccccacatgacagacaccctatataatattcgatgtgacacatcaaatctttacacccctggatctaaacacccccttaggcctcgttcggcaacaagggggaatttccccagggagattcacccaagtgggggatttggtgaataccctcccgccacccaatcccctcatcaatcccttccaccatgggattagcattagatttgttcggacaggtaggggattggtttgtttggactagggacgaaggtttcaccattacaaaagattttaatatgcggcgcataaagttgcagaaattcaaaacaccacccagaaaaatctaaaaaggaaagaaaaaattacgaaaatggtaaactaactaagattggttgcacaatagtctagaaagcatgtcaattcagactataagattagtgcacattgagattatagatacaaatgtagatagctattacagtaacaagtagcagggattaaattgtacaaaacaaaatgacataaactgaagctaaatcattaatatctaaaagctaatcttggttgctagaaattccccaaattaattgcacatttctcaggtacatcacaataatagaagcgcgttattgcaagggtattagtacctcctccgttagggctgcaggaa

SEQ ID NO: 90916 - DNA, 2324 bp, Oryza sativa
ccgagcgtgtatatagtcctaagttaatttcccgaggagggtacttctccgtatttagccccggttggatggtcatgacggattgtcgtaagaaactcggcaattggggatggcttctcaaagcaccatgagggcatcgaaaagagggtattagctaagtaattatataaataggatgtatgtataatatgtatgtatactagaagtataggaataggctctttctattttcttcccacttgcctagataattacgaatgagagtatagatgcttctgcttagtgtcactctacccttgatttatattaacccctgcctagactttggttattacaagtcatatataaattattagtacggttctttctattataatcttcccacgggattaaacaaatacgatatccttgaaatactctcgggtgaaatgctacaatagtatatctctgcgcttacggatgaactctgtatatttctgcaccattgctgggaattatatttgtagtaatgtcgttaaaaaatattaacactacatcatgatgttgatgttagtgaactgagcataagcattcagttgccattcctgcgtctgtgctatgtgtccttcgaggttgtattggatctctcccgtttgtatatcacgggtgtccatcctccttgtgatttctcccaagtcccaacgagaggaacttgagcgccactcgttgggggacggaggcataccgcttgatctgggggaataagtgttcatgttcccctagtgtatgccatgaggcgcccgccatcagctctcgctggcactttcccagaccgagcctccgatgctgtggtgtggagcttgggtccatccgagtgcatccccagttggcttccaaccagcctcgtacatctgcacagatgttgaggatgttgaaccttcttgattcatttcttgccatgttgcgtgtgtccctgtactgatgatacggatcgaaattgttagaattggtatcaaatatactagtcctatttggttatttggttacagttggacttggagtagtaatatgtgttagggggtggagtcagagtcaaactctgtaacccggcatttctcttaaatagagagggggcaccacaatgtaaccgtggcgactacaatgtagcgtagacatgtagaaagaggatgacggcatggccatggactcgtatgaatatcaccattatttttttttgaaaggagtcaccattattaattttgatagataaatgtcccttttatttgctggaaactaattgttacatccataactaagaaaccaaagtctcttaataaatagatgttctatgcacacgtacgcgtgcgcatgcacgaattattaagagataataaaaaaaaagatacttgatcgatcatacacagaattcttgaaagttaacaatattatcgtgactccatgcatgcagacgatgattattattatatttctatttcccttgtcactcctctgggagagggccaaacttgtgctgcagaaccgcgatgaattcgctggaggtgcagccaccaacgctgacggttgatgcacagttcttgtcggtttggtctgtgcagattttgccggccttttccagtttctcttctttgatgtaaccccagtaatttgggaagtgatctttctcacgtacctcggtgtaagcctgcgacaagaaaaaaaagctttaattcaattctcttttaagatttagattattggtctatataaaataaaaccccctctttattaagctcggttgaccttatttagttagttaattactccctcaggttaaaagtaattgttattttggacatattaatatttgattagaacaagattttacaagtgttttattacaatatcaacaattattaatgttggcatcttgcgacgatgagtggtcatatttgctggtcgttttcttacagagttctgcgtggcgctccaaggaagggaccatgcgaccatgaagtcccggacctggccgtcgacgtcgcggccgcggaagacgcgcgccgcctcgcagccgatcgactgcgccgtcgggtgggcgtggaggaacgccagccactggccgttctggaacgacgccggcggctgctcgtggtagacgtagccgtaccagtccatcgacccgccctccccgtcgacgagctccagcgcggcgccggtggcgttgtagacgagcaccatggcggagacgccgtcgccgtaggaggccttgagccccagcgcgtgctgcagcgcgtccaggttcttgccctcggcgtggatgaggcgcatcgcctcccgcgcgcggtcca

SEQ ID NO: 90917 - DNA, 733 bp, Oryza sativa
ccgttctgtagtagaacaagctcatgagattcagatgctggctaaggaacttgagaacaacaactgtgagttgccggacaagtttgtggcgggtggcattattaccaaactaccaccttcttggtcggactttgccacttctctaaagcacaagagacaagagttcagtatttctgatctcattggctctttgggtgttgaggagaaggcgagggcaaaggacgtccggggcaaaaaggttgagggaggttctagtgccaatatggtacagaagaagaaccctcatgcatcccacaacaacaagaaagtcaagcctgatgtcaaacccaaggctgcaaccaattttaagaagaaaggcaagggaaaggcaaaggtagactgctttgtgtgtggcaagtctgggcattgggccaaggactgtcctgagcgcaaagacaggaagtctgccaacatggtcattagcgagggcggaggaacatcggggtacggtaaaatattacctatagttctctctgtttttcattcacctgattggtgggtggacactggtgctaatattcatgtatgtgctgacatttctctgttttcttcttatcaggtcgggagaggtttctccttgttgatgggaaacgggtcgcttgcggctgttcatggtgttggtacggtcgatctgaagtttacttcgggaaagaccgtgcagctgaagaacgtgcagcatgtcccttcaataggg

SEQ ID NO: 90918 - DNA, 656 bp, Oryza sativa
ttgttcacatagtgggattgcacaagtgtaatcccaccctcatctcctctttgtagtttgatgttaagaataacatcagcctctcccaaatccttcatttcaaaactcttggacaaatagtccttgacctctcaatcacattaaggctggtcccaaagatcaatatgtcatcgacatataagcacaagatcaccccttctcccccaccatagtgatagtatacacatttgtcagcttcgttcacaacaaagcctgcagatgtatgcgtggtgtcaaacttctcatgccattgcttaggtgcttgcttgaggccatacaaggatttcaacagtttacacaccattccctcctgaccttctagtacatacccgtctggttgatccatatagatctcctcctccagctctccgtttaggaaagctgtcttaacgtccatctgatggacgagaagaccatgagaggctgccagagcaagtagtactcgaatcgtggtcaaaagagcaactggtgagtatgtgtcgaagaagtcctcgccttccttttgggtataacccttggccacaagccttgccttgtacttttcgattgtaccatcaggcctaagctttttcttgaaaacccatttgcatcctacgggcttgcacccatatggacgc

SEQ ID NO: 90919 - DNA, 1146 bp, Oryza sativa
ttcctgcagccctttactcagccggatctgaacatgagacaaaggagatggttggaattaattaaggattatgacatgggaattcattatcacccgggaaaggctaatgttgtagcagacgcccttagcaggaaaggctattgcaatgctacagaaggacgacagttgccattggaattatgcaaggaatttgaaagattaaatttgggaattgtcagtagaggtttcgttgcagctttagaagcgaagcccactctaattgatcaagttagagaagcccaaattaatgatcctgatattcaagagatcaagaagaatatgagaagaggaaaagctattggtttcttggaggatgagcaaggaactgtatggttaggtgagagaagctgtgtccccgacaacaaagatttaaaggatgcaattctgaaagaagctcatgatactttatactccattcaccctggtagtactaagatgtaccaggatctcaaggaaagattttggtgggcaagtatgaagcgtgaaatcgcagaatacgtagcagtatgtgatgtttgtcagcgagtcaaggcagaacatcagaaacctgccggtttgttgcagcctttgaagattcctgaatggaaatgggaagaaattggtatggattttattactggtttacccagaacgtcatcaggccatgactctatttgggtgatagtcgacagacttaccaaagtggctcatttcattccggtaaagacaacctattctggaagtcgattggcggaattgtatatggcaaggattgtgtgtttgcatggcgtccctaagaagatagtgtctgatcgaggcagtcagtttacttcaaatttttggaagaaacttcaggaagagatgggttctaagctgaactttagcactgcttatcatccgcagacagacggacaaaccgaaagggtgaatcagattttggaagacatgttgagagcttgtgctttagacttcggtggaagttgggataagaatctaccctatgcagaattttcgtacaacaacagttatcaagctagtctacagatggctccgtacgaagcactgtatggtcggaagtgccgcactccgcttttgtgggatcaaacgggagaacgtcaggttttcgga

SEQ ID NO: 90920 - DNA, 4275 bp, Oryza sativa
  unsure (1)..(4275): unsure at all n locations
tcctgcagcccaggagaatgcctcatgctgccaaaattgtagaatagagttgagagtgggtgaggaagaagttcataggagacagggaagtgagctcctcgtctgacttgttcctcaaagatgcggctccacgggagtaaacttttagtctttttgatcggatagcatgttattagtaacttgcttgcttgttggttcctagtctattttacctaaagtatccattctttgtttgtgttggttgcattgcttatgattgcaaataagttgaatagtaattccatgtatggttgtggtgatcggcatagttttgtctaggaaggcaggttagagcaacaaaggacgtagccagccaggtggtgacaaccatggctatccattgaggtctaccacattagccctagtaacattcatataaattgggtgataagtgttcaccccattctttgatgaatactcttatgccttaagcaagcacaacaaagtatttgtactgaatagttagctcatttaggcgtagtgacatgaagcccaagtaagtcatttaggctagaggatcctctcaaattaaaactacactcttggcttagtcctggaaacataagtatacattttatttctcgttgattcgataccgtggaatactctaggttgaaaacttgagcggttctcattcacttgtggactatttttcctgagcataaagagtgccaacacacattcatgtgatgtccagagctggcagcctgtccccgcctcaactgccaccgcttgagcctccaagcgcccaccaatccactccaggagacaccattcttactgtcggcttcccctatgatattgggcattggaaaaagtacaccgaaggtccctcaacttgtcatcaagttacaaaatcgtcccccacctattaaaccaaatatatgtcatccctcaacttacgaaactgggtcactttgcgtcctcaggcagttttgacctcggttttgtctgacgtggtggctgagacggcgtcggacccacgtgggccccacatgtcagggtgtccacgtcagcaccctctttctctttctcttctctccgttcctcctctctcacttttatcctcatgtggagcaggccggtcggtgggtggggaggaggccagctagctgaggcgggagagaaggaggtccaacgttcggcgaccgacgacgagcgacgcggcggtggcagcgtcggcgatgacaacgcgggagcaggtggacctcctcccatggcgacgggtgacacggcgacagcggtgtcctcgctctcctgtcgcactccccctccccgctgctcatcgccgtggcatccctaggccaccttgctgtcggcataccaatcccaaggcctggttcctccggcggcagcggggatgagctgggggaagggaggagagggcctccccacatggcgacgggcgacacgatgatggcggtgtcctcactctatcatccccactgctcgtcgtcgcggcgccctcaagccacctcgtcgtcgccatccccatatgaggcttggctcctccagtgatggcggggatgaggtgggggaagggaggagagggcctccccctatggcgatgggcgacacaacgacaacggtatcctctctctccccatccctgctgcttgtcgtcacggcgccctcgagccacctcgccgtcgccatcaccatctgaggcttggctcctccggggaggcggcagcgaggcggaaacgacgcgggcatgcagcgggcgtcgtgggtgagtgctgggaggtggagcttgaggatggcgaagacgagtgcgcgctcacgtgggtcatcgacagcaggcgcaatgccgtcgaggtcgcttacctcgctgccacagggatattcagcctctagctcgcccgcgcggtgacaccatccccttctcccgcgtcgcagccgccaccaccgccgacacctcccgggcctctcctatggttcgacaccgaggtcgcacacgcgatgacgctctcccttctcccgtgtcgtcgccaccaccgccgccgattcgccggccgctgccgcgagtcgcctcccttccccaacgtcacagccgccgccgccgccgcatcgccagtcaacagatctcctctcctgcctcgcctcggcgacctccccacccaccggccggcctgccccaaattaggataaaagtgagagagagagagagagagagtggagaggaggaagggagagaagaggggaaagagagagggtgttgacatggacaccctgacatgtggggctcacgtgggtcccacactgacttagccgccacgtcaaataaaaccagggtcaaaaccactaaaggacttaaagtgaacaattttataagttgagggatcttctctatatgtgattttgtggtttagggataattttgtaactcgatgacaggttgaggcaccttcggtgtactttttccttgggtattctactgctgctatgtgcttgctcgatgcccatcggccgttgcaatggatcagggtagattgcgactatttttttttagtgatgtttgtcatgcctgacaagtaggaatgtaaactaacgagcaggctagcttgtgatctaattactctttccgtaaactagttaattcaggtcttttttttttgtcattttcagaacatttggattgaccacgctttaccatcaatcagtaaggtgtaagtgtacgtaaatgtgaagttaagactccctgcttatgaagactacaggaacatacgtagcaacaagtttgatttgcttctttgcttttgtgtagtataggacgttttgtagctgccgtactgttgacacttgttacttaattatcttccgattttcaatttgcaataataacccttgtacggtaattatctttaccgtacaatgaagctgcgatatcattcagatcaacaacatttcaatcaaagcctagcttgcggcatgcagaacgacaatcctcaaggcatagatgctagaaacttccatactcaaaatataggtttttttgctgaggtcacaaaaaaaaaagttgagagcctaattaagctagagccaacttggtgagacgactcatactacatttcaattaaaatggatagatgactacagagaactctaaaattatcttccttcttagagcatcaccaacagtcctcgtataatctccttcaaaaaaaaaatgtttttggtttcctaaactgaaaataggaagttgaaaaactgatcttttcaacacaacacctaaatctaattcctaaaacttaaaaagtggacccttctgttgaaccaccaacatattttttttcgtttttcgtttatacggcactcgtgatcgcgattccccttggcggtacccaagcagcgccgcttcctctcgcccctctccccaccgccaatcgccctccccgtgacagcacacagcagcagctgctgcccttgcaaaatttcagcagcaccagcaatttcagcagcatctcacagctgcagcagcaatttcagcagctgttggggtgacagaccgattcaggctgaaccgaggcggcggccggaattgagacggcgctcacgcttgggaaacccgtgacagcgttgttgtcctctgcctagcaccgccatagcaatcagatagcatgtgtcgcccccggaaagaaagctgacgccaaagaagcttgggggagcgatgacggcattccagtcgccttcaaggaagaggacgctggcagtggaacagaggaacgacctcacggcgaacgagggcgcaaagatgatgccgcgaacgagggcgcgaagatgatgagctggatgggaacatttcgcctcctctgcgcgaatgtgctggattaggcgattggaagccaaatcaattctctagatgtggagagcgaaaaatctggagtagggaattcgtagatcggcacatgcgagtagggaatctgttggattgtggttttagcaaaaatccgccaaaacctgagattaggggccatgtacgtatgctgttggtgattcttattatattactcttttgaactttttgaactgggtatataggaattttttttataggaatctattttaatagtgaaatagcagaaataactaccttacaaaattataaacccccaaaaaantattctttaaattccgacgaanacaaagtaaagacaataattttttcactccaaaaatactatatagatgcaacttgtcccaatatcacacaatctaagattacttgatcacact

SEQ ID NO: 90921 - DNA, 2883 bp, Oryza sativa
ttcctgcagccctcaaaattttgtttaagttctatcaaaatactgaaattttgtcaaaattccatcaaattcagaatctgtccaaattgttatattagtcaatgtgcgtcatctaattttaaatatacttccaaaaataaagttccaaagctacgtgtataaaatggggacaaaaacataattaatgtatatacatgagagggtataaatatcattttatcaattacttaacactattaacttcaccatccaaagtaggggaaaaacaagcattcagttaaaaaaagtgagggtaaaaatgaaaactctaaaaaataggggtaaaatcaatattagacatcaaagtaggataaaaacgaaattgcccctaccataaatgcataagggcccatatgtcatagattgagtggcaaagccttacttgcaacatcttaaatgtggcaataagtcaaactacctagaaaaactgtcgcaagtttttttggtaaaactttcaaatctaactatagtataattgtaatataattccactataactattatataacttgtatataagtattaaaataatatatgcaactttatatctaacttatatagagtttgtagttacactacgactatactatagttacatttgaaagttttttccccaaaaaaacatgcgacggttttaagcaattccgaaagttgaatgtccctacattataagccaatgactagcctcatcccattgagaagaagttgaatcttccgcagtgtaatgaccaggagaagattgccttcgctacccaccagctctagggcctcgcttttgcttggtgggacaactacatgtttacccgcccagcaggaagagaagtcacttgagcagagttccggtgcagtttcaggaaggcgcaagttctcgatggaatagtggtgcaaaagaagaggaagtcccgtgcacaaaagaagaggaagtttcgtgcactgcatcaaggagacatgacagatacatagtatctgcatgagttcaaccgccttgcgcactacgtccctaacgacctgcacaccaatgctgagaggtaggagaagttcatgtctagttttgatgatgaactgaccgatcagctgatctctgcagactatactgattttgagaaactagttcacaaggcgattcgtcaggatccaacttctcgtcccacaaccaccatccgcgtgctatcctatgtccttgcctcgccaccagtttgcctaggtcatgcccacaacatcatgcactctagccgctagctcctgataggcggggcccatcgacttgctctctatgtgaccaacatgtgggtctgcttgtacaaaataccttatgagcagggtcattttgtcttttcaaaatatttttcttacaaaattggcaagagataataaaataatggtgcggtgtgttgtacttctctgtttcatattataacattgttggcggatggcatgaggcccttcgaccaaatctgccgaaacccatggcgaaggctatggagcaagaacggcgtgaggcgaagagtcgtgcgaagtgccttgccaggccagaggcgtctcaggcaaagggtgcaaggcgaagactatctgccgaaggaagacgacttcgccttggcaagttcgcccccacgagggccaaagaagcctttccggcccatcaagcctaggggcaatagggccggcgatcgccagacggcccatcaggggcccatgagcccctatatcatcatgtacccctgtaaatgtccctttcataagggtaatcatgtaaattcccctgtataacctaaaccctagtagtaagaacctgtaatggggatataaatagccccctaggaccatgtaacgggggaagatcccaagggaaattcaaaatttaatacacttcgtttttctaaccactgttgagtaaccacgtctttcgacgtatgcggttgtcgtttcgacaacagctggcgccgaccgtggggacctccgagcgaaaccactgagagtgaatgccaccgaagaaggtcgtgaaggagaaggttgcaaggcggaaggaaagcaacgccgcaccggacatggccgccgaggagggagcagagcattcggcgccagtggccgaagatggaggaggaccatctgcttccacatctgcgccatctcaaacgccttcggcccctgccgcctctgtgcaagtgccgaacgcggccgacgtggcgaaggcggctgctgtggcaagggcactccagaccagggcggagatcctttcgacaagccaactagtggtgccccaagccactccatcgcagccggcggcagccccgactgcgctcgccgctatgcaggcccatgtcagccctgaccctgagacacaagccgaagccgacatggaagccatgcgacagaacatgacacggctccaagacatgcttcgccaaatgcaagaacaacaacaagcatacgaggcggcaaggcggaccaaggtcacgtcggctccaatccttcagtattcggcaggttatgtcccgcctcaagtccatccgcaagtgacgacctagccctatccgcctcaagtcgcacaagcgccaatgtacttcgccgggcagcaatcggccgcagtcgctgcccaagtacaccatcaaccacccggccaagcgccaaaaatagtggcggaaggggcttcggctctgcaggcgcaactccaagcttttcttcagcaactcaaccaaccccactgtatttcaagtacaaccccatcggcccacccggaggggaatacaagtcaaggtgcgcctaattggttgccaccgattcagccgggcctgggagtttcgctgtggaatcaaggaccgcagttcgacttcgggggtgcaggaa

SEQ ID NO: 90922 - DNA, 1531 bp, Oryza sativa
cagttcaagttcccacccgtcccgtgctattcaggcgaaaatgacccgaagaagttcctctccatctacgagtcagcgatcgaagtggctcatggtgatgaaaataccaaagcgaaggtaatacatctcgctgtagccggcatcgcccgttcttggtatttcaatttaccagccaatagcatttactcatgggagcaattgcgcgatgtttttgtccttaactttcgaggcacctatgaggagccgaagacgcaacaacacctactcggcattagccaaaggcagggggagtcgataagggagtacatgcgtcgcttctcacaagcccggtgccaagttcaagacataaccgaggcgtcggttataaacgccgcttcggccggtctgctcgagggcgaactcacatgaaaaatcgccaacaaggagcctcagacgctcgagcacctacttcgcatcattgacgggttcgcaaggggcgaggaggattccaagcgacggcaagctatacaagctgagtacgacaaagcctccgtcgccgctgctcaagctcaagcacaagttcaagttgccgaacaacctcccctcttcgttcgccagtctcagccggcgatccaaggacagccgccgagacaaggccaagcccccataacttggagaaagttcagaacagaccgtgcgggcaaagctgtgatggcggtcgaagaagtgcaagccctccgcaaggagttcgatgcccagcaagtgagcaaccatcagcagccagcccgcaagaaggtccgaaaagacctctactgcgcctttcacggacgctcttcgcacaccacggaacaatgccgaaacattaggcaatgtggcaacgcgcaagactcaaggcctcagcagggaacaactgtcgaagcaccccgcgaagcagttcaagagcaaacacccccagccgaacaacgccaagatgtacagcgaagggtaatctaagtgattacaagggctgacccgccaagccagttgtcgaaatggcagaagaagatgcagatccgtatggtccatagcatcacttcggcgggtgaaggggcgccgcaatatctgaaccagctaatttcttttgggccggaagacgcagaatgagttatgttcccgcatcaagatcccttggtaatctcagctgagatagctggtttcaaagtccgacgaatcctggtcgacggagggagttcggccgatgttatctttgccgaagcatatgccaaaatggggttgcctacccaagcccttaccccagcaccagcatcgctccgcggtttcggcggagaagcagttcaagttctcggcggaaaagcgtacatgaagtacaaaagcttgcaagccgaattgcggcactcagacgattcctctcaaaggcaggcgaaagaggttgccctttttcaaaaccctccggggcgcatgaaagtttaattggacaccaaagtgccaagcagcattcgacgagctaaagcaatacttgcaaagcccgccagctctgataagcccaccccca

SEQ ID NO: 90923 - DNA, 2452 bp, Oryza sativa
tcctgcagcccataagcaatagcaaactagagcaaaatgtatgagcctccgaccatagtgcaatatggtatatgctggacttgtgtgataccaactaactctttgttccttctatgaaatgcacagtgctgatactggatcatctgaacacaagtgatgaataaagatacttgaagcttatggttgaaccggtaagtcctgttttatgtaattcagattcaccagtcattttcttttaatcgattgtaaactggtcacgagtcctgcatgcttggagcgtaaaatgttatagtttagtttttcagatgagtgtagtattatatgtccatatgccttataggcttaaatcatcataattttgctggtgtattgctttgcctttacagtcagggttctgttgaatgattctatttctatatctgtttgttaggctgtgcgtggctttaccatttagcatccttagaggaagggtcgtgttaactctaagcttattcgttttgcaaggttatagcatacttcaggaacatcttcccagttgtccccatgtgtgtgtcatgccacaagtgcagccaaggatttgagcaccacactttgggcaaagaaacgggaggtactgcagctgaactgtggcgtgctgtcattcagtaaagaaacaaacttggctggaaccaaacaggtctttaacctgctgatgtacatagttttctctttacactagttgtcttattttttgttgcaaatcatgtagaaataaaaaaaaatccttgcttggatgatggtatcttgcatgctttagcttgaattgctctggaaattttatctggtcagtaagacagtttctggttatcactcttctgtcttctccagttttctttggtcataattttgcttttagtttgtatagttcaaatatcataatttattgcaatgtacctttgatatttgtttgtctgttcaaccaacaattcttcattttgagacatgaatcctctaaggattgcagacataagggaattctgctgcttatatgatgtccgcagttctgattttctctccaaagttttcgtggctggagttatgtagaattgtagatacaatatctcaaatcttcatggctagtactagaatctatcttgacatgttctctcttaactacgccttggacgcctttttccctgtcggaatgataggtccgtcataacctaatctgatgtttggttgtatagttatttgactagttagtggctgtcttaagacaccaattgttatgaagatttggaggtcttgtttcagtaatccagttatccctctagtcacatgcattgccatgggcttccaagcttaaatattttgattactcgtcgggaatacacatctaagagaatgatattttagataatggatttgaaaaaaacccggcctctacaccctgcaggatatttgcagccacaaagttatgtagtctgagcatttaaactcgcaatacaggtttcaagcaacaaaacataaaccccaggcactaggcttccgaacggtatctagcagcaacaaaacagagaaaacaaagttcgaaacttccaaccttcctctccaatgatgtttgctttattttttaaggactgttttaccaatctgaaatgttacggtgaactgaatatggctaaatattccagacgtgtagaacttgtagcccagaatgaacgaacggtcccaatcaatcatagcgtggaaataaggtgcacgttttgccatcacaatcaacttcttatctcgaccgttgatcattcaattcgatgtctgctcttagctttttctctcacttggaaaccgaccgttccttgcctgattagatcattcgaacggttgattgcttatttggtgttagctgatcgccgtccatgtgaccactgatcacaaaagcttcttgccaatatgacagtaacatagctctgaagaattctcttgatccagaactgccagctgaaaattagcacactccaattctccaaatgctcagcaaccacaagttcacaactgcaatggttagtcgacgcagctaagctccaaacaccattggtccctgtagccaccatgctccaagttgctgtccattgtgtccgtattctcctaatccattctagccaagaattctctctcttctcatcaagccaagaattctctcttctcaccaagccatgtactttgagcagagcagccgctgctcagccacaagctccgctgcggtccacgtgtcgctattgtgttacgacacatcgcgcgccgccattggtccggaacagagccccaaaaagcgagctatatccaatcttggatcgatggctagagagatttgtggcgcagctgcttccggttcctcctatttacttagcttgtcaaaacacattactcactagtagcgtacactaccacagctagcaatggagacctcgtg

SEQ ID NO: 90924 - DNA, 1154 bp, Oryza sativa
atcattatagcaggtgttattggaacatcaatataaattcatggttgctgatggtgaagaaatgcgtgtgtactatatatgcagatactgctgaccaagatgtcgaagcaggttcacttctatttgacctggcaacattaaggaaggcaacagctaattttgcagaagttaacaagctcgggcatggtggttttggagctgtatacaaggtatatgcaccttgatactatctgaaaataccaatgagaaccctgctgatatgatctgaaacttatttcagggattcttgcgagatggagaggagatagctgtcaaaaggctcgacaaggcctcgggacaaggcattgagcagctgagaaatgaactcctattggttgccaaactccggcacaacaatcttgcaaaacttctaggtgtttgcatcaagggggaggagaagctgctcgtgtatgagtaccttcctaatcgaagcctcgacacctttctttttggtaacagcatttatagttctacgcttcatttttgttatgaaacacccagtagtctggaatcattctcagctgtagtaatcatcaatatgctgacaactagtagtataattgcgtagtaaatagcatccgagcatggtttgcaagcacatgatcagtttggtacttggcagatccggagaagagaggccagttaatctgggaaacgagataccatatcatacatgggacagcacgaggcttagtctaccttcatgaagattcacacataaaaataatacatcgtgacctcaaggccagcaatgtactgctagactctagcatgaacccaaaaatctctgactttggcttggcaaggcttttcgatggcaacaagactgctagtgtcacaagccatgtcgtcgggacactgtaagacactgataattaaattccttcattaattctttacacgttgccttcatctagttatatataaatctgttttacttaattacaattggcatacaaaactataaatgttagttacatttggcatacaaaactataaaggttatatatgtatctaaatataactagctagatttcttaatttatttctagtctggattacttacgtgcagaggatatatggcgcctgagtatgcagttcttgggctcctatca

SEQ ID NO: 90925 - DNA, 1192 bp, Oryza sativa
caatggataaagatatactccctccttcccaaaataaacgtagccataagttttcgtgtccaactttaatcgtttgtcttatttaattttttttaaaaagattaaaaaacataagtcacgcgtaaagtactactccctccattccataatataaggtgcgtacatatttcaagattcaacctttaaatcatttgacaaacacttagtataatatgaaatgaattttattgttaaaaattatatcaatagattgagatttaaatttactttgatatggttataattttgttgctacaaaccgtatatgaaaaattgtaagctaaagattagttttagagaccgtgccaactttaatcgcgtcttatattatgggatagagggagttttcatgttttataatctagcaacaataaaaatataatcataaaataatttcaaataagacgaatgatcaaagttgaaaacaaaaactcatggctacgcttattttgggatggagggaatagataggttaggaccactcagaagtgtaatattcatgtgttttttctttggaatggggctttgttgacgaaaaatctatactcggccgatggtgccggaactgtgttggcgcgaactaagttgacgaacacaacggcatagaagatcttcttagctccagtgcaggtccaaaggttgatgagatacaggcatgctagtcagtagattatgacacttgatataaataacaatataaaagcaatcggctgatgatgataaataacaatataataattcagtagaaaacaattggctaacaatatgatagaataaacactaattcgatgcttaaagcatacatcggctgaagatccaatttcataaaatccaaatgattagataaacagtaaaacatttgttgtcatcggcgaaatctaacttgtatgctatccttataagccgatgcaacatccagatacctcatcggctgaaaccccgatgaaacccttattggcaattaagagcagggtagagaatatgattctaagcacgacttagtaaatcaaacctaactgatacagcactaagtatgaaaaaaacataatatctaaacaatcaaacctttgactgattttcagggtggtggatatcttagctaatataatctggtaaagcgatttagccgataccggcataaactctaaagcaa

SEQ ID NO: 90926 - DNA, 694 bp, Oryza sativa
actttttttaatcgttttcctcatatgcagaggacttcctgcttggctacgtgatattccacaaatgcagttcagaatgcataatgcgccatttgaggtaatgggttataataataaattaattcaaacatgtatatattcatatattatgtatagcaattgaaattttgagcaattgttttgtttcctactgaatagaatgagatggaaaacttcacgactctcattatcaacaagatgaaggatgccaacatgtttgctggtcaaggtggcccaatcatcctggcacaggtgtgatgcatgctagcaccctcgatctgttgccaataatacaagttattcaattacaaatgcattgcttgtatctttatatatatatagtaccgctctattgccaataatttaagttatttaatacaaatgcattgcttgtatctttatattatagatcgaaaacgagtacggaaatgtcatgggccaactgaacaataatcagtctgcgtctgaatacatccattggtgtgcggacatggccaacaagcagaatgtcggtgtcccatggatcatgtgtcagcaagacagtgatgtgccgcacaatgtggtgagcatgactttcaatttgtttaaaataatgtataatgtttgtatgtgtttaaattcttttattgattgtttgaaattcatgccgttgttt

SEQ ID NO: 90927 - DNA, 5566 bp, Oryza sativa
atatatatatatatatatatatatatatatatatatatatatatatatatatatatatatatatatatatatatatatatataggacactcatatggggcaccatggtgcccgggcaccatggtgcccgggcaccatggtttcaaatgcacaaaatcactcaaatttttcaaaattttcaaattgtgagtatatacctagttataagaattcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttcaactagttagtaatgtagttaatattaatacctaaataattgaaaaagtttcatgctcatttgaattgggtatatactcaatttcaacaatggtgcccgggcaccatggagcaccaaacaaatttactatatatatatatgtatatatatatatatatatatattatatatatttttttatatatatattttcttttcctgggccgaaaggaacagtattgggctttcccttcgtgggcttttactgcgccgcttggacggtgggaagttaccgtttcgcctacccttgcgacacgtggcgctttattactggtgggtaggcgaacggtcgcccgagtgagctatatattcccaccgacctttccttttcaccgccacacttgccattttaccgcgtgcgctctcttcctccgtttctttcttccacagcatctctcgacccctcaagtgtttcgcccattctctttcttcgccaccgcaaacgcaccgttcaccatggcccctcgcaagccaaaccgtgcttcggctaaagggccggatcccggccgagtcgatgacgacagcaccgcctttctgggggtctctcttgtggacgacgtcgagctggcgaagctggtccgctctggggcgttggttgaggggcaggctttcgccccagggaaagccgtggtgccgaaacctatcgacaatcggacggtggtattcgccgtcttttttgaggctgggctacggttcccctgcaacgtgttgttgccggagatccttcgcctcttccaggtggaacttccacagctgagcccatcggcgcttgtttgggtcgctatcttcgactgggcgcgccggacttccgggtttgagcctaacgccgagctcttcggcgccatatttttcgccaccgtgaactcgaaaacggtgattaccccggctcgaacgaagaagacagtgttcgggagtgtgaattcaacgttcgtcccgagcggttcgatctttggccagtgaacgctgtcatgtcgaagtgggaccgccattggatagccaggtgcttctatcattccatccccttcgaggctagttctgacgcggcgaaagccctccggtgccggcgtagggcgatcgcaccgaactggaaacccaagatcgccgtggacggcactatggaggctcggttcgttctgctgcgcaaggtttgctcccgccttagctgccgtgacttggtggaggaattctgtatgcttcgcatctttcccctctcccagtcatggcaagtcacggttgatcaaggcgaagaggtcgacggtttgccgaacctgatacttcctgagggggcgaacagtaagactgttcttttgctatatactactgtgctttgttatttcgccttatctgacttttgacatagcctcacactctaattttgcagtgttgatccttgaccaggttgaaaccgaagcccgcaggatgatcggcgatgtgtcaatcgttgagtatagccagctgctaacacgacaagcggctgggcgggcgaaccgggtttacaacggcgaattgcctcctcgagcaaacccccacaaagccgacgatgatgcagggccttcacggaagcgaatgcgcggacaagtgaagcttgcccccaggaaacgaagggctcctgcttcgtcggactccgatgccgacgacgaggacgatgccgaagaacgcgacggcgagggggaagcagaggaggaggaggaggccgtggccgataaggccgcgaacgaggcggtcggagaccgcgtcgacaccctcggctacactcctaccccaagtccaggtcccaacgagaccggggtggagtcgaacagctccccccttcgacggaaggatttggaaggggcgaaggccctagttgcgttctcctcaggcaaggcagcgaagggaggtccggtgcagaagatctctaaaaaggaaagactcgtcgacatcgcccgcgttttcagcgacgacgaatcttctgacgggactccaacttcgcccgctggccgcagtttagacctttcgactgctcccctcgctccgctcagcgttgctggggcaggcggtaatgccgccgccggggcttcagcctccgccgaacggatcgtgtcggctgcggcgagggtcttcgggagccctctgcgtgagccagctatttcgccgctagtcaaggcgaaggggaagtgtgcggccgccgaagcatctgtctctgagtattcccttgcggcgccccacttcgcccctggtgatttcgagactcgggcgaaccttgttccctttgtggagggagtgagcaaccttgtcttgcccgtcggcaccccgagcttgttcaccgaacttaatgagttcgacgaggggtgttccgccattaaaagcctagcggttcgggtacgccttttcttccttcttcgttttcctcttcgtccccccttttttttacgtctgacaattaaccttttgttcttttggcccgctcctatctttcatctagattcttgcggctcactgtttgacggagcgaaccgtacgggcccgttttgacggttttaagagccgtctttgggccaaggacgacgaaataagccgcaagaacctggaggtggaggccctgaccaacaccctcaaggaaacgaagaccgaggtcaaacgccttcagtctgagctggataaggggaaagaggccagggctgaggttgatcgcctcaaggccgaactggagaaggagaaggcccattcgacagtgttgattgactactacaaccttatgagccgaagatggaggctcttcgcctgaaggctagtacggccgaagcgagcgccgcggaggagtcgcagcggttttcacaggagatggcgaagaccaccgaatccgcgagaactgcttgtcaaacgctccgcctcgcccttaccgacatgggcgcgaaagtgcgaggggttcctgccgaggatgcatcagccttcgacttctccgagtggacccagcaggctggcggatcggtttcggactgcgccatcgcgtacggcgattgctgtgcgcgtgtatcagcggccttcaccttaggccttttgcaacattttggctacgagcacgtcgccgagttccctacctatgcgaagggggactgggagattagtgcgcagaacatttcgcccgctcttcacgcgtggcgaaaacagttttggcagaaggacggccggtccgctgccaaggcgcgccttctggagcaactagcgaaggcggaggcggcagaccggcgcgaaggagaggacgcagcgggcgaagagggtggaggcaatgcccaggatcacccagaggtgtgaggccctccgccctttccttagatttttgtagttttcctccatcttttgcatttgcctggagaggcgaatgatgtacattcggcaggctgccgccaaaccttaaaagaggcttttctgtatatttggaatatatgacaccatcctaattactttttgatgatcgaagtctttggcgtattattatcttgcccatttcgctttatgccacaccttccctttccttcgcctattcttactatgtaaactgtgttttgccttttctgcactgtctaacagggggttcgccgaaagtcgtgcattcagcccccttccgggagctggcaaagtcgaaacgagaaatttgtggcattgaagggtctgccgaaggtgcgatgtccatttcggcctgtttatcgcgaaatggagataaacggtcgcagctacaaggttttcaaggttgccaactggctgcgggcgcaccccgggcgaaccttagaagattacgatcttgttcattcaagacgtttggaggatatggctcgcttttggcgaaaccatcagaagactaaacgtcaggaaatgatctttcagcgtcgttatagtttagtctgtgtttcgccgcctactactcttaaggttgtgtatgatattagtagtgaagacgaacctagttcgcctgtccattccttagggagggatagtgattatgggggcgaagatgtaatttacttgtaaggtgaattgtatcgtgttgtaaaccttctattcttcgattattttttcgaagttaataaagatgtgttttatttccttttcgctattctttcgcatcgtcacattccgtgcttttgttaggtcggaacatgtcggcccctttgcgtatattagcgaaataggtgtactgatttttcagcttttcgtcgttcattttcgatctatagcattctgtgttgaaagaaacgcttttgcttttatgtcgatcgaacgtaacgccgttcggctagttaggacacagaggttttatactggtttgggcctccatggtggataatagccctacatccagttttttttttctttttgcactctttcttcttttttttcttgccgaaaggctttcatagtgccaaagggcttacatagtgccgaagggcttacatgacagtatgtacatttttacaagttggcgatttgggtgccacccattctagacatagaagcgcttgagacaggtggcgttccaggaatggtcgaactcctcgcctttgagtgtcgttaggcaaaaagatcccgtcctagacttgtgtttgataaggtatggtccttcccgctttgattcaagcatgccaaccgctactgggttcgccttcttccttaggacgagatgaccaggcatcagctccatgggtcgaacttttttgttgtaagttgccgaagtgcttgtggcatacttgtgcatgtgctccagcgcttcgactcttactccttccaagagtttgagcgatacttcgcgtccctcttcgcccccagagaacatcacccttggtgagttagcccctagctctgctggggtcattgcctcatcgccataaagaagcataaacgggctaaacttggttggtcttgtgggggtcgttcgaagggcccagagaaccgatagcaattcctctggccatttgcctttcgctgccccctcgagtcttttctttagtgcttctaggatcttgccatttgtacgttcggccgccccatttgactgcgggtgtgcgaccgacgcgaacctgatttccaggttaagcccttcgcacatttctctggacttatcagagtcaaactgcttgccgttgtcagtaatgaattcttttggcactctgaaacgacaaacaatg

SEQ ID NO: 90928 - DNA, 653 bp, Oryza sativa
cctctcttttttttcttaaaaaatcttgagatacttttattgccaataaatatattttatttgtaccatcctcccgtccctctttttacttgattcatatacatgcaatttgttatggatgtgaaccaataaagatagaaattttctttaaaacttatttattttgttgtgaacttagtgattgagttattttaatttcaaaatagtattgaaatcaaattggtgttttatcatttttattctaaagtgtttttagggaatttaaattgtacttaatctcatattatattgtattatttggactcttcttttaacacttatttaaattttacatgaactcttgttatatttttatttctatttttaaagaaaattttgttttattttttgaatatgtgttttaatcaaattgcttgttttattttttttcttgaaatttttttacaaattacttgcagttgatctgcctgccactatcggcctcgcggatcatcttgctgacctccttatcagtgaatctctcccgatgcattgtccatgacatggcggggctcaacggcggagatgaagctctcttttggtccttatcgaagacacggaacgcctccctcaaatcatctccggggtccttgtcgatcatctaatcatcttat

SEQ ID NO: 90929 - DNA, 1671 bp, Oryza sativa
agccattttggcttattagaaaaaaagtcaaacgatggagcccgaacaaaactcaggtggtgtttagatccagggacttaactttagtccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatccgatgtgatagggacttaaaatttttagtcccatctaaacagggcctcagatactagtaccatcaacagtccaaaatccgtacaaatttgaatccgaagtcgctttcaaaaagccagagagagagagagagaaagatagatagagagagagaagggaaagggaagagagagagagaagcagatcagcagagctcccccatctctcgctgtctcccctcctccacgtgtagacgtcgacgacgagttatatacgttcgcacgcgcgcacgctcgctcgctcgctgccaccgcctccttcgctgccaccatctccttcgccgccgggcaccatcgccggcggtggccgggttcatgtaatgctattgttgctcttcttcttcttcttcttcagcttcttgttttgtacagtagtaagaagggaggaagaaagtggttgttttcctttcttttttgttcgtttgtttggatgttaacgagtggcgagaagttggagtcgtcttgtgtgcgagaaaaagcctcgatttctccgggtgtttttggatctctgaatctctgacgctgatgcgtttcttgatgtgtcagactaagacagagaggctttgcttgttcttctggcgcgtgtgcttggctcagctcaagctggggatcttcctgtggtgattcttttttcgttttttttctttttttttgtgtttttggggaggtgaggtcggcaggttcggttttcttgtggtgaggagtatctgtcaaaaggctggatttttatatattgccaaaaaaaaatgtgttcttcaattttatttgtggctgtcttgccaaatgatactagctggctgtttggctgaataaagtgagaatttgatgcaaatcctttgttagattgtgtgtgcatttgtgcttctgatttctgaggcggcttctttgatggagttagttgcaggaaaattgcccctgcttttgattagtttgttttggtttacctatttgatgatccaattaggatattttttaaatatttttggtgttcttcgtgtttcatttgaaaagttcttggctaggagaattggagcaaagactaaagatccaggccttatgttagtaatttcactccgactattttaatctctggttctttgtttttcaatgtggtttctgtgttctttgcctctgagaagcttaaactagtttttgttgtagtggccatcaagtcaacttggatgagccgagtagttcaaggagcaattaaacttttgcagaatcttcagaattattattggtttatctggagtgcttgtttttttgaccaagtccaaagtacggggtgcagg

SEQ ID NO: 90930 - DNA, 722 bp, Oryza sativa
ctgcaccccccccttggccatttcctaacctctcaacactctgtcatttagccataattcaatccactgtccagctaaattcctacagaatcttgctgcagctgaagcaaatgaggttcttgatcatggcagccatcaggtgggtggttcttgcatacattgtcgtcatcggatgcgcactattgcgcgtggcgatgagcagccactgtcgaggattgcgatcgagagggcgacggttgctgctgttgattcagccagcgtgaaggctcaaccgacagttcttggcctgaaggtttgctgctcatttgcttcatagaaacactgatttcttaattgcataattacaatgaaatctcatgcacttttacccttttttgcggctatgtatgtttcagggtcaaagtagtgattgggtggtggttgaattctcccatccgaaaccctccaacgacgattggattggtgtcttttctccttctggattcaggtcagctgcaagcatgtgttgatttgcatatatcttgtctaaattgtgtactagaactataaatggaacgatggcatcattcaatgtctgaacatttttagctctgaaatatgccaacctgaatactatggagacctcccaccctatctgtgtacatcacctatcaaggttggtgccctcccgtcctttcatatttttcatatttatgctgctattcatgatgcatcatggattg

SEQ ID NO: 90931 - DNA, 1433 bp, Oryza sativa
gattcaatattgatccttgtttgcatttcagtggtaatcatgaaagagattggcctgaaagcgggtcattttatggacacaacgattctggtggcgaatgtggggtccctactcagaccatgttctatgtcccagctgagaacagggcaaaattatggtaatttcagcatattaaagccatataattagttgaactcatgtgattacttattgatgaaaaaaattgttatcttatctccaggtactcgacagactatggcatgttcagattttgcatagctgatactgaacaggactggagaccaggaactgagcagtataagttcatcgagcaatgcctgtcgtcggtcgacaggtcgaagcaaccatggctcatcttccttgcacatcgggttcttggatactcatctgcgagttggtatgagatcatgatgggatcatatggtgaaccaatgggccgagatggtctcgaggaactctggcagaagtacaaggttgatctcgcagttttcggtcatatacacagctatgagcgcacttgccccatttatcaggtaaacctacaacctaaattctcatcaagaaattatgtaacagaaactcagaaatcaaattcatacaccatgtcagctttgttttcaactactttgcaggacttgctacagtagatatgtactattccagtagccttgatttacaatttatcaaatgtgtgacaaatttcattttacttggttgcagaaccgatgtgtccaggatggctcaaacctttacaccggtcaattcaatgcgactactcatgtaattgtgggaggaggcggcgcgatgctctctcccttcagagccactgtaccctattggagcttcttcagggactacgactttgggttctcgaagctcactgcactcaaccactctacgcttctgttcgagtacaagaagagccgggatggaaaggtctatgaccacttcaccatctcgcgtgattaccgagatatcatggcatgctcaattgataactgcccaagaaccaccttggcagtatgaacagcctccactagttcattgtcattatctttgtgaagtgttagtatgtgctgaagcatatatgctaagcattgtactgtttgacactggattatctagtgatatagtgacagtggagctggaataaaccatccaatcagccaaagtctgaattgcagttagccaaattttagagaggaaattagccaatcacactgccagtttagaacaaaaagagataagtaaaagaactggacaatgcataatatgtccaatcaatccatatatttacaaataactgtcacattctttttgacaaaaactgcactaagatgccctctgaatgcacctcatgctcaaaagactagttttcaattcccattgtaaatggagggagaatcttcata

SEQ ID NO: 90932 - DNA, 1310 bp, Oryza sativa
attcctgcagccccattaaccgatgtttgtgggctcaagtaggcaccttgcactaagagctctaatctaactacagcaggtgccaggaagtggacagaaacatagcagagcgttttagataaatcaaagatgggacacccaacccaaaaaaaaaagttcaaggatatgtgacttatgaaagtctactacacagcaacaaagattgaggaggcatatgtaatagaaaattcaaagagtacgcatagtttgaagctgataaaagattttaagtagctacttgcttcccaacctggataggattaagaaggatctgcaaacgttgtctcagtgaatcaccacactgtgctccacttctcttgttaataaacactagcaatggcctagaatcagaaggcacatccacgatttcatatttctgattattgtgtacgtgtgaatcctcatgttggccgttcggtatgctagttttgttttctgtcaacagctgtttatcattctctgattcagagctttcatgtacttcaggaagttcaccattggcatgatcctctctccttttagctgcattgtttgtttcttgtgaatctccttcaatatcagatggcgggtcaatagtaccagagctatctgaatcaacagaaatggtaccctttctgtactttttaccgcgactcctgatcctctctcggacattggaagccaattcattagccccatgtgttatagaactgataagtcctgctgcacctgtccaatggagctccttaacacaaagaggtgacaatattagccgcttcaaggggcaagtcacagatatcaccagtttctatagataggttgttgtgacaatcaacatgcactagccgttggcaccacatacagtaccaaattggagaacctgcgaggaaagctccattgcaagattcatcacaatagcagcagaaagaatcctcctcagagcgatccgatgtgtcaatccactgtacagcccactgatgaatgacatgttcaaaaccaaccatagaaacacatttgcaatctttgtgcgcatttcctgagcaactaggatgtgcagtggcaccacaaatatcacactgatggataactccccccatatactgcggagatgaaacagacttcaagcatacacagcatttcagacctttactacgagagccaagttcttttctccaaatgtgggaagaggcagggaccttatctttcaatttcttgtacttccttgccctaactctgatagctttcatcaaactcaagctgatgtttttgttcaattgattgacagtataata

SEQ ID NO: 90933 - DNA, 2559 bp, Oryza sativa
gcacaccagaacagttcggtctatgtgaacataattcctgacattgcaagtgttgatcatgttgttgattctatgtagaacccagtgaaacctctggggaaagagcccactgaaccgattgatgttgtgctacatagcgagattcgctctgtcggtcgcgccaggttcgatcaccaagtgagtagtaaattttgtaatgctagatcgccctcgacgagttcctaaacgtcttgacggtttatcttcaatcctgcaggtggccgaacgtaacagcttcctggagaaactgaacatggagagggagaggcagcaaaaggtacaccttgcaattcagagaatcacagatcaaaaactctgaattcagatgcaaatctgaaaatcatgtttcacaaaaatgattttaatgtaagaatttgagttatgaaatttgtgtgcagctggatgaagagcttgagattaagcagctgaggaaggagcaggtgccaagagcgcatccaatgccggatttttccaagccgtttgtgccgaaaaggtaactgaaacttttaaggtttctgttatttgtaaatataaaatcttgctgttacatttcaaatgaattcagatattttgttttcattgcaaatccaggtcagtgaaacctcaaacagttcccagagagccaaaatttcacccaaggctaactaggagcaattccaagacttgatttgatgccttcagagattcaccatttcctcctatctccacaagagaatggcagtaatcgtcatcgctgttacatatctatttactgttttgcttatgtgattcatcgtttactgttacatagtcatttgctgtcatcaaacatctctgaattcagggaaactgctgattgatgatgtaaaatgttgattcaaatgtgtagaaaaacaaaaaatcggacatgttttggtcactgtgtcgatactcgtatcgatttcttgtagtttacacaaacttgggaaatgttacgcaatttagcatgaagaacattgttactgtgatgagtagataaaagtaaaaaaaaacaggttgacaaacaaatgctcagcgctgcacatggagagttattgatgaagtttattgcagtgtccattctggagggaaagctctttcaatgtactacagataatttgaaatgtgacaagcgataatctcatatttgaaagatggaatcatggaaacctcctagtatggattatttctgcatcttggactgtaatttaaccaaatattttaagaccctgtttagttcccacacaaaaattttacaccatatcacatcgaaagtttgaacacctgcataaagcattaaatataggctaaaaaataactaattgcatagattgcgactaatttgcaagacgaatcttttaagcctaattgctccatgatttgacaatatggtgctacagtaaacatttgttaataacggattaattaggcttaataaatttgtctcgctgtttactgacggattctgtaattagttttttattagtgccgaaaacgctatacgacaccctgtataatacccgatgtgacacaccaaaactttacacccaggatctaaacaccccctaactgaagaaaccgggtggattttgaccatcagaagcgacagcaatctgtgacatattctgcaatcctcaacaaactaacgcctgtcaatctgaatcagaaacatctcattttttgttaatttttcacaagcactatgtgaatcaaacgttgaaatttggcacagattttttttttaacttttcagaagagaaaattacacacacaaaaaaaactggatatgtctgcgtgacgctgtttaccgaacggcccagctcagcgctttgctcgaactgggccggcccatctggccatctatgctctctgacatgtgggccccactatatagtcaaaagggataattcgttgatgaaaaaaaattttggaacggctcggcgcagactgcagtgctctctgtaaatggtgcgtgctcgagactcaatccgcgaaatcctccctgttttttcgattcaatccgccctggggacggcggattcggcgccggcgatccggccggtcgccgccgcgtccgatttggtgcggatttcgtcggagaaatcgcgtcttgaccttcctgtgcctctttttttttttgttgctcgtgggggatttcaggagaagaggggggcggcgtcgcatggcgactacgacgagcaaggttattggatgggtttcttctctttgatacctcgagcgagtcttgcgttgcgtggtgaatgaatcctgaggagttggggggtgtgtgtgtgcagatcgccgggtgaaaggcgccgaggtgttcgtcggcgggttgccgcggtcggtgacggagcgggcgctccgagaggttggtgttcttccgagagttgcgcgctgccggtagaatgtgcaactgtcactgtgttgtttgattggtgttgtgaattttagcctagtgtactgcatggttgaaaatacctgaattgtttgtgtgcttgattgtgtggacgtgatgctttt

SEQ ID NO: 90934 - DNA, 1907 bp, Oryza sativa
catccactggttcttgccatgacagctgcaaatttggggcacatcattcccctgaacccaagaagtactggcctgttcgtcgcaggcgacatcaggaccgtgccaatgccgggtgcggaaagcaaggccaggatgaaatccagacacaaaaaggcagatccagaaacaaggacctggagctgaagatttgtcttgtgaaagatggtaatgttcatgacaagcctgaattcatcgaggtgaagaagccgcctattgaaatggcatctgacaactctgaaacctcaccatgcgtgcaagatcagttgtcatcagctgaagaatccaaacgtgttgaggatggagctgatctgccatgtggtgatgataaattcttgatccctgatggcaatgctgcatgttttgtggatggagaatcatcagagggagctgtaagcattgagctggagatgccgttggccatccaggacagtgacgcgtctgacgatcatatcgcagatgccatttcgcctcctgaatgtgtgtacaaagctggtgaacagttacttgtggatgacatgtgtgatgatggatcaggaaatgagtgtgcaggttcagagaagaagagcactcagattgtgatggcctccgagaagcgtgaaaaatctgggcatggaactaaatcgaagagtttgtataatgtttcagtaaaaccgaaggtgaaagagacatcgactgcaacgcgaagcaatgcgtcaagccagaaaattgtaagaacattggatcggaaagcttcaggtacaacaattgaaagctccaatggatcaaaggtagtgagagccaccaagttcaatagggacaagaaattcagatctaccgtcgcatcgaatgtaccaaaagtgaaggagatcaaagttacatcaccagctactgtgatggatcaatcttccaaacctactaggcaatcaaagctgaagtccttggttgcaaatgatgctccatctccatcagttaattcagagaaacaaactgacagaaagatgacagtgatgaatgttgccaagaatgctcgtgtttggcaaaagaaggaagaagagaaaataagtccagtgaaactgtctcgttctataaacttgtcatccaagtcccttttgagcataaagatgagagcagtcaagaaagaaaaacctgcttccctagtgaagagcaacaagaaggtgtatggagcagaaaatgctgttgctgacgttaaggagaaaaacctgaagtcagcttcaccaaaagtgagaaaagtagaagttagcaagaaagaaagccgttctcagaaaggtactacattttgtttgcccccctgtcaacaccatgttcaaagatttgcttaatttacattcaacattactacagatttcacatgataatctgtctgtttatgtcatgattgacaataaggtttaccttcttttctccccatcctaattcagtaatcttgcatccaacattactacagacaatttatgcagaaaacacttgtttctcaagcaaacattgacatgtgctcattcaaatttagcagaaaattctgccactccaagaactgaaaacacaaggcagccaaagtcctcaaccatcccagcgcagtcgcctcgcaagctaactttccgacgaggaaaggtactgaacctacagagcaattcagagtcgagcagcacgccgagacggctccggttcaggcctgcaaagactgtagaagacagcaacaggagcaaagaatccaccagagggagaaggaagagtgacagtgcagcctcttccgggtcaaaagattcaggctcttcgaaacctgaagttgtcatcctgaggcatcaggatgtcagggacaagaagaagaacgagcagggattgttgaacaatgtgatcgaggagacagcgag

SEQ ID NO: 90935 - DNA, 6084 bp, Oryza sativa
ccattcattcattcagtaatactccctctcttattaagatgaaggttggttagtctaaaatactactcccttcgtttcgaaatgtttgacaccgttgacttttcagcacatgtttaaccgttcatcttattcaaaaacttttatgaaatatgtaaaattatatgcctacataaaaatatatttaacatgaatcaaatgataggaaaagatgtaataactacttaaattttttaaataagacgaacggtcaaacatgtttaaaaaagtcaacggcgtcaaatattttgaaacggaaggagtagtaattaaccaacgtcatataataaaaaaattggaggaagtaagaaacaggcaaataatcattttatccgaagatttgatttgttttaatgctctacaaattgggctacgaccttgccgtcattaacttagatgatctcacatattattgtcacttagtgtcaacataatcgaagtggcaacgaatactatcaaattttactctttttttttctctccctcttatcctcttctatttgtcaagtttgtaataattaaaacttagttaattattccctatgtcctataacatagcaatctagtaccgagcaggatatttcatattacaacgaatccagacatgctttctgtccagattcgttgtactatgaagtgtcttgtccggtcctagatttctatattatgagacggaggaagtatgtgctaatagctatctcgtttgacgtgctccaactttattttcatcttcatgagtgtcaaacactacctatgacttctttcatgtccccaatgagccggctagcagtgcgagattgctgattaaaaatgcgtgcatttcgcttcttccaaaccatacaacagagtaaaagaccaacaaaaccaaagaaccctcatgcccttgtcttgggcatcctcgttatagccggtttcagaccttgcatcagaagaagaaagcccaaaatgaggctgaaaaggaggcaaaccaggacagcacaattgtgcataagcacattttcgtttcaactgacgaatgtttcagttatcatcctaacctataattagttcgtagagatttcactagatttttcttcttacatatgtactagaaaaagaagaagaataggtctctagttgttaattatctcaaattatgaaaaaggtaagaatgtaaaaggtcagaagcaataggagaggattggtgttaccatttcacagccaagtttcataaccaactgatgaaaaatgtatcaatgtatagccatttcaattaaaacaaagattagttgcaaggttatcatgtcactgtctcaaattctcaataaaaagaaaataaaaacagaaatgtgaaaaatctgcagcactgaagaatgcaaaacttccctgcttgtttattcaagagtgtgtttgttactgtacaagagaatcatccattcattatttattaaccccaatataccattaatttactcccaacaaaacaaaaaaacaatttccagaataattctatctcaattcatatatgctcatcataatttcaaacctatttgaaattttcaaatgctacatctattcatttttaaaatttttttaacactttcttttacacttgagctcaagcttggaggtcacccttctcctctggctcgagctctctgagctcgtcggcctcgcttctcctgcaactccggtagaacatgcagctcacgatgatctcgagcacgacgcagagcgcgtggatgtacgcgatggagaacgcctcgccggcgacgcccgccgcgagcctcttgccgtcgccggcgccggcgaggcggtggcgttgcgcctgcgacacgacgcggagctggaacagcgcctccgcggcggccatgccgaggttggtcgggagcgcgagcgccagcgcggtgggcacgcggccgcggatgacgacgcacgccctgagcaccgcggcgtggcccgcgcggcgctccatggcggacaccaccacggcgaggttgcagaccacggtggcgatccccacggccaccgagtaggcgatggcgcccgcggcggacagcgcgagcgtcgccgcggcgtgggaggtggtggtgaggcccatgaggtcggcgccgttgaaggcgaggaacatgagggagaacacggcggcgttcgcggacagcatcacgaacgcgccgaacaggtgcgtcgccaccatcgccgggtacgcgcccgccacgctcccgcacggcgggagccgcgtcgccctcgccacgccgcgccctcgccgcgccacgccttcgccatcgtcgtccggccggagcatcgccgcgacgcacgccttggcgaggagcaggaacgtgagcgtgaacggcagcgcggcggcgaacgtgaacaccgtctgcgacagcttggcgttgaacagcgcgaagaacgacgacggcgggaacccggcggcgtcgaacatgcgccgtatcctcgccgacaccgccgccagcgctcccgacgacggcgacgccatggcgcccgacgccagcacggcggccgagaacggcagcaccagcagccccgccacggaggtgtagcaatggtagccatggaagaacgccgccaccgccgccctcatcaccctccccgccctcgccaccgtcgtcggcgacgccgccgccgcgccatggaagcctcctctcctcatgccgccaatccaatgcaatagtgtcaagcctttggtttcttggaattcttggaggattttgtagcttgagattgaggttgagatgatgatgatgatgatgatgtgctactggtttttgagatggaagctagaatgattggctacctactgatccatgagcgaaatgggcgatgcaatggactcatctcatctcatctcatgtccaccttaatatggtggaggttgagaagaagcaggtgaaggaatagaggttgaggagaagcaaacaaatttataaaatttagaagaattttcaattactaaccattgatttaaaaaaaagaaatgttttttttttaagtttatgttgctttggtaatatggtcattgtaggtagtcctaacttggatgtgtgatgtttcaattgtcaaaaaatattcttggattggatatttatgagaaaattattttcattaaacatatggaattagtgcaattatttatgtctttgcgtttttgtgccatggaaaaatatatgatttgtgacaacgaactgcatcagaaactggtagtctaaagatacaataaataccgtgtcaataaggtttgaaatttcgatccaaaatctctgaaatttcagatttaccggtggatcccagtaggaagcatttccagataaaacttttgagtttgtttgaatttataaattttctgttcaaattgagcgaaaatctttctcaaaatttcgtatgatattttggtgcaccatttttttttaacatcctgaaatgtaaaaccctggccgaggctgcactcaattctgtcaccagctatacaaaaagtaacaaatgacatgcaattgcaggtgacgttgcatccaaggctgtatgcatatcaaatagacaaaatgtaagaggtttcttcgatcatatcccactcaaaggtcaaaactatttatgaaactgaagaaatacagctttcggacggcgagcgtacgacaacggagttgggcagaaacgcagaatggttggaagaactgaagccactgcattaaaaaaccaagaagaaaaaagataacaaaaaaaaagcagttcagataggaatgttggtgactgtcagaaactgtcactttcacagttgggtgaaattaggtccactaccgaattcaccggcccaaccaacatctgacagtccgagtgacagttactctgaattgttcatcagcagttggaggggtaaaaaaaaaggcagagcaccttcttgctgttcttttattttttattcttttcagctttatttgatggttaagatagtacttctaggtttatcaagatttggtttgttggttgcttcgatgtgcttcacttggaattgaagttacttcagagtcacatggcactatgtaggattttgttatcgtttatttgtccccctcaagaaaaaataacgttatttgtagttgataattgttatgtactgtcaacaagatcacgctattgactttagatcaaatggagataacagatgtaacctttctctctgcattattattttcttttcaaaaaggatactttatctctgattgatctttattgttttgtaaagtacgaagactcaaatgcttaaaataggatcttatctgcatacagaaagggtgaaattttaatgaactaactttatccagaacagataaatgatcttttagagaagttaataactgtttacctaatatgttcaggtgtaacaaagtttggtacaatcttaacacaactcccatttcattgacaaaccttttacttccttacatattcactcctctagttgcatatcaaagtgatcatttattacctatccaaaagtgatccatggtacacaccggtaaattcacctgaagacagttaaactctcccatgaattaggtaggtcaacttcttaattaacattaagctcttctttaggttgggattaggaaacgtaataattctaatacaaaagatattagtactatatcatcacggactctgaattgtactgctagtggagatggaaggtagatctctcttgttcagtgagatcctatcaccatttattgtctcttgttgccatgttcttttcccatgtaattatccagccaaaaaagcagggatctaaatggaaattatccagccagccagcaattaggcatagccaatgagagctagctggtggttgtactgactaaatggaaaaaaggctagtagcagcagcatccaccagacatgcagacactgataactaaaacctgtacataattcagccaagaaaaatgcagttaatggctgttttgatcaacttgagttcagcttgttacatgcactaataatgcagcttctgcactcaaagtagtacagcatgtgtttctgcaggggtaaaattgttctgcaatgcatgtttgcatgatccaattttgactttgtgcatgtcacttcacttcaccctcactctcactctaattgagtcactagagtttgttgagctgggactcaaagaaggtgattaatgcactttgctgtgtttgacctaactgatgaaccccaattattattgctaagccaatcttgtggatgttcttgatgtgtgtgtgtgtgcatcatcgctgccattttggttttgtaccaaagtaaggaagctaggttgggtccaaggggcaggaaagagaggttggccacaggaccactggtgacaggtcaattcatttggtggaaaaagcatatctgcaaactaactaattattaactaatggcctctcatttttgtttattaacttagtttccttcactagttgttcctacttatcttttaaaaattgtgtcattactttttcagtgccaacaaggttgtggagaaggttttgtatgttaataaaaaatctatttggttgccaacttactattatcagttaggtgtttctaacagtgctaagtcaataaaaagtgcttgatttcaggtcgttttccagggcatcttgataaaccagcagcttacctatctatgtggttttcattctctttttaccaattgccactaccattttgaaatgtagtgttcaccaagcaaaagagaagacaaataactaaaaacttacatggaccactctatgcttggagggaggatgatccaaattccaaattaagcatgcaaatttaccataacatcttctttcttcctctgtctttttttagccgagccggcctaagacaggcggaccaaatttacttaagaaaaggatatgtacatatttacagagttcaaacttcgacaagaggctgcccaagtaatggatgttgcacaggagcaacttctttcttcctctgtcaaaaagttttacaataataacatcactctctccatattcttgatgttcatatataattaaa

SEQ ID NO: 90936 - DNA, 6776 bp, Oryza sativa
ctctcgccctctctaatttgccccttttcgttcccaaggtctccccagagctcgtctcgctgtcgccgtcgctttccgccgctcgcagtcaacgatcgtcgtcggtgaggcccctcccccttttcccctctctctcccacccacctagcgctgctgcttagccgcctagccgcgccgccgccgctcgccgctggttgccgccacgcgccgccgccgcgcaccagggccaccgggccggcttaagctgcccacgcgtgtacggccgcgcgccgcctccgccgtccgatctactaccctcgggtagatcggggccgtctgttgccgcccgcgtggcagcccacgtggccgccacgtcggcgccacatggcgctcccctctccgggtccccctggactcggtccaccgtggaccggcgtccccgagcagatgacatgtggggcccgcatgtcggcaccgcccccctttgctgacatccccagggttaattattgcgcaataaatcaattaaggtttttctttttatagtaaaagcacagtgaatcttctaaaattcatccgtgctccgtttaagcccattcaagtctcggtaaatcaagaaaaatgcaaagaatccattaaaaatggttttgttctctgtttcagtagtcttatagcctgtttgcattgtttgccttgtatgtcgcatagattccggctctcccgatgctccggtgtacttcaagatagtcgccgaagtttctccaatcgtagagcaaggcaagtcatgcttgtcacttgaacatattgatcccatattgcaaatgctctattgttttcctttaaatattgcatcgttttataatgttactatttgttatcctgttcccaagcgctagcttgggttgtaacatgactagatgttggattagggattgcttagccatgcttagttcaactagtacacaatggaggaatcacattaatgcatagacttcagattctagtattgatgttggattagtgccaccgctttggtgttggttaattaaaatatattaaatggtgggctgtgggtgcatggttttgatggtcgctgcaaggtgggcgtgatagagtttggatgggccctgcgacggcctttgcggctttcggattcacctaggcacgagaggggactgcccgctgccttgcgaggagtgggggtgaaacctgaggtgtggtgtgcttggttaaagggggttatgcgaagggtcctgtcacggcctctttccggtatgtcgtggtggcatgccggcgcacgggaacatgtcgtggggctgtgtattgtgggtacagttgtacatcgctgatcagagtaaaagtattcgaatagccgtgcccacggttatgggcggtcaaccaaattcaccgtgattagtctcaccctagtttagcttaatggaactgattagttcaggtggtagtttgggcctgtctcaacgtggtgtagcgttgagcagtgattggtttaatattgattaattattacaactgtttttctgctttcaactactgtttataaatgctagctttatgcaaatgaactcctttagccctcctttagttatatcttgcatcataccctccattccggtatgacttgctgagtacagtgggtagtactcaatcttgctctatctcccaaccctcagagttcgagtatgtgtccgatggtggtttctccgaggagtaggcttcgtccgtgccgtcgaagatgcctgtggagtggtgttcccgctgcaatccaagtcaaggcttagctccagttatctttttttttccgctgcatttatgtaagagttttataatgtttgtaagacgtggatctgtatgtcaactttgtcgtttgtgtaccatggccgatcctggacagaggttttaatgcacattctgcttaaaattctattcgggaatttctgggtgtgacatgagtccacatccgtacccacatccacgtacatatcggtcgcttttatataagggttaatttgatccatacaattagaaatactactatttcatataaatgtcactacaattcgtctatttgtagccgtgccactgaaatttacaaaattaggactgtgccactgccgtcacgttttccatcatctccttcgtgcgtccccctgggcggcgtcactactttgtctccccccgcacaggccggcaaggacgacaaggacgaggtggagatgctcaatcatggtggcggcctcgaggtgagccatccgcagcgcggctaggacgtttcagacagcgccgcaggaggtggccgtggagcagacggtgaaggagcagctacagcgcgtgctggagcgcatcacattgcagtcgcaggcgcaacatggggacggggagctgcttgtccaggtctgggtgccgacatggtggtggtgggagcggcggtgggtctaacgatggcgggggacatacaacatggggacgggaggagaagggcggtggggaagggctcgggggcgtccaggtacagcttgcggtgtccatggtgaggagaagacatgatgagattgggtggaggaagaagaactagtggatgtcctgcgcattgcagcgggatttgagaattcttactgagaaacattattgatcaatctttgtgtgtttccttcttttactcattggttacgtgttttcttttcgacaaaataatatggattacgtgtttatcaagtgggccgctttcgtccgttggttgctaagaaagaacaataggcggagacgtcaagggagaggttcgtttcctttttttttttttgccaacagcaaactggatacatgcgatgtttgaaagccatccgatcaatacctgacagttaaaatatgtagatgacgtggcaagctgtggtgtaagctttataacaattataacttagtgggtattattaactatataggaaaaagagatgtgccgagtgagtctcacgtgcagacgaggaagaagatgaaaaacgtgactacagtgacacggtcctaattttaaaaaaattaagtgatatagttacgaatagataaattgtaatggtatttattcgaaatataatatttacaatggcatggatcaaattagcactttatataacctcctcatttcatttcaaatcaaacgagataatctgatccattatcgcccgctccattccccattcccaccacggcaccacctgtccctgtcccgcagtccaaaacggcaccaagaatattgctcctacctttcctgaatcttcctaccgtgcgtgagccgtccccagtaccagtactcaccacctacgcggtcgcccaccgcgccgtcgccggcgccggtcagcccctcaccgccgcctcccgttcgccaacgacgtcgtcgccgtcggccctatcccccgtcaggtacgcccacgcaacgccgcccccccgtcttgtatactatttctcgattttgtttttcttttttaattttattttagcgagctctatcctcgcccacagctccgtcaaaggcacggagaaacgaacaaacgcgagagagaaaacaagaagaggaggaggagccgacgcaaccgaggccccagttccgattgatctccggttcccagatcggccaggtttgtcctccccccaattcgcccccctgaatccttctccccccgcccggtttcgtcctgatcggtgcccgtttcgtgctgttccgtgcgcggattagggttcttgctaggatctttgggggtgggctggcgacctggtgttgggtgcttgatgggtttgttcgttcgtgcgtgtgatccgccgtgggaggaaagaggaagagattgttctcctgaagaaaccttaccatttccgttggtgttttgatgaatggatatgttaggattggtttctttctgttattccctgcaagtttcgtcaagctcagctttgcgattagttactatgagcttattacaattttttacctttctacaagttattcattaccgatttttgtacctaataatgtggttcaatttgggatttggaagtatgcctgcgattttgtctggtattaacaatttagctctcaacaagcaaaagcaaccttttgaggctagttgcaggctgcagcagaagcagagtgaattaagggcattcaagtgtaaagaacagagggtatacttaaaatcattcttatatttttaacaactattatgtctcatgtggtactataaatgggaacttaaatgagattagttgttaataaaaatttctgtaggaaatatctttgcattttagcctgtttttccttatgtccactattaaggttggaataggttaaacagtgtacaggtgcaaatcagaacctgaaatgctgatagttaccttccccgtacatttgactttatgaccggacggtgcatttctttgctccgaaatgctgatggttgtcttcctcgtacttcgttaatacattccaccattaacatgcattcctcataccttagtagcaacagttttgtgtttatgtgaaaatatcaaagagacataatacactagtttcctgtcatgatatctcatggttattttttacacgtatccatcctattagagatttttatattatatcatccttttgtgtgcctacttgatgtttatgccattgttttgaattaaccagcaatggcttcatcttcggacccatggatgaaagagtacaatgaggcatctaggcttgctgatgatatcaattccatgattgccgatagagggtctcttccacaatcaggcccggaaattatacgtcacacatcagccattcgaagaaaaataactattctttgtactagactggatagcttggaagcattgttgtccaagattcctccgaagtcactgtatgttctgttgctactacctttttctttatataaaactgaagataggtggagttttttcaattctggcatatttccttatgctaaagcctaaatttattccgaaagcctatatactggcaaattttgtacaaactgttagctaacctgtttacttaatgtgacgtatcttaaaattgaatttatcagctattctttaaaatggaggataatgatgtttttgctcgtttataactgatgtgtggacttctgacgcctctgcttcaccacctatggggacccagactagatttaaaatgaaatacttcctctgtacaaaaatatatgaactacaaaggtaactatattttgggatggagggagtattgtaattgtatgatcaggttttgtgttattttttcaatgaccttagttggtgtagaaccataagagcttgtgttggttgtggagcatgaaaccaactatgctagagatgttataagatgcaattatttggcatatgttagaatttaagggctgtgcatgtagttcctgtttgaaaaatatccattgccattatggtaggaagattgcaccttatctcttacgtcagttgtaaggacatgttttgcctgcttatgagaaagatatggtgaacgccacttagcaagttaattaatgtggtttgcagtatagatatgctgatagaaaatggtttgtcattaactagttaggattttttttttatcgaagttatattttactaatgcaggaacctgcacattttaacactgacacatagttttatatttatatggcatggcagtatggtgtaatggttattggaatttatacctgccaaaagttctcaattcctttacttttgaattcatgcagcagtgacaaggagttacacaagcgccaagacacgctttccaatttgaaatctaaaacaaaacagatggcaacaagttttaacatgtcaaactttgccaacaggtgtgttcttcgtatcagtaatgatcttagtatggaataatgctgtaccaatgctttggagaagtatcaatcctttatgtcatccaaatatggtcatgtaattattgttgggaacttttatttctaatgatcatagtatcataccaaatttgtacttatccaatatagggaggacttgcttggtcagaacaagaaggcagctgatgatatgagcagagttgctggtttggataaccaagggattgttggccttcagaggcaaattatgaaaggtgacaaatatgtcacttaattattccattttttgtttccctatagcaggatcttttgaataatggcattgaaatttcggtaaaagaaaatgatggaattgaaataaaacatgaaaaaaaaaggtgcacgagacccctgtttctttacagtacatgcattttgtaattgtaggcacatatcattttatttccacaaaccacagcaatttgcatggtgactaactgtttggcatattttacaatttgcagaacaagatgaaggtcttgagaagctggaagagacagtcctgagtacaaaacatatcgctttagcagtcaatgaagaacttaccctgcatacgagattgattgttagtacctgctatgacagctgtatgcatgcgtgtttctaaaactagatgataattgctttatattcacctattgcaggatgacttggaagatcatgttgatgttacaaactcgcgtcttcaggtgagtctgttatccttcttcgctgttgttaatagtagaagctctataactactgtttgtcacgaattgtttaacactcacataaattaaacattgaacgaacttatttcatccagcgtgtgcaaaagaggcttgcaattctgaacaagcgcaccaaaggtggctg

SEQ ID NO: 90937 - DNA, 1175 bp, Oryza sativa
acgaatcaagctgagtatgaagcagttcttaaagggttgcaattgctcaaggaggtcgaagccgatgctattgaaatcatgggagattctttgttggttatcagtcagttggcaggagaatatgagtgcaagaatgatacttgatagtttataatgagaagtgccaagaactgatgaagaagtttcggctagtgactttgaagcatgtatctcgagagcagaatattgaggccaatgatctagctcaaggggcatcaggatataagccgatgatcaaagatgttcagattgaagttgctgccataacggccgatgattagagatatgatgtgcatcaatatttacgaaatccatctcagtcggcttctaggaagttaagatataaggcgttgaaatatgttttattgaatgatgagctttattatcgaacgattgatggagtattgcttaagtgtttgagcgctgatcaagctaaagttgcaatcggcgaagttcatgagggaatttgtggtactcatcaatcggctcataagatgaagtggttactttggcgtacggggtatttttggccaacgatgttagaagattgtttcagatattataggggctgtcaagattgtcagaaatttggtgcaattcagagagtgccagcgtcggctatgaatcctatcattaaaccatggccattcagaggatggggcattgatataatcggcatgattaatccaccatcgagtaaagggcatatgtttatattagtggcaactgattatttcaccaaatgggtagaggcgattcctttgaagaaggctgattctggagatgcaatacagtttgtccaagaacatataatctaccgatttggtattcctcagactattacaactgatcaaggttcaatctttgtgtcttatgagtttgttcagtttgccgatagtatgggtatcaaattattgaatttttcaccgtattatgcacaagctaatgggcaagccgaggcatctaacaaaagtttgatcaggttgattaaaaggaaaatttctgattatcctcagcagtggcatacccgtttagccgaagcattgtggtcttatcggatggcttgtcatggatcaatccaagttcctccttataagcttgtttatggacatgaaactgttttaccatgggaagtt

SEQ ID NO: 90938 - DNA, 2343 bp, Oryza sativa
aaagaggtaaaatgaattggtcctgtggatttctttgaagatcctgagcaactgaatcccccttatgcttagcaaaggaaaaaagcctgggatatttgacagatcttatattatcatgccacaaatcctcccaaaacaggactgtcttgccagatctcaaaatgggctttgcaatacctctaaacaagacatcaaactgaaagacatctttccaccaaaaagaaccacaagaattagccacttgggggattatatttgagtaatatgaagaccagattaaattcacccaaggcacattatccttattataaaatttgtgcagatgtttcatgaggagagctctgttttgaattctaagatcaatgactcccaagccccctttattctttggcttgcacaccttgccccaagctgccagagactttttggtggaattaaggtcattacccctccataagcaatgccttctggctctatcaatattctcaatgactgaaaatggcagagaaagcgaacacatgtaatacgttggtaaggaggagagtactgagttaaccaacgtcaatctatcaccataggagagaaaagaagaactgactgttaatcttctttcaattctatctgtcaatggggcaaaatcaatcacctttggtctagtggttcccagcggcagaccaagataagtgaaagggagagttccaatggcacaaccaaaagtggcagctagcaagtgagctttgtcatcctcaacatttaaaggaatcatacaggactttgaataatttactttcaaaccagaagatatggcaaatgagtttagcagagctttgagagcaaaaagctgaggggccgaagcttctaggaaaataagcgtatcatcggcatattgaataataggaaagttattatctcctgaaactggaattggcagagagagtatccccctgagatgagctttgttaattatggcttgtagtaaatcagcacccaacgcaaaaaggagaggagagagaggatctccctgccgaacacctcttttacacttaaaaaactttcctgggactccatttaagagcacttttgtagaagcagaagaaaagatgttactcatccaaacattccattcatccgggaagcccatagctaacatcacttgaaggatggcaccatgttcaattgtatcaaaggctttctcaaaatcaagttttaataaaacaatctctctttttgactgcttgcactgatgaatgtattcaaaggcccaagctatgcagtcttgaattgatttaccttttataaacccatattgattttgatgaaccaaacttggcatcaacgattgtaacctgtcagcaaaaaccttgcacaggattttaacagagaagttcatcaatgagattggtctataatcactgggggtttgaggacttggtttctttgggaccaaagtgatataggaaaaattgatagaagacaaatccaccgaatttccccaaaaatctgagcaaagcctatagaagtcctgagctatgattggccaacttgatttgtaaaaacacccattaaacccatcaggacctggggttttgtcaccaggcattttcctcaagacaccatcaatctctttggttagaattagtgcacacagagtagaaaggtcccccttatgttcaatcagctcattgagatcaaagaccatagaaggtttcatagaaactcccattctttccttaaaaacattctagaaaatatcagctttcccctcgtgatcaaaaatttggtttccatctgaatcttgaagacaagaaatagcatttcttctgaaactttctgttgccatagcatgaaaaaatttggtattttctcccccaagaagaaccagcttttgtttaaatctctgcctccaatattgttcctgccaattcagcaacctttgaacacgagccttaacaagcaatctgaatttcaattctgggacacatagcaacctcaattcctccaatttatcaagaaagagaatcactttattgcaactttcgatggttttcgacagcttggcaagggaggaactccaacattttaggaacagagccttttgaattttgcagctataagctttgcttgatcattgatattttcaatatctctccaagcattagccactagatgaaaaaacccttcttgatgaatccagtaattctcaaaccgaaagatgttggacttaggaatcgaggtggcaatctgtattttgattggagcatggtcagaagtatttctagccaacactagcgcctaggtgttgggaaataaactagtccaattcgcagaggtgaaaacccaatc

SEQ ID NO: 90939 - DNA, 1268 bp, Oryza sativa
cccctggtaattatgaaggttcggccgaataccacgcgccaaatgctcaggaataacttgaggcaccaccgaaccatccggttgcacatgatgaaccaagtgttccgggaccacctgatttgcagggtactgcacaggctgaccaccaggcattgcaaacctagccgacgcattcattggggcttgttgctgaatcggctgaacgacctgctgtctcaacggtgtctactgaattggctgtaaagccggttgccttggtggcgtctgctgaactggttgcacggcctgctgaattggggatgcttgttgaataggctacacaacctgttgcctggacggtttttgttgaatcggctgctgctgagccgaattaatagcattttgaggaggtagaaacatagatgcaacctggtcttgtgttaactgagtcacattcggtccaggatgctgtgattgctctcttaccaataattggggattgattaattgacctggagccgatgacggtgctgcaggtgctggagccgatgctggtaccgtcgattgagctggaggagttccccgggtaagtggatgaacatcggtaatcaaagtccgataatttggaaaagtacccccttgcaaatagactgggcctgcagcctgatgttcagctattgaaccatcggctaccgatttcatcatatttgacaaagtattagttaatactccagattgattgatcaaagcaatatacacagcatagtcgacccgatcttgaaagttattgaaaaaatcttggaatgcattgtcattctgattaagattccccccttgcaatccctgagtgccgtcaccttgaactccatgtactccatgagagtagtcaccctggctctcctgagtcgacccatctgtaacacttttgtcactcggctgggctgatccatctggaacttgtttcttttctccctctttagacgaaccgatcccaagatcctcaggaaccaccttcaccttgtacttctgaacaaatgtgtcgttgcgagtttgcatgaacgagcttaaaaattgatcccgtgcttgctgcatcattgcattgaagtctttcttctgttcgggagtgagcttctctggatcaatgggcacaacgtttccttcatggacgtcagtcaaaccgaacttctgagtcttttccttaactttacccgggctgcccgacgacggagacagtggtggtttctcagccatgaaggaggctgccttctgacttctaatcggtcccacca

SEQ ID NO: 90940 - DNA, 1429 bp, Oryza sativa
ttttgaataagacgagtggtcaaacgttgtaaacaaaaactcaaaatcctttatattatgggacggagggagtagtgggtcatatgtgtctactctgtggcaataaggaaaggaagtcccctgaaagaaaaaaggcatttgaatcagtttcacaacagtaggtaggcatttcaatcagtttcccaataacagtagttaaaccaaaatttacagaggaaccgtctccacaggttaagttcacacggcacttaccagccacctctcctagaaaaataatcacaatccagagacaccgcaagagctagtgcaacagccctttcaggtaaagtcaactggcgaacaacatgcagttcatcgatctgtgaccatcatttgtgacatggatctcgatcaggtaaatagcagttaagtaggcaagctgtgtgtggactgtgaagtactaaaatgagaacagcacttacatctgaagcgagaccaaatttacggtttagtcctgcatcaccaaatcgaattgcatactggccagcatctgtgaagagctgcagtgaaccaaagatacattcagtccttttttttttggaataatgatacattcagtccttaaaagctcagtcccattatttatgcaggctagaagtagcagtgcaacaaatgaaaaaaatgcactttgaaaagatgtggggtgtggcatctgccatcagctgcatcaaactgcacaaatatgtggagtcaccataaagcaaattcaaattactgcacaatgagtctgtcctgtataattgacgagttctgtaaaaaaacactttaagcaatgtaaaaaagcaacaccgtcatataaatttggaagggcagctcttactatcaatctgtaaataatgaatctatatgtatctagtttttcttgtcagataagcatggaatgcccaccgacataaaagaaaatgcatattatttgacaattctctactagaaaagacatttacctcaaaaccgattcccctccaattacgatcaatctgggctagtacattgtcatcctcatctgtgagagtaaaggtccagttccaaaatccaggattctcgaccacagcaaattgcctattcctaaagaacccaaaaggtggcagatcaagtgtcaggcagtaaagcaatactaaaaggtacacaaagaattgagtaatttgagtctagtcgaagagacaaggaaatgcagagatcagaagaccaaattaccctaagtacaggtcataaattctacgccagagatgccaacgtctgtggactacacctacctcctaaccaaattgaaaccgttaaacaatgtcagtacattcctgcacatttatctgggggcaaaattcccatctaaataaatttgcacaagcaagtaaagaagtttgcataccttggcattcacttctgcataaat

SEQ ID NO: 90941 - DNA, 1139 bp, Oryza sativa
cctgcagcccaccaccgttttcgccactcgccgccctctctccccgccggaatcgagctcgcgctgtcgctctctctctccgccgtcgccgccgagctccggtccgcagccgtcgtcaccccggaccacctcccacctcggcgccgcctccttcggcttcgccgcatcctcgccgacctcgtccacctctccgtttcggtcgccgaccaccggagcaccgtcgaccccgtccacccgagccgcgccgccgccttcctccgctccggtcgccatttccgtcgtcgccgtcgacccggggtgagccgtggaccgccgcttcgtttccctctttccctcccctctctcagccgccgctccgccgtgcctatggccgccgccggcgaccataggggcgcgggcgcaccgcctcccgccgctgcgctggcgtggcctccttcgggcgcaccgagcggctgccgcgtggggcccggccgtcatccgcccgctccctcgggtgcggctgacgtgtgggacccacggcgccggccggtgtgagcccgggtgcacccggtccaccgtggaccgtgaggctgccgcgtgggccccactcccgtggacccggtccgcgcgcccctcccctcggctgacgcaataaaccctttttaaattaaaatttaaatgaagaaattcgcaaatattcatttaaagagcatataaacttcaaatgaccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacggttgggaaagcgagcaaggcaagtcacatcatccttgaacatattgaatcccagtttataaaattatgttgatttaaattattgcattatcgctttatttaaattcccgcgttatcactgttttatctagccatgcctatttacctttgttatgaccttattattgttattgttattatttccttgttcaccctagaataaacaaaaccccaactagtgggcactctactcatgg

SEQ ID NO: 90942 - DNA, 5330 bp, Oryza sativa
aagatcctcctgcaggagcggagaacggaacatcgacaacttccgcgcccgagaaggatcctagtgcggccagctcttgtccttccgacgggagcacgagccgacaagaacaactcctgaggcgacgaggaccgggtcacaagacaaaagggcacgacctgcaaacttgcaaggtttttctcgacgtagaagctgaaatccgcgcctgcaaggagcgtggaattcaacatgcgcttccccaactcgtgatgtctattgccccattcacaaggctaagactcacgatctatcaagctgcaaggttcttctcagtgccatgaagacgtcgctccctaaggtcccgcagtcacgaatctcttttagggatgcagacaaggaacaaggtgcggcgactacctcagatcggttcgttggggtaatcgatatcgatccccacgagacatctgtcctacatctactcgaagattaggcctcatcatcgacgagtacgctacgtgacgtgtacgccatcgatgtaaccggcacctctagaggcggcaacacggaaacggaggaacaattggctacgccagcccaacacattagagccatcaatgcaataccgagggaaaccccttacgatcccgttctaaacgctgacctcgatcagtggacggaacgactacgggaatcggtggccaacatcagtaacgcgttcgaggaggccgctgccagagcaccctcgaaacaaccgctgacccgcggcgctgacgaagaactgcctgatcagcgggtgtcacctcatcaatctacccctccacctcgcggtgctagcgatctccgcgaccacctaaatatgcgccgagaagcgcgacacacgcaagacaacgaaaatcgttctcgacatcgcatctcttcgcaacatcacgagaacatagagcgacgtggacacccgagcggaaactgagaccatgatggtcgccacgaccgccgcgagcagcggctgccaggcgatgctagtcgaggtaaacgcaacaacgacgatagaggtcgacgccgggacaacgatgattggtgacgacgaggttcacgggaacccgggcgcaatccctgaaaccgtaccccggagccgagcgactcatcatcatcatcgtcatcggacagacatccacggcgagtgtatgatcgccgacaacccaccgcccctggcggcgggtgcgtggctttcactcgtactgtacgagatgtccggtggcctaagaagtttctaccgggagcaatagagaaatacgatggaagcaccgaccctgaagaatttcttcaggtctattccacaatactctatgctgccggagcagacaacaacgcattggcaaattacttgccagctgcgttgaaaggatctgcgcgttcatggctggttcacctcccgccctactcaatttcttcgtgggcagatctgtggcaacagtttgtcgcaaacttccaaggaacatataagcgccacacgatcgaggacgacctaaacgcgttgacgcagaattcgggtgaatcattgagggactatattcggcgctttaacgagtgcagaaatacgatccccgagatcactgatgcttctgtaatccgcgctttcaagtccggcgtccgagatcgctacacaacccaggaattggcgacaagacggatcacaactgctcgcaagctgttcgaaattgtgccaaggacacacctgagtcaagcaagaaaaagagtcgcaagaatgggaaacggaaagctcaagcggagatcctcgcagcaaagtacattgacccgcccaagcatccagacccacaaggcgacgatacgaggaaaacatggtgccctatacacaagtcggacaagcactctttagagacttgtctcgtcttcaaaaaggcactcgcaaggcaactagcgttggacaagtgcaagcgagtacgtgtagtcgagaaggccgccgaagcggctactcaggactcagatttagcataccctgactccgacctccatgtctcacacatcttcggaggttccacgctgtactcttctaaacgggaatacaagaaagtggagcgcgaagtttgttcgacatggcagggggctgcatccaagatgaagtggtctgaacagaagattgagttctctgaagcagaccaccccaagactgccattactccaggacgatatccgatcatggtcgagcccactattcggaatatcaaggtagcacgggttctcatcgacggtggcagctcaatcaacttactcttcgccagcacattggacgcgatggggattccacgaagcgagttgacgcccactgatcaacctttccacggaatcactcctgaatcgtcgtccaagctattgggcaagattatgctaccagtgaccttcggtcaggcaaacaacttccgaacagagcagatcacctttgatgagctgagttcgacgcaacgtataacgccatcatcgggaggactgcactcgcgaagttcatggccgaagggaacaatcactattcagggcaacgcgaagctagcagtacagtgcgacaagcgtgcctcgacatggtcgagcaaactcccaacccgcccgccacagctgagccgcccaagaaagtgagcaaaccaacaagacgccgaagccagacagcgcaattaagatcgttccgctcttcggggcatcactggacgacaaataggaactcacggtcatcaccttcctccgcgacaatgtagacgtgttcgctttgtagccgtccgacatgccgggggtccccatggaggtgatcgagcacaaacttatggtgcgacccgatgccaagccagtaaaacaaaaactgcggagatttacaccagatcggaaacaagccatatgagaagagctcgataaacttctcaaagccggcttcatccgggaagttctccatccagagtggctagccaatccagtcatggtgcacaaggccaatgggaagtggaggatgtgtgtcgatttcaccgatctcagcaaggcgtgccccaaggatcacttccctcttcctcgaatagaccagttggtggactcaacagccggttgtgagttgttaagtttccttgacgcttactctggctaccaccaaatcagcatggcgaaagaggacgaggagaagatagcattcatcatgccgtttggtgtattctgctacgtcatgatgccgtttgggctaataccgctggaaacactttccagcgcacggttcagggggcgctcaatgaccagcttggacacaatgtcaaggcctatgtcaacggcattgttgtcaagactaagaaaaacaactcattgatcgatgatctccgggaaacgtttgacaacctccaacgatatcgcctcatgctcaacccagagaagtgcacgttcagagtaccgtcaggcaagctccttggattccttgtctccggaagagggatcgaagcaaatccctagaagatcaaggcaatcgagaacatgaaatcgccgacaagactctaggaagtccagaagctaactggatgcatggcggcactgagcagattcgtcgctaggatgggagagcgaggacaacctttcttcgccgtgctgaagaaacaagacaaatttgtgtgcacacaggaagccgaagacgcgttcatcgcactcaagtgctacttgtcaaatccccctgtacttgttgctccccaacctaatgaagaattattcctctatatcgctgccacgccatattctgtgagtactgtcattgttgtcgagagagagaaggtgcaaagacaggtttattacgtcagcgaagctctacatgacacaaaggcacgacgccgcacgacagggacgctacgctacacaccgggggctttatccctcacccacctggcgtggctcgacttcgcccggggcacacttagctacttcgcctgcgatgccacaccgactcaccacgggcttcgcctccctcgtcgtccgggtgctctacaccgacttaccacggactcgggggcttcgcttcctcgttgtctgggcatttttcgccgacctcaccatggactcgggggcttcacctcccgcgtcgtccgggtgctctacaccgactcgccacggactcggaggcttcacctccctcgttgcctgggcattcttcgtcgacctcgccacggactcgggggcttcgcctcccgcgtcgtccgggtgctcttcaccgaccttgccacgggctcgggggcttgacacccctcgctgcctgggtactactcgccaccaccaagtgatccgctccccgcgcaggatggctacttcatcgccgaccgaacgcttgcaccgagccgaccgcatacaccgccgccgggtgatccgctccccgcgcaggatggctactgcgttgccgaccgaaggcttgcacctccgagccgaccgcatacgccaccaccgggtgatacgctccccgcgcaggacggctactgcgttgccgaccggagccttgcaccttcgtgccgaccgcatacgccgcctctgggtgatccgctccccgcgtaggatggctactgcgttgccgaccggaggtttgcaccttcgagccagccggctacgctgccgccgggtgatccgctccccgcgcaggacggctggacgtctgcatcgctgcctggtgacttcctccccgtgcatgacggctgcaacaatttccacctggcaatgttgagatgagtactcagccagtcttgtctccaccagatggcttcaccaacctctgagtcttcatcaagcaaagtactcggaggctactgtgggatacacggtacccgggtacccaaggagaggactttgggccatacggcataggttgggccaagagccctaagcccatacggcatacatgtaaataaagaaagagagattcccgggataagatataaatctcggggatcatgcatatctttataaatagaatagggacatccagttgcaatcaactagatactttccttgtaacccttccccctcatcctatataagagggggcaagggtcctgagaggagaggccggatcgtctccacgaggcttcttcctcttctttgatcattttgactagagacagagaaaaacacacactggacgtagggtattacctcatctcgagggcctgaaccaggataaacacctgtgtcaccatctctccttgatcttgcacacctcgtaaaatatattgccgatcatagaaatcgacacaaatgtcttcaaaagatttgagatgacaacaaaattgagttaattgtccataaatttacatatttcagtatagccaaagatccaa

SEQ ID NO: 90943 - DNA, 1026 bp, Oryza sativa
  unsure (1)..(1026): unsure at all n locations
aagttagaatcttttacaccattattgagattgaaggccgattagcaatttacttggggggcagaacaacagaaggcgttggataatattaaggaatatttgagttctcctccagttttgattcctccacagaaaggaataccttttcggttatatttatcggccggtgataagtcaatcggctcggtcttgatttaagagctcgagggaaaagagagggttctattctatttgagccgtcggctcttggatgcagagactagatattctcctgtggagaagttatgcttgtgtttgtatttttcatgtacgaggttaagacattatctactgtccaatgaatgtaccgttgtatgcaaggccgatgttgtcaagtatatgttatcggctcctattctgaaaaggaaggattggaaagtggatattttcattgactgagtttgatcttcggtgtgagtcaccgaaggcgatcaaaggacaagctgtagccgattttattgttgaccatcgtgatgattctattggctcggttgagattgtgccatggactttattcttcgatgggtcagtttgtacttatggttgtggtatcggcttggttataatctcccctcggggggcatgctttgagtttgcctatattattaaactttatgcaactaataatcaagtagagtatgaggcagttctcaaggggttgcagctacttcagaaagttgaagctgatactattgaaatcatgggggattctttgttggtgatcagtcaattggcaggagaatatgattgtaagaatgatatgttgctggtttataatgagaagtgccaagaactgatgaagaaatttcggctagtaactctgaagcatgtgtctcgagagcagaatattgaagctaatgatttagcccaaggggtgtcaggatataagccgctgatcaaagatgttcagattgaagttgctgccatactagccgatgattggagatatgatgtctatcggtatttacnnaggatccccatctctgt

SEQ ID NO: 90944 - DNA, 1587 bp, Oryza sativa
ttcctgcagctggaatagtaggagtagctggttgttcttcctcttcgacgttatgactgtctgccgccgaaggaataaggttgcctgattctagctacacaggaggtgaaggaggaggaggaggctgtaaaaaacacaaatgttagacataatcggccgagatcagttgatgagaggattgataatatcttatggtggagccggtttgagagttggtgcggccgatttcttcctcacggcagttttcttcttctgtgattatacatctgtgagtaatcagctgaaaggtgaagtaattacagaggaaatcaaagagagatgcttactctcgaaaaatgagctggggcagaaggagttggaggagtctgcttgggtgaagccgatggtgttctctctgtatcgctcacttcggctgcagcttgatcaacgtcctcttcaatctcttcctcgtctagcgcttgttcgatagatggatctagggcaggcagatcatcagttggcttggttttctttgacttggttttcttcttgagagccggacctgatgtgtccacagctgatgatctggttttccttttcttgcctgcatcggatggttccctgattaagccttagagaagagccgcaattttgggggcatcatagccgatgaatggaggagatggtccacctccatttggaattagtcctggggcatattcgatatctttgccactattgctctggtgtgggggggaagattctgttgtctataaaataggagattgattaatcaggtgatgaatcggctgataattgttcaaatacgattaataaaataaagacatatctgagggacaacatctggaaataggtctgtcatgtacattgaagccggttgatggaatagatgcagcttccattcaccccaccatctatcgaagtttctactcctgaatcttgccaactctatattttcaatactgcccaatgggggtccttgaagattaagcagccgattcatcattaaggtagatgagatttaccctcgcattggatcttatcggcaaagaataagccgattggaagttggcccattccaaactgcctagcagagctcattggatgataaaattcataggagacttggatgtttcttccttgatgaatgctgacagtaaggatacatgggctgattgcagttgagaagatttctctgggtttctaatatctgtcatggttgatatcttcgaatctaaagtccaaaggatgttctagaagtgttgaatcttcatagaggaaccagactcgagcttctttttggaatccttcatagaagctgcaaaaccaatctttgagcatttcggctgatagctttgctcctgcatcagttggtgtggatgcatattctccgaaggatgtgcatctccgatgagtgcgttcttctccgtcactgtcttcaattggctccagtcttgggaattcagcttgtgttacagatggccgattgacaaacttcatgactaccaaattcagccaggattgcagtagccaccatgttccaccagctccgactattgagccgacggctaacttagcccatgcgtt

SEQ ID NO: 90945 - DNA, 4560 bp, Oryza sativa
tctacatgcatgcaagatggcattcgtgaactgtcgtcctgttctctgcattgatgggacattcttgacaggaaagtatcggggccagatactaacagcaataggggtagatgggaacaatcaggtattgcccttggcatttgcttttgttagagtgagaataccgacagctagtactggttcctgaaattggttaaaacaaaagttgttggtatgaggccaaatgtgtgcctgatacatgataggcacgctggcattctgcgagcgatacaagagttgcagtttgggagtatggaacgaggataccccggtgtttgggaagatgtacagagtaggtggtgcatgcgtcatatgggagctaatttcttcaagcaattcaagaacaaggagctcatgaacatgttcaagaggctgtgcaatcagaaccaggagaaaaaattcaatgagctttggaagagattagatgagttgacagccaaatgcagtgatcagcgtgcagcggctccatcgaccgccgttgctgaccctcctcaagctcttggacctctcccaacggatagtccaacattggctagaagaactggattggagattcggaaattttctcagtggattctgcatgaaccaaaagagaaatgggccaaggcgtatgacacaggtggtgctagatatggaataatgacaacaaatttggcagaagtttacaactgggtgatgcgcggtgtccgtggactgccactagttggcatagtggagttcattttacatgggacatgcaggtattttagggatcggttccaggcagttcttccctctatgccgaacaacagcattttgtttggaactttcatgcagaacaagccagaggagttgcgtaaaaaggccatgaaacatcaagctttagtgcaaggtacccaacagcacaggtttgagatactatgtcaagataaggcaggcaagggtatctaccgcaagagagtgaagcaggagtgtgttatcaaagtcgactggcacatgtcattgctcttgttcaaagccgaagctgctccacaggccatgcacccatgtcattgctgccgcagcagagtgtggcataccagatgcagtatatgtgtcacagtacttcagtaagcaagcaatatatcatacatggagcggcgagatttatgggttcggcatagctggggagttcacagagactaacgatgaagtactcaatattcctgacccatcgaagctccgaggcaaggctggaaggaggaggactcgtcgcatccgcaacgatatggacgagtcggaggctggcagggtgaagcgttgcagcaaatgcgatgaacatgggcacacctacaagcattgtcctaaagacaaggagaaatcaagtgcggcgatgaacatgggttagtagtcagctggcgacttttgttgaggactggttgctcgcaaccgaggaggtcgtggaccacgagggagaaccacacactgaggaggcgtaccaggcctacctatgctggtaccagccacgcacctgtactagggtcaccttcgctcccttggagcagcagccccacgttgcgagcactagagacctctacgccaggcaccgcgaccaggacttcgctcgtgctgtgagtaccctgcatcgcaccattcctttatgttttcatgtctttctcttcgtcaaattttacgaatatttacgaacaaattaaccatgcaggtcgacgacatcaaccgggtcgtcgttgacggttcaacgacgatccaatgtttaggcgtggggattccggtacccgtagaggagcacctgacgacgtacacgcggatggtggagtcgatgcgctcgattctccgagtgctcacctgtcgtgcagacgacgttgctcgggcagacgcagctgtacagcggccacccgtaccgactggtccctgtccagctgcgcacgttcctaggccgactccccctctgcacggaggtaagtatttttattactatttctgtacatgcctcgcacatataagtgagccgtttcacttgccgattgcttcagggtttcgtgcaccgttcagtaccccgccttcctcggctaggccttctgttgtgccccccacaggtacttaaaaaaacaacattacttcgacaatcaatttacatgcattttatgtcttagcttataagggtcccgttgtcgatgtgtaggtttcgcccagttcgctatgacgcaggccgcccacttctcgcaggctgcagggtcagcgtctcaggcagctgcgtcgacctcgcactcagcgcagttctggcagtacaccgggacttcgtcacaggcagccggcacgtcgaatcagggtccaccactggaccatgctaggacctcgttggaccgcttgctgccttccaccttgctcttcgacatcactgactttgacttcgcttcaggctcgacagaggacgtcatcagcccctcacagctgggaggcgcaccgccggtgcagacgcaggaccaggcgcaggccactcctccgcgggacactcgtgctactcgtgctgtgccaccggatcgtttcacctactcctaggaccacgtgcgagcacaggcccggaggaccaagcgtggtcgcggcgcggggcagggccagtagagcagtcttctctttgtttatttgcttcactttccagtactgtatgcttgtgtaatgactacgttgttgttatatgtgcacaatacctttcggcgcatgcacgatacctttcggcgcatgcacgactactttctgccgcaccgatgcagccttctttattcgcgtgcgatacgagtatttgcccgccatttggcgcatacgaccaatgtaacttttggcgccgatcaggcatgtaactttcggcgccaatcaagcgtacccaccataccccaccacgttcacatgtcaggggtatcactcgattttttgcgcctatataagtcgccttaacgagtgaggcctcacaatctttcagaactcagtcacattcagtactctcttccccacttgcttcattacaaatccgactggctttcgtcaatggctagacgtcggggtgttgaggatccgaactggcgtagcaatccttgtgtatacctactaccaccttggtgctagcgtcctctctgcctatgcggtgatcgatgccaactaatggcttcgaggaatcctgatattcgaggaaggcgcttttttaggtgccctaactattttattatctgcatatgcttattcattccgtatgggcaatcgctttattcttcgtaacactactctattcggctctattcggcagacccgcactacggcttgcgcatacatcgagtgggtcaatacagaaaatctcgttctcgacctaaccacttgtttacaagaaggtcgctggtatttcgcatccgaaagtactgagcaatacttacagagaaaagcggcaaaaagcggcttatgaacgacaatgtcgtgaacaacagagcgactggcgggtgctaactacggcactccctccatgggaagcccatccaagatgcaggtgtggtgatcgttgtcaggttcttcgttccataaatcctacaacattgggtcgaaggttctttgtttgtccaaatattcttgacgacgatttcataataagaatattttgattacatgaatccttattttctcacaatatttactaactttgcttgctttacatctattttttcctcccaggaaccactaaggagatgtcaatacagagaatggatagacaccagaagggttctaactccacctagccgtgttgtgcagcttgaactaccagagcaatacagggttactaaagcgcggtttgagagaggagagggatcctcacgtaggggttagctattatcggacaactaggcatattgaaatttctactgtcatgcttccttgtcccattactacatcgtcgctgtgttcaactattgcactacctccctcatagttcgaatctaatatcatctatgtaaccgcaatgcaaatagttatatcatgttcaaattgtactactatttcttcatgttacataattctccttgtttaagtcaatataatgtttctacgacccagtctgcgataggcctatataaattatccgagtactaatacgtcgaataaggtacaaaataatacctcacttaacatatgaaattgcgcaacaaccaacttcaatacatttttataacaatattaacaagttttaccaataaatacttttttatttattattaacataacatagaaaaatcttttggccgtacttttttcatctgggtcccttgccgccctagcagtaagggacccagatgtaaaaagtacggccgcaagctctttatgggcggccaaaattgcaattagccccttgctgccctctgtatgggcggcaagggcctaatcgcaatttttgccgacggcggcagatggcgcggtcgacccaccgtctgccacgtcagcttgccacccaccattagggcggcaggggctatttctgcaatttttgctatatagattatgggg

SEQ ID NO: 90946 - DNA, 4148 bp, Oryza sativa
ttcctgcaccccatatttacaaatgagtgcagtaatcgctttattataaaatagtaccgtaaagatctcattgcccatagcatcagtaatttctgcaacaaatggccttcttgagcaaatagctgaaacattagcaaaatgtttcttgtacatcaaagatatggaatgggtaaataaacacaagacctttttgcacgacagttatacaaacttgatacatatttactccctccgtcccataaaaaaccaacatagtactggatgtgacacatcctagtactatgaatctggacgtacctctgtccagattcgttgtactagagtcacatccagtcctagattcatttttttcgggacagagggagtactttttatcatcacaatgaaaagttatacaacaacaaggccagatcaaataaacaagacgaacatgtacaatagagaacacttccttttaaactactgctatcaacagctagctcaggttctctaatgatctaacctttatgctatacctcaaatctaccagatcgataaacaaattatacataaagcattctacataaaacaaattatacataaagtagttgatatttctctgaaagaagatgtaaagtatgtttccattaagttgaaacagaacaaaagcacagatataacccatccctcagtatcccagtaaccacttaacatggtaacatattgatatgttagatgattaaaaatgggagggaaaatattttttgacaaaaattcaaacacccacaagttacagccttgcataacctgcattcccttccatatctctagtttctgagtctctacagctagatactacaactccattgtgaaattttatataacactacattctacacatcgaaattctacataacattgcatgagtcccaccacattctacacataatgaaattttacataccacatcacagccaccctaattgaaagtttgtagcatcgatcattacaagaaaaaggtggcaagagactccttgcccagcaaagagagcaaccaaaaaatcattcaacacaaaagaaaaggagtcgttaccggtgctatagctaaaagaagggttatctgtctaacccactaaaaaccaacagctgttctttaacactaggaagagaaatgcataactcgataggacatgatgcatgatatatgagaccatgataatgttttatacagaaataaaataaagtcgatgctgactaagcacactagtacaaatatcacatagcataatagttaatttgagaagttcaacatattatgaatttatgacactggtttaatatttagaacacgaaatcatatatgttcgaacttaagtactgctacgcagagaatttaaagaatcaaaatcctgtctctattccactaagttactttgaagtcaaaaaacaacaccatgaaacatggactactacagtattaacttttttttttcgccaggaagtattaacttatttaggataaattaatcacaagccatacctgcctaaatatgacattgcttttctctcgaatgaaaccaacaggctggaaatttgacgaaaaatacaagtcaataatgaagccaagacaataaaataatacaacaatagagtaatacagcaatggaaccaatgacaatctgagtacacatactgattgaggaaagagcggatccattatgatatatctactctcctgcagtatgagtaataacagtaagtgataacaggttgaaagtctgaaacaatcaaaggacataattcaataactgggagaaaatatcaatgtcccaaataaatgtgcatatattcaggaagcacagaatgaattgtgtaactttgttgctggtaaaatgaattatgtcacttttttcagttttttagccgagaaacgaagcacttattcaagtatgtgctatcctccttgaatcacatgaaaattgcctgttgttttatacagtaacaaaaacaaaatagcaaggacaattgaacacagttactatttcatttccaaacacagcaagagaagcatcctagagtcgcaacttcagtacacgtaaatgagtaaatgactcacagatacattacctgctcaaaagccaacatgatatttgcccattctatgtccctagcgatcaggaggttggcccttgagaggagaggcttcagtttggcctgcgaacccacaggaaagtactctcagttaatcaagtaactctagataatgattacacataatttcaacatgacgaaacagctcatgtaggataaacattgaccattaaatctaactgtaaagaggtaaataaataaatatagacaattaactgattggttaatatccttccatcccacctgcccacaaaagtgtccatcttgttcattcaaaaaattggtttccatcttcatcctatatcctatacccttcaaacctatccagctattctgcaatacaaatttaccagcaattccaaaattggggtatagtaattcatcattcactctttcaatctgacatgtcatagttgcaaaacgtatatggattcaacgatagcatcaacaatcagactatgttgaatgacagtgcaaaataacagtggaacagactataaacagaaataaatcccgcttgcctctattggcgtgaggtcccgatcgtcgtgttggaagctcctcgacggcgccatggcgaaatcgccgaacgaatccgcaccgccgccgtcgctggtcgcgaccgcgcgccgcccccaccgcctcgcaacatccctttgcttcctcaactcctcggttcacagcttctgtagccactcccgaggcaccaccgtaccatcgccgcccccgcagccgctcgcgaacccattggatcccccgacatggctgccagtggtcctcgctgtggccctcccagccgccgcggcgtgggagagcagccggagcagccacctcatcggagcgaactgcagaggcgggggaggttaagaggtgttaggattctataagagaaggtttcatcgccgcccccgcggccgctcgcgaacccattggatcccccgacatggctgccggtggtcctcgctgtggccctcccacccgccgcggcgtgggagagcagccggagcagccacctcatcggagcgaactgcagaggcgggggaggttaagaggtgttaggattctataagagaaggtttcggtgtggtcgcggaaatggggtttccacgctccacgacgttaacgatggaggttaagaggtgttaggattctataagagaaggtttcggtgtggtcgcggaaatggggtttccacgctccatgacgttaaggatgggcttttgccgcaggtacggcttccggaggattaaagtgggctcatttccgactaggctatgttgggccaactgggccgtgggccaactaccgtcttaatgttttttttccatttttcaaaatgggcctttacgaaatgtgtcatacacgtccaaagaaaatagagaattgcacctatacatatcattggagcataacaaaagtagagtcttttcatacactagcgaaatgcccgtgcattgcaacggatgaaaacaattttaataattaatctatcatacggtaaatcatccgttttactcattgatatttaataaaaataacgtgaaaatatttagaaatacatcaatatcattgtttattaataatattttttcctttaataattttaacttgcattttattatgttatcacttaaatataaatttatatttttctttaattttatatatgaatcgtacttaaactttataaaaatattatattcacattgtttctaacattctattgttattagattgtacttggcatatatcattttgttttttttattctaaactatagttaatttgaatttattaattacctaatttaaatatctatattattagtctaaattatttttaatattaaaaattataaaatattatagatatatcacaatgttttagagacgggaagacaaagtaaattcgatggtttcaatttataacttgataaagaaagaatgctaaattagattcatgccaagtggcacaatatgtcttataaaatttataacctaataaagaaaaaaaatgtt

SEQ ID NO: 90947 - DNA, 1084 bp, Oryza sativa
agccccatgttcgtaggtatgagagatttaatttcttcctttcccattcctcgaatggtgttacttccttatgcttcattggaattttattcaggacatgacacgcagtcaaaactgcctcaccccaccattccatggaaagccccatagtgtctaacatggcattcaccatctcagttagagtacggttctttctttcggccaccccatttgattggggtgaatacggaggcgtcctctcatgaataattccaaactcttcgcaaaaggatgcaaactcattcgaaaaatactccccacctctatcagacctcaaccgtttgattttcctttcaagttggttttctacctcagctttataggtcttaaagaaatgcaatgcttcatcctttgttttcaatagatacacataacaaaatctagtgcaattatctatcagtgtcatgaaatatttctttccccctttagtcaacaccgttcatttcgcaaaaatcggaatgaacaagttctagaggtgccaaattcctcgcctcagatgccttgtgaggcttgcgaggttgtttcgattgaacacaagtatgacacttagaacctttgaccaaagtgaattttggaattaaactcatgttagctaagcgcgtcgtacaaccgaaattcacatgacagagtcgcgaatgccacacattagactcatcattctcgctaatatggttcacaacattatgattattacacatgtcattcagagaaaagcggaacaagcctccgctgtcataaccttttccaacaaaagttccatatttagatacgacacatttattggattcaaacacaagtctaaaaccttctctacacaatagagagccgctaacaagattcttctttattgaagggacatgctgcacgttcttcagctgaacggtctttcccgaagtaaacttcagatcgaccgtaccaacaccatgaacagctgcaagcgacccgtttcccatcaacaaggaggaacctctcccgacctgataagaagaaaacagagaaatgtcagcacatacatgaatattagcaccagtatccacccaccaat

SEQ ID NO: 90948 - DNA, 4949 bp, Oryza sativa
taatttgctttcgtactatgttcctgaaacagtgtctgtcctgcgacccttgttcggaaaaccggatcttgccgtaccaaaatcagaaatcttaggattcatttcagaatccaatagaatattgctgagcttaaggtccctgtggataatctttagccccgagtgcaagtgaaggtacacaatcccttgagctataccttcaattatcgcaaacaacctatcccagtagagagaccaatcggttcttgggcctgataaatgtgtttaacagaatggtgattatgagatcagggtacaaattaaatcatttatagacttagttatttaagaacataatcctctggggacttgtcaaaacataccaaatatgaatttatcgaggcttttgttttgcatatactcgtaaaccaagatcctttcttttccttcgatgcagtatcccttgagcgtcacgatgtttctatgttggagcctaggaatgaatttaatctcgttttcaaagtcagacagacgctctgggctcgattccacgaagcatctcttgacagcaactggaagtccattcagttgtccctgataagtgatcaaatagaggaaagtaaaccatatgaaatatagaaggcatgctccaagtggtcttagagcaaacttatagtcttgatgtagtaattgtcaaaaatcaataaagccttctttattaaaaaaggaatacggaaggctatgcattggggaaggcatgcagcatgctaccaatctggattaagattaattgtggtgattgcatatatattataagcgagtacatagctaggctccgatcctacagttacgctaaactctgtgaattgggtagatgatcgtttatggatgtgctcgtctgctcgcatccgctcagacttcagagcaagcctgttctataaatcccacagacgacctactaaaaaaaatatagaggcaatcgctcattcaaccctattctaaagcttaactaacaattttatcctaccttctcaagttggcttatttgatcctttttcaaaattgaatgagataacagtgaagacaagataacagtgttaagtaattaagggcagtggagtgtaggcattggtgtcaactaacaccaattacttcttgctaatctctttgctaatacactttggaaacaagaattactctcttatatatgcattggcaccaccatatttgagtaatgaccccaatgactatatttcctgtacccgcccctgactaaggggcaaattatcttttttgcacttactcatttcatcgtgcttcttttttttatccaaacttttgacatatttgtaaccaatttagcatagttttaatagattcgagacaaatttaatagttttggcttgaaattgacaaatttgataaaatcaaattaacaaaatttgacatatttatggctgaacatttaaaatattttaacagcatattggtcttttttttcaatcccaaattgcatccaataaaaaaatacacagaaaaagtagaacacaagatagccatgcgccgtcgtcgcccctgctgcccaccgtcgccaccactgccactgttcccaccgcgcgccaccttggtcgcccctgctccaacggctcgccgacaccgtcgccgctcccaccgctggccgacgcctccgtcactcccgccggcacccctactcttcaccgtcacagctgccactcccaccgtgcatcgccgcggctgcccttgctcctactgctgccgccactcttaccgcaggctgatgccttcgctgctgccaccatcacccctgctccccgttgtcgccatcgccgctgccaccgttccccgcctcggtaatatccgccacacgagtatccagacatgaatggaggagaaggaattcggggatatagtattgttgtgttcttatgtgtatttttgttagtttggcatataaatacatttctttcaatcttttataaattgaaccctaacggtgttatggaaacagggtcaaatgacaactccgattttgaaagacggggtcaaatgagcaattgtcccaaaaaatatatgttgtttagttaaacccacaagaacattggcatatttctatgggtttctcttgaacaaaatgaaattttgctactttcgtggtggtcaaactcacgaaaaataaagtagctggtgtaccgtataaaaaagtcgagcaaccaacccccaaaacctagtttgtcatcccccgttcccagtctatcaagcaccacctccgccactcgattcacccagatccccatcgaaccagtaggcgagtgggcacaaagaatagggaggcaaaatagacttattatatggcacggctcaaagagtaggaacataatagacttattttagctatatatatatatatatatatatatatatatgtgtgtgtgtgtgtgtgtgtgtgtgtgtgttacagcctaaagaggagggaggataaatagacttattttaaagaaggcacgataggccacccgtgccttcgggctgacacggtgggttgtgcctgggcctgaggtgcggcacgtgggccggcatggcacggtccgaagtgccgaccgtgccgtgccagcccgatggccatgggccgtgcctagcccgtgtctaggtcgggctgtgccgagcgggtcttatagtcatctataccatgcatgcacgctggtccgatcgacctgcctgcgataccagctgccacgagctcacgggctccagatcaggacagcccaagccccaagctcagggactgtgtgaatcaagtcgtcctgagtttgggtgctccagattaggaggcccccaccatcctgctgctaccgcctagtcatccactagttgattctgaaatgtgtgtgattctccttttttatgacacaagtatgcatagatatagttaccttgtaaacacgaccaaacccaccctcgccgatcttgttttccagcgagaagttatctgtagcatccactatccgaaataagtcgaacaatgaaaaccctgcggctgtaagaaaataaattactcatgaattaagtgaggttagagaagggttttcaccctagccatcagcaaaccagaaactaatgttgcttcaaaactacttaatatttttttcttaattcattatttacatctatttcttaaatatgtagaagtttaagaattaaattaaccttggtgggctggtgtcaataggtgtccaatatcatcattgcttgaagatgccttatcgactccatctttgttcaagttatgatgacctgcatgcaagggtaatcttatatttgtatgtaattatatgtatctgtaccatgcatggtcgcgataaaatagaagaaaatttctcaaacggataatatagggacagaattattagagaagtcaactctaatcgtcctttcatatcaatttatctagatccgactttctcggaggagatttgctctggttcaataaaaagtatctcgagagactggtaccttacagtaccaaatcgttttttattgttggatttaaacaatgcttacgctgcccaactagatccaatgatcgaaaacgattcagtaccctaaggtaccagtacctcgtggtactttttgttggaccgaagaaaatctctccccgggtcttcttccgcttcggcaagtcttcgggcatcgccggcggtggagtacggcggctaaaaacaaagggccaaaccggtgttgtggtggattgttgtgtaatctggcatcaaagggccaaaccgacttaaaaatatgcacatgaacaaaacccctccagctaaggctttgttccaaaacacactctcagcctcatcgtttggccgatacgaggaaatactaaaacggtatatttgcaaatgaaaaacaatttatgaataaaacttttatatacgtgtttttaatgatctaaaaacaaaggttgaaacatagactatgaagaaaaaaatcccaattacctccaaatttaagtttgaaaattgaaattttggctaataagtataagtataagaaaaaaatgagggcgtttggaatgaccttctaagccccacgagctagctcatgagctttcttacgataaatgagagtagcctaaacctaaaccatattgtgctgtttggtctggtttaaccgttgaagcatttttctttttggaaatggtgtttatgtatattgggtgttataggagccaatttggagttgaggggttatttagacccttgggatgctttgagggtgtaatatcgactaactccttgtgagaattactttctttctcgagggttcttacatgtaaattgatggattaaaaacaaatagaggacaaatgtagacatgatttattaacttgaagccacttgccaacttgggagaacaaaattttacacaaaactacaggtattttgcataatttatcacaaaactacatatctaagagtttgtttcacaaatctacatattttgtgtctctgtttatcacaaaactacatgtactttgtacagtctattataaaactatagatttaaaaacttgtttcataaaaattatacatttagtgtattcattcatcataaaactacacaattagtatctttaatatttattaattacaaaactacatatttagtttctccattatcataaaactgcaggttttaacaatgctaaaacctgcagttttgtgataatgaagtcactaaacctatagttttgtgataaatgaagatattaaatctgtagtgttgtgaaacaagttctcaaatctgtagttttatgatatattgtgcaaagtacctgtagttttgtgataagcgaatgcactgaatctttagttttgtaaaacaagttcttaaatctatagttttgtgatacatcgtgcaaagtatttgtagttctaggagtgcgacatggctgt

SEQ ID NO: 90949 - DNA, 2683 bp, Oryza sativa
aaaaggggaggggaggagcgcgcctggaggaggggagggagcgaaaaaaaaaaagaaaaagggagaggaggggcgcgccaggagggagaggggaggatggcgcacgtaggtggtgcgggaccgggggagggagggagggaggggtacagaatagttattctatagggggtgtagaatagtcttaccctatatatatatatatatatatatatatatatatatatatatatatatatatatatatatatatatatatatatataggcaatgtatcctatgcacatacctatcttggtgcactcatgcactcggccactgtcggccctttgattctaatccaaaggctaaaaacgtaggtacggcatttttacagaaagccgcctgcaacacctgtgtatgtttgcagaaaacccctcagttcccttcatcttctctcgtccaaacctcctcgatccaagtcgatccccaaatctgctctatcaccttcggtcggggccggcaggactcgtcgtcggcgcctgcagcatggctgttggtgattttgtgtccatctacgcgcagctgaacatcgagctggccgagcaagcagcacagtggcccgtttggccgtcaagcagcgacatgactggggagcatcgtggtgttcaatcgagtaaaaatggcagcgaggctgccatatcaataattaaaataggccatgtccaaccaggagaaaaacaagaagagaaatcaacaaataaacatggacattatagctgaagaatcgagagaaaaaacacgaagagactcgccggaacgacggcctccatggctccatgcggacactatagatggagacgaaccattcagcgagcagctggacagccacgccggctgtgaaggacagcgccgaggcagccgcagcctggcgtgtcggccgatgctagccctagcagcaggattcaatgaaaatcgagatgaatcgtcgttctgttcagccccatcgcacggagatgagatctggatcgaggaggtttggacgagagaagacgaaggaagtgaggggttttctgcaaacatacacaggtgttgcgggcggctttctgcaaaaatgccgcacctgcgtttttagcctttggattagaattgaagggccgacagtggccgagtgcatgagtgcaccaagataggtgtgtgcataggatacgctgccccacatatatatatatatatatatatatatatatatatatatatatgacactcatatggggcaccatggtgcccgggcaacatggtatgaaatacacaaattcatccaaatttttcaaaattttcaaattgtgagtatatacctagttataagtattcaattcatacctatacctagcaacaaaacaactcaaatttaactttatttcacaatcgaatgttgcataactaactaattatatgtttggatgcaatatacctataatcaaaatataacaaaaacaagttcaaattcagttcaaacttgctttgaactagttagtaaagtagttaatgttaatacctaaatattttaaaaaatttcatactcttttgaattgggtatatactcaatttcaacaatggtgcccgggcaccatggagcaccaaacaaatttacataggaatatatatatatatatatatatatatatatatatatatatatatatatatactattctatacccgcctccctcccatgggctaaactcacctctcctcccttccaagaggcaaaaacccacctcccacctcagtcaaaggtcagtcaaaacgcccccacatcggtcaaacccgtgggacttcctccacaacccacctcttctcagcactcgtcatgcaggaattatgcagtaacgtgacagtcattgtgcagtaacaccatgtattacttgcagtaacgacgttaaaatatagttcaaatatagtcatgatggatctagttttgataagcacttttttttacaacattatggtgaaaacggtttttaaaaataatgcatatcttgtgagatattactcttcaaaaattgacattttaaagtttatcctccacatgcagtaacactatagcattactgttactaccgcatcttccgtgttactgcaagagtacagtaacgactgcatgttttacagtaacatagtgtgttactataattgcttaataaagttactgcatgaacatagtaacaaccaataagttatcgatgtttttttcaaggagaaaaagacattgcatgagaggttgtttaagccctattacatacatattttcttacttggagccttcgagagataatggtgattgttttggagtgctttgtgaagaattgggggagcaacgattcgggagaagagggatgattagtcagtctacaacttattgactcttaatagcaaatctacaacccgtctgctgactccccccaccacccaccttttcttagctctcgtctcacaagagtgcagtaacaagacgtccattatatagtaatatcatgtcttacgtgtagtaacaacgatcaaatatagtcatgatggatctacttttgatatgcactttttttaatatcatgctgcaaacggttttaaaaatagtacatcacattagagatattgctcttcaaagattagtcttttgaaatttaactcttcacaagtagtaata

SEQ ID NO: 90950 - DNA, 1664 bp, Oryza sativa
accccccctcgggggaaatcaggaggagggcggacacctcaccctcgggcccgacgtccccgaaggtgccaggccacgtgggcgattgtgtctgcctcaagcctctagtcatgatactcccggtcccatatcaccgacaggggcagagcaacagaaggctttggatattattaaggaatatcttagctctcctccagttttgatttctccacaaaaggggatacatttagattatatctatcggccggtgagaagtcaatcggttcagtcttgattcaggagcttgacgggaaagaaaaagttgtattttacctaagtcgtcggctcttggatgcagaaacaagatattctcctgtggaaaagttgtgcttgtacttatatttttttgtacaaggttaaggcattacctattgcccaatgaatgcactgtgatatgcaaggccgatgtggtcaagtacatgttatcggctccgattttgaaaggaaggattggaaagtggatattttccttaacggaatttgatcttcggtatgaatcaccgaaggcggtcaaagggcaagctatagccgattttattgttgatcatcgtgatgattcaatcggctcggttgagattgtgccatggactttgttctttgatggatcagtatgcactcatggttgtggtatcggcttagttattatttctcctcggggggcatgttttgtgtttgcctatactattaaaccttatgcaactaacaatcaagctgagtatgaggcagttttcaaagggttgcaattacttaaggaagttgaagccgatgctattgagattatgggggattctttgctagtgatcagtcagttggcatgggagtatgagtgcaaaaataatacattgatagtttacaatgagaagtgccaagagttgatgaaggaatttcggctggtgactttgaagcatgtatctcgagaacagaatattgaagctaatgatttggcccaaggggcgtcgggatataagccgatgatcaaagatgtcaaggtagaggttgccacattaacagctgatgattggagatatgatgtacatcattatttacagaatccatctcaatcggcttctcggaaattgcgctataaagctttgaagtataccttgttggatgatgagctgtattatcagacgattgatggggtgttgcttaagtgcttgagtaccgatcaggctaaggttgcaatcggtgaggtaaatgaaggaatttgtggcactcatcaatctgctcataagatgaagtggttgcttcgacgtgcaggatatttttggccgacaatgctggaggattgtttctgtcacgaccggaaataacccaacgggcgttccttacgtgcgtgcattaatccttgtcccaggaggcaaggtacaccaaaagttgatacaattcagagtttaacaagcggaagcgtaaataattaatttattacacgggcagcgaaggcccagcacacacaaagacaaacgagaaacagcggaagactagggcgacgaccacaggcacttgacggcaggcacgagctagacaccgaagccttcatcctccaggaactcctcttctgagtttgggaaaaattgagcaagactgagtacaaccaccgtactcaacaagacacacccacaagt

SEQ ID NO: 90951 - DNA, 1677 bp, Oryza sativa
acattcaatcattgtttggagaatttagataaggtcttacaaagatgtcaagaaaaggacttggtacttaattgggaaaagtaccacttcatggttcgtgaaggaatagtcctgggacatcaaatctccgaaaggggagttgaggtggacagagcaaaaattgaagtaattcgacaacttccacctcctgtcaatgacatgggtgtccgtagcttcttgggtcatgcggggttctacaggcgcttcataaaggatttctccaaaatcgctagacccctaactgccttgctagctaatgatgttccggttgactttgatgatgagtgtatgaaatcctttaaaatccttaaggaatcactcatctcagcaccaatcatccaaccctctgattggtcgctgctgtttgaaatcatgtgtgatgctagtgattttgctgtgggagctgttcttgggcaaactaaggatagaaaacaccatgctatcacatatgctagtaaaacgttgacgggagctcagcttaattatgccacaactgagaaagagctcctagccgtagtgtttgccattgagaaatttaggtcttatttagtgggggctaaggtagttgtttacactgatcatgctgcactaaaatacctgcttactaaaaaagatgcaaaacctcgggtaattaggtggattcttctactccaagaatttgacattgaaattatggataaaaagggagtagagaattatgttgcagatcatttgtcgcgtatgcaaatcactaacatgcagaagctactgataaatgactatctacgggacgacatgcggttgaaagtcatagactctgacccgtggtatgcaaccatcgtcaacttcatggccacgggtcatgtaccaccggtagaaaataagaagaggttgatctacgagagccgcaggcacttgtgggatgcaccttaccttttcagagtctgctcagatggtctactgcgaatatgcgtttcgacagacgaaggcatcatgatcattgagaagtgtcatgctgccccatatggaggtcactatggagcattcaggacacatgcaaagatctggcagagtggattcttttggccatcaatgtatgatgacacaaagtaattcgttcgaagatgcactagatgccagaagcatggagggatcactgctcgagatgcgatgccactgacacacaaccttcaagtcaagctatttgatgtatggggcatcgacttcatgggaactttcccaaagtcctatgactgcgtgtacatcctggtggccgttgactaggtgtcgaagtgggtagaggcagggccgcagacgccaagcacgcccgccggatgtttcatgagattatcttccatcgttttggaactccgcggatggtgataagtgacggagggtctcattttatcgataagaccttccaaaactgtttgcaagaacttggggctcagcaaaaaattgccactccgtatcatccccaaacaagtggacaagcagaaatgagcaacaaacaaatcaagaatattctgcaaaagactgtaaatgagatggggtaggcatggaagaacaagctacctgatgcacttttggcatataggactgcttataagatgcccatcggcatgtcaccatactaacttgtctatgggacgacttgtc

SEQ ID NO: 90952 - DNA, 1917 bp, Oryza sativa
attcctgcagccccagaattatgtggtgcaatgtcttgtcagttttgagttgatatttccaccgtcatttttcaatataatgacgcatctgctttgtcaccttgtcaaagagatcggtattctcgggcctgcgtacctacacaacatgtttcctttcgagaggtacatgggcgttctgaagaagcatgttcgtaaccgtgctcatctagaggcaagcatcgccaaggggtatggaacagaggaggtcatcgaattttgcgtagaatttattgaagaccttcgcccaatcggggtacctgaatcacgccatgaagggagactacagggaaagggaactctcggaaggaaagcaataatgacggtagacaacaatttattccgtaaagcccatttcacggttctgcaacaatcttcattggtagctccttacgtcgaggagcacttggctctagttcgcgccagaaacatcagtaagtccgatgcatggattacacggcatcacattgatactttccctgcttggctacaacaacatctgatgggtaacgagacgatcaaccaacagctaaccttcctggcgaggggtccatctggctcgttcgcgacattccagggatatgagatcaatgggcacacattctacacgagagcccaagacatgaagagcacgaaccaaaacagcgctgttcgtatcgatgccatgggacacgatggaacaactggcacgtattacggtgccatcgaggacatatgggaacttgactatggtcctctcaaggtccctctgttccggtgccaatgggttacggtaccagtacttgaacgaggaagggaacgtggagagggatgcggaggggaaccaggagaggaacgtggagagggatgcggaggggaatgaggaggaggaggctagtggaagtcaaccctccgctggacagaagagggcacgcgggcaacgaggtgccgcgaagaagctagagggtcggcacatcataacggaagtagacgaagacggccgacctagtgccccggcagaagcagccaagaactacgtacgacacagtggttgggttgtgcgggataacgtgcctgttagtgcggtgtactggcgcagaacaagggcacacggagatcatgagagctttgtcccagattcggagaaagagatgctgtggaccacaatgctcgagacattcacccttcccgcgggtacagaggacaaagtgaaaaggtggactctaaagaaaatggcagaatagtttcagagcttcaagggagatctgtaccagaaatacatcctgaaggggcagacaccgtacttcgacacattcccgaagctaagggatcactgggacaagttcgttgcatataagacaggtcaacaagggcaggcgatgacggaaagaaacaaagaaaatgccgccaagaagaagtaccatcaccacttggggtcaggcggctatagcgtcgcgatgccgaagggggaggagatggaggcaagcttgtttgagaggggtatcgaaccggccaccgctaaatggtcggatcgatcgaagttctggtactatgctcacggtggaacgctcaacccagttgatggctccctggtcttcagcgatcagatacgcgaggctgcgcgtcgactaacagacgcagtggaagcctcttctcatggcacattccgacccgacagagagatggacaagctgtcactcgtcctgcagaatcccgagcatccaggacgaacacgagggaaaggggtgattccttggaagattggattcaaggaggacatccacacgtacaggagtcggataaggagcaagagagataccgaggcgaagattgcagatcttgagtacagggtatcgagctacgagctcaacatgcaaggggaggtggcaaggaaggttgatg

SEQ ID NO: 90953 - DNA, 662 bp, Oryza sativa
tctggatcttctccaggggagaccacgacgcgtgcggattcggtagaccagccgcgacatccgctgtgcgacttgtccgaccaccgcaccgacgtctgcgacctcgccggcgacatccgcatggacgccaacgcctcggcgttcgtcgtcgtcgtcgacccggcggtcggcgcggacgggccgacgtacaaggtccggccgtacccgcggaagggcgacgccacgagcatgggccgcgtcaccgagatcacggtgcgcacgaccgcggcgggggcgccgccgccgcggtgcacgacgacgcacgcggcgccggcggtcgtgttctcgatcagcgggtacacgggcaacctgttccacgacttcaccgacgtgatcgtcccgctgtacaacaccgcggcgcgctactgcggcgacgtgcagctcgtcgtgacggacggcaacgcggccacgcggcggtggctcgccaggtacggcgctgtcctgcgcggtctgtcgcgccacgtgccgcttgacctcgccgccgaggccgccgccggcggcggggaggtgcactgcttcgggcacaccgtggtcggcctgcgcgcgcacggcgagcccatcatcgaccgcgaacgcagcccggacggtctcgggatgccggacttcacgcgcatcctccgccg

SEQ ID NO: 90954 - DNA, 1036 bp, Oryza sativa
ccccttggatcgtgcccccaatcgccgggaacgcgcgcgttttctccggccgctttccatggccgccggccgccattcccgtcgccgttccgccctctccagtgctcggctcgcttccctccgctataaaatgcaaccccctcgctccgttctatcgttttagccccctcccgcgatctcccgtggtccctagccctctccccgccgtcctcctctctctcccgtgccgccggccgcctccagccgcctctccctcctcgccggagcgccgtccggtcgcgccgtcgcctcctccagcatcgcagtggcctccccttccccggcttgccctccgtttcccgcggagacccccggagctgcgttcccgccgtcgcccttccctttcctccgcgccggccgcctccagccgcctctgtctccctgcctgagcaccggtcgacgtcgccaccacctccctcggctccgcgacgccgctctcatccccggcatcacctcctcctcgcccgaatttcgccggaacaccgtcgcccgcgccggcctcaccttcctcctcgtcgacgtctcctccggcaacccctttcgccatgcccgtgcgtcagccggcgctgccgtcccctccctcggcacggtgacgtagccctccacctcgtccacccctcggtttcgcccggaagccgccgcacatcgccgcgaacctctccatccgcctcgccggagttgttcggccgcccgtccctcctcgcccttgcaccggtcggccacacctccaccatcttcggcatcgcagccgcgacgtcgtcctcggcatcgcttccccttcggccgaacaccgccggtatccgtcgtcgtcttcaccgttcatcctcgcccggttcgtcgtctcgcggcgccgcctccgtcgtgggcatcgctgcggcgtgttccacgccgtcctcgcctccgtgcagccgctgccggctgccctcgtcgcctcctcgccggtcccggtcgtcgtcgtcgtcgccctctcgtcgttcccggtcgtcgtggcgttcgt

SEQ ID NO: 90955 - DNA, 689 bp, Oryza sativa
tgagtgatcagtaacagaaagatgcaagtactactcttagtcatggttttagtagttaggagagaatgggagttagaaaaaaaaagttaccaaagtggagttgatgcatggagaatccattgaaaaatgacataagagcagtccagagaaagaaatatgcgacccggaaccaagggaagctctgcagatatgttgaattcagtgggtaattgtcaaattaaccattcattcattcataaaattacttgactgatcgagataagtagttatcaacttaccaagctattcagggcagcttcaccaagcaagaaaacggcatttaccgagtgcattcctatcaacaactgtcgaaacatagtaactgaatttttagcactgtattggtcaaagtatgagatggcaggtagggaaggcctgaagcatgtaatacttacaaaatttagattgtaatctttgactgtaaggaatgggaagatgatgaaccaaaacacacaatctgtaagcatcactgcgcctgcatttgtctgtcatggcagataaaaggtcagatactggttcagtaaaaattgctagtaaactgtaaaacttacataaattactcagttttctgtaaagtttgataataagagcataaatccttaaaaggatattcacaacgattatgaattaatgaatatacccattctttt

SEQ ID NO: 90956 - DNA, 1375 bp, Oryza sativa
tagatgtgacacagtccagattcattatattagaatgtgttatatctagcactaggttggttttttataggacgcagtgtctaaattccatcccccaccaccaaccctaccatggtctgttgcctcccagtttatcccgcaaaagcctaaagagcccctctgaattgtccccatcgtcaccccgaggatattagagtttatgttaaatatgtgtacgtagttgtttatgatttaggacttagagttataagtataaggaaagaagtaaagtcggaatatgtattagaatatctcttaaatagagaggttcacctattgtcttgcatggatagtataataggcaaatttaattcgattgagatttttaaggattttcatataactaaaatctagcaattcccaaattataaatatattggctgcatttggagcaatagaaacttaactgaagtttttttaatacaaatctatattgttttttaattttaagaaaagacagattttaagaaaattgtgcatgcagcagactttctttagaattgtagttctgtaaaatgttagtgagttagtcatcgttggagcaaatttaatctaaatcaaacggcgagatatcaagtactagtaaatctttcaaaacttgacaacaaaacttgagattgcgtctgtaccttcactgaagagaacagcagcatgtaaaactgttttccctgcgggcccacaatacgacacggcacctgcaggcccacacgatgcttttattgtcagttcttggacaatgtcacctcttcgtaatgcgatggccaaatagaggggagaaatatcctcgttgtctactatttgcgccaatccttcatcttgcgaaaccaaatacttgacgatctccgtgtgaccgagtagaatggccttatgcaagcatgtttggccctccaaatttctcgcacgcagcagattggtagtaaaattggacggctctgtgatacatttcgctctttccacaatgagttgaaccatttctttactctccgtggcagctgcacagtgcaggggcctatctcctctcttgttctcttgttgtagtagcataactatgagggctttgtcctcctgcccttccaagatggatttggcaagctcgaaatggcaaaagcttgcagcaatgtggagcaccccgtccccgtcaaccgtcacaccccggatagagtatggctcaggtggacctctatcactagtaactgttgatgttgcatctaagcgcaatggactccgcataatctgattctcttgctcatcagaacggcatgaggacttgcaatctaaacggaaacaagaacggcgggatgatgtgctctcaaaaaaaacacaagaacagcaagcg

SEQ ID NO: 90957 - DNA, 2000 bp, Oryza sativa
acacttccaagctatgtttaactgtccatgtcacctcctaactagttgtagcgatattggaaaattttttgttacaatttcaatactggagctcataacaagacacgtcagcagtaagacctcgatgaaggcacaaacctgcaacaacgggatggcagagtagttttgagctctgcgcacattcagaatgctacggaagaatccacgggcaccacacctatcccacagcggacgcgcgtgctgcactatcttccgcaaaaggttggtgcacagcgttacgcacaacagcgaaaatataacgcagaaggcaccgattcctgtgccataaaccttggctagatcaagccgtgctgctaacgcctgcaggctaatcatggacgacccaatgagcacccctagtcccaagataagagcaaaggtgcgtcctatgacaccgggcaagatgggaaatccagcaatcgcaaataaaaggatggcacatgcagagatgctcagtgagtctccactgagtttcttaactttctgaatttgcttgagctgatcgcttccttgagttgcattgttgttgttggtgctggtgttattgttgtggtagatggcttgcacattcagaaagatgttaagcgccgcattgaaaagcagagccgcgcatgtggccatgaccgcggcagatttgctcagtgtgtcggagaatgcttccctgtcagccttggcttgttctgggatcttgctggacaaatggtccgcacggaaagtaccaaaatcagctccagcagcgagcaaactattgcatacccatcgctggtgacccttcagaaatgtcatggaaagtaacttcataagacatgaaaatccatgttcccccctattaatgaattaatctatatttttcacattaccctgcttctagatatatttcataattcatagacgatatgatgtacatgcatagcggtgtgatgcgtgtgcatcttcgatataattacgggaaaaataatagtaattcctaccatatggtgtaattagttgttaacatacatatccatgtcatcacacctaagattacttctggtcttacatatttgacattcatgacaagattcaatcatacttttgaaactttaaccatacattcttacattagtagaatatgtttataaaatctaataagtttacaacatagtgtactttgagaggtaaatttacagatgctacttttgtaaactaagcatttgagcaattgatcatggtttaagagtttaaagattgactgaattttattctatacatcaaatattaatgccaagaggaagtacctttgaattactttgtagagaatatgtgaaacaccaaccaaattagggaaattctacaacaatttttcgttgttctagttgcccaaggtacataatttgtagtgaactttgcagaaatggaatatgtttaaaaacaaatctcatttcagaaaaagaatacgagtaaaaatgcaaaataagagaaagggagggtgctaataggacatactggccaatatgtggcatacgtcagtccgcttgttttgttcagtacggcatgatcaagaggcgtatacccatttctgtttctgatacttaaagagacattcttgcatcccatcaaaatgccaaaggtcttgttatgtcccttctgtacagccaaatggagtgctgtattcccatcgtaatccttcatattcagaaccattttgaacatttcattcgaacaaacaaatcgcaccacatcatggctttccgtttggacagcgatgtggaggattgtctggccagaagcattgcatgatgactcacagccaggacacaattttatcagctgatcaatgatgccaagcgtgccatttgcagcagcaatgtgaatgggcaatgagccctctgaatcttcacagtagcctgacgatggatccttcttaaggagaagttcagtaacagaaatgcaactgggttcagtagtatacttcccgtctg

SEQ ID NO: 90958 - DNA, 1588 bp, Oryza sativa
catcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagtccactagttgaaggtgacgagcctcccatacctcttggtgcattacatgatgacccaccaacaatgagaaggaggtcagggtcgtccatcagaaatttcactcagtggattgagaatgagcctaaggagaagttgtctctattgttcgacaccgatggatctcggtatggcataatgacaaccaatttggcagaggtgtacaactgggtaatgcgaggagttcgggtacttccattggttgctattgttgaattcatccttcacggcacgcaagcgtactttagggatcgatacaagaaaattggtccgtccatggccgatgacaacatagtgtttggcaacgtagtgacaaagtacatggaagataaaatcaaaaaggcacggagacatcgagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaattgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgctgt

SEQ ID NO: 90959 - DNA, 3249 bp, Oryza sativa
attcctgcagcccaggacgtgtcgtacctgctcgggctaccgctggcgggagcagcagttggtcccgtggacggtgtttttgggtggaaggaggatatcactgcgcgcttcgagcaggtgatgcgccttccacacctaggaccgaccaccacccttcctccgtactctacagtcgggcctagcaaggcttggttgctccagttcactgtaagtaaataagttgttattatcatacgtgcttatttgcgaccgaatgagtgttttgtactaacatttcattcttaattgtaggcggaccttctacaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctatggggttggtcgcagcgcgcagtggccagaggacggtcccacgatggggacttactggtgtcgacgtggggttagtgcaacttcgctgcgttataagtttatcagtcatcttttttttttcttcacataacatgtctaattccgatcatgtttattgcagcgtcgttacgctcacgtccaggtgagacgtggttacccggacttcgtgttcgagtttgaccgtctccagccgagcgacgtcatctgggagccatacacagaagaggtcgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgcgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttctcacacacggaggagaactaccgtgactaccttcgttggtaccttcctcgcactcgtgcgcgtgtgaccttcactccagacgccccagagccgcacgttgccgctgtcacggacgcgtatcccacgcaccgtgaccgagactacttcgtggcggtacatccaatttgtattacttcttacaattatttcatttatcttgcataatataggacaactactgaatttgttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggcacctatttcgcacggtactgctcagcccagaggtttcttaagttttgtttctgtttttgtacgaaaacatcaccccgtcgtaacttgatgatccatcctcgcaggacctcgtttgccttcgagcgcccctagcttcggattagtgcgacctacagcaccggtttcgcacggtacagttcagcccagatattagttcatttttgtttcagcttttgcacgattatgtcaccatgttttaactgcacgtttcctcatcgcaggacctcgtctgccttcgagcgcgttcgcaggcacgaccggcgcttccacgagctccgcaggggcgttcgccacctcttcgggcgcgttcgccagctcttcctctcacggagcgtcgatccctcgcccacacggtactttactttttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccacgacgtactaggctcctctcagcttggaggagctccagaggcacacactcaggagcagccagaggtcacacctgtacaggcaggacgggttggccgtgccgtacccccggaccgactcacgtactcccacgggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgctgcacggtagtgtcagatccagtagcgcgcacagtccacaacagcacacatgaaaagcggcagctcgagttatcactatcaactttcggcgctgcctgtttacataaagtgaatcacgcccacgcgtgatcgtcttgtcacatctaatgaataatgtatctcattgagttcacatatattgcagtgaaaacgacgctatataattgacaatctgaaggcaatctcttcatatcttctttcccactagcacacaacacacgaaaatggaagcctattcattggtaatacgtaatctagatttgagattatgtagaacattcttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaacaaaatatttgtacggtaacaatccaaatatgccctaaaaaataataaaattgtattttaccagtcttggagattttaatcttgtatagttttcaatataaaaagatttgataact

SEQ ID NO: 90960 - DNA, 1177 bp, Oryza sativa
tcaagaaacttgatctccaataactaatggatgtttagtactgtgtacgccatgcatcctatctcttgattaatcttattgaagaaaataatttgctattttgctacctaactagggaatcctatgatttgcaactccaagtctccaatcagagtattttaggattttacaacttgatgtttcactgacatgccaacaccgcaagtcattgaaacattgaatggtaaatcctagagataatatttttggagtagcaaatcctagattccccctttttgctagattaactaaataataactaatcagcaatctctcccgtggaggttctctataactaattcgactccaacgagcacaacaatgcacaatgcagtgcatagtccagttaacagtgactgcttcaaaccattattactgccaaaacatggtacataaaaacttcatgcacaactgaaccatgtctactactaccatagtacatccaaatttcatgcgcatcaactaaaacatggctgctagtttaagtcataagtcccagagcatctaaagttactatcctcttttttaaagaatatcaaggttaacatcttctgtccagaaccattgaaccattcagattatggcaaacgaatagattgatggtggagatgttttaatttaattgcaaaatttaaagcctggtaccctggtccatgcaaagtcaaataagatttaatgaataaatgtggtgtgcctttttacagaaaaaaataaggatgaatagtccttgaattaagttgaatgttaacattgcaactcacttcctccacagacatctttaaaaaaaaatgacagttgactatgttgcatagtccagtcaacaaaacgcaccgtgaatgcaagatgtgagaagggcgttaggtctctgtatttggcacttaatgttacaagctcattccagcagtatggtgatcccaaagatttcaacctgaaggagaacacaaattaactccagtaaatataactgatcatgatcatggtaacaaaataaattatcattcaagattaaatttattacttttttctcttataatcatattaggtttaccttgtatttgtggacaatccaaactgtactccatcaatgtatagtgtacactcaacaaagagcactggagcacttctttcaatcaacagg

SEQ ID NO: 90961 - DNA, 5028 bp, Oryza sativa
cacatgtttgattattcgtcttatttaaaaaatttacgtaattataatttattttgttatgagttgttttatcactcttagtactttttaagtgtgatttatatcttatacatttgcataaaatttttgatgaataagacgaatggtcaaacatgtgagaaaaagtcaacggcgttatctattaaaaaacggagggagaatactctaagagcacgcataaggcaaaaatattcctttccatttctcctaggatcaatcttcatagtcaacacccctttgattatcatcaatcaacagagtccgtttaaaagtaagaatttacataaattacaaaacatttagctaaaagagttgctggtctctatggaagttagcactaacaatagcttttgtttcagataatgtaatgaaacatccctgcttttgctaaaaagttatagccaattattacaaagttcacacaaaagcaaactcacaaagtgagtatgtagcaaaagtaacgaaaccaaaagtagaaacaaactaattaaaaccaaacaaggtaaagactccacaactactgaattctattggtgaatcttcacgcgaaactggcaaagagctgtatgatcgtcgacttaagtttacgacacacatcttttattagcttgataagatcatcatgcctttgtagttgggccaatatattaccctgaaaaaatcctgcaaataagattttgaaggtgatctatcaaaaaaaccatttcgttttactaagctagagagcccaataaataacggaagctccatcaagtataagttccttgattttttttattaacacccacaagccaattcccaaacatatgagatatactatgtggagggtataatataaacgagaactatatagatctccaaagaaatctagcgaaatggcaatccaggaaaagatgataaatcgattcatttttcataaacatctcaaactactatccaattcctcctagccaataactaattccacggaaatgagtccatggagattaaacgaattcttactttgaattagatttttcagcatgtgcttgagtagagggacaatctgcaataacaacacataaatcggtaagaagaaattctattagcacataaacacctcgctatgtcaactgttttggtgtttcaattcatggcctgtaaaggttcttgtagacatgcttgttagacatgtacttcatatcaataagtcggatggagaaattaaagactgagtttctctcaaccatcacacataaaacataaacacattttatgctgattcaattggataggcacacttcaccgttatctaggtcacaaagattggaatatgggaaacatacacttatttatatatactgcatttctaccctgatttattttgcaggaggtgcatgcctgcatggcaacatcattttttcactaaataagatcattttttcaccagcaaatagaagaaaatggaactttgccaaacctagatcgattattgcgactgaaacaatagagaatcagaatactaccatttgtgtcggtgatatgggtccggggctatcagcaccatagggaggaggctgcccctggttgccacgtggccttccccccgaggggggtcaggcctgaggtagggtgacggcgccccctacatgcccgggggtcgggcttccccgtccccctccacgcggtgccgcgtgtgccgcattagataggcgctcccagcgccacctaaccgcatttaaggtggtctgagcgagcgcaccacgctgcattaaatgtggtgcgcgtctgactggtctatgaccggtctgtgaccggtcgaatgattgatgtggcagggttagtgcgtctgctcactggctctatgtcagatggcgtgccgcctaacgcccccgtcacgtcgtgatgatgaaaggctgcttagcctctcatcacagccggagacggtttgcctaacccagtcagggcggggtttccgtttcccggcgcaagtgagggcccaaaaatcctcactcattaaatgtcaaatgacgggtgtgtcccccgtgtcagccggatagattaggcggaccccacgccgcagcagggcgtacaagagacttccaaggcaagcaacgagacatgcatttaatgtgattatcctccctgaataggctcgatgggcccatgttgtaaccccttgagatataaaaggaggtccatgcctacttagggagaagatgagcccttttcattagagcagtctcctgcccctcatcatcaacaccttctactccaacaaggagatcttgtaatctctctctcaatcagcatagcacaggagtagggtattacgcttctcagcggcccgaacctgtataaaccctttttgtctcatcgtcctcgaggagcctgacctcctctacgtcacatagcttcgctcaccaagcccacgaatctcaccctcttcccctggccgaactaaaaggggggcttcactgtcccccgcgtgaggagttcaccttccgacaatttgagaaaattataaaaggccacaaattttcactgctagataacctaacaaaatacgaaggaataaatggtagaataattgaggagagaacagtgtggcctgggcaacgaagtgatatcgtcagcccaaaatccaatatctcctgttctctgcacaaacagagatgtaaaattttccatatgcagagcttagcacgccataaccagtgtccaattctgaggtgggttttgaagcacgacccggtatatcgatgcaaccatttattcatgagacaggatgaaatgattagcataattccaaaacatttagcaagatagtagtccagtagtgtctaaaaatcagggatggaatgatccactaaatgaagtggcgattaatccaaagcaccttagagtccagtaaggtcgaagaagtcctaataccagttctgaaacatagctgatcgctttataatgcagatactgcaaattcaaatgttgtctattagaaaccaaaaaataaattcagttgtgcacctatgcacagccgtggtgcagtctttggtcaaattaaaacggattatcaggttactcaaatcaattcaagaaattttattctagaaaggttcattcagaaaatttatcctaaaaaaggtgaaatgggcttagataagcggtaaaattttccattccaaattgcatcagaaaagtttggagattaacatacagagatatgagtagtgaaaaccaaatcgaagagaagagtaaatacctgcacaactgcacagtgcacaccatatgctcgcatccatcgaatcacggatttttttagagtatcctccaatgaatacgagccattcatctagtttgatccaatggatcatattcatttctattacacccaataattttgacagtagaaattgtaaaggggcaaatttggaaaatatgtatttttaaaattcataatctcctattttttctgtcgtttcatggccttctcaggctgtagatgggccaagtcctaattaattgatccgtaatccatgcgcacgtacagatccaaatttcttggctaatcgttggattatgtgtggcttagttgaagagaataccatgttccaattattccatggactcacgtttgcatacatggtcaggatggaaattagcggcggcgaggagatcaacgcaacggcgagctggccagcggtgccaacgagatgggtcatgggtatcgagcgatgattcatagcctagagagacgagtgatatgttctgcacgaattaaccagatctaataataaaaatgcattacattaaattctaaaatacctatcgtaatcaacggttagatgaaacttctatagttctactacactattaccactagcagtgggaggtacagtaaaagcgcccttaggttgaaagtgtccagtactattgtataggcagagtgaatagaaaaaggcaatagttaagtaaatttgaaattttcctttggacagtagttatacacaagacaatatgctatcggtttagtaagtaacttcatataactatagacattctagtatagatggtactgtacaaaactgactgctaatcagaagctagttataagaatcgtctactaatgaacatatagcagcatccttctctttttactctgttctccagggcactccaaatccaacattgcggatgagtgacattataccctaaatattgatcccacgggttgaagttctcttccaactacatggcaacatgtgtagtgcttttggtagatatatgaataagaccagcatccagagatggcagtttcctttgtaactgatgataacagaagatctgttgcatcaccataaaatacacattatgttgtagaatgcagttaagagccttgtagttatcgaagaaaatatgatgtcaccgtaacagaaaagaacttcaaaactgacatgtacagaccaaatattataaatgtcttgaccaaatattataaatgtttttaacgcctagactgtgcccattgatggatggtctcaaccacttgagggaagaaagcactgatactttcgttgataagaccctggagaaaatgtatagcatcctcgtcgtctagatccaaccggaaattttgctgtagctgattaatgtccacagaaaaaatggaaagacgatgtcacttattctgtaggtgtttaactttagggtaagtccattttacaccccttaactcttcctgtcgtctaaaattcacaccttaacttaaacaccgggcatccaacaaccccaactatcaaaaccattcaatttacacccctagacaaaaccagggtgattttcctgcttatgtggtatcaacataccaatctgggttagcaaaattattaaaaagaataatggccccacatgtcattaaaagtttgagaccctcttcctctactctcaccttcattctccatcttcttgagatttcctcaatccgcctctgtcaatggggctgcaggaatt

SEQ ID NO: 90962 - DNA, 1418 bp, Oryza sativa
ttccacttcccctgtcaccccccgagcttgagcttgcagatcccactcaggaggcttcgatgccattgattgtcttgggtgcgtcgacatagggaactaggggagaggagagatcagagagagaggagaagaatgcctcctaactgacagttgggccctgtattttctttttatacttttcctgactaaattgccatgtcgattgacacgtaggagaaaaccgcttgattttgactcgggtgtaagttgaacagttttgatagttgagggtgttgagtgtctggtttaagagtcaaggggtggattctagacaaaaaaaaaagagctaggggatgtaaaatggacttatcccttaaacactttaacagctacttaccttagaagtccctttgtctgtgatactctcaatatttgatccagtcatcagataaaaaagattcagtatgaggttgctggactttcgtaatatgttgtatgcctcgcaacagtaggacttgaatcttgcatagtattcactaaaatggaagtcacatgcaaagaataaatatctgtgaaatgagcaaaggtgcaaaactatatatacataactaaataaagcatttacctttcagtaccacccatggcctcaaccatttctttgcataatttcatcggtggtgatggtggtgcaaatcgatgtggttgttccccaagcatatacgagaagtcaacatggaaaagtcttccatcgtcttgtaggagaaggttgtcaagatgcctagattagaaaagcagttgttatttattgcttacaaactgcataatgcttgacctccaaaaaaatggaaaaactgcatgttgctttgatgttttgttgtttgtatactccagttgccatataagaccagacaggactgaactacaagatgtgaagtgaaggtgatttattttttttagatataatggatagaaatctagccttttatatctacgagtggatatacagaaccaaaggttataggaatttagattctaagtctcataactgaaaaacaaaaacacaaaatgaaaacattgttatgactagcttccatcttttgctgcctaacgaaccctgccacaccaaaaactgcactgagacgatctagatatgcagttcgaacttgtgcagcccacatccacgttccatccacctttcaccgggtcctatgccaccctgccccaacctcagctggatccaatcgatccagattcatcaatagtgcatttgctcgccgacggcatccagaggaggcagagaagagacccctgcaagtgagattcgggcacggccacctcagatccagcagcatttaggccccagattgagcgccgcgccccatctgtaccagcattgccaaccagcttgtcgttgtcctgtccatggcactcatagcttt

SEQ ID NO: 90963 - DNA, 2463 bp, Oryza sativa
tcccccccaagcttgcttcttgctatggctcatggcggggatcaaatccctggtagcggtgaaacgcttgccagtcagcttgctattgttgcatcatagtgttgaaatttgcgagctgtgcaccaacagactgctgccattcccatgactgtaccacatcatcctccaaggtatgttgcatgttccttgcctgcagttcaagtgtatccgtcccccggatgagttctcccaaatcccttcgagaggagactgagcaatgcatccaagaggatggaggtagaccacttgaactgaaggagcgcgagtatccccagtgcagctcctacggctcatgccaccggctgtcgctggcactctgccaggacgaacctccgccgtcatgttgccggaattgggtccaaccaagggcatgcgcggtcgggtcccaactgtctccatacatctgcactggtggtgaagaggaagacgcctcttggggtgcttttctccccatacgccgtgttatcctgcgtgggacatcacgaggcaactccgcttggagagaaatggttagttctcggcagttatacaaatgaaactccgggttaggtaacggaatttcatttgtatagccgggaaacaaaatcatttggaccatgtttgagtgcgtggccttgaaccagataggcctcatcaacataagagccggtaacaagaatactagatacttgcatattaagcatagtcccaactcttcatgctaaacgagtcaccaaagaaatacactcaacaggaccagacaacttcacattttctaaccattgcttgatcatgggttgaatgggtgaaacgttgattttttttctaaccatggcatacaagaggactagttcgcgctatctggatatcagctctaagaaacgatgtgaaaccaagcaacttatgcaacagcctcaaggtaggattatggatgtcattagttctaggctttctataggatgagagacccgaaatactttgccaaaacatacgcttgttaaaatcaggaaatgcgttcctgaaattaattttgcatgttttgtcaaagcctagatgcaagctaaggtccttccaaaaaaggtgatattccttgcggaataaccggaaagtaacaccatcgcctacctctagcatggcacataaaaactgcacggttcgaaacccgtgcttaaatcctactcaaggcccactacgggtagcgagcaattaacaaatagagacaatgatgaagagaaatgacgcatatacggccggcctgggtcactcatgatgttggtagttcaagtgaattgtcgtagtgtaaggaagattgattggttttctgattactacttggctggcataagaaagaaggcgccccggcaggaattctgtaagcttgacttgcacgcagcgtttgggaatcaaagataaaaaataactctatgggacttgaactattaaggatcgcatcccgtgcatattccacattatagccagcaactgattcagcttccgcttctgggagatcagacggagctcgattagtttctgctagacaaggaataaagaacataaccaatacggggaacaagggaataccggaccatatctgcttttgcgccatgacaatctcactcgaattacagggacctacacatattagtacagtataccggggtccccggccagaaccacacgtgcaagtttccctgcatgtggctcgtccatgcttttatccgaggcgctgcctgcgactctgcatgggagaagagggctgaactgcaaactttcgtgttcacagcattgcattgtctaagggaatagggtgagtaagcagcgcctaccaagctaagctttcgtcgaaaaggcgtcactgcttccttttcggcgcccgccaggaacccggctcgtctacacatgaaatttatcccaacctatagcacgccaaaaagtaatgaagctcagcatctatacctatccttttcagaaggtcgagtcgtatgctcaggtccgagcacaggttcggtctttcagcatatgataggcttgcatttcccggtcgcccacgaggtcgtgaaaggagttgttgtacagcctcggtggaatgtacgcctccttcatggatgcatccgcggaagaaggtgtactcggcttatcgtgtcggcttgtccgtgagcttgatcgtctcttgaatatgcccaaaagtcgtttctttatggctacagcaaagagcaagaatacaagactactcggacgggggttaagcaaatacccgccgataaccttgcaccaaactaaagcaaacttgtatatgcaagtgtctaaactaaatgcagcaaattgtgtgaatttgaggcgagcttgcaaaactttgaataaatttttagagcaaggttttgagagggagtgaaaatgagttaaggtggtgtgacttccttctcccagccgaggggctgcaggaat

SEQ ID NO: 90964 - DNA, 1904 bp, Oryza sativa
tgttgtacagcctcggtggaatgtacgcctccttcatggatgcatccgcggaagaaggtgtactcggcttatcgttccccgggttttggggtttccccgggggggcccttttttgggtttcccccgggttgaaaggcccttattttggaattcgttcctctttgaaaatatgcccaaaagtcgtttctttatggctacagcaaagagcaagaatacaagactactcggacgggggttaagcaaatacccgccgataaccttgcaccaaactaaagcaaacttgtatatgcaagtgtctaaactaaatgcagcaaattgtgtgaatttgaggcgagcttgcaaaactttgaataaatttttagagcaaggttttgagagggagtgaaaatgagttaaggtggtgtgacttccttctcccagccgagctacatatatagtgcatggataacggctaggaatggcatgtgggccccactagccgctaccctgcaaaaatttccagccagccggtgccagccggttcggccgaaccagggattcggccgaacccttggtggacccaaccagccccacctttagctattggattcgaaaaacccggaaatcccccaacaatgtggggtggtgtgctgtgcaaaagttttctaaaaactttattttattttgctcacaaaaatttatttgaagaatttgcctcaaattcagatctcaatgtgtgtttgaaaatccaaacatgctttgatgcaatggaaaataaatatgagataactaccaatttacctgttggcaagggggatgtcgttttaggtccgacgagcacgaccatacctccgacgtatttagctcaatgaggcacccagttccggaggtacaggaacgagtgtcttctccttaacccgccacaccttctttgccttaggtgcgggcagcggcctcttcgtaactgggaacacaggttgaccggcctgtattcccggcttcttggatgccggcttaaggtattgacggttactcgtttcttcctgctccaggaagttcatcatgaaagtattgaggctatccgtccttcggggttttactttgacctccttgtgtttggtccattcttgatctaccccatggagaaatgctccatccttggtctcctcgtggacgatacccattgttattgttcatgagcataacgttctcatgggttttcgggcaatccatcccagagtgaccggtgttgccatagacctcacatgtcgtgtggaagtccagggctttaacggtaccctgcttgttatccttctcattgttgtctagtctcttcataaggagatccaactgggcggcgagcatctccgtcctcttgacggtgtacatgccgcattgacgggtttggagtcgttcctcgctccaacccatatttgagaccatcttctcaattggttggcatctgactattcttgagaagaatgtccctccagcagcagcatccaggtgatcctaggacgagggggttaatcatttgaagaaattctgcaggatgagccactcggccatcccatgatgaggacgggtggtgacgtattcctgcagcctttcccaatcttcaagaatggtttcatccctcgtctgctgaaagctagatattcttccgcgaagagcgttggtcttgcccatcaggaagaatcttgagaggaatgctgttgagcaattgtttcggtattcaccgttgcacggttgatgtagaaccactgttctgctctctcgaggagggagaacggcaacagttggagtctgattcttctgacggtatacgtgctatggctttccacaaattgctgcaaatgagcacttgcatcctccttaggcttgccacagaacgggcaagcctgcgccatcgttaatttagctgg

SEQ ID NO: 90965 - DNA, 1202 bp, Oryza sativa
ttactggatcgagtttgaaattcaattaaccatgcaacggtgattaacactcaattttttgctatgtccaatgtacactgatgtatttaaatagagtattatatcatcggattttctttatttttgaacagttcaaccattttgcctcggcctcatacattatagtgttttgtttttgggtaatataggtgtgggatatgtcatctggtgaagacaacatctatattgttggtggaaccactatatctcttttcaatagcaaaaaccaacttaaaactgggaggctgaggctgagagtatggcccaataaaatggcagatggaagtctctccacctctacccctggcaaggtatataacaagctttattgtctctatatatagatttcagaatgacaaatgtttaactctgtttactaatgttggcatcaggttattttatttatcatgcacttaacacttttttatcaacttaaaggttcccaagaccaagagggaagaaatagagaggttggaaagggttgctaacaagtacatcagagggcagataccacatataggttggctagacaatctcattgcaaatgctgctgataaacttgagaaagagagtgagagaactgaaaatttgcattctagccttattgttgaactatgcagctttgaacacagagttgtctttcaggttgcactatttgactattcagttcttttttgttccaaatttcatggaggtttgctttaataaataatattcttgtctgttatattttaacattatagttaaatatgcatagcgcattggatagcacacatattttgacggaataaattttcattggtattatttgggctgaagaatgctgtattacaaggttttttttttttttttttttttttgcactcaaggatgcattatgtttggtttacttttcaaccttgctctattgctcgtcctggattttgttattgagctagtgcctttattgttcaaaactattgtcactatattaataattctcttgctattctcgattcttgtgtagagccaggatgtttttctttatcttgcatgtcatcatgtcataaaattttctagagtattttactgtcttactattattctttcatgcaggaatatggagcaaagttgcatacatcagtcccttcatccttagtggatatatctaagaataaacttgt

SEQ ID NO: 90966 - DNA, 1353 bp, Oryza sativa
  unsure (1)..(1353): unsure at all n locations
tgtagatatatggatttgatgtggataaactggatatcagatagtccttcagtaaaaggaacaaaaactcaagattgatgagcccacttaagtcttccagccagtataggtcggcagcttgcttatcacaacatccaccatgcagtgcctaaagttcagcataatccaacaggtgctacctcttttttgatgcctccctagccaaaatggtgtatatatggaagctaggcatgtaacgtctggtttccattatgtgcagaaattccatgcacaagtctttgtatccatccctgagcaatccatcgatgagcactgcctgtacaacgtcatcaggattccaggtcctcatgagcatgttttcaaaagtaatccgggcttcctttcttctgtgtaattggcataaagcacatattaattctttataaccattaaggtggacctcacaaccttgagtagacatatgcttaaatacgcccatagcaaggtcaacgttccggactctcaagagtgagcataataaggaattatatgcctcctgatctgggcataaaccctgactaatcatgcttcctaacaactcatttgcctcaaaccatctcccagctgtacttaagtttgaaactagtgcattctgcacctgaacagataggccaggatccagttctgctaacttagcagacataactgacacagcatcttgatcagtggtttgataaccaaaactgcagtttggaactacatctggcaaggcagcaagtctctggtcagctaataggtactcatttttcaagcctttaatcaaaacaccatatgtccacaatgttggttggcacccagctttatcattcttccaagaaaattaaacgcatgctcaactttccctgacatgatatatgcttcaatcatcttaacataggtaatttcatctggaatgagcccgtgccgctccaattctgcaaacaaattctcagcttcctctaccttgccttcttgacctagagcgcggataagagaactgtaggtaagaagattaggcaaacaaccctgctcaatcatcttgttgaacatttcaagagccaaagatgtggaaccatttttgcacagcccatcaatcattgcagtgtaagtgactacatttggaaatatcccttcttcaatcatcactttacatagttcctctgcaccagaaaaatataattncctgccttttttaaaggtttcaaaggaaacccccaattggggaaaaattttaaaaaggggnaaaaaaacccccgggtttttgctgtatgtctgaacatttggtctgcaaccacttctcttcatatgttccaacaatgatgttgcagtgtccag

SEQ ID NO: 90967 - DNA, 1585 bp, Oryza sativa
gaatgtactcgcagttgcgagacttagggaaaggtcccatgaagtctatacctcacacatcaaatatctcgatttgcaaattgtatgtgaggggcattgcatcgcgagcagtgattcctccttgcctctggtagcttgtgcatcttctgacgaattcttttgagtcttcgtacattgttggtcagaagaaaccactttgccaaatcttggcctgggtgcggaatgcaccgtattggccaccgtagggtgaggcgtggcatcgttctatgatcttaagtccttcatcagttggcacacatcttcgtagtaagccatcagagcagacccgatataggtatggctcatctcatatatgacggcgactttcatatttcagttttcgtttattttcccctggtggtatgtacttggataccatgtagtttactatgttagcataccacgggttagagtcacgaaccgtcatcagcatgtcgtctctcatgaaatcatttatcggttgttcctgcatgttagtgatctgcagtctagacaaatgatctgctacagaattttctactccctttttatctttagtttctaagtcaaattcttggagcagcaaaatccatcttaagaggcgtggtttagcatctttcttagtgagcaggtatttcaaagcggcatgatcagtataaattatcaccttggctcccactaagtaagatctaaacttaccgatagcaaaaacaaccgcgagcagctctttttcagtagttgcataattcaactgagctccggttagagttttgctagcctaacagattgcatgatgctttttatccttggtttggcccaagactgcaccaacggcgaaatcacttgcatcacacataatctcgaagggcagagtccaatcaggaggttgaatgattggagcaaaaacgagtacctttttgagaatttcgaaagattttaggcacgcatcatcgaactcaaagggcgcatccttggctagtaaattgctcagcagcctagcgattgtagagaagtctttgatgaaccttctataaaagccggcatgtcccaagaagctgcagattcctttgatgttcacaggaggaggaaactgatctataacatctattttagcacgatcaacttcaattcctcgttcggacactcgatgcccaagaactatcccttcacggactatgaagtggcacttttcccaattaagcaccaggtccttttcttggcatcgttgtaagactttgtctaaattttgcagacaatgaccgaaagtctttccatagaccgagaagtcatccatgaagacttccatgatgtcttcgatcatgtccaagaaaatatacatcatacatctttggaaagatgcaggagcgttacatagtccgaaggacatcctacggtatgcataggtgccatacgaacatgtgaacatagtcttgctttggtcctccggatggataggaatttgatgatacccggaatacccatcaatgaaatagaagaaggaatgatttgccagccgttccaacatttcatcaatgaagggtagcgggaaatgatccttttttgtagc

SEQ ID NO: 90968 - DNA, 800 bp, Oryza sativa
gagggaagggtggggggtgaggaaggcggcggcgagggtgagggtggcggcggaggagaactggcggcgggcgtgggtggtggcgctgtggttcgccgccatggcgtcgctgttcgtgtggaagttcgtgcagtaccggcgcacgccggcgttccgggtgatggggtactgcctcccgacggcgaagggcgccgccgagacgctcaagctcaacatggcgctcgtcctcctccccgtctgccgcaacacgctgacgtggctccgctcctcctgggcccgcttcttcgtccccttcgacgacaacatcaccttccacaaggtaaattcaattaaatcccctcccgcctaaataacactctccgtctccttttaaatacagtcgtatgtcccattttaaatacagtcagaatttgtatatttaaattttaactatctatcttatatttaaaaaaaatattaaataggttaaaaataagatatttaaattttaatcgtctatctaatttaaaaagtttattaaatattttaaaaataggtcaaaaaaatttcaagtaagatataccgtcaatatgttcagattcgttatactccctctgttttttaatagatgacgcaattaagtttctgcttttttttttcaaaaatagatcaatatgattttttaaagcaactttcgtataaaaactttttacaaaaaaacgcaccatttaatattttgaaaagcgtgcgcccagaaaacgagtaagaggggttgggaacatgggatggccaacactccctaaagggagggggagtggggc

SEQ ID NO: 90969 - DNA, 539 bp, Oryza sativa
attttacctgtatgcatggagttagatgtgttcctgacagtataaccttctttatttgtccaccaattgactcaacccggggcttcaagacatcttcaacaatctctgtatcatcaatagcatcaatgctgaatttcacctacagtgcatgcatcaagtattaatatacactgattagagtagagagaggtttaccaaagtgaaaagctttcatcaaacctaccaatagtgtattaagtacattgtaagaattcttgcacaattcacggttttcaagtggtgttggtttgaattcagatacaccttctgtaacctgtcaataacataggaaacagatatgggcagaactaagctaaacattttatgaaatcgtcgttataaaatgaaagaacttaaatttatatagcacctgattcatcactgatggtaactggtcgacaaatttgctcacggataacataacttcttgatcatacacctgtgtcaaaccctccactcaatcaaatagggccttccatgcatctcctacaaaaccatga

SEQ ID NO: 90970 - DNA, 524 bp, Oryza sativa
atatttgttgtgctcaaaaagcatgcttttcatggtatttctgatagtctgaaatacagttcagtatgacaatattttttctgttcttcttttttcaatgaaagagcaccagggtcaatgattctggggtaaggataatttggctgtattttgttgttatcttgtttgatcaatcgtatatatctcagattagaacgggaacatgtaatgcttgtcttgaatggagtaatctccaatactgtcactattcctttaattatgctatttttgtgcttaccttagaactaactagtactttatttttcaggtgtttctgtgctttggtaattcagttgcttcaacccgcttcttgctccaagatgaattcaacatacagacaactaaatgcgataactgcatcattgtactgtcactgtcctcttgttgtttgttttactaacttttaggtataattcctatgttccctttctatgagactataacactccagaagatcactcttttcctgtagggcttcatgttct

SEQ ID NO: 90971 - DNA, 1006 bp, Oryza sativa
cttgtacgtacacaacctgtagtgtacgtacacgatgcgatcgatgatgaactgatagtatatgtatatggcgcagctggtgtattatattacatgcgctagctggagggagagtgtgctaatgttgtactagtactacgactgatctgtttgcttctcctctgctttctttgtctccagaaaagagggagaggagagaagtttttcccctgtttttgtggaatatgtaaaagatggctgcagtgcatgcagcagtgtaaaagtgtgaaaagaagtgggcaataatgcatggccaaataatgttatgaacctatacttaagactgtttattagtagtaagtagatggtatctgtcaattatcatggtggttgataattgacaatacttgattgttttttcacagcagtcgtgttcctgatgtcaagacgatggggaagtttatcagaaaattgaatgttaccgtgctctttggactgttaaaggtcaagaggatgaggctgatgtatcatgaatgacagaaagtatgaaccatgctgccatgccatctcactaaattcacaattacgtgctttacacccccaaggccctaaaatatactcatatatatttttttgtcaataacttaagcgtccacttggaatttgagtcctgtgtgaaatacaaaacgaggctctaaaataagaaatccatgttgttgtaacagggggtcatcgccatccttcctattcaatcgtaatacttaagtatggaaagttcttcctgtgctagaaagttcctctcgaactggaaacatgctctcaagtcggaaattaaagttcctctcgagttgggaagttcttctcaagtaggaaagttcttctcgagctggaaaaatgttttcgagtaaagagaacgtgaccaagatggtttgtcacttgtaacttgttttgctcaggaactgaggcagattcgcttcgggagtcgacggtggagaagaataagcaagtcccaaagaacacaggaggc

SEQ ID NO: 90972 - DNA, 1374 bp, Oryza sativa
tcctccttatcctcctcctcctcctcctcctacgtccgcaacggcctccctcccccgtcctcctcgccccccgagccggactcgggctacgccgccgcgtgcggggatgccgcgggggactggatcctcttcaccagcccgacgcccttcaaccggtgcgtgctcctgcggtgcccctccgtgtcgttcgaggacgggggcgtgctgctcgacggcgtcaacgagcgcctcctcaccgaggagcggcactacgtcaacctgagccgcggaagcatccccgcggcgcgcggcggggatggcggcgccggcgacatattctaccagagggtttgcattcccgcggaggacggcggggtgatcgcgctcgattggccggacaatttggatttgggcaaggagcatgggcttgattccacggtgtttatagtgcccggcacgcctgaggggagcatggagaggggaatcaaggtgtttgtgttggacgcattgaagaatggctacttccccattgtgatgaaccccagaggctgcggcgggtcacccctcacaacacctaggtgaaatttatgccccttatttatttaccattccaaagctttggacaacatctttgctgcaaacgtgcaatagtgcttagctagtgatgactactactccctccgtccctgaatatactccctccgtcccagaatataagaagttttagggttggacacgttattaagaaagtaggtagaagtgaatagtgaagtgttgtgattggataagtagtggaggtaggtagaaaaagtgaatggtggagggttgtgattggttgggaagagaatattaatggagaagttgttatattttgggacaaattctgagacctaaaaattgtaatattttgggatggagggagtagcttttactagtattagtatttgtaagaaacagtttctgtgagcaaaattagaagcttcttgtagcctctgcataattcactttaaattttatagtgttttccatgtttgctaaacctatgtactattgctgaatttggtaaatgggaattccagtccgtctcatacacaactctgttatccatgctgaactcaggctagaagattacaggaccttggtggtagctagtactgatgtgtaacatcagtaaaaatgtttagaataactagcgttattattggataacaaaacaactttacttaagaatcgcagaagcagtgattggtaagtgtggattgtactggaaattaacataattttagttagtgtagtggacgatagttttagtgatcatttcaaggaaaaagtacatctttgcaagatcaatcataaagttgacttagaagtttgatatgggtaggattgttgtct

SEQ ID NO: 90973 - DNA, 2267 bp, Oryza sativa
  unsure (1)..(2267): unsure at all n locations
tgcatgatcaagaggtggcactcgtcgagcaggatctcccgcacgccgtcggggtgctcggcgtcggcggggtcgacgtcggcgcgcagctcgcacggcggcggacgcgtcggcggggaggaatgggggcgcagcgtcgtggcgagcggcggcggagggggaggaggaggaggagggcgcggcgggtcggtgtcgttccacggcgcggacggcgtgcccccggggctccacccggtgtacgtcggcaagtcgcgccgccgctacctcatcgccgccgacctcgtcggccacccgatgttccagaacctcgtcgaccgctccggcggcggcggcgtggggggcggcggcggcggcggcaccgtcgtcggctgcgaggtcgtgctgttcgagcacctcctctggatgctggagaacgccgacccgcagccggagtcgctcgacgagctcgtcgagtactacgcgtgctgaccgcgcctagctacctgcgatcgagaagacggcggcggcggcgatggccggcgtcgccgagctcgccggagtcgtcggaggcttctagaagggggtaatttggtaattcggtttgttctttttttttttggttctttctttgaggttaggggtagagttgtaatatacgccgagctacgagggcgagtagcgaaatgtttggagatttagttaaccttggggtgtttgtggtaagctggagattagcagtgtaattaccgtccacccaaggtaaatgctcttttggagcagttaattaattctctaatgctggatgtaataatagcttgcttcttttttgttcttcttcttcttcttttcctgcttaatcttaataagattttagggatcaatgtatccatgtactctccaccattgtataaacttcatgatcatctcttctgagattcctcttaaattcacttgaaattcttggtttggtatttggaggtgttattcacttaattgatccatgctaaaaaaaatgcatgtcacttaattatattaactagcatggaggcccgcgcagattgcgcgntagcatcattatattttctctcatataatagcatatatgttttctcattatattattaaaatatattacaatgacaacataattttaaattttgcaataactttacgaaactactaatgtgtaatattcatattgtattttatatacgtgttagttattaattatttttactatcaaattttagttatctataaattatatatattcctttatggactctagactcgtcttttatttttttttaattctaaatttttattatttctaattgtatttctatgtggactctaaactcatctttcaatattctttaatttttaatttcaaatttcagttacttctaaattgtattcctatattgactttaaactcttcttcccatgtttttcttaatttcgaattttagttatttgtaaattgtatttttatacggactctaaactctacttttaattttatcacatttattccgaattttagttagtttcaaattcatgtatggactctatactctacttctaatattccttattttttaattccaaatttcctttttttcttcattgtatttctatatggactctatactttacttctaatattccttattttttaattccgaatttcagttattttctaattgtatttctatatggactctagtcttctcttttaatattccttattttttaattccgaattacagctatttcctaattgtatttctatatggactctagtatcctcttttaatattccttattttttaattccgaatttcagctattttctaattgtatttctatatgaactctatactctacttctaatattccttatttttaattccgactttcagttatttcctaattgtatttctatatggactctagtctcctcttctaatattccttattttttaattccgaatttcaactatttctaaattgtatttctatatggactctagtctcctcttctaatgttccttaatttttaattccaaatttcagctatttctaaatgtatttctatatggactctgctttttctttttctccgattaacgtgagaatttctaggccatgagagcgaacgtggaggctcctttttctattcctttaattatataatagattccacccatttgatttgtcttacaaagacaacacacagcttgattcctaagcaatgctatatgtatatactataaagcaacttt

SEQ ID NO: 90974 - DNA, 642 bp, Oryza sativa
gcacgtaacggatcaatcgatccatccgtcccgaatcccgatgcccattgtggtagtcacagattcttgataatgcttcttgttgcgttcttggccccaaaattcagggtggacaccaacgtggatgggaggataacgagggaggaagtacaggaggtgactttgtttaaacacgttttaaactttctttttctcttttaccttctctctcactaatcatcagaagcttcttcctgtgggcacccagttgcctaaatttctaatccgatcactaaccaattctccattttttttactgcggtaattaactgtcactcgcagctgatcgtcctgagcgcgtcggcgaacaagctggcgaagctgaaggagcaagcggaggagtacgcgtcgctcatcatggaggagctcgacccggagaacctcggctacattgaggtgcgtgcactgatgcgtatttattttttttctttttttctctatctcttggccgtatacgtatatacgtatagtgtacgtatatgtttagagctttgtctttttggtgggctccggcgtgatgacacgtgtctcgtcgtcttcctcgtttgtgtccgccagctgtggcagctggaggcgctgctgctccagcgcgacagctacatg

SEQ ID NO: 90975 - DNA, 1144 bp, Oryza sativa
tcatttgtttttcacaggaacttggcaaacaacaaccttgaaggacaaatccctgataatataagctcatgcataaatctcattagcttgtaagtttcatttgttctctctgaagttctatatcctctccgatggcagggctcttaactttagctttgtaacagcaatgcttatggcaataaattaaatgggactgttccacgttcattgcacaaacttgagagtataacttatttgtaagtgttattggttttaggtgattttccttcaagcctgccataaatttagttctgttcatagtgcctaatgatttgtgtttccatccgtagcttctacgaatctgtcatcaaactatcttagtggagccattcccattgaactagcaaaaatgaaaaacttggacacatcgtaagtaccagaagttaatttgcattctgcaattgcttttaagcaagcgattctcatgatatggcgtgttagctgatatatttgaaggggcttatcctgtaacatggttggtggttcaattccctcagcaattgggagcttagagcatcttctgtgactgtaggttctatagtatagtacttttctataaaaaaaataaaataaaatacttgtattatgtcatgacaacatcctcttattcctatagaaattttagcaataataatttggttggatacatctctgctgagtttggaaacttgaggagtatcatggagatgtaagtaccttctcacctacgcgttctctgctctgttcctttgggaataatgcagattcctcttcctttgttttagtgattttttacttgcaagaaatgaatagtcaatcattttaattgccccagtggatcatctaatcgatagtaaaaaataattccaaatcaatgtggacgtaaagaagccttaagatttcatatgaacaaaaaaaactcccaaaccattcatatatgtcgttcctaacagcaatgccgtttgtaacaccaactttagtgcaaaaaattatctctaaattgactggagggattatgtgaatatgaaattgcatggacatttttgtaaccacaaagatatatgccgaccaaagttcatccatctaactgggatttgggaggcattgtagatttcagcagtagaca

SEQ ID NO: 90976 - DNA, 921 bp, Oryza sativa
aattcctgcagcccgataattttctttcaattttttgatttgcaggtgagggcgacttcactcatgctactcaggaccaggatcatggtgctccaagctctcaacgaactaccattgcaccgggagtccgacaacagcaacaattcagtgacatacaacaggatagctctagctcattcagtgcctctagctttgaaagtggctatccaacgtatgtgtacaaccgtccccaagcttctgattatcctgctactacatgggtgtatgaatggcaagagccttagtggtatgctcaattgtacgctcagtggcaaacaacatcatcatggacaggtcaaagttgggaggaatacaaggcggggttgctacattcacatggcttgatgctcatgtccacagaggagtacaatatggcatataatcagtggaatgcgtagctatgcatgtccttgtttatttcctttcattcgaactagaattgtaatcgtggacattatactgtggactctattgttattgtggactatattgttattctggactgtattgttattctggacctacatgtggacatcgttatgctttgaaatgtgagattgatgattgttattgttgttataatgttatgaattattgtattgatttgaactccacaatatagagtaggtcatgccgaatttttctgttgtataaccacatcttaattaactaaaatactcacattttagtttttttctattatttttttcatttttcttatttcagttccaacatatcgcggttaccgtcctcttaccgcggttaccgtaccaaaccgtgcggttaccgtgtccataccgtggattttgaattcaaaaatttggaaacgaaatttgtgcggtttttcgtggtaaccgcacggttaccgcggtaaccaccata

SEQ ID NO: 90977 - DNA, 2484 bp, Oryza sativa
ccagatctgatggcacgaactcaaggccgcctgatctgatggcggtgagctcgtggctgccgatggttaggcggttggtggagcaaccattgtcctcccaccaaccggcttcaccctttccgccgccatcgacaccttgtcgctgtgttggacgaggggctccgcctcttcacgcgcagccagccgctgcgtccgatagaatcctcctcacgcgccgcgaaccatcgatggaccagctgaaggaaccgggtgggccaagcggtggagctcgcagccatacgtgtcgtgccgcacggtaagtgctatatcttctcaagcaccaagcgcttcgaatttgtagttgcagagagcattctgacctgcttctattgtcaggcgtcaggtagagttttgggtcaatgcgattgcattggagcttgaattgattggtgttttatttatgaactgtgacagacatctctgcaagagctcaccaggcttgggataaagcacgtggagaacctggtgattccgagtgtcagaaatgatgtaaggcctgctaagcttaaaaatgtatttgtagctttgtttagttatttggaaattgcaatggtgcaacagagcgtgatgatttgatggggattctggaatcaagcattgcaaaattgcaaatgcagaagaatagtagtgccataatttgttcagaagcatagtcccccattttccttcttgtgatcacgcaggcagcattttttttcactgttgtcggttcaaccggattcctacccattcgtgcaggccagcttagtagggtttttccttgctacctcctctttgtgctactctggattgataaaaataatcttttttcccttacaagataagtgcattaggcttcggtcacaggttcctgcaaaataatttttctgttgatattaataaacatcctgtgatatataattttagcttttcaaaattctctatctcaggattggggctttttggttccttacttgattggaagcatctcattgatagtattagctatcggaagcatttcaccagggtatgtgtttgttgtctctgctaataagcctgtgaaagttgggaagagccggcatcaaacaatccagatgtctgacatattctaagattctttaaatggatattcaagcagcaaaacttatcagcttaattaatttaatgttatgtcactcaacatagactacttatggcatgacaaataacactatctgttttatgaatgctcaatgaaaatatgttgcaactttatcaaggatatattgtaattttccattccatcatcacagtcttctgcaagcagcaattggcgcatttttaactgtttttcctgactatcaagacagagttgctaggcatgaagctgctcattttttgggtatgtctccagttctgcaataggagtatgtctgaaaataggttttttactgactatagtttattgaatattgaagtgccttaacaaccaatcgtgacaacagttctggagcagttttagtataatggttaatgatgatattgtcattgtaaagaattatgctgaactagccatctaggtaaaggtaaataacattgatcggaagaatcacttgaaatatctgaagctaacttgagtagaactaaagagcaatacaaaaatattttttgaagctaagctaatggttagatgagctggatatgaactaaggctgtcaattggatcactccattagatgcaagacaatcatactgacctttcagattaattaagttgtatattctcagatttttcaggcccatagacagttgacagccagtcagccactgaaaaagtacactattactagcttagtttttcttttcctacttctacttgacagattaagtcttgttttttactatatgcttttaacatctatttttggaataatagttagctgccttaggatgtaagccactagtagttttccttaggatgtaagccactcctagtttcttaggatgtaagccactagcctataccttatggtgtaagccactagcctatatatatgtttccaaccagccatggttgatagagtggagaatagaaattaaaactagccccaaacctgtgttccttttgctaacactacttggtcagtgtactacttaacatttttatataaataatatcgtggttgtgattgggcatctactggaaaagaactggtaggtcaatgaatccattacggtgcttgtgttgcagggatagttctctcgtgttgcactccaggtgtttgtagttttgccttacggaagagtagtttcagttctgctccatggcttgcagtggttgattactaggggttgatcactagaggtgtgattcatgcttgtcagtactggtaagaaaattcacatattcctgtcatcctgtgtttagtgaggacttcttcttcatctattacttccactgatcagtcttcaattttgggcaagctt

SEQ ID NO: 90978 - DNA, 630 bp, Oryza sativa
gattttatgttatcaggttatcatttacatcggcctgttcaaatttttaggatcatgggattttccttcatggtatttgtgctatggtctcctgttgtgattcctctactgccaacacttgtacaaagttggacaataagttcttcaacaggaattgttggatatgcttgcattgttggactgtatgtgtctataatgatacttgtcatattgtggggtaaaagaatacgtggctacgaaaatccagttgagcaatatgggatgaatcttgcatctgtatcaagggtatgaactgtcttgcctgtgtaacactaggtctttgtataataaagatttgtgtaatgttcccgtcacatatataataacttgcatatttcatttggttgcaggtacaagaatttttgcaaggtcttgctggaggtataactgttgttggattggtgcattcagtaagcattttacttggctttgcagctcttcgtgcagggtcatattcattcgtgactaggccacttgatcttctcaagtcttctagtaatgtactattgctagctctcagaggatttgtcacagcaactagtattgctgtggtggaagaagtacctttcagatcatggcttccagaagaac

SEQ ID NO: 90979 - DNA, 871 bp, Oryza sativa
ctgcagcccacattgcccgagacgacatacgaagcaaagcaggttctgtgtccactggggttagaggtccgtagaattcacgcttgtcccaacgactgcatattgtaccacaagcaatatgcggacttggatgcttgtcctgtttgcaaggcttctcgatacaagcgaaagaaaagtgctgacgaaggaaataagtcaaagaggggtggtccagcaaaggttgtgtggtatctacctatcattgatcgtttcaagagaatctttgccaacccgaacaaagcgaagttagtacgttggcacgccatggaaagaaggaatgatggtatgcttagacacccagcggattcgattgaatggaggaatatagatcaaaaacacaaagactttgctgccgaccctagaaacatgaggatatgtctttgtacggatggcatgaatcctttcggtgacatgagtagtactcacagcactttgccagttcttattgcgaactataacctgccgccatagttatgctttaaacagaaatatattatgttgtgcttgttaatccaaggtctaaggcaacccggcaatgatatcgatgtattcctggagcctgttatcgacgatctggagattctttggaaagaaggtgtggaaacttgggatgcatatggtcaggagaacttcaagctaagagttctattgttctgcaccattaatgactaccctgcactcggtaatctttccggacaaactataaaaggaaagaaggcatgctccgattgcaaggaacatacacgaagccggtggctgaagaaatcacgaaagatggtatacatgggtcaccggaggtggctcccgctacgttacacatttagaagaaaga

SEQ ID NO: 90980 - DNA, 515 bp, Oryza sativa
ccattcgtccagccaagtcgcttcaatgcatctaaactgaaatttcctcgttttgattgtaaaatttcagtcacagaagttgttagcttcccgcgcacatcttcgggtacagcttcttctagagctttcacaagagtctcaccttgttcaaccgctaccagaaccttatggccaaaaaacaatatattagcatattgacttatgcctcacaaggccatagcgagcagattatgcgacatgactattccaaggggaaaaaaagcatacctttagcttcaaaacaaaaaaatgtgttgtcttatttaggatggggtttttttttggcacatatgcaagtaattttgacatgtgacatagaaaagttgcagtagtcaacccaaatctatcacaggagagatctccagatgttagaagcatctatacactatgcagattcattttaaatgaaaagagacatatctcaagtttattatcagatgtacaaatatttagtttggtcatagtaagctcaagtg

SEQ ID NO: 90981 - DNA, 1131 bp, Oryza sativa
cggtggcggctataggggcggcggtgcacggccggaggcggcggcaagcggcggcgctagcggcgaacggcgcggcggcgttagagagcacgggaggagacggctagcgcggaaaaagagagagagagagagagagacatggggagcgttttataggggctcgggaggggcggacgtggccgggggcggccggatttctcgccgacgacgtgtgaggtggagagagagagttggggggattcgaattgaatctcgccctttcgggcgcgcgcgtgggcgggagaaggcggggcgtgggggcggcgatgtgggggacgtgtgggcgcggagtggggcgcggatgtggaggaagcggcggcgtgggcggcggtttcggcggcggcgctgccgtcggctagaggtggaagaaggggccgacaggtgggccccacctgtcggtgacccgtagagaggagggagggagtgggccggcccagcaaggaggaagggcgtgggaggaagtgggccgacggcccaacaagaggaaaaagggaggaaaaaggaagaaacagaagagaaaaggaaaaaaaaggattttccagggattatttattgcactttgcttattttaattggttaaaattatttccaaggctctgaaaattccactgaaaatcctgttagcatattttgacatgtagaacccaagaaaaattccacatgccaattcctattattatttgcatttattaatttagggattcaactctaggttaaattaaacaatttcttcggacgatttatttaacaaattttaaagcaaggaggggaacttcagggcgtgacaggccccttaggaacaatgagacaaaaggggtttatacaggttcgggccgctaagaagcataacaccctactcatgttcttggttgattgagtatggaatacaggcacttgaatctgtgagacccaagcgtgagctagccaaataaccgatccctcccctttctccctaagcaaggtcctccttttatatctcaaggggctaccacatgggcctaaaagtctacctagggatcaaggaggacattctttacattaactacatgtcttgtttcttgacttggaatccacatgcacaagcgcggtagc

SEQ ID NO: 90982 - DNA, 536 bp, Oryza sativa
  unsure (1)..(536): unsure at all n locations
tcatgaagtgttaatccgtctgaagtataaatgctacggtacctgaaaccacaaatatcctccatttatgaacaaaacaccaagatccctttttgagtaaaaaatatttcaaacgcctctatatataatgatgatgcttacggttgccgtcttctccccattccaacatgcttttcaaattgtgaaggagtatactgcacctcaaaagaggaaaaaaaaaacgtgnnnnnnnnnnnnnnnnnnnnaagaaaggcctcagatcaaacttgggcaattgctaagtttgggacagatacctcaatactgcaacattcacagattatacctgtcccaagtttatatccttgctttagaacctacaagacagggaagtgtgaatgttcctgagagttgttacaatttctggtgttgggaaaggataatgtagttcatttaactatttagaggacctctccgttcttcaacttgtaagttaacaaagtatagtctggaaggcccccctccttgaagagcatcgggtgcaaagtgttatctct

SEQ ID NO: 90983 - DNA, 1031 bp, Oryza sativa
tgcgaattcggttccctacgcgacagcgcagcccaaaggactgggcgatctcccacaggaagttagccaccctgtagaatgcgtgcattgcgccatgcgctccccgctacccgaggcaccgtttttccatgtccgccagttcttctgccccatccgcgccggatgcgcgcacccagtttctcgacctgctgaacgccgccctgcatggcaataccctggtcaaactggtattggcgcgccatgtcggtgccgaccagaccttgcaacggatcattgctaagccgctgcaggtcaagggccagccgtgcctgtcgctggtctatcgccaccagacccgtgacatcacccgcaatctggcgctggagcaggcccaggcgctggtcgccgagctgctaccggacagcttccgcaacgcgcacctgttcgatgccgacggtgaagtgcagttgaccttcagcaagaagggcaagcccagctccagcgccacggcgcacaggcgccacgcgaagctgccagcagcagcggccatgaccgcgagaagaagcgctatctggagctttcacggccgttcctgcgtgacctcggggttactgacgcacaaggcgcgctgataccgtcgatgtcgcgcaagtggaagcagatcaacaagttcatcgaagtcttcgaccacgccctggccagtgcaccggtgccggcggagcaggcgctacgggtggccgacttcggctcaggcaagggctacctgacctttgccatgcacgactacctgcgcaatagcctgggccgcgaagcgcaggtaaccggcgtcgagctgcgccaggacatggtcgacctgtgcaacgccgccgccttgcgcctggagcacccgggcctggagttccagtgtggtgacgtgcgtagcgtggtgcccgaggccatcgaagtgatgattgccctgcatgcctgcgacatcgccaccgactacgccatccacaccggcattcgctgcaacgccgcgatcatcatggctcgcggtgtaccacagcagatcc

SEQ ID NO: 90984 - DNA, 1157 bp, Oryza sativa
catcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcctacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgctgatgctagtccatctggacaggcaagtgatggtaggcgaccaactggtgaaggaacaacaagcaggcgcgcaaggccaaggcgtcgtcgcgcagcaggcgattccatggtgtaacaatgctttcgatttaggaaataaaatgatgtaatgagtgttcggactaaatacttctatcgtgtaatttcaattcaatcttgttgtactgagtacctccgactattgttgtactagtagtattgcgaactattcggtgtttgtctcgtaatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttgaactcaactttgctttgttttgcacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctccgacactgcagg

SEQ ID NO: 90985 - DNA, 2675 bp, Oryza sativa
cgggcacgctgggacttcccggctggtccactacgcacgggccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggacgaccagtggtggacagcgcaccctacggggttggtcgcagcgcgcagtggccagaggacggtcccacgatggggacttactggtgtcgacgtggggttagtgcaacttcgctgcgttataagtttatcagtcatcttctttttttttccttcacataacatgtctaattccgatcatgtttattgcagcgtcgttacgctcacgtccaggtgaaacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcccccctgccgaccactcgtatgttcggattgttcatttctaaatttttatgataattacatcatcgagccatacaatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttccaacaattatgtcatttatcttgcataatataggacaactactgaattttttatttccatcttgcataggctgatgcggcacgggatatcagtgccgatatcaccgcagtccaggtgaggttgagcagaggtttgcacttgactgacgttgagcagaggtcgaccttcgaccggatgcaggagaagatgcgtgcggtcatgcgcgtcttctcctgtcgcagcgccgtggacgtcgtacctccagctggtccggtacacccacggcctcgcggtcctaccgtcggagcaggacctcgtttgtcttcgagcgcccctagcttcggagcagtgcgacctacagcaccggtttcgcacggtacagttcagcccagatattagttcatttttgtttcagcttttgcacgaatgtgtcaccatgatttaactgcacgtttcctcatcgcaggacctcgtatgccttcgagcgcgttcgcaggcacgaccggcgcttccgcgagctccgcaggggcgttcgccacctcttcgggcgcgttcgccagctcttcctctcacggagcgtcgatccctcacccacacggtactttactttttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccaggacgtactaggctcctctcagcttggaggagctccagaggcgcacactcaggagcagccagaggtcacacctgtacaggcaggacgggttggccgtgccgtacccccagaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacgtagttcttttcattcgtattgtgctcgaacaacttatgctcacaacaacacactttcggcgcttcacggtagtgccatatccagtagcgcgcacagtccacaacagcacacatgaaaatggaagcctattaattggtaatacgtaatctacaattgagattatgtacaacattcttcactacaattttacattttggcagcaaaccaaatatgatcaaatgcaattttaccttaccaaatatttggtagtgccaaaacttgcttatattttggcactaacaaaatatttgtacggtaacattccaaatatgccctaaaaaataataaaattgtattttaccagtcttggagattttaatcttgtatagttttcaatataaaaagatttgataactattgatatttatataaaaaaaatatagagcacagtgcaaaatcgccctagcggagggcggcaagggggccgcctgcaaaattccatgccccctcgccgcccatttgcaggcggccccccgcacagtgcaaaatcgccctagcggagggcggcaagggggccgcctgcaaaattccctg

SEQ ID NO: 90986 - DNA, 3421 bp, Oryza sativa
tggaagaattttactcaactgcataatattggcaaggaatgaaaatgatgagctagtgttgggttgagatgatcaagagatactaccatttgttgagaaaccacttgtatataggaattcgaatttgggatcaaggaatggtagttggctttggtagcaaggatcaacttgtatttctaaaaatagatcatgatttcagcaccatcctcattaatgctaaggtataacgtttcagcgccaccaatattagcgttgacatatagttggacatggcatgatttgctaggtcaaaagatgctcagcgacatatctcttggtgttgatctctttatcatctagaaaacaaaaaacagcttatggaaattatcaattgaagctagccaagtggtaggtatagaaatgtgatgtttctatctagaggacaagggttcgattccctacacctttttttatttgttttgaaagttcacgtgctttgaaaaattaattaatttcttttatagttttgaaactagtcacttttattcatttcaaaatgcaaacatataattattgagcgaaataatttcatcaagattaacaatataatttaaattctcgaatttgttggcttcaaatttaacataatactaatttacaatcaaaacctatgtttttttggaaataaaaataaaacaagcattctaagaaaaatcctgaaaaaggtcattcccctcttgaaacaaagccatcttcggttttggattaatttaaggttgttcctttttcttctttacaacaagaaataccactgacttgatagcactatcatgcactggttttagcacgtgtttaacaccacgatgtataaaagaattgtaattagtctggccctcgtgtgttgcattaagatcaaattgccatggtcttcccaaaagcaagtgacaagcattcatcggcaccacatcacattctactttatcaacatagctcccaatagaaaatgtaactctcaccttatgagtaattttaagcgtgcttgcttgattcatccattgaatataacgcggcgtaggaagcctttgcatagataaagataaagcatgcaccaaatctgagctgaaaactaccaccatcaattatcaatttgcataccttgtcttgaattttgcgctctgactggaaaatattgtagcgctgcccctttgcatcaacattagagccatctcattgtactgcgcgtgcaagcatagataaaccattcttttgttcggcaccatcatccatagatgaatcatcaatatctcgaaaccctgcagttagaatatgatcaagctgtacaccttctgaatttcctaataaactctcagaaacatagccttctttagtcatcaacaccttcttccaattatgacaatctctcatataatgtccaactatatgtcaacgctaatattggtggcactgaaacattataccttagcgtcaatggggatggtgctaaaatcatgatttatttttagaaatagtttttggcaatgtttattgttgaaataagttctataagggcatgtacaatggaggccacaagcaccagtggtctcaaaacgccacgtaggatagaaccacacaaaggtacccacggtggaaaccactccaaaacatattttgcatgtcagcccctatctatttatatgccagaccttgtagatatcttattatcaaacctattaaaactttatattttgaacccgatagtaaccaaaagaagtatatgtacatcctcaaacacattgcgacccactgtcagcctcttcccatccccctcgcttttttattcccccctctcaatctctctctctctctctcttcgatttcttctccaccgagagcctctccgccatcgctttcttcccttctcccctcccctctctggcgcgatttcgccggctgctcccctcccctttccggcgtgagctcgccggcttctcccctcctctcttaggcgcgagctcgccagctttgccccttccttctctggcacgagctcggcggcggggagcagcggtggcagcggatctagcgccggggggagcagcagtggcgccggcgatgtgctgtcgacgacgcgcgcctgctggcccatggggacgacggtggggacgaggaagacggcgaagcggcacgagtctggcctccgtaccggcggtgacggatctggcggcagccaggggcggagccaaacgaaaatgaaggggggtgcctgctttcatcgtttttagcgtcatatacagttgtattactaaatacttgtttacccaataacaatagagaagccaagtaataatatttttgttaagtagataaaaagtcagaaattgtgtacctattctttgtcaaattaattttcagcaaagaataagtcatgaaatgatttgatataaataaaaataagtatcttctttatcaaatttgcaggtcgttgtcaaattctctaaatagtttcttcttaccatgtatcttacgttaggatggtaatcatcaataagcctagatcatattccatcatctcttctcacttggtaatcattcagtacagtagaagggctgaacttccaacattgttagtataatctagtacttatcatttaagatatttcttcatagcaacctattcaagaccaaataaatttgttttcaagatttatgttcgtgcaaatgatgagacttgagagaaagagcacacatgagggacgggactataggaggcaggttgctcctatatacacaggtggcaagctccagctgttgatggcttgccgtcgtcggctatctgtcctctacatctctgcaactgggagccctagcttgatcaaggcgtgtgccacataatgaaaaaattgggagcagggaggaaacggaaggggaggagggctgaccttccgattgggggcttaccggcgggcataggagtgtcacggcagcgacgagcgagaaagattgaggagtcgcctcagagaagaaatggcgtcacggaaggaagacgaatcgataccgctgactgcgtcgtacgttgtgcaaggcttctagggaaagcggtggctgttccccagtattgggccggggggtgcctctatggtggagataggaggggataacttgtttcatattttgtgccgggttcctgggcaacccctgggtttattgggctccgcccctagcggcagcggggagcagcgacaacgaccacagcggcagcggcggatctgacaaggcgacgtgagcagcgacgacgaccatggtgagatggggatttggggtaggtgcacgaggggactggatgaggcgacgctcggggctccgactcctccaacgcgaggcttcggctcgtggcttcgcggctccccagcccaggtgtggcgctttgagcggttcctctgca

SEQ ID NO: 90987 - DNA, 667 bp, Oryza sativa
attcctgcagccctgacccggaccgacggatgccgcgacgcccacgccgcggccacgactccggtgccgcaggcgaagtcgatcgcgccgtcgacggggtcggggaggtgcgcgaggaggagacgcgtgccgatgtcgatcgacgcaccggcgaagacgccgcccaacgcgcgcacctcgaggccgtcaacggtcgcggcctccggctgcgggtcggcgccgtcgtgcggaccgcgggcgaccagcacgcgcgacttctgccgcgcgtgcgtgacgtcgacgcgcgtgaagtgctcgcgcagcacgtcgttcatcgtgggcgtcatgtacttcagccgcccgccggcgaacaccacgacgtcggggtgcgcgtgcgcggcgatgagcccggcgatgtcgtggagcgcgcgcagggcgcgggggagacggagcaggacgacgcgcgcgtcgcggacgagctcggcatccaggtcgtggtgcgtgaaggttccgtcgagcccggcgcggtcggcgttggcggagagggcctgctcaccggtcagggcgtcctgatggacccggatgccacgcgccccggccgcggctgcgccgagggtgagggcgccgtacgcgtcgtcgatgacgacgagtccgccgtcggggacgtccgcccgcgcggcggctgatt

SEQ ID NO: 90988 - DNA, 1928 bp, Oryza sativa
attcctgcagcccgaaaagaaaagaaaagaagagaaaatagttaagtagggtatctccggtttgaacgcggcgcgcggccaaatgcggaatcatacaattctttactccttccttaaatccgttggtttcgtttccgttgtttatgcctcggaagccgcatgcatctccttaaatcttcttcttggccggcatccgccatccctagaaaacaactcacgaagaacgtggccatgcccatgccagctttgattgatgagtagtggagtacactggactggactggactgaaggagtagttgttgattgataccgatttgtctactccaccacatgatcagcacgagctagacaggcaggcacaattagctgggaatgcgactcgatcctcgtttcacgcagtccatcaaggagaaaaataaaagcactatcttgcttttggctattttccttccttccagcaatatataccttgaagcatatgtagagaacatgtcccatgtgaacaggtatgttacactcttctctgtaagggcattaccttatgttatagttaaaggttgactctatttttcctttgctcttgctttctatctctgtaaatttaatgtaaatatcttgagcacgtgtaaagcaagctcttgtattagagctaacactttttctcttttttctatataagtttatatttgacttatagcctaccacttcactatctttgctctaaaagaaaataaactaatgtctactccatctgtcccaaaaaaaaatcaacctacgtggacatattcttttttgggacggagggattactacttccaccccccactaaaccaaaaaaaaaagataaattaggaggagatatgatactccatccattccaaattgatatacatatagtttttttaggttattcctaaatgatctacatatttgtgttcatttattgagtctattcgttatttgtgtattggagtaaatggacattgatgcatgcatccatgcacacaagcatttataacccacatgtaatatcttgatttgttattggctagaaaatattgggaatggtgcatgcattgagtttgttgctagaataaatatagtatgaaagagttattagcttttttggttttggtgtacctataaaatatgtagatcaatttggaatggagggagtacctcttaatgagaatgtgactcatcctaatacaaccaaccaacaaatttggacggtattttttgaacggatggagtagttagaaaaaaaataaagtaaagatttttgctcttctttttcccctcatgtcaggtgaggtgtacagtagtcggcgtctcataagcagaggcgggcaggagcagtgtgtgtgagtgcgaccatcacttatctcttctctaatggtgtagcggcacggcccggcacggcacggctactgtagcggcacggcccggcacggcccgcggcacggcacggcccgtttcgccggcggcccgtcaggccgaaagcgccacgtgggcgggcggcggtcgaatgggaaggcgccacgtggcacactaacggctatttgaccgttcaaatttgaaaataaccgttgggaggctaaaaaattcataaaaatttcgaaaaaattccaaaaaatctcaaatttcgccccgaacggcccgtgggccgcaggcgtgccgtgccggcacggcacggcccggccatccacgggccgtgcttgggccggcggctcggcacgtgggccggcacggcacggcccgtttcatcagccgtgcctaacgggccgtgccgaaacgggccgtgccggacccgtgcccgtgccgggccgggccgtgccgcctgtttggacacctatataccagagtcgtggggcttgccttcactcacaaaacccccccccccccttggaccttggtttgttacctt

SEQ ID NO: 90989 - DNA, 4944 bp, Oryza sativa
atgaattgttttaattcaactttaccttttatacgtgtcctcaagccagatatacatgatggtaatgctagactgctagctgtaacttattgataagaaaatattcaacaatcatcaaaagatttcggagtgttccagttgagtttgatgtcgtgatacaaaatttaccttgttatgatgtggctaccatttatcaaattgccgagatagcaaaggtctggcaaaatgtcaaagaaatcaaccagacctagtcctcgaagacagaaaaattttaagggaaacattataaagtaattggcgtcaaaccgaacagtatacagtttaaaatcaatggaactatggaagcattcaactcgacaactatacggtttgattctgacgacaaaaacgagcatctccattcttgcttaattctgacgtaaaaccagatccaagactagaagcaccaaaacatatcttcgtaaattacttatgtactgagcaaacaaggcaaaatactccagtctatggatttaagcacaacggatgaatcattctacactataacaaagcaaaagaaatgggaaaaacaatcgtagctccaaaacgcaaatctgtacacactgcctacactgagctcattaatctcacagcaaattacccaccaaagaatgaaaagaacccagctttcttcttgggcctctcctgctcctctaccataactgctgtcattgcatctctttccaccaaccgccaagtcgcctgctccagagcaagaccagctggtgtgggtgggtcgttcagaaccaacggcacacctctatttgtactccggatcacctccgcgtcctctggcacaacacctagcaaaggcaagccaagcatttcttgaacatcaagtgctgacatcatatcctctcccttcaccaggtctgggcgtactcggttgacaataatcttaatgtctttgatgccgtcacactccaatagccctgcaacacggtcagcatcacggagagccgtaatgtcaggggtagtaacaagcacggcctcttctgcaggggcaatagcagtgacaaaccctgcatcaacacctacaaagaaaaatctgatttaagcaatctggcataacatatgtggatgcatatataactggttataatctaacattattatcaggcaactgcagataatatttgtggcactggaattgatcaaatcagtggtgacaattgcagtgctctaacttattatctgtgaacatgggatagtgaatacagcactatagagatagaaaaggagaaggttccttcttttttaagaaagagaggatgacattcccatttcattaaggaaatgtaatagacgtttaaccagtgattacaaagccaaaaggaacctattaccatttcaccggtgccatgtcctaagcaaaggataaagctaagtcttgcaacattttcacttaacagaccagcactaaaaggtgaaggttcataattatatattgacatgacagaattatgctgcagttagttatggatggtcaatcactcaatcagtggggttgaaatttacagctcacaaccaaattaaacaaactgatgcctggcctaaacaacacctatatgtggcaggtaagaaaacaaaatcttaagttacaatgatcaaaggataacttgatatggctctaaaatctaaaatagaaaataggtaatatgcataaatggattgactttgagaatataagttgcatcacggttatgcactggcatcataaaaagtttgacttgcatcatggctcttaaagttacaattctgggcaatagatagggatgggcaagcgagaacaagataaacatcacaattattaattgcgttaaagcaaatcgagtggcatataacatccatcatcataagttgatggaaatggtggtggggcggactgacctgcagggcagtcgatgaggatgaaagcgggtgggttggcggcgcggcgaagcgcgtcagcgacccaggtgagggtcttggagccgaaggcgaggggcagcttggagcggggcttggagaggcagagcagctgcaggtcatggagcgcgcggtggcggacgagggcctggtcgaggcggcagtccccagcgagcacgtcggcggcggtgaggtggacgcggttctcgaggccgaggaggaggtccagattgcgcaggcccgcgtcggcgtcgacggcgacggcggagagggagaggcgtgcgagggaggcggcgagattggccgtggtggtggtcttacccacgccgcccttgccggaggtgaccaccaccacgcgcggggtgggaccggacagctcaggcgcggtgcggccgccgtggcgcgcgggggaggaggccggcggggggcaccgggaaggtaggaggaggcgcggggcgaacgccattggagttagggttagggttggggttctcttctcttcaagcggagatcctcaggaaggaaggaaggtgggtagtggaggtggtagcggtgtccgctttggctgctactctacttgcctagtactagcatcgtttaggcctagaaatgagaaacttcccaacattttaagcccatgaattgtttgctccctaccaaaataaacccacttataatatattctaaaataaaccaacttagaataacatgatatcctattctagatttatttaatttgaaaaatgttaccattgaattttgcatatatacgagtagaagaaaataaatcatcatacattgtactccctctgtcctattttaaatgttttttttttaccattcgaaggagggaatcaggaaaatgggtgaaagccccctacaatggcatcgcatgtcagtggtagtgactactccaccacaactgtttagtatagatatataattttgttaaaaattttgtaaaagaacaaatcctagcaaaataaatggtaattacatacatacgtgcaaaaatcatatatttgcaaaagtcatatattaaaagaaggattgatataaattgtttggttaaaaaaacagatagcttagtataggaaaataccaatgttatacactatttttctaacatgtcatgttctgagtggttgatctttctgcggcgactccttatcctgaactactactccgttaaaaaaaaacaaattcctagctacgaatcaaggttcattggtaggattggtctcttttttttttttgaaaacggagggggtaaatgcttaaataccagagaatcgttacatggatagcattttatcctagaaactaaattaaacataaaatgctactgtagctaaaagaaaaggtgaggccagggaaacacttccaaatgtgtctgtcaatctggtactttcttttgcagaatagtatttatacagaaactgaaaacaacagataggcaggcagacagacacaatgcagaggtggctgctacggtgatggacctcacccaatattcgttgggttccccactttcacaacagatcactccagatcaccaacccattcataacttctccatatttatatgcaaatgcaaccaacccccaccaccagtgaatcatcaggtaccttatcgcagccaaacgattgtattgatggtaaacgctaacccaagctcattgacacaggtacatagcggtatggcatgggtaaagagtactatttgacgcaagtacagcaaaccgtttctgggtccttcatactgcataagcaatcacacgcatccatctatctgtatctcaagttcatgtcaagctcgggcccgtacatgccgccaggtacatgaccagccattgctgggtgcatctgcttggatctggctgtaagctccatctggagaaacctttcaaaggcatctgggtgattgcctctcagttctggacctgatggacctaaaatcgaaaaacgaaagaacagaaatcaaacatgtggtccaaattggtatacaggtaaattcagggtaaaaaccaaacctatttggttgacaaacaatggtaatgtagtcctaacaatgaacgaatcgagaaaatgttccccttaaaaagtgatttcaaggaaataatagaaagcccgttccatatagagaataaaacaattggtatagacaagaataacgaaaaaaaagtacttggcatgttaagctcaaggaaagcagaagcacacaattataccacaattcatattcccaaaccttagtgccatataattcagattagagattttgtctatgtgaattagtgaattctgtagttttcagtcatggatgtcacatttgggacacatatattatcttgtcacctgtagcaggcctgcttctgcaatctcacctttgtaaactgtgacaacataaatttgcaaatacacacaacatataatatcagcttgcagaggctttctaacctgccatcatcaatccaaattctccatagttgggctggcgagggtgcatatggaagttatttacattgctcatctcaggcctataaccaggcatgtgatgcacaggctgagatggcggaacacctctttgcaggccttctggtggaaaatttccaggtgtggagatgtgctgcatcataagatgatgagcagctgggtctacatgaggagcccgaggagcatgaagagattgttgcataggattcatgttcgatgaaaaggaacggtgaggatcatgctgtatcgcttgtgtcatgtcaaacggggtttgctgattcctattaccaatgtgatccatcataggacgaggagccagtgcaggtggtctaccttgtagaagatgataaagattttgagattcagcctgataacgccgttcatgagaatgggatcccagcgcatcaggaccaagtacttgaacatgttctgaatcaccaggcactagactttgaagcctataattaagatcatcaactgccttttctggtagtagcccct

SEQ ID NO: 90990 - DNA, 2798 bp, Oryza sativa
gcaggtatgaagagtgaacagatcagacatacagaaaatctacggttattaccatttgctaacaatgcaagaccacaaaagtcattccttcttaaagacagaaatcagtgtttctaacaagtaaaaaaaaagaagctcaagaaccatctgcattttacacaacaaagttgacagaattgcaaactgcaaactgcaaagcttagttaacgtcagaatttgtttgcattgacaagattatgttggatcatgtaagtcataaggatagaccattttttattggtttaataattcttaaattaaataaatatctaatgcttgtatgtacagaaatcagagtgccatacaaaagggacatctgcacagataggaaattaagagtgagcatacgcaaacaaatttgttgtcatacctcaacatatggtggcaaatcagttccaccttttgacaatgcactgccaaagaattgttccaagattgagattgaatggtccttcctaacagaaccaatatttttagactttccttcgttttcaatagaatacttatccattgcatcaccttcccagtctccacttcctttcagaatgctcgatgcaaattcagctgaatatgtaacacctccagatggaagtgtgtgttgtttacctacactagcaatgttatcaggaatgcccttctctttatttttgcttgctgtgatctctgatgctgactggttaccctctacaaggccaccaaattgtgctgtagccaatatgttaccctcactagttgcatcaataacctacaaagtacaaagtcaattaaggagcaatctagcattgctgcataatagatttgttatatccctttgctaagcaaatgacacactagcatcagtagaacattgtgccttccatcctgatagcaaatcaatctagtaatgtcaaaatcagaatttatcaatctagtaaagcttccgttagatagagcataatgatctgaagatacaacatataacatcatcttaaaaaggtggtagcaactgtatgttatgaaattgttcgtttagctactcaaataatgtcatgatctgcacctttggttcaagagagatgttggacgattgtggctgaagctttttctccacaaaggcatttgaaaaaccaggcggcacaagtggtctggcagtggaagctgatagaactgaagaggttttagtggtatcttcttgataagctgaggaaattgcagatccatctggcttctcacttttagctgtggttgctgtcctttcggagggagtctgtaacagtgaaatgatatcatgaccggagttttctttctcaatctcaggaccattcttcttttcttgaagggctttatgttgctctttcctcatcatttcaaacgatgctgcacagaagggtaatatgagacactgaaaatgaatccagctaaaaaattagatgccatatgttgcatgaagagggactaaccccttcgtttcctttcttcctctgctctatcctcatttgaaaattcagaagacccaaatgtttcatcgttcattgcgtcaatatctttccgtggaaaaggcgcagcctggtaacagcgttaaatttcatcatcagaaactaatgtgcaaaaggttgatgatcctgatccacacaggagaggaaggaaagaaacatgtgtagaaccttgggacgaggtggttggtagcgttcagatgtcctgtttggctgatacgtattcccacgatccttggatgccacttgccctccatatccaggtggtctagggagaacgccacttcccagcaggccatcatgctcttgattctgccaattgcgcctgtattggttcccattacgcctatctgcattgagagcgttattaaaaccacagatgtagaaagtgaagaagtcagcatgcctactgctatgcccgtggatacacggggaaatgtactatgcatctaactaataaacaatatggcggtgcagttaacatacatttaacagtgtactaatattctgaatggcaagtttagaagtaaaaaaacaaattaccattttggggagaacatagttaccatggtcatgctgaataacgtttcactaaccttgtttgcacaggctactgaagctaacccacaaaagaggaagtaagagaacatatagaacagtgccgaaaatggtaaaaattcacgtaccctgcattgatgagtcacggtcaggcaaatctccgtcgcggtcacttgaaccagaggagcgtgtttcccaccttccccctgagctcccgccatgagaagaataagaatagggacctgagccgtcggacctccccaggggtgtagtgtagtagcctttgttcctgtcaagcacgccagcggacatctcctgcagatcactgctcgacgacaaaaaatagagatatgaggagaggaaggcgacgtatagaaaggtggcgcgcaagcgatacacgacaaggctacaacctgagaagtgaggcatcaaagccctggggcagcttcttgcagcggtcggtctctccaacggagatcataaagtccctggagtaactgatcctcatgttgcgcctgtgagagatggacacatgagcatggcgacgaacaggatctatagatgctagtagcttattaaagtagcaataagagaaaggcatatagagagagatatactgacttgggcggctctggctctgggggctcggagctcatcttcaacagcaacagcaggtgcaggtgcaggagcaggaagagtggagaggtgtagaggtaaatgtaacaagta

SEQ ID NO: 90991 - DNA, 1451 bp, Oryza sativa
attcttcaagacaaaacaaggatgcaacttgcaatatatcctgatgagtgaaagatggtgaaatggatgtcacctgtcaataaaggcacatcacattcaaatggactgttcattgttgatggccttttccaaaaactagaaaagaaaaatctgccagtgaagaagaaaagtcacagcgttgcggtacaccttaattgcaaactggttgatgcaaaccataacagtgaacaaagcctatcatgtgcaatagcaatacaattatccagtgacattttccttgtgttttccccagaaatgtgtttccacaggaagaaccttgatggagtgactagagaggaaagaaagagccaaaaataaaagagaactactctgtatattagatcagagatgtgcacaaaagaaagacgtgcggttatgaacagttgaatcacaaggttgggggcttgcactcttgagcactcccaattttgtcattgccatacaaattgtacaagcatgccatggagcatgaattctcccaggcaagaaataattacccaattactactactagtgctaacatatcacaagcagctttggtttgatcaatttacccaaagctgaaaatattcaagatcaatgaacaccaaacatttgtagtacaagtgtaccaggcagaggcagctagcatcgccacgctgacaccgagacgagctccgaccgctgccaccacagcgccagcgccgcctgccgcttctccacatggaacccatggctggccgtgcgcctcagcaggcattccgcctgcgcctccgccgcattgctcacctgcagcgccgcaaaccccgcggacgccaacatggactgcaacggcggaggcagcttgtcgccgccgccgaccgcgaggcgctccacccgtggccgcaggacgaactgctccaccttggacaccacgtccggcgacgcgcccgccgcgtccagagactccagcagcgccgcgcaagactgcaggaggttgagggcgccgcgctcgcacccgtggtcgacgcacaccacaacggcggggcggagctccttcacgacacggaggtgcgcgggcgccggcgagaaggccccggagccggccgtgagatggacggccaccgcttcgtcgggcgcggccgagagtcccaagggcggggacgcgctgctgagggggtcgaacacgagggcggtgaactcgaacgggatgccgagctcggcggcgaagcgcgtgaggctctcgttggtgaggtggagctcgagtgggtggctggaccccggcgacaccaatgcggtcaccttgaggttcggcggcggcccagcagcgcggcgccagtggtgcgcgagctcctgcatgagaggcggccaatgggcaccgaagccgacgtcgaagtcgaggaggtggaggcggcgcgcggagccgagcgcgtcgaggaaggcctgcgtggatg

SEQ ID NO: 90992 - DNA, 2437 bp, Oryza sativa
gggagccggggacagctcggtggcgctgtggtcgagcatcagcgtgggggggatgccggtgctggcgcacctgcagaagaaccaccggtcggcggcgacggcgaagaagttcgacgaggcggcgctggaggggatccggcgggcggtggtggggagcgcgtacgaggtgatcaagctcaaggggtacacgtcgtgggccatcggctactccgtcgccagcatcgcctggtcgctgctccgtgaccagcgccgcatccacccggtctccgtcctcgccaagggccttgtccgtggcgtccccgccgaccgcgagctcttcctcagcctgcccgctcgcctcggccgcgccggcgtgcttggcgtcgccgccgagctggtgctcaccgacgaggaggagaggaggcttcgcatctccgccgaaaccctctggggatactgccacgccctcggcctctaaattcattaattactacgccaacccgtttatatatgcccatatatatatgattaataatcgtcgtgctaatgcctatcgatcgatattatgcatcatcgtatatgtcggtcgatcgaagcttaatttcatggccgcccgggttgtaataagctactattctcattgtgtgattaattagctctatttctctgattgagctaattatgtgtaactgtatacacattgtgttcaaacaataatggaatgaataaaattgattgagacaaatatatgtacaatatatatatagtactgctcaacgtaacgtgtcttgtttactattgtcatcagtattcaatttgtcagacaattaactataagttttatcatcaatcatcatagaaatatgtgcttgtggcttctgacctagcttgtcgaatgaagtttaaaacaaagtgcatgcaagctagctgcgcagcggatatggagggcactactactacgtactcaatcgtatcgatcactactacctccgttctaaaatatagtaacattttttttttattttacgtaaaagttaaagactgtaccttgtaatcatcattatattaatgatggtcaagtgtgagaggtaaatagccgaaacacagtggagaacagaaaagagtggtacagattgcacgtcaatatattaaaagaaaagaatatttgatcatccgtcttatttgaaatttctttaaaaaatataaaaacataagtcatacataaggtattattcatgttttatcatctcataacaataaagatactaattataaaaaaattaaataagatagacaattaaagttaaacacgaaaactcatggttgtgcttaaaatgatacggaggtaatgcatgcatatagtacataccatgatgagtacagtatatatatatatggtattatctccgtcctaaaatataataattttttgtttatccagattaatagctaaaaatacttatattttaaaacggatggagtacttaattagtacacgaagaattacatgatgaagctgtaggcaggtcacatcactcgtgtatatacgtatctatgtgcaaccatgagcactcacagtactgactcacgctcgcacgttttgtacgtatacctacctactacagtagctctctgcaaacttaattttattacaccaattaacaccactagtaacagaatatgccataggtgccggtttgcaagtgtctataggttccggatttccatccggcaccaattagtcagcaccaatagcaaaacccggcacctatgcaaaaatagaaccggcacctataagttcacacgagccaaaaaaaaaaaaagaggaaagagccggctcgaatcgcgccgagctcaccaactgcgtcaccacgccccgccccacatcgattgctcccggcaaattcatccacaaattcacaaaaaatcatccacaaccacacaaccatactccatgttcatcaccgccctactcgatccccttcatcaccgcctctcggatccgagatcaactccaacagcaaactactatatttatcaagaactagtaaaatactacaaagattaatgaactcatgcgggaactcaagaacactcaagaaccttcgtccttctcccttgggttgcctccggccttcttccccttgagatctgccgctatggcacggccgccgccgctgtggtgcgccgcagctgcctcctccaggcagccgccggccgcgggagctcgccgcctccccaccgcctccccttccgcaggatctagtggaggggagggcgcagccgccgccgccgctgtcccaggcagctgcccgccgcgggagctcgccgtctcccctcccgccagatctggcggaggggagggcacagccgccgccgccgctgccttaggcagcgcgccggccgagggagctcgccgcctcccctcccaccggatctggctgaggggagggcgcgg

SEQ ID NO: 90993 - DNA, 786 bp, Oryza sativa
taataaatgataattatataaattttttaaataagacgaatgatcaaatattaggcaaacagtcaacggtgtcgtacattaaaatatagaagtagtagtagggaaactattttcatccttcgaggggatatcctctcgttgtttgcatgtcacccaaatggttatgaaaaaaatttaaaagatgtattaacatgtgatatatcactccacaaacatgcaagtttaaattcaacttctacacctcgcaacgaaaaaaacaaattggactgtgaatattaactagttatagtttaatttgtttttttcgttgcgaggtgtaaaagttgaatctgaacgtgtatttttgtggagtgatatatcacatgttaatatatgttttttttcataactatttaggtgacatgtaaacaatgagaagatgttcgctcgggacgaaaatccactcccgtagtagtaactgagagagatcaactgctactccagcgaactcttctcctccatttctatctccgcctccgcctcagcctcagcctcataggataggagtactctacatgctgcctatgatcaatattgccctcatgtcctcctcctcttgccatccccacaaccccaccaccctgccgctgccggagccggacagcagcaagtcgccggagcccacctccgtgctctacaaccgcagcagcccgagcacctccctcggctcctgctcctccaaaccaccggaggaccctcctccccccatcgccgccgacgacgactgcgactgggacgccgtcgtcg

SEQ ID NO: 90994 - DNA, 1362 bp, Oryza sativa
gttttgattgaaaccatacttaataagtttgtcaacacgagtatcaactgtcagatagtagtgaggaatggtttgcttggagtgcagcaggcggtttgcagtaacctgacgaaataatatcagaaactgttaatagaagtagagcaccaacagcaacaaaaaccttgaaagaaattaagtggcaatgatattaccttccttatttgcgtattaggaagatccacatagcctagtccaggagctgctgctgtttccttcttggcacccttggccacagaagcttcattaagcataaatatcattagattaccgaacccacttactctactctttataggtaaaactatcaccattcattacttatcatgctttaatctggctcttatatataagcatcttaattctgaaggccaccatcaagatgatgttttttcagcatgaataaaaatacagaacaattgcatacccaagtaatcctcaatatctgccttcaaaattcgcccatcggggccagtaccttttatgcttgacagtggtacctgtttaggaaacaaggtttcaaaattaaaaactgcgttctttggaaaccgtaggatagctaaaatattagaagcttacattgttgtcttctgccaatttccttgcaattggactggagaatgtgcgatcctctgaaagaaaagattcttctgtctttgtagcctttggctcaggagccttgggctgctctttctccttttttggctctgtgggctcagattggggcttcgattcggctggagctgcagattcagcagatgatggagccttataatccttaaatttgccgatgtcttcctcttcttccacggttacggcaataatctggttaacaaataatgtgtaaatattgaaggcaactcaagttcatatcagcacagaacatgggctaaatggagggaaaaagtgtcttttctaaatcaagaatatgtacctcaccaactttaatttctttggcaccatctccatggataattttagcaaggtagccttcctccatgcattccatctccactgtcgctttatcctaatcaccataaatgtgattgatggttaagctgctgttgctccttaattaaataaagtagggaaattaaatcaagtcttggtgtgcacattaagaaagtaacttacagtctctacttcacaaagaacttcacaggtgagactttatctccttctttcttcacccaccttgcaatgtttccctacaggcaatttaataagtttgacatgataaaggcaactcaagagatacatgacactgctcatcctttaattttctctttgccatgatgccatgattttatttatttattcaat

SEQ ID NO: 90995 - DNA, 660 bp, Oryza sativa
tcctgaaagaagatagctatgttttctttttggtattcaaatatctattatttgatcatgtatttttttgttttatccaccttttttgcagaatcagcagatgaaaaatgatgacgatgtgattgtttcctctttaccagaatcatccaaatttgctcactggtttcatgacgaaggtaggtactcatcttccataaattatattgcatgctatgtattagttttatgatcttacattagttggtgaaattctgttcttacctcaacatttggttcaaaaagtgtataagttccttgataattaatcttgacacaaaaacctctaaaagccagattagctgattccttggtattcatgttaggtgaaaatacatgcttaggtacctcttactcggttactccgcagcattcatctgattatctattattttgacaactttgatgttgtatttttttctgtagactcgaaacctgcagaagacttatcatcaaatggtctgctatccatgattgtcaaaaatgaaaaaccaggtcaagaaagtatagctcatggacctcctttatctgatggtgccgttcagaatttattaccaatatcaccgactcataaacttgatgttgcatcaacgcaccccttgttcacaccagctgcacctgccg

SEQ ID NO: 90996 - DNA, 906 bp, Oryza sativa
ttttttaagcccaacgggtaaaattcaattcctgtatttttggccggagactaaatttcagcatttttttgtcaaaaggttaatcacctaattttagcaagaagaataatgtcaatgtgtttttgggcccaagcctaatgctcgtgtaattttgagccgaagaaaaaaagtttcattcggtttttttgaaggatataactcacgaaattatatgctaaagggataaaaataataaaactgtgttgaaggcatgcatacgcatttggcataaggttaatacccataaatttttaggtcaaaagctaaaaaccattgaaatctaaacatcagggaacgaaagaaagaatgatacggtatatacaacatttgcccttatcagccacacggcattgttatttcagaccatccttgttttcaaataaatgaacaaatgctctaaaggggtaaaagaaagtagcaaagtaatcactttacaccaagtcatttctttcctttggcatctcaaatcaactggcagtgatctatctgtacaacggcatccgcatacttctttcatgtaaaaaaagaaaagaaaagaaaagggacgccgctcctttgtttcctctctagacatcatagatattaaatacaaaatgacatgaaaaacaaaacatggccatatgattgatttacacgatggacgcacctcatcttttacccttttgttcaggtatcagagctctacctcgtgaagatcctcgcccaggccattgttgaattgaagtgatgagttactactggaacggctgtgggattgtttctgtccaggaatcaacggagactgcatcatggtccgttgtccatctggtgatctcgaaacagcattgccgctcaactgctctgaatatgctccactccatgatgctg

SEQ ID NO: 90997 - DNA, 1572 bp, Oryza sativa
agaattggttctggctaggtggcattggtggcatccctgaactaggcccagaaggattcaaaggccttgcttctgaaaatccattagcagtataacttacactgcctgggccattcgaactctgatctggaataccgttctggaacaaggcctttgttggaggtgggggaaggggaggctcctcagcaggtatgtcagcaccttcttccacccaccgcttcagcttctcgtcatagtagaacttgttttgttcccccagcttcgcctttagggcacaaaagaattagttgtgttacacaaatcaaaaactactgtgacatgcagttcgaaaccgggatcggatgaatttaatgttttagcaagcacctgatgatgagatcttgaaacaagtcccattgtcttctgcagcaaccatccaaaacgtgaactacctgaacctgatgtgctttgtgcattatctaatcctgcaccctgtgagagttccaatttcagaaaagagaaatgaaacacatcaagaaaacattccagtctaagaagcacctggttgggggttctgccaaagtctggttcagagacacttctgttatgtgtgacttttctgtcagggccagtatttcctgacatttcactcatagattgctctgaaacagaagacatcaaagaagacatagccatcactggctgattattcacaaaatttgtagctgcaggagccgaataggaatctctttcggttaaggagccctgtggcactggtgacaacgctgaaggttgtgtacccatcatgcgggacaaagatttatcaagtgatgtgaaaagttttccaacaagctttgcaggggctagatttgtaccataaccaccctgaataacaatgagttgatcatcagtcaacatggaagaaacagtctgctctagtaaatacgagaatcagcaagcaacagctacaataaattcaaacctgctggtaggtgcgtatccgctcctctagggatgaaaacaactgcttccatgcctctaattcaggtgcacggccagatgctttcagcaccttcaagcatgcttgacaatacctaaagagagtagtttaaagtcaatgtgtgtaactaagaaaccaggggaaaaactggaatagtaactcagcaaattaccttaatgaatcagaaaccttcccaacctccacaagcatgtatgcatatatcagcttatatggttgaaatggcaagaggatgtactgagaattaccaagaacttttgcatattcatacacctctgttcgctgtttgttacattgtgaggacatttgtttagaaacagcaaatgacaaaagcaaaaaaaaaaacagtaataatatgaattaaggccgaggacaatcatcatctaatcatgccattttctgagtaagaagtggtccaaatagagggactgtaaagcttttgactaaagtaagtcatgcaaaaaataacactagaatttgacacatctaaaaacatatgtgatacgcatgctcctctgcaaaaatgcgaaaccatctacattagatacataatgattcatatctgagatattgtt

SEQ ID NO: 90998 - DNA, 2878 bp, Oryza sativa
cagttataatagccaaattctcttgccaatcatccagcatgctcttagaattcacagcctatccaacaaaaatgctaagttaggttcaaccctaatgatccacacacgataaaagatgagaactaaaatgtatgaaaatcatggaatgggaagtcaagaacaatcaaatgatatacatcacatgacatataaacacgaaatgagtatagaactataggtcataaacaacatagaattattatagagtctaaatagaagcatttggatcctataacaaaagaaatagacaacatgtcccctattgcttcgaatcgaataatcattcaggtaggagtaataaatttagggattccgtctaaatgtttgatcaatagatccttctactgtcatgagcaatcaagaatgtggtaatgaagttatgtattacctccaccggccgttggggtatatgcaaattaccataattgccatcaacagggttctcagcattgaaaacatctgcaggctgtcccgcaataagaaggcacaatgtcctcaaaggtgatccagatacaaaatggtggtaagccattttcttcacagtatccacataaaactacatcaccagtcaagaaaacattaaacaaactgtccagggaaaaaagaaaaatatgtgtatcatgcagccgaaaaatgaatgcaaacttatatcaatagtagcagaccttatcaccaagttgtaaagcaaggattaatgcgggtccccaaagctgaccttcctgagcatactgaagagcctctttccttctaccagaaactaggagattttgaacctccttagcagtagcctgcaataaaatggttgccacacccaggattactatttttttcccctgaagctggtgttcttagagaaataagaattacctggatctggttttctgacggaatgtttttcatgcaatggacaatggctccatactctcccttatgagcaccactactcttacaagatgagaaaagttttgtcactgccatctctggaccatctataccctgttaccaagaattcaaaataaattcaatattcctttcaaaagaatagaaataaattcaataaaagatagccagcagttatatgataaagctgattgaaaaataaagtgaactcaaggaagaataggtcttttcatttcataggtccagtttaacatgcatacattacttcagtgttgctggttacatgcttaaaatcctgtatggacaggccatttttccatgtgagaaattaatgacaacttgacaaggagatgtttttaactgtggtcatgaattatagaaatatagtacagcaagacaaaaagcaaatacctcctgcgatggatcagacccaaaaggtgaacggagctttccatagtgttggcacaatattttaagcagtgaaatgagcaacttctgatcatctcctccctggaactccctgatagaggaatcatagcctccggtgatctcatcaagccacttgttcacatcctttgctgcagcacttccaccaacaagggggccaggaataggttgacgacacaatgcatggaagtaactaagtgcgctaccactagggatacttggatgatcaactctatcagaaacaatctctgacacattaagaattgacactgtgccacatggatttcccttaaattgcagcaataaagtttttcagtcacgatgacattgcaaagaagagaagtacaaataaaaattctaatcgtacctgattcccactatcaaagtttgtggacattgaaatggtctctcgcacaactacaagcttccccccaaatccgaatgtaaccaaagcatgtggtgggcgtccagctgatgacctctgctcatgggaggaataaccaaattgttgaggtaaagcattggaactgatgaattgctgctgcgcaaaatttacagagcttccagtgctcaaatagttatttggcaaattcatgcatccatcagaatcagcacgtgtttgcatctggggcatgtttgctgttggaacagagtcttgtggcttagcagcaccattgaagctgctgtaatggcttggtaactgttggtatgccacatggttagcttgactatctgtagaaggtccaaattcctggtggccagtctggcccgtagaataatcatatcccttatatcccaactggtgacctgaataaggctcaaaccccttataattctggttgcctgtagaaggtttaaatccctggtgagcagcctgttggactgtggaagattcagagccattgtacccactatgatggctggtaaaagtactttgatgacctacagatggttcaaaacccttgtaaacactctgatgactagtggaagatccgaatcccttgtaactcgcctggtgatcctcactactagtgtactgacttgtagaatgcgcatatgtgttgatatcagcatgataatacttagaagattccaatgactcgacatttgcctgctgagcagtttgattctcagtgtgctggttggaaccataaaaactatccgacaagctgttatcacccaacgagccatgttgctgttgtccctgatggctatagtcacctgtgtaagaatcactggtttgagctacattatggcctgttcctgcatatccagctgaggctgctgcagtagtttctgcctgcacaccaccttgctgatacgactccagtgagagccactgctgagtattggtgtcaaagtaccatcctgggtattcagcgtagaacaccatgttggacgggtactctacggctcctgtattgctctcattcggggtccagcttgtagccatggtgcttccctcctctgcgatggtctccaaccccgcctg

SEQ ID NO: 90999 - DNA, 1915 bp, Oryza sativa
aatcatgaatcacctctcaaatttcacagttccattcaacaaatctccctgtgaaagcagacagaacagacccagaaaatgagagatcaaatgtgtcagcaaactggactttatttatgttgcacctgtccaggatattcagtacacaaacagttccagaggagcatctaacatcatctgatggtacacgacacatattatttaccatacaaactactgtttgttagcctgtgcaaacagctatacataatcacacgcatatacatatatgcatacacggccaaaaatacatgcaaccaaagtaccaaactctcaaagggggttaaaaacaaaaggcatgcatatgccgtgatacaacataccccactatgtggcaggttcatagatgagttaaaataaaaggaaaggcaaaaaaaaaaaatcacaggcacataaactacctggccatctagatgatgagcaaaactagcctaatggttagagcattactaactgctatatgtacaacgtgacagtacaacatgtcgctaacacaatgtggtatttcggattcactcaaaatcgccactgggtgctgatagcagggtttgcttgttacccccaatggatgctgattgtggtggtgttctttcatttggtcgttaccctgcaaaggggttcatagcttggtgaaatgatgatgcatgtattcaggtatggaaccatactgtgaaaaataatgactgtttacatgaatgggagatgaagggtgtgagttgatcccagatcccctaaattctcatgcttcacttggtccatgccatatccatgtgatgcgagtaccttcctctgcaacaacaataagggatttccattgctcagattccacgcatgagtatagaatcagaatatcaggcagcgcaaatatttatggaacatagtcagaaactcagaacactagcaaacatggtgttgtttaggtcatgtaacaacatatataactgtaaaaagcgcaatcaataggtcaaggttgcaaaaagaacacaaaaggggatgccagagactgcatcgatatacctattttgaaacaaatgacggtatacaggccgaattggattcgagctatgagaaaaataatcaggtaatgctatgagaactagagtaatgttccattgtgctgccaagtactagcaagttgaaataacaaacagatgcacagaagataaaataaaacgaagaaaaagaagcaaggtacttacatgtgcttcaaagtttgggtttgtcaggtttattgacaaatttttcatcagtaacagcacctggatatcaaatcaaaacaaaacagttttcattatcatttcaagtgatacaatgcaattatgtactggcataacaaacattgaagtgtacgtgttcactgaacaaactgatttaaaccttaaaaatgcatgaaacagggaaaacaacccatgcagacctgacatgcaaatcatgaaagtgtatgaactgcacaaactaagagaaaagggcaatgaacaaaataaatatttcttttatggcctcagaaggtgcatagtagagacattatgccaaacataggagatccattcttactatgtcaagattatctaagccacatgtagtaactggtatccaccactaataattaacaaaatgaaacacattaacagtcgagtttcagttatgctgcatagtaaattcctattttaccttctctaaaaaaagtcttcgatgtacttaattattatagcatcatctttctgtcttatctgacatctcacacaagagtttttcaagttgctgatggaatggcagtaatagtacaagttcgcgtgacaatttctattagaattgaagccaaagcttcatttaagatgcaaatgaaatcaagaatagcttccatgcaagcactaaa

SEQ ID NO: 91000 - DNA, 677 bp, Oryza sativa
tttctgagccaatccactcctgttttgggaaaacaaaggtatattttgatgtttcttcatgaatgcatgtcattgaggtttttgaatttactagccctgcaatttgataagatcccaagtagtattttgagtaaaatgcctgcaggctatcttttgtgggtgattctgttatacttctgcgaaacctttctttttggcctctagacaatggtattgctaagaggtgtataagaaacctagggttggcacttagctagatgatgttagttcgagtaatctataatctgtaccctgtatattggtttagcagtggatggatttccaagtctcgtgatcttaacaaatcatggaagtgctttctcagataaacatgcatttgtggtctgaaatgcgcatataattatcttactgtctacggccttgcagatcgagttttctcatgatggaacatgccatggttttgcggtttggattgattgggttcttgatgagagaaaatccgttgtgttaacaaccggaccaggtaaatatatataaattcctgatatctgtgcttgggagagatgaattgatgagaagattgatggtgttggtgttgattttgagctcagataaccgatactggaaacaaggagtacagctctttagcaagcctgtagaagtaaatccaggcaagt

SEQ ID NO: 91001 - DNA, 1324 bp, Oryza sativa
gaatggatgcttatgtctttaatgatttcagagctgggactgggttgctatccatgatggccgcccgagctttggcagctgttgggggtgaaactagaggaggaagtgtttcagcatgtgaatcttacctcccaatgggaaaattgatgcgaagggtactgagagccaatgggatggaaaacagggtcaaagtctttcacaagcgttcggatgagctcaaagtcagagatgacctggattcaccagctgatatattggtatgctcttgttttaggccagcactattgaccataagatgctgctcatatatatagcaaatttggcaggggaaaatgatcattttccaatctaaagagtagcacttgatcatttgctaccccttgtctctcagacatgttgcctcaggacccatggtcagagtctacacattgtgtgggaaatgattgattttgccaccccaaatgttcagtcccccattatattctgaattaaaattgctaatctcatctatacttgattatccaaccaaaagtttcccaaaagaaaaccattctactgatctcacttattgtcaatgtgatagactatctgtatcaggcaaactgctgtagatgtattgattgttttgtttttttttcttgaatacgcaagagagttgcgtatcatttcactaagaagaagagaaaaacaggagaattgggaggggagcccctcccctcaccaagaccccacagccaagacctttacaaacaggggattgttttgttattttgactactgccattcagaggcacggccaactcaatattgcttactttcccttctatttgtgttttaggatataagagggtttaacacttttcttgctattgtgtattatgtgtaactaatactcgtgctaacaaagacatgttctgcaggtaagtgaaattcttgattctgagctgttgggcgagggtctgatacctactttacagcaagcatatgacatgttattggcaaaaaatccaaagatagttccttatcgagccactacatatgggcaggtcagttcccagtgccttctaatatgcgtttgtcccaattttaacaatgtgagataaatttatactgaatttgttgatttccttgatgtcctagctagttgaaagtacattcttgtggaagctacatgatttgcacaacaatgaagcaaatgctgcagacggtgtatggcttactcctggtgagatggagaggattgtgtctgtgaagccacaacaacatgcaatgcaatgtgatgcactagaagatgagatacgattggtatggactttagttttgc

SEQ ID NO: 91002 - DNA, 752 bp, Oryza sativa
gattattgaattttttatctaaaggaaaaggatttaattaaatcctttttggaaaagaaaaagagaagagaagggagggagggaatatagacttttctcggacggctagggggcgcggcccaagaagaaatggagcggtctccggccgagctaaatgggccggccggcccaaggcggcccaaactcgcgcgcgcgcgggagggaggagagagagagagagccggcggacctgactcaccacgcgcggtcccgggagggacccgcttgtcagcggcttggctcaccgtgcggagggagcacgccacgcacgcgcgcgggcagggaacggactccgtgcatgcgcgcggtccgggacggacgcacgtgcggcgggcccacacgcagactgacggctcgcggtggatcgcgcgcacacggagggaccgaccggggtcggacccaccctgtctggctgagctggcacctacgtggcacctacgtggctgccacgccggccggagggaggtaaacaaccacccggccgcgaatggacggcgggcggcggcagcgagcggccgaaccaaccacagccatacgggcaacagcgagcacaccggacggttgcacctgacaaggggaagccagccaaccgctctgattcgacggaggttgatcgacggcggctgattgcggcggcagcaaccggcggcgggagaagaaggaaacagcaactaagtcacgagaggtttattcccggcagagagagcatctac

SEQ ID NO: 91003 - DNA, 629 bp, Oryza sativa
gttcaactacaccggcacgccgccgaacaacaccaacgtgatgaacgggaccaaggtgctcgtgctgccgtacggcgccaacgtcgagctggtgatgcaggacaccagcattcttggcgccgagagccacccgctgcacctgcacggcttcaacttcttcgtcgtcggccagggcttcggcaactttgaccccatcaacgacccggccaagttcaacctctacgaccccgtcgagcgcaacaccgtcggcgtgcccgccggcggctgggtcgccatccgcttccacgcagacaacccaggcatgtactctgaaccacatcgattcccctgcgattccacatttgcaccaacttaatttagctttagttaatcagtttgcaattataactcatcaaagatacttatgccgatacgattgcacgatctcaggtgtgtggttcatgcattgtcacttggaggtgcacatgagctggggactgaaaatggcgtggctggtgctggatggcagccgtcctgaccagaagctcccgcctccaccgttggatctcccaaaatgctaggaataaaactcaagatcatatcaatagtcaagattggttgcatttgcatcgcttcacacagaccccact

SEQ ID NO: 91004 - DNA, 996 bp, Oryza sativa
attgtcaactgtaagtgggtttatacagtaaagcaaaatcctgatggaaaggtggaaagatacaagtaaggttggtggctaagagatatagtcaaacatatggaattgattatgatgaaacttttgcaccagtagcaaagatgagcatggtaagaactcttatatcttgtgcagctaattttgattggccattgcatcagttagatgtcaagaatgcattcttacatggagatcttcaagaagaggtgtatatggatgtcccacctggatttgccacttcacaaactaaaggaaaggtgttgagattgaagaaatctttgtatggtgttaaacagtcaccaagagcatggtttgatcggtttaggcatgcaatgtgtgctatggactataagcaatgtaatggagatcatatagttttctatcatcatagtggagatcatataaccattcttgctgtctatgttgatgatatggttatcactggaaatgattgcttggagataactaggttgaaacggaatctaagcaaagaatttgaggtcaaggacctaggccagttgagatattttctgggtattgaaattgcaagatctcctagagggatagttatttcacagcgaaaatatgtattggacttgcttagtgaaacaggtatgcttggatgtcgcccagtctctacaccaattgatcaaaatcataagttatgtgcggagtctggagatccagtgaataggaaaagataccaaagattggtgggaagactgatatatctatgtcatacacgacctgacatagcatatgctgtcagtatggtgagtcgatatatgcatgatccaagaagtggtcatatggaggcggtgtatagaatcttgagatatctgaagggaagtccaggcaaaggcttatggtttaagaaaaatggacatcttaagatagaagggtattgtgatgcagattgggctagctgtcttgatgatagaaggtcaacttcaggct

SEQ ID NO: 91005 - DNA, 3602 bp, Oryza sativa
aattaccttcgggaaggtaattgagatgcggcatgtggagacatgagcgccacattgccatgatgttgatgacatgatttgtgaaaggagaaataaaattaaaacaactgttttcgactggggcggacggaggatttgggtggtatctggaaaaggctagtaccgtccctagtcaattaaggaccgagccatgaagttaagcatgaaacgaccccccgtacaaccgtacttctcgaatgggtatagacctagcagattagatagccaagtggaggcagtatccctgcatagatggttcacccctgattgaggcaggtgcgctacgatgggacagccgttgaggtagggccgagaggcgtgccctatatcggtgttgccattggtaggactgccatgagtgtgtgagagagagaacttaacttgaaccataatttaatatgcgtgtgagacttctctttccccgggagcgccagaactcctctcactgctagaaacatggacgcctagagtgcatgaggatttaagttcatggagcgggtactgccaatgcgaggttatcgaaaagctttgccgtgacgtgtctcatgtgttgggacgaggctcatgtgttgggtagtcgcggagtgcgggtaaagtgtacatccactgcagtgtgagtaaaccaaatctattcgaatagccgtgctcgcggttattgagcaccgggacatgtattacacttggctagactctaaattcttaacttgtgtgggatgggatattgcatgatgaatttttatgctgatggagccacttcctaagaggcgggaatgtggacgtcctcagaaaaccataacgactcaatggcgggaagctatccttgggatcacaatggatggtggacagaaccgtcattatttaatatgaacactggtattaaaacttgaacagtctatgctaggtcttaggcttgtgaaaagaattacaaaacttgctttgtgcaaaaagaaccatagccatcctttgaattcctctgtcatgtgcatcattgctatgatggcttgctgagtacggttggtactcacccttgcaaatataaaattaatcagaagcgggagatgaagcctcggaggatccctatgcctactaccaggagggagatgaagacgatggcgctcagtaggtcttagtacggttgttgcctgtggcaatggcatgccgctgcctgaattccgctgccttatctatttctgcttttggatgtattccggaccgctcggtccgatgatttaagactatgcctgcgggcttatgatgtaataattcgtattagacactcgtgtatgtgcacttggtattttagctatgaattcgtgtgtaccagactacttgatccagggaaatggtactatttacacgattgattcctgttataaaaatgggggtctacacaaagtcatagcaatccatttgtgcataagtctaagtgtaggattatggatgtcatttgtcctaggacgtctgcaagttggagcaccagaaatgtcttcccaaaatctgtttttcttgaacccgggaattcctttctgaagatcggttttacagttatcgtgaaaaccaagaagtgtacttaatcctttccatgaaagcgtatactctttacggaaaaaagaaaggatatgccatcttctgattctttcaaagtgcacagaaattgtatattaagcaaatgagaacctggttcatctactactgcaaatctctgccaaattacagcattccaaatggcatgaaaatcactatccatacctgttttcctcagaagttccggatcgtacgcccgagtgtggctgaacttccggtccttcagcatatggtaggcttgtaattcctgatcaccgataaggttgaggttggtgtcggtcaagaggcttgtcggtatgtcggtgtcttccatcgatatgtcggtggtcgttcccgatgaagagccagatcccttcttgaacagacgggacaaccatcgcctcgttctgcacaaataagaatggactaactcggcgggggttaggatagcaagaagttctacccaccggttagcttcaacgaaacaacttgtgtatgcaactaaagtgtttgattttgagacaagcttgcaaaacttgaaatggattttgagagcaaagttggagaggaaatgaaaatgagttgaaatggggtggattcctctctctcgaccggttggcttatatagggcaccaacaacggtcgaaactgtcatgtgggtcccactagccgttggtctgccaaaagtggcggccgaccgttgcctggccggttcggccgaacccctagtgggcccaaccggccccacttttaaccgttgggttccaacggccagtgtggtcgtggcaaactaaattttgattgaaaattttgctctgaaaaattcattttgaatatttgcctcaaaattcaaacctaaatgcaaattttgagaaattcaaacatgctttgatgatgcagaaatcaaattggtgaaaataaatatgaggatacataccaatttacctattggcgagggcggcgtcatttcaagtccgacgtgcaagaccgtacctccggcgttcatttcatggatttttcacccgtctccggaggtgatggagcgggcgtcttctgtttcagccaccataccttatttgtccttggtatgggcggcggcttcttttgagccggtttctcttccttctaggccggtgtcttccaataacgggacctcatcctggaaggttgtatctccagagatttcttcatgaaagcgatgaggctgtccattttgggtggctccacttcgaccgtctgaatattctacggggctggcccgtactttaaccggaccatggagcattgtttcgtcctcggctggaactcgaacttctcctcctttccattgatgtggaaacggatgcttcttgttccgacatcaatgtttgcctctgcggtactcaggaatggacgcccaggatgagcggagtctccttaccggtgtccatgtccagcaccacgaatcgaccgggataaagcaatcccgtatctttaccggcacgtcttctgctatcccggctaggtagcggaccgacgagtcagccagctgaaggcgcatcggtgttggtgccaacaccgtaaagttgagtttgtcgaagacgtccttgggcatgacgcttacacttgccccaaggtcgcagagtgcctggtcgaatttttgtgtctagattgagcaagtgattgtgggacaccccgaatctttcttcttctccgggagtttgtggaggatcgcgttgctgcattcctctgtcagcttgaccacctcggtcgtcggtagtggtcacttgttgttgaggatgtctttgagataacgtgcatatgttggcacttgcatagcgtccaacaacggacgttgatgtgaatcttctagatcacctcaatgaaacgagcgaactgctcgtccactgacggcttcctcatcctctgggggaatggcagcaacctcgtgtcgcagtaatgctgcggcacggtcttttctggctgaatttcttcttcagccgctgcgtcagacggtgttt

SEQ ID NO: 91006 - DNA, 2285 bp, Oryza sativa
cgtaagccttgtccttctagcctacagaacattgttcttgtttatcatcaagaaacaactatgttcttgcatgatgcatctcttgaggaggaggatcttcaggccacagacaagcttgagacattgactctagaggatgagagaaaacattccacaaatgaacatgaaagtttttctttcaaaattccccaggattcattctcacataaggaattcctagagtcctgtctgattagtgacgtttctctgtgcgaggaccacaaccaccttacggtcctcatttctaacatgtttagaagtgtggttctggatgcttatatttatcataaatactacaaatcttgtatttgtttgtggcactaatcttgcagcatgatgtccctatggtcgagcttgagaccataatcaaagcactgccaggagatagtccagattactacggtaagtttcttttctaataaaagcaagaacctatgtttaggattgtatacatcttcgggtattcttggtcgctaagcatttcaggttgagattaagaatgagggtcagacgatgcctaagtacacggttagctacatcaactttacactttggcgatcctcggtatgggaacactctataggagactccgacatcacacacttggtttttgatgtcttgcgacacaaaagtccaagtgtggggggaaaggccgacgagcttgtgatgacgagttccatcaatcaaggccatcttggtttaaagttggtgttagtcccaccttactaaaaaaagagataaaaaaagataaaaagaggagaaaagagagacgaaaaaaaaagaaaaaaaagatgggagaagaggaagagagcaagagagctgacatgctgtgtaatgccctagaaaaaaaaagaatagcgtatagtatatattggaattccctacatttttttttggtgtttgcaattagaagaaaaacaatagttatacgctagttgggctagctttcggccagcccaaggcccagctgccccctccacacccccaagaccctaggaggtcccccccacctccccctagccgtcatttggtaccctggggcgcccacctccccctctggtcgacctcccccatgcctgccctactgcagacctgggaagaagaagaagggaaggagaagaaagggagagaaggaagcggagggaatcgaggtgaagaaggaaatgaggggtttgattgccgcttcccaaggaggcctaggtatcaaatacatgatctttcccactgtattggttttcttttagggtttagatcaagtgttggaagtgagtaagtttgggatccaccgatttattcctcagccaggtttttcttgctgatatgccccctgcgcagttctgttttggctgcttttccggccaacataatgggttttcctgtgaaagtctctatacaaaagttgtagataacgtgtagatctatcttctgaccagatggcatgattttatatcaagtggtttaggaggtatcaatttctgaagttggctgtctgaatgtcgatgcatttatctgtagtcgaggttcagagggattttaaaggatcttaatgatggaatcagagaatcttgtacttacagaagttgtagaatatgctgtatctacctcataaaaaaattgttagcttttatcttgtattttgttgtcagtgctcttttgaatgtttgttgcatagttttctgggcagatgcacttatctgttttgtgccatgttttaggccagctaaatggaagaattcaattttgttatctaaatgaaagttgtaactcttgttctgtagatgtcagaaatggtatatttttctatgttatgtgatgtagaattggaggtatcgaatcgttaatctatgctgcttttataggaagattatcggtgatttgctttatgttgtttggggtgggttcccagcatagaaagtgaatgtgtgattcttgaatgattatatgtgtgttgtttgaggctgagtcggtgtttattcaggtgataccacttcggaatgcaactagagttcatctcgtcatcggtaaaggcaagtaaatgtagcggtggtttgctacagctttaacctgttattttcctaccttcactttaaaattatatatcaataaccaataatcaagatagtattacaggtcgtagcaaggttttacctatctgaatcattgcttatcgttattgcactgtttatggttatactttatgctcttggttataataaccttatactggtctccatctgggctgcagg

SEQ ID NO: 91007 - DNA, 4854 bp, Oryza sativa
cggacctcctccgacctcggcatcactcccatcgccaccgacgccgtccaccgcctcgtcgagctcgccgaccgccggaacgccgccgtccccgtcgacccgagccacgccaccacctttctccgctccggctgcctcctccgttactgccgtctcctggggtgagccgaggaccgcttcctcttttcccccttcccttcccctctctcggccgccactccgtcgcgcctatggtcgccgtcggcaactatagtggcgccctcccaccggacgcgccgacgtggccgccttcgggcgcgctgtatggccgccgtgtggggcccggccgtcagctgcccgcgccctcaggtgcggctgacgcgttgggcccacggcactggccggtgtgagcccgggtgcacctggtccaccgtggaccgtgaggctgctgcgtgggccccacttccgtggacccgatccgcgcacacctcccctcggctgacgcaataaacccctttttaaattaaaatttaaatgaagaaattcgcaaatattcacttaaagagcatataaacttcaaatggccataacttggtcgtttgaactcggaattggaccgttcaagtctctaatcgttcaagtctcttggcgaaacgacctcttaaagtttcaccaaaaattggtgctatcttcgcggcacgacacacgataacggtcatagtcctctaaagttcgacctgggtgtgcgcgcatccatctggcaacacttataaccttgtagctgttgccgtttattaacatctcgtggtaaacgggccgaaaaggaaacttggtcgtcggaaaacccttcaccaccatgaatttctcatttttatctcgccaatccccagagggaggccgatcgcatatttttcggccgcaaacctgccaacaaggcataatggaacagtgcaaaaggagaaataccagcaaaatcaatcccacattccagtgaaaacatacgattggcgaaatactaacttttgattaataaaattaaggtcataatggccacaatacggcaacggctcccagccgaacatgtaaggcacctatatacatgagcaaactaccaaaaagcctaaaaaggcgaaggaggaaaaaaaacactagggtgaagggcctcacacctcagggtggtctcggtcttcatcgcttggctccgacggcctagggtccaccctggggttggtggcagcggcttccttatccttcgtcaatttttcaagttgttcgcgaagccgggtcttcgtgcaatccttgccgccatcctcccagaagtccttttggaaggccctcaaggccgccccggagcactgggaattctcgagccaagcccccttcaatagctcaggaaaatctttaatatggtcgcagccatgctcctgaagcaggctaagcacaaagcccgctgaaacgcgtgcgctgtagtctccgtaggcgccagccacttcaacaaccgagtcggtgttgacggtcgttatcgatcagtttcgaccgtcaatactaccaaaataggagagagctagtgatgcttacaatgcataaatgtgttagagtaataatattccactagtattaggtatactaacctttttgtagagaatgaaaataaagtggaggagaatcgacatcaacgcaaatgataaatcaatcggacgatgtcaggaaccagacttatgaataaatgggtcaagaactcagaactgacatgacaaactgggccaaaattcacaagtctacggagaagaacaacggaggaggccgccagctgaaattgggctagattggggtggccccaggttcggccaaaccaccctcgcctccgttggatctaggttttggctggacggttgagatgaagccccaatgacggttggaggctattaccgaccattccaaccatcacaaccgtcattacctgcctatataaggacttcacctcctcacttcacacacacacctcaagcaattagctctcttatttctctcaagtttagttttgtagtatctagctggtggaatagaaatagagtagaaatcggagtccgaaagccttcggaagagttcgggtatggctctagtagcttttctcttctcttttgtaagctttgtactattattagaatactcttctaaatacatttaaggtattgaaatactttccgagtatatgagtacctactttacatgaatatacggctagcttatctgggagatgctttcgtgcgggtataatgtttgcttatgcaattactctatgtcatgacgatgatattagagtagtatctggtagtttagacgtggtgtctagactacgggatatcattatttggggttatatattgcggatgagaggtgggccgctgatggtgacagctcagtacaggtattcgtccacgcctatatataatcctaagttaattccctggggagggtattcctccgtatttagccctggttgtatggtcatgacgggctgtcgtgaggaactcggcagccaggggtggcttctcaaagtaccaggatgttaacgaccaaatttggtaatctgagtatcgaagaagaagattagatcgatgcggaatcgaagacaaagatcgtttcggaaacagagcaagattcagctgaagtccaaatcggctacgatcaaagacagccgagttcgagtcggacaaggtagccgattaagccgaatttgacaatataacatgatacacgtcatcgggatgagttaatatgcttcatatggactgccagacatggattgagtcctgagaaggcaattgtatctattaattaggatattttacgtaatttccttggagataagtctgggcaaaagtctgccgcaaagacttatggtatcttagagtttgttagagataagagtcgtgtccgagaaggacatgttttgtaatctcgggtataaatagatctcgagccccatgtgtcacgcccggaatttctatccaaaattccaaacgcttacatgtgtgtgaaccctcgtctaggaatcagccgaggcacacaataacaaattgataatagagtacaattattactctaattaataagcgtataaaatgtcattacagaggtagatagttcctctcaatcaataaagatcttaagcagcggaaaataagataaacggcgcagacgactccactccacaggcagcttgaccagggctacacctaatcctccacaccatcagcatcattgtagaactcttcctctgatgaatgattgcaaggtgagtatatgacatactcagcaagccacgcagcaaatatgcaagtgcacaaggataccaaaggatggcatagtagggtttcatttgcaaaagcagcatttagcaaacatttgagaattttaataaaacagttaagtaataattaaacaatattaaaccaacgctatacaacataccctgttgcataggcccaaccattctgaacaaccatacccggctgtacagatcaatctccaaaccaggaatataccattccaaaccaggagctaatcaaattattaccaattatagcatcttttattacgatgagaggtgtgagactaatcacgaaagacattgttagacccgcccataaccgcgggcacggctattcgaatagttttattctgatcagaggtgtaccactgtacccacaagacacagccccacatcatgtcaccatgtgcctcaataccaccacggtacctcggaaaggagctgtgacaataccccttgcataacacactccaccgcagcgcaccattcctggatcataatcacccccttataaacaacgcatggactccccagcgacccctgtgggcttatctccgccacttctcagtctggtgccccgcaataaaccatgctatacaaaaggtaaagccgttgcccacgctggcttgtggttggcacggttaatgtttcacatccgaaactcgtgaaccggtccttaattgtcatgagcacgactgtcaaaaccatgtgctcacaacccaccattatcaagttttagttggcaagtaattaattaaccaatcacgattgaccatcgtgaactaacataaaatcatcattaaataataatgaattataagttatcccaataatgtgctaatgtttctaagcatggctaagcaatcacatctaatatctagctgaaccaatatatataaagctcaactagtcaagttatattaacccaaggtatcaaggaataaagtaatcaagaacaaaagggctataacaaacaataggttaattccacccaatgacattcgaaaataaatgcaatagttgaatagaaacaatagctttaaacgggatcaacatgctcaaaagggttgtttgggatctgtgtgacttgccttgctagccttggaactcttcaaattcttctcctgcgaaaacggactctccggaaacgtcggaatctaagcagaaaagagcaaaatcaccaaaacagcacataaacaagcatgaacagtacatgtggatatttttaacatgtagatctcaattttagaaaaatttagagacttgaaccaactaaatccaagctaagatgaattagttatgaatttttaaagattaaatcggattaaaacacttatatggattttaattgaattatgacgcaataatgaattatttttgaaaaggaaaaaggggtttattgcgtcagcggctagggtttgcggtggaccgggtgcacggcagcggttcacgggaacgaacggccgagatcgatccatccaaaacggacggccgagatcgctcgggtctacggcggctcacggcagacggccacgatgacg

SEQ ID NO: 91008 - DNA, 2692 bp, Oryza sativa
atcgattgttagaattttaaaaaattagttaaatcttgttacaagcgttaaatatttgtatttatgaataaagttagccttactatctccatcctagaataagttcacttttcacccatcctacacatagcaataaaaaaaaaataaataaaaagaatatcctcaccttatcaaatcccaatacgattgtttttttatccactcacaacatacagtatttatttcatatttttacaaacttcgatacaatgattcctaaaactaaactattttaagacaaacaaaaaaactaaagacaaatttaaaattgggcatgaaaccggaggcaatattattgtactcctacaaatgcaaaatgcaaggtactccttccgtcccatgatattaaggaattttagagggatgtgacacattctaacatcatgaatttgaattgtttggattcatagtactaagatgtgtcatatatctttagaatctcttatacggagtattttggaagtgagtttactgtactcgtacaaatgcagatgcaaatgatgatgagaagaagaggaagaaacaaaaagcgataaatgcgtctgaatggaccggtgaatgaatcagagacgggcagcaagattgtgtagggctggtctgcccctcctctctctctctctctctctctatctatctctatctctgcaaagagaggcctcatcaaatccagttgggcgcgggggacaagggggcatgttccactcacctacccgacgacgacgaaccggcgcctcccattggcccagaatttactccccctccgcccgctccgccacctcccctcccccctccgccgccgccgcaccaccgcctcgccatgtgcggccctgcacgcgctctcagatgcgccaaactgcaaaccctgcaagaaaaaccaaaagcgagaacttatcaactgctgcagactactctgcatgggaaggacggaaggacgagcatcagtggcatcattgggaggcggtcgccgtcgtcgccggccgggtgtacgtacgtcgtcgccgtcaacaccaacggtgggggcggcgatggatggatggatggctcaccggccgggccggcagcggcgatagggttgcacgtggtgacggacgatggaaacaggtgtggatgcgacgcctatgatggtttgtggatgccgtcatcggcatgcagcaacaggagagaggggggggtgcattgctggctgctgctacggcgacgttcgtgccgacggctcgacgcagaatccggctggctgtttgctccctcttctgacattgctagcttcacgatcatttgacatggactcgggttcaccctagagtacctacagtaatactccctccgtcccaaaatataacaacttatgactagatgagacacatcctagtccaatgaatctagacaaagcgctgtccagaatcgttgaacaaggttatatcccatctaggactatgttgctatattttaggacggagggagtagaagatggatcatttaccgctgacaagatgtcaatcaccttgagtagtacccctccatcctatagaaaatcaatccatgttagtttgtttttttataggatggagaaagtacactatatgagatggtatcacaaagttataaaaaacaatactactacctccgtctttaaatatttgaagccgttaattttttaaaaacatgtttgaccgttcgtcttattaaaaaaaagtaattattaattcttttcctatcatttgattcattgttaaatatacttttatatatacatatagttttacatatttttaaaaagttattgaataagacaaacggttaaatatgtttaaaaaatcaacggcgttaaatatttagggacggagagagtataatgctattgatttttaaaatactacatccgtctagaaaaactcaacctaagtgggggatgtgactcatccaaatacaacgaatctaggatgggtcacattcccccctagattgagtttttttttttgacggagggagtatgtttaaaaaaattatgtaattgatttatcattaaaggatcttttaagcaagccattttttttatgtttacataaaaattttaaataagaagaatgatcaaatgtatgtccttgaacaatacgatgatgttttacagtttacgtatgtccttaaataacataatgtatgaaaaaacgtagggaggtattttgcggtttacgtaaacatattgtgttgttttattaatttccttaagcaaaaaaggctagtggaataggaggtaaggggctaagggcactgctgaattgcaaaagtaaggggggggggggggaggaaacagggaatgaggtgccatgtctaaccgaaattcataggaattacaaaacatagagaaattactcaaacgtgttggatgttttgcaagcaaaagacatgatattgggatttgggagagacataagcgttcctttgtaacaacacatgactgttagtaaaacacatgaatggaacatcatgatcactatttaaatttcgccatgatttaaaaatatacaaaactctaaaaattattgtttgaatgacacataaaacccgtagaagttcaagaggacaaggaggagaaaacataaatgtgatactctgtacttattttcctccaaaactctcatagggctgcaggaat

SEQ ID NO: 91009 - DNA, 1059 bp, Oryza sativa
acatgcctggatgacttcatgttgtccttcgaactgttcactttgataatcactgtttgtttatcacagttcatcaggattgttggtactggtttttcaaccaccggcaaatccatcaggagctcacgaagccattcggcctcaattgtggcagtatctaaagctatgagttctgcttccattgttgacctcgttaagatggtctgcttgcaaaacttccaggaaatagcgccacctccaagtgtgaacacatacccacttgtggcctttatctcatcagcatcagatatcaagtttgaatcactatagcccttcaatacttttgggtacccggcgtagtgaatctcatagctcattgttccttttagatagtgcactactctttcaagagcatgccaatgatcatctcccggatttgagacaaatcgactcaacttgcttacagcaaatgagataccaggcctcgttgtactatctaagtacatcaatgaaccaatgatctgtgagtatctcaattgatcccttgctattcttcggtttttccttagtagcacactggaatcataaggagtagaagctgtcttgcagtcactataaccaaagcgactcaggaccttgtccacatagtgagattgcacaagtgtggtcccaccttcatctcctctcagtagcttaatgttaagaataacatcagccactcccaaatccttcatttcaaagcttttagacagaaagtccctgaccacctcaatcacattgaggttggtcccaaagatcaatatgtcatcgacatataagcacaagatcagtccctctcccccaccatagcgatagtacacacatttgtcagcttcgttcacaacaaagccaacagatgtaagtgttttgtcaaacttctcatgccattgcttaggcgcttgtttgagaccatacaaggacttcaacaacttgcacaccattccctcttgaccttctagtacatacccatctggttgatccatatagatctcctcctccaactctccattgaggaaagctgtcttaacatccatctaatgg

SEQ ID NO: 91010 - DNA, 13246 bp, Oryza sativa
ttttcttctctgcttgaagctttctactgtcaagttatcaacaatgtttccagtcatgagcgtgtaggccatttatttaatttgctaggagacaagtttcttttcagtaaaaatattaaattctactagtacatcctttgattagaactgtattttgtgttcatcactggtacgctgtatgtccaacttgtgatgtacttgtctattaagatctgtgcttaaatgaaatggatgttttttgaacggaaatgaaatgaatattacattggaacatatacatggttttgagttcttgtatggaatggtgtgggcagatcccctgagatggtgctgcagtaaaacacaagtgcttgatatatcccagacgtacaggatttcaagctttatttgttttaggcgactagtttatactatttcagagtcatgctggatactttaattacattatgtggatatcatcaaatctttcaacaatattgggcttgatatggtgcattatacagtgttgacttgttctgtcattttcaatttaagtgtgctgatgctttggtctcatatgtacctaagttttgtgaacttatgtctaccaataacagcattagtaatcattattgaagaactaatgtacgtcttgcttgcagcctgtagaccagcaacaacgcctttcgcaatgcttcgacaagctgatgactgatgttgctacgaatttggaaccaaagaacagagataaattcactcaaaatcttacaacattcaggcatgatttccgtgtgaagaacattcaggcatgacagctgttcaggaccagctgctttaaggtggtgcactcatgtgctgtaaatacttagcttagcttcgttttaggaaccaccattcccgtggggggaaagttatggtttaactcagtttggtttggattggctgaaagatgaaagggttctcctgctgcatgtggcggcaaaatgcagttgttgatctcttaccttgtcgtgtactagaatggctgagtgcaggggattgacttttttcttcttctctttttataccttagtgttaattccttctctttttgcttgtacagcaatattcatgtgaaagcctgtgatcgctgtttccccgagttgttagggggaaagcagccatcgctcaaaatataattcattcgttaacaggttagaagaagggaaaaaaagttgtaaatggttgtgcttcctattgcagtcaatgctcaaattgaaagtgaggagatggtaaatttgctccttgagcttcaatacaggtttttattcagctaacatcattttttgcagctctccatatttcggttcattatagcaccgggctactgttgtgcacagcatttttcttttggtggtgctgtgcagagttttggagttcgacggcgccttttgcctatggaccaatggaaggtagttcttcagtcttgtccgcggtatttgttggttaatcttgttcttcactcttcttgagagtttagattgtctgattgagtattttgggtgtaggttaatgtagctttgttcggtttctgttcaggtttccttggtttgacactactcagtttactaatcttgattggtttcatacttcccatatttcctgtaaaattcggtagcttgttttgtcagtgctagaagtgtaggatcagctaccttatattgtctcgctgcacggccgatgacagaaggtatgaaaggacgaattattcatataaaatacgtcttaatatttaattaaaataaaagcacagaatttttccagcactcaaaaaatgtcatttaagaaaataccttgtcaatactgcacttgtacaggaagaaccagtaaaatctaaaaacaagtaaacgtctgaacaatggataaattggggattcatttcacatctttgtgactgtcactgtcctctatggagggagcatgtctatcagctgtattggcacatcactcccccagtttaagctcactatggacgtgagcacagtactgtcgttatgcaatgggcatcggtggaagccagtcaagccactactaggctgccggtagacgtggatgaacgacacgagacctgtgacaggaaaatttaaataaagagcataacatatagtagcacaagatataaacatgtactccattgttgtcatgttacatccaaattcttatggggaagaaaatatatgcaaacagtaataaaaaaaagaaaactgcattgcaacacttaaacccgatgcaggggtcgaaggatagaaatggcacaaaatacgatctgccaagtctgatggaggcaaccaaacacgctaaatctgatctcaggaggtagaaaaaagagcgtaaaagtagacaaaatgtgcaatatccccattagtgtttgagagtagctaccattggtcactagttaggacgcaacgacaaacaacaatgcacttgaacatttaacaagcagatgttcatctgacaacgaggacaacatatcgataataggcatataataggcagtttggatatggaaggatgctgcatcatgtttccttcatttcctgttgctttttccatagagttaagtggatccaataagtccgataagaaagccgagtgccaacatcgcctcagctatgccaacctgcttgctcgttgtcgctgcagtattttccagtctatccaatctccctgcaaaaagacctctcttgcacatataaatagttacaaattcaagcgataaccaccgtaagtccgtaactgggtgagtatcgtcgattcgccgctaggggagcggtggtggtggtttggggtgtggagtgggtgtttcaaatactgggtccccgatttatgctgcattcatacgtgcaatttgcttgagcttttcgctggaacgtaaaacaaggacgagatattaagatatgattaattagtataaattattagaaacttgaaaaatagatttatttgatttttttaaaagaaattttgatatataaagtttttgaaaaacatactacgtaccattttacccgttcgaaaaatatgctaatgaaaaacgagaatttattgtttggagttgttcagaagagggagtaccattattttgagttagccctcgctagggatgaaatcggagcggatagtttccgtccgctctggataaaaacgaatacgtacctctcggatcggataattctcggatagttcggatacggatacgaatacggatatttttctctcggatacgaatacgaatatggtatcagggtttccgtcggatacggataataattcagatatccggtgaacagtgctattcggatatccgcagaagccacaagacataccccatttctttataactctatgaccttcaatatacctttttagattttaatagtagttcatctcttaacactagtccacattattaatattatttaaaattttaaaaatatttataaattatactatattttatataaaatgatctaattatatatgttgatatttgtttctattagaagttgaattggttttcgtgttccgagaaaaatttgttcccgtattcgtgtccgatcatattcgattcttattcgtattcgagatagtccgtatttgtttccgtattcgagctatccgtattcgtttccgtatccggcaaaaaatataaaaacgaatatggtatgagcattatccgtccgtatccgctccgttttcatccctagccctcgctcagaccgcttggttgtatagtacatggataatatggcgcttgtgtcatcttcttcctctggcttgccatctgatttttgtggatcgctgaccatagcagctcgaaagaaagctgaggggtcggtagtcaacctcgtgatggactgatggcagtctctggagtgcgtgatggactgatgacagtctgttctgctctactccctccgtcctaaaaaaaagacaaaccctaatttccgtgtccaacgtttaaccgtccgtcttatttaaaaaaattatgaaaaaaattaaaaagataagtcacgcataaagtattaatcatgttttatcatctaacaacaataaaaatactaattataaaaaaattttatataagacggacagtcaaacattggcacggaaacccacggtttgtctttttttgggacggagggagtagtgttatgcatgcagcaggcgcgtcaatatatgatcgattttttgtagacgtggctatggttcgtctaaaatctaacgagggttcatcttaaaaaaaatcgtttatgtagcagttgcatggccacgtatatttcaggggttcatctttaaaaaatcgtttatgtagcagtggcatggccatgtacatttcaggccaggttcgactcagccacgcttactcccctcgtgctaaaatacaatatttattaactttgtccatataaggcttattccattgttcatcttctcaacttctaccttatttttcgtgtgcatgtttttcgaacagctaaaaaaagttactttaaaattataataatctattttttaattttttagctaatacttaattaatcccgcgctaatgagttagcttatttttcgtgtgaaggaagtgagttttgaagaaccttgacgttcgaatgcacccttgcccttggcatggctattatggctgtattatagctgagtccggtagtgtgttgagctttttcaactcacaatgttcaaattactaaacaatgcattttttttcaaatttatttttatatagaagtttctttaaaatgtcaaatagacgtatttttaaattttgtaataatttgtactcaaataattataaactaattgcttatctcattttacgtaatatgaaaactctcactccaatcgtccaaccgaactcatcctaaggagaggaatagaaaaacttatttgtcttctcgagatagatgtggtataagctttggactataataaagataagagatagtaggggtagtatggatagtttattggtaaaagttatacttacaggtactatgttatatttgaaataatttttgaactctaaaagttgctatattttagaatgaaagaagtagtaagtagtaatattgtacaaatcatatataaaatacaagctcagactataacaaagataaaagacagcagggtagtatggatagtttattgataaaggttttgtttacaagtacttgattattatatttagaaaaaaaatccgatctatatcttagagctaaaggagtactccgtgataactagtactacaattgctcgtctattactccgtactgttgttttgaataaagaacctctgtatccttattagttccctatttggctagcggttctctgctgatagaaaacacagtggcatgagagattttcttaactctagtacatgtccacggcttgcgttgagtgctaagagcgtgccaactggtttgatcttgtaatcagcaagaaaaaacaataaacaaagttaaatgattgatagacgatcgcccgatgagccgatgacgtatcgatagagatcttagccgatatagttaggccatatcggcagtggattgaataagtaaagcaaaaccctaaatatgtcctatcggtcgcactaccgccttcttagtttttataaatctccttttagacaatgttataaaaatagccgataatctagtatttagagtaaatatagctaaagtactagctattactctagtacaaacttatatagataaatcaatatatctatagaaatatatcaaataacacattcattcaccagatttaatgattatgccgagattgattaaagcttcatatacttataaaaagtgatctatctagataagtggcaaatatacacaaaatatatcatgaaacatgcactaccatgtatattaggtaagatcggctaaaaccctagtactatccttagttatgattgattccaggttagtttttagggttctagaaaggactagggttgatgcaacacaaagtgtgtaaagaaacctaaaatctaaacaatcaaataattaaccacttttcaggatggtagataccttagctaatctaatttggcaaggtgatttagccgataccaacttaaaccctaaagtgagaatcaaccgatacgactaaatcaaggtgctaaactagattaactaacatatatgataacaatgaccataatgacaagactaatacatctaaaataacataatagcccccgatagtgcaagccatcgaaataagttacctcttgttgagagatcgcaaccaatgtcccaatttgaagcaagaactcgtcgaaaagtaaaaggaaaaaggtgacgatgcaccaaaagttgtattgattagattgtcctctcttattaaaatgatccagggtttatatttatacccggagtacaaaatttagtccataatggacacgacttaaactttcctaaagataaaaacaaacaaatccacatgacggactcttaccaaatctctaattcaaaccagcattaaatatcctaatcaatagatataattgacttaaatgagctcaatttctaaaccgcaatgacggttatctcaatcgaggcccaaaccgagcccaggttgagttgtatatgctacttccatatcggctttaaacgtttacaattctgtttcagccgatacgctctccagccgatgcacaatctgtttccaaactgactcaatctcgcaccaaatccgcttcgatttgtttcttcttctctgagtctgatgcgaaattctgctgtaaacattctctaaatctggctttctaattacatccatctacatacaaacctttttaaaaatccaaataactacccatttctacatgctattttttttcacatacacaaatcacctatatatacatatcaagtacaaagaaaactcatcacatctgtttgttgaaatgatttatgtcctcatgtgtacaaatcaactctgctcaagtccctaaatcccacctgcccctcctaatgcatgcatcctcctactcaactctttctattaaaatgtgtgtacaaagttttagaaactttataacaaaaagtttttcggacattaagattattttagatttagttaaaattttatgttgatattcataaatatttcttattggaaacttccaactttgtataaaaagttcaatttcaaacttaccatatttgcatgcaaagaaaaaacttgcgctaagaggaaataatatgttacaatctgcatagaagataagctagcacacaagggtgaaaaaagcactgctagacatatacatgtctcccgcaagcccaacacgtatgtactagaaacatctaataaaagtccaattaaaaaagagcactatagcagtggaaatcgaagtcgacaacagagggctccctaaattggagattcaccgagataaacaacgacttttaaagggaaaggagatatactgtgcctttctttcattcattttctgttttcttgtccctcatagcctaatattgattttagtttctcaaccgaaaaatcaggtacaacacctccctcaactattcaatttgcctcccttagcagttctaacggtggtttcattctacgtggcattagtatcaacaaaagaaataaaagaaaaaaaactgcaagatccaaatgtcattctcatctctctcttcttcctctcttctcggtgactccacacctgcaacgtcaaagcattcaagcagcatctttcccttccaactttcgtctccccgctgcgaccctccaagtaggcgccatatattaattgaaaccactatctaaactactaagagaattcatttgaactaactttcatagttgagagggacgatatacccggtttttgcctacaagtgagggaggccgagatggactttttcctttactagcaatagtgcccgtgcgttgcaacgggaaaaacaccgtttgatagtgtgacaccttgaaaacctcaaataggtaaaaatcaagtctaatttgatatattaacaaataggtagaaccgagtctaatttgatgaattagcgtataatttatgatttagttttagatttatttttcgagcctacttaggagcttatctgatggactttgattttaaaaatctgagccacattgtttgatcaaatttgctttcggcccaggtcttactagccggcccaaacttgggctggcccatctgcggcgacctaagtcaaatcgacagcccgcaagccgggcagctgagcgtggcccacatatgtggggacggtctgatgcacttccgcggcccattgggcgcagcgtaatcaatggcggcggcggttttttaagtagtatttttttttcgattcggatctatagtttttctcaccacttaggagaaaaagacttttgttgttgttgttttcctttattttattttttgtgcggcttttctttttctttttatgcacctttctgcctttgatctctctcttttattatttttttaacaaaaacgacctcaagtaccttattgcaagattatagggactcaaatataaatataaaaattacaaggactcaaatgcaaaagtacaaacccaaaaactaaattcatataaaaatggaatgctctcgacccgtaggttccgtttttgcaaacaatcttcaattcggcacatcaatttttttcaccaatgtagagtcggacttttttttcttttctgaaagggaagtcggagtttttttcttttctgaaagggaatcggatataggtgtcggacttttttattttattttttttcgctattatttttgttttgacggacgaaggaagcatctctcgttttgacttttgttgttgttgtttttctttattttattttttgtgcggcttttccttttctttttatgcacctttctgcctttgttctctcttttattatttttgtaacaaaaacgacctcaagaacctattgcaagattatagggactcaaatgtaaatataaaaattacatggactcaaatgcaaaagtacaaacccaaaaattaaaatcatataaaaatggaatgctctcaacccgtaggttctgtttttgcaaacagatcttcaattcggcacatcaatttttttcaccaatgtagagtcggacttttttttcttttctgaaagggaagtcggactttttttttcttttctaaaagggaatcggatataggtatcagacttttttattttatttttttcagtattatttttgttttgacggacgaaggaaacatctcttatttttttaagtagtagagagtaaagacagagatagagatagagaagtagagattaggaaggcagtgcaggtccctcgtgggtggtggttgtgggcttgtggaaataaatccacatccgagcccatatctcccaacaagagaagcccacccaagcccaaagcccaacccgtctctctcttcttcgattcgacgtctcctccttccccccaaatcgcgctcttcatttcgaaacctcacctcgccctcaccgccgcaatgccgcccgcgcgccgccgccgccgcaccgccgccgaggtggacggcgaggccgtcccctcctccgccgccgacctcctcgccctcgccgccaccctcttccccgccgccgcagacgcgccgctcagggaccctccccacctcaagcacctcgtccactccctccccgactcccaccccgtcctcctctccctcccgggcgccctggcgccgcccctctccgacggcggcgcccccgggtaccccccgcgcgccgccgcggtgctcctccacctcctcctcacccacccgtcccacccgccgcgctggggcgacctcctcccgccgctcgcccgcctccacgaccgcctcgcgcagctcgccaccgacgacccgcccctggccgcgctcgccgtcgcgtgcttcgagctcgcctggagggccgccgcgccggggcgggaggcggtcgttgcacagaccctgccgtacctcttcgccgaggcgctctcgtgcggctccgccaccgcgaggccggtgctccgccgcctcctcgcgctccgagacgcgctggcgctgctcgactacgacgacgacgacagcatctccgacttcaagatgctcctgctgcgctgcttcgtgtcgccgctcttcctcaaggccgaggaaggcaggaagctcctgtccctcgtgctcggcgtcagcgagggcctcgccagggaaggcctggagctcatcagagcgcaggtggggatgccgggggtgaagcgggcggcgctggtggcctacggggaggtggtgttcagggcgtggaaggacgggggttgggtcaggggggaggtcggggaggcgttcctgcaggggatgctggagggggccgtgcacgccaggagcaaggagcttgccaaagcggctaggaagcttctgtctgcgttcgtcgagcagagaatggtggctggagttgaaaaattaatctttcagcttgccgagcccgtgctgttccggtctttgcaggtatgaaactgtctagtatctttttctgctcctgtgctaatgtattactctctccattccaaattgatctacatattttataggtacaccaagaccaagaaaagctaataactctctcatactatatttactctagcaacaaactcaatgcatgtatcattcccactatttcctagccaatagcaaatcaaaatattgcatgtgggttataaatacttgtgtgcatggatgcatgcatcaatgtccatttactccgatgcacaaataacgaatagacttaatgaatgaacacaaatatgtagatcatttaggaataacctcaaaaaaactatatgtagataaatttggaatggagggagtaactagtatgatgtgcttacgatattcattatggatgggtcgaaggtgagcatcacagaataaaattgttatgcactacttgtgtacatgaagttacagccaaattaaaattagtagttatgatgaatggtagaagagcgaagagtggagtattggtcttctagcattacatagacatatcaatcatggtgctgcttgactaggattattctttgttacattggtcaaacagtacgacaagctcaataacacattaacatgatctggtaataggtagactatttaaatggttcagcaaatacctccctctgtttcaaaagtaaggcatatacctcctggcttcctgcaagcctttttttctttttgaaatatactagcaaaaatgcccgtgcgttgcaacgggtgaaaaaattctaatgataatatatgtttttcatgcataattatgtcaatgacaatgtttgtattttaatgagcgacttgttttttataaacaatgttttttttcttgcgcgattttttcaaaccatttttcagaaaggtgcatttctttctaacagtttttcctagcatgttctttttgctttttttacttacaacgaaaaccgtatttttctcccttttttcttttcttttctcgtgtgttttttgcatgtttttttttctaacaattattttctcacgctttttttgcttgtttttttcgaatgttcttttttgtttttttccaatacaggagaatatatgacgaaataaaaaccgtgtagtagatgacaaaaaatcgatggatcctatccggctcaagcgtccatcaatttagtgttttttctgacagatttttcagagtgatttgttttttagtagacgatatttttatcttgcgcggttttttcaaaccattttttagaaatggcgcgttttttctaacattttttttcctcgcatgttttttttaaaatttttttaccgacgatggaaataatttttctcgcgtgtttttttattttttatggaagatgcaaaacctttttagtgtgttttttttgcgcttttttctgacttttctcacatgtttatttgaaccgtttttattttgtcgtgcattttctctttttaaatagttagattagattagacatagcgaagagatatatactgattagaaatcggaattagttttgccctttccattttttctcgcgcgcattttttattttttacgaaccattttttcttcttatagaatcggacgaactttttttagatgttttttcggattttttttcgcctttacaggaatcagacttttttttttcagtttttaaaggaatcagatctagcattttttcaccacttttattttgccttctataggaatcggatctacggttttttttcgccacttaggataaacagacttttgttgttgttgttgttgtttttctttgttttttctttattttattttattgtgtggtttttctttttttatttttatgcacctttctgcctttgttctttcccttttattatttttcaatcaaaaacgatctcaagtatcttatttcaagattgtagggactcaaatgtaaatataaaaattacatggactcaaatgcaaaagtacagacccaaaaattaaaatcatataaaaatggaatgctctcaatcggtaggttccgtttttggaaacagattttcaatccggtacatcaattttattttttgtttttaagggtgaatctagagtcaggatttttttccccttcctgagaaagaatcggtaggagtcggacttttttttatctttttcgctttttttttgacggacgatttccttttctgagagggaatcggtaggagtcggactttttttatattttttttgctattttttttgttttgacggacgaaggaaacatctcttattttttaagtagtagagatagagatagagataaagcatgcatgtaacatttatcgctgattctctttctttcctgtctttctttcctgtctttctttcctgtctcttcaacattcagtactaaaacactaactactcccccttattctctagacatcaacgctgtggactatgatttacttgcgctagtttattgtttccaacttttctttccctatttggtctttgtgtttgacaaatttatggcttacaaaaagaagtagattgtccaattatcaacatgagtgctaaacaacatatgatattattgttttatcactttcttttggttgaacttccacgtggtcacaactcatagtagagtcagttattaagtgtctgtacaaatgaaattgctcagtattgtg

SEQ ID NO: 91011 - DNA, 5632 bp, Oryza sativa
ttgtgtcccaactttccccacataaaatttcccgtcaaaactttacctacataacccttccttgtataaactttctatcgagaaactttcattgtataaactacttcccgaaaatattacccatataaacttttttcccaaaaacttgcccgtataaactttcgcccaaaaactttccacatataaactttctccacataaactatttccatataattttccatatagaaacttttatagagaggagattacaaataaatgaaaaaattatttcaaaatcatatgaaattttaatcaaatctcaaaaagtatatactcaaattcaaagaccttgaaatgaatctttcaataaaataacttctcaaaaccctgaacttaaccatggcatggagctcaccggggtgcagtggattttttgctggagagaaacagatttcgtgcacacaacaccttgccagagggaggaaaaagcacgtcgtcgttgacaaccacagctgcgacagggccacctcgcccttcgcttcatctgtgatgacgacctcatcactgtgcgctccgtccatctcgccaaggtgagaagagaggggaggggggaacagggctcttaccgaagaggtgaggaggaatagggagtatgcacacaacttgatttgtcgcgatagtggtggaggaagtgtgagaggaactcaagcagggaggaaaaaattatgtgatagaacagatctacttcctccgtccttaaaaagagtcgattcctagatccccaatgcaaattttgtataaacgtgaaaagacaaaagtgccctcattaactatatccatttatcaactatgccgtttctatgcacatgtatgtaagagacatcttatgcataataaacaacgccaaaaaaatttaaaaaaattcacttgctggaagaaaagaaaacatctacgatctctccaatctgaggggaaaaatgctcttaattccccctgtaagaactactactgcaaacaacggcaaaaaccaagaataaagaaaaaagaaagacaaaaaagaatagagaaaaaaatacaatggtatttgcctttaccactgtaggcttgtgcatcgagagtcaggattagatcccctgtaaatgaaaagcatacaaaacgcaagagaagagagatggggcggagataagatttgtggtgttaaagcgtgaatgatagggagagaggccagagtcattgaatgcttctattttttaagcattctaagtcggttttttataggacaaactctccctcgtacattcgtggtgaacgttcccccacccccacacaccccccgttttcacaaaccgatgcctaacatgcttgcgtgcaaacatcgatagtgcgaagtttttgaatttgaaatgaagagctggaattcatgagcagaagtatcaagatttcgctgtacgaaaatataaatgcagagacgctcagggggtgctaaacaacaaaaactgaacgaatgcacgcatccccacgctgggctcactcttcccctgtttccgtgccaaagatgagcatccgaagcaaaagagcgtagcgcaagaggaaaggagtagacaaaaaccgacaagcttcacgtttcggattaatggcaccgaggcattttcccagcacccaggcgttcgactgacgccgacggggccaacggcatttacgcctagcaacaagcacacacagtgcttgtttaccctacagtggcattgtggcaagcggccagccgaagccatgttcatgataagggagggagttcctgtcgacaaattcgcacggcagaaacaacagacgtttttcagtttttcacatgcatattctgtagattgtagatttccttctggttaagcaaggtttgcaattgctcccgtagccagctgaatacgagaatgtttggggagcttctgggagagagagcataaaagctttatcaaacagttttatccgttcagaagttatttagaagttaggggaagttaaggccggaaaggctgatcgcgatcgatcgccaaggccaactggtagcaatcagtgcccccctccctccacctggttttatttttttggcaccgcattactttcatattttagtaaatttatgcacataaagtttatacatctcgagtttacacatctaaagtttagagactaaaagtttataagtcaaaagtttatatatccgattcaaatttgaatttgaattcaaatatttttttatatatagtatttctagacctaaagtttataagtcaaaagtttatatacccgtttcaaatttgaatttgaattatatctgatttaaatttgaatttgaattcaaatattttctatatatagtatttctatatatctaaagtttatacacctaaagtttacagatccaaagtttataagtcaaaagtttacatacccgatttaaatttgaatttgaattcaaattttttatatataatatttatttacataaatttttctaacttttgttttttaaaaacaattttgtggtgttctgtagtagggaagagaaggagaggaggggggagaagagggacgtataggggagggggtcagcgatcacccgcttcatacgattaattatttttggaggaatactatccaaaaaaaattccctttcctttggtgctggtttcacaggaaaagtccaggaaaaaatcatccatcacaagctctttttttgcttcctacatgcaagtcctagacagtcaacttactgtgatccgcatgccctcaacttttgtactcctttgtttttcattattctgttttacgcttaaattccttctctattcctatacttttcagatcctatggttttcctatcctttaatccaaacgagcccttatatttacgaactctagaaaataaactagaagctagaaacaagtttttttcttcttctagattgtttctcaagactcatactctcccaaactcaattgtactgcttggagcctttggatgcctactttcattaccatccagtacccagttacccacagaagaaaggcaaagaaaatttccagccccccatgacgaagcatcgaagaggacatcattgactaccaagggaattcgttgcttttccagctcagaaagtgccctttaaaaccaatcgtgtctaacacatccacggtatcagaattaatcgacaacaaaatggcaattttcccaaggactaaataaaagtacagcaaaggtctcattattaagaggtgaaacttagggcatgttcactttgatgccaaaaaaaaaccttaccaaattttggcattaccatgacaggatttcttatatagttaccaaaatttggcagcaaactaaatgtagccacttttttttgataactttaccaaaatttggtaaggttgaaaatggcatcaaagtgaacatgcccttattttacccagatgccatactaacttccatcttcatacctactattcgctacgcagttgcaaccgagttgcttgcacataaacattagactatcgttaggatacctcgctactatttgatattctgattgaactcattcaattaacactctcaaggatgtactaacagagggcatcaaattggggagaactacaaatacaagaaggcataccatacataacatgaaatcttccactatcagcatatcagtatcacctactgcctttaactaaacttcaaagcaacaactagcatatcactatccaacatctctataattaacgacaaaaaatggcacttggcataacatatgcattatcttcattgtttacagaataccatttcaatagcacactacatgtataacaagctagataaatggaagaagaatcttaaaagagaacacaagttcaattatgcatgtttggttctaaaacctaatgcagaatcggagactgcagtgcaaagagcaaccaattatatataccatgttgtaggctgccctatacagctaattattccaatgtgctcgacagcgatggcagctatttttagtactgaggtagttaagcttgcaggccagatttctacaactcgaagcaaccaaagaaataaatttgtatagatgcatcctaatcatcaacaaaaagctaaaccaaacccttttttttaatcagagaaagggcaacaactgctgatgaaatagcaatggtaacacagaattatccatcatgatgattttgcgagaactagatagtaaaattaataacctaaggaacatgaatatgagattagaatgcataaagtagcaaataggttcatcaattttttttatctcacatcacagagctggaggattgccaaacctcctcctgagtgctgacatgacgctcctcatcctactacttgcctgggcagatgattgtgcattgctggcgttagtcgggagatccatggctgccatctgatcagtaagctctgtaatttgcacctgtccagcctcttgcccgccattttcaattgcacctccagcatcacgctccaatacaatatccaagctgatagagaatgagccacccctaaccaccttcaggttctcaatacattcatacgatacgccccggcatctcttcaatttcaccttgaccaagctggggcagcccccattcagtgcccacatcccacggtctgagactgggcaacccttgatgcaaagcttcttgagcgcagcgcagcgctcagccaggcaaatgatctcaggatccccaacggtctcacacccacaaagggcaagacgctccagtgagcggcaatgttcaccaagcatacggagactctgcacggtagggttgaccccaatcaagacgagctcttgcaggtctggacatcctcgtgcaacagccatgaggccatgatccccaatcctgtttgtgcgccacccatcaatatgtagcttgcgcagtttgtgacatttctcggcaacgctgattatgcctgcatcagtacactctggggtcttgacaagaaacaggacttcaaggtttgcacatgccgatacagcggagaggccgcggtcacccacctgcagcttctcaaggtggagctcaacaaggccaggtacacgcgcggcgatgacctccaatgggaggtcccaggagccagagcacctcaagatcttgagcgaccggaggttcggcgacgaggcaaccaacggcacgaagcagagggcgctgtacaggtctttcaggcagactgaccgcagcgacgaggcgggcgggaagaggatctcctcggtgatggcggtggtggcgccggcggtgtcagggaggccgcgaaggcgcttgacggagaggtcctcgaggagggggcacgaccggaggacggcgacgaaggccttgggcccaaaactgcaggacgcgacggagagcttgcggatcaccggcgtggcgccagcgagcgacgcgagcccgtcgtcggagagctgccggaggccgcggagcttgagcctggcgagccgcgcggacggcagcgcggcggccacctggcgcgccccgtcgtcggagaggctgtccgtcccggagccccgggcgcagcggagcgcgagcttgctcaccgccgtgaaccgcgcgaagatcccctgcgcggcgtacccgagcg

SEQ ID NO: 91012 - DNA, 638 bp, Oryza sativa
gctgttccaatggccgaactttcgacggagctgcacaacttctggtccatatggactaaatgctcccacatagagacctacatgtacaccaagaatccatcagtcaaagcagagaaaatatcaaggcgtccgtttaactgacaagacattaccactaaatgatctgagccgttactgtcagtaatgatcctattgaaaattgtattctcagtcagcttgactcgagccttgctgagggtaagctttaagagctcttgtacttctttatttatctgcagtgaatccatcatttcacagttaacttgattgcatgaaagaaatacagcctagaatactagggagtagggacaatggagagttgacaattaccactacaagtggatgaaacaagaatagacttgatagatagaatgggtcaaactatttctcaatgctcatatactaatatgttactttgtgaaagacatgatactattcaactaattgtgaagacttcaataaaccaaagcatacctcactaaatgctctaaactccagacttatatatagctaaaccaagtgttatgctcaccttcgaagaactcttggtcgttccccataatgccttcgcaacatcagaaagcataagttctgatgcc

SEQ ID NO: 91013 - DNA, 5972 bp, Oryza sativa
gttccgttaaaggcaaggcgttgaagcagggattgactgacatcatttatgacaacgtcatgccgatcgatccagagaaattcacgcctgagcagaaggcggagttgaagcaaccctgcagcaggcacgggatcagttcctgaactcatttatgcaaacccgcaagggggcacttgttcagaagtataaaataaaagtggttgctgatagtcctgggaccggctcttctaaagatggagaagtgaaacaagctccaggcggctcgggtcagccgagtactaaaggtgctaccgacggctccccgagcgatcatggcgacaattctcaaggagttcgtggcgttcaaggtgatggtgctcaggagccacaaggaggaaatcttgaccagaatagtgaactagcacaagattttttcaataacttccaagatcgggttgattacgctgtgcatcatgctttgatcaatcagtctggggtattagtcaacacattgtcaaacatgatgaagacaatagccggtggttcgatagctgagcatcctgcaggcccagtttacttgcagggaggtgtcttcccaagttatcaatctttgatcaccgatgttcagccgtctgttcaagcagttccctctgttgcgcccacaactcagccgacggcgccagcgtcgactcctttgcctgctatactagctatgtcgccaggacagccggtgaaccctcggttgttaacaagggaacaaccacaacatggcgggcaggctacgaatcggctaaccaaaaatcaggttgctgccatgtttctaccacctccacctattgttgatccagtgcagcagcagccaattcagcaggcaccaccaatccagctggttgtacagccaatccaacaacaggtcatacaaccagctcagcaaacaccaccaaggcaacaacctctgcagccggttcagcagacgccaccaaggcagcagcctcagcagccgatccaacagactccgttgagacagcagatcgttcagccgattcagcacccggggtcagtgaatgcatcggccaggttcgtagtacctggtggtcagcctgtgcagcagtttgtaaattaggtcatcccagaacatttggttcaccatgcacagccggacggcacaatgataccttagatggttcctgagcacttggtgcgcaacatccagccgaatcttcataattaccaagggggtaacttgagctatcaatatcagcctccttccccgcaagcccaatatcagccagggggattggctcagccctagttcgcatctcagtatggtcagttcgagtctatgcaacaacagccacaaggagcagctcagcaacgaccgtgggtcgatgtgattgccgatgtaatgagagaacaatttgggcttaaaccaaaagagactggaagcttgtatcggcagccttatcctgagtggtttgaaagagtccctctccccaatcggtttaaagttccagatttctccaagttttcgggacaagagggcgtgtcgacttatgagcacatcagccgattccttgctcagtgcggtgaagcatcggctgtagacgctttgaaagttaggttattccggttatctctgtctggatcagcttttacttggttttcttctttgccatacgggttgatcaatagttgggccgatttggagaagcaattttacagctatttctacagtggggttcatgagatgaagttgtccgacttgacagcgatcaagcagcggcatgatgaacccgtgcacgagtatattcagaggttcagggagatgaggaacaaatgctttagcttgagtttgactgatgcttagttagctgatttggccttccagggtatgattccttcaatcagggagaaattctcgttcgaagactttgatagcttatcgcatctgatacagaaggtaaccttgcatgagcataggtcggcggaagttaggagaagctctaagaaagttaatcatgtttgtccatacatgtatggatcggatgacgaggaagatgattctgaaatagctgcagccgaatgggtgaggagcaaaaaggtcataccatgccaatgggtaaaaagtcctagaaaagaggaaaagtatgattttgatatcaccaaggctgaaaagatctttgatttactactccgagaaaagcagattcatcttcctgctggtcatacaatcccatcggcagaggaattaggcaagaagagatattgcaaatggcataattctgggtctcattctactaacgattgcaaggtttttagacagcaaatccaggttgccattgaagggggaaagattaggtttgatgattccaaaaagccgatgaaggtcgatggtaatccttttcctgttaatatggtgcatacagctggtcaagcagccgatagggtccgtgcaaagggttttcaagtaaattcggctaagattatcaacaagtatcaaaggaagtatgataagcagcaggagaggcattatgaagaatacgacgatggttttgatcctcattggggttgtgagttctttagattctgctggaatgaagggatgaggttgccatccatcgaaaattgccctgggtgcagtgatatcgttgagaactcgagccggtcatacagtagaggtaatcggctaaggcaggcaagacttcctgttcatcagagattgggtccgatgaatcaagattgtggccaagaggatgaggtaatcaggaagaatcaatggtgtccttctggtattttcacgaagaatcagaaaagaagggtccagagattgaggaacagggagcgttttcaggaggttgaagaggaaatcaaccatcggctgaggaaaccaaagccaagacaggagtggcgtgtcaagaatcaggttcctgtagccgatgatgctgcagccgatgaggcgaagaggttggcaaaagggaagagcgttgtagcggcaccaattaacatggtctttacattgccagccgaattcgggatcgatcaggccgatgtcgatgaggtggaagagggatcagctaagttggttctgtcaccagaacaggcagtattcgagaaacccgaggggacagagaatcggcatcttaaaccattgtatataaacggctacgtcaatgggaagccgatgtctaagatgatggtcgatggtggggccgcggtaaatttgatgccttatgctacgttcaggaagttgggtaggaacgccgaggatctcatcaagacaaatatggtgctcaaagactttggtgataatccatcggaaaccaaaggtgttctgaatgtggagctgacagtcggcagtaagactattcctaccacgttttttgtcatcgatgggaagggttcgtacagtttggtgcttggaagggattggattcacgccaattgttgcattcctttgactatgcatcaatgcttgattcaatggcaaggcgacaagatagagattgtgccagccgacaggtcagttaatgttgctagtgccgatttagccctttgggagatggatggccttgattgtttatctggaaaagtctgggatagagattttctaaaagtgtccgattctgatatacagccaatcgaagatggagaacccaagctattactttgagggcgtcgtggagggttcaaatgtctacgccaaggatatggtagatgatctcgatgacaagcaaggtcaaggtttcatgtcggctgatgagttggaagaaatagacataggtccaggcgatcggccaaggccgacatttattagcaaaaatttgtctccagagtttagaaccaagctgatagagctcctaaaagagtttagagattgcttcgcttgggagtattatgagatgcctggactcagccgatcgattgttgaacatcggctacctatcaagccaggggttagaccacgccagcaacctccgaggagatgtaaagccaatatgcttgaacctgttaaagctgagatcaaacggttgtatgatgccgattttattcgtccctgccgatatgctgaatgggtttctagcatagttccagttattaaaaagaatggcaaggtcagggtgtgcattgattttcgagatctgaataaagctacaccaaaggacaaatatccaatgccagtggccgatcagctggttgatgccgcatcagggaacaaaattttgagttttatggatgggaacgcaggatataatcagatctttatagctgaggaagatatccataagacggcttttagatgccctggtgcaatcggcttatttgaatgggtcgtcatgactttcggcttgaagagtgctggagcaacatatcaaagagccatgaattatatatatcatgatttaatcggctagctggttgaagtttatattgacgatgtggttgtcaaatctaaagaagtggaggaccacatagccgatttaaagaaagttttcgagagaaccaggaaatatggcttgaagatgaatccgacaaaatgtgcttttcgtgtgtcggccggccagtttttgggatttcttgttcatgaaagggggatcgaggtaacccaaaggagcgttaatgcgatcaagaagattcagcccccggaaaataagacagagctacaagagatgatcggcaagataaattttgttagaaggtttatttctaatttgtctggaaggttggaaccttttacacccttattgaggttaaaagccgatcagcaatttacttggggggtagaacagcaaaaggctttggataatattaaggagtatctcagctctcctcctgttttgattcctccacagaaaggaataccgtttaggttatatttatcggctggtgagaagtcaatcggctcggttttgattcaggaattggaagggaaggaatgagttgtattttatctcagtcgacggctcttggatgctgagactcggtattctcctgtggagaagttatgcttgtgtctgtattttttgtgtacaaggttgaggcattatctattatctaacgagtgtactgttatatgcaaagccgacgtagtcaggtacatgctatcggctccaatattaaagggaagagttgggaagtggatattttccttgactgagtttgatcttcggtatgaatcaccgaaagcgattaagggacaagctatagccgattttattgtagagtatcgtgatgattcaatcggctcggttgagatagtgccatggactttattctttgacggatcggtatgtactcatggttgtggcatcggcttagttataattccccctaggggggtatgtttcgagtttgctatactattaaaccatatgcgaccaataatcaagttgagtatgaagcggtgctcaaggggttgcaattactcaaggaagttgaagccgataccattgaaatcatgggggattctttgctagtaatcagtcaattggcaggagaatatgaatgcaagaacgatacgttgatggtttataatgagaagtgcttggaactaatgaaagagtttcagctggttactttaaagcatgtatctcgagaacaaaatcttgaagctaatgatttagctcaaggggcgttggggtataagccaatgatcacagatgttaaagttgaaattgcagcgatgtcagccaatgattggaggtacgatgtgcatcagtatttgagtaatccatctcaatcggcttgtaggaaattaagatataaggcattaaagtatacactgttggatgacgagctttattatcggatgattaatggagtattacttaagtgcttgagtgccgatcaggctaagtttgcaatcggcgaagtacatgaagggatctgtggtactcatcaatcggctcacaagatgaagtggttgcttcggcgtgcaggatacttttggccgacaatgctggaggattgtttcagatattataaggggtgtcagg

SEQ ID NO: 91014 - DNA, 2147 bp, Oryza sativa
ctgatacatcagagtggttcaagaacatggatgatgatgatgagtcacccctatggctaaacgtactgctgagaaccgcattctggaggaagtgtgacgtgcatgatcagcttgaaaatacacatagggctgaggaaagcatcttctgcaccaactgcctcaagacaatatgcccacactgcaaacatgatcaaccgagccaccaactcctcaaggtccgccgctacatcttccgcagcgtcgtccatgtcaaggacatgcagaattttggtattgacatgtcttacatacaggtattacttagataaaattaatgcccatgctttgctatggataaaagaaaatatattataatatgcaatagatattttaaaattatcgaatatgttagtatcacttgtttacttgtttgaatatatggtatttacttgtttgaaccaaatatttggactattccataatatcaaaaaaaataaaaataatcaggagcatatttgtaaaaaactgtaaaagcagtggtgaggggacttttaaaggagtatagatgtatagttggcactgtggttaatcaacttggaaagttagtttctctagctccaactagtttaattagcttgtttcgaattaatcatgataagttcgtttgtgtaaggtttgtgtgcaataaatctttgttatttaaaactcctaatttgatggaagcaacaacaaattataatctgatcactatttgcttcatttttcttgtttagtcctagcattagtaatgataatttattttgcgacaatgtgggtttgaaggcaaataggctggtctccatttagagcccttgcaaacccatcctaactggttcactgatcagctagctagaccacacaggtcagacacaatttgacacaactttgtttggaaacaatttgacacaattagagtcgatcaaacgcactgaatttataatgaaatgaacaataatttttatatataagtgattgcacagtagcgtagtaaaggatgtgtcttgcggcctaatactactaggataaatggcaattaatagtgtcccggaggtgaatgccatgatcatctgaactcaacttttttttatttaaattactaccattctgaactcaactttaggctagaaataaaagatttaattttgttcaaacacatggattgattagaaaactgttttagctcatctgaaatgcataatttggtgcatatatatttattgattcaaaatatgtatctaattaatatcatgtagttatgcaagcacatctatgtaatcaaaatatttacaaagatatgtgtactcatataatgcatccatcacatgaagtgatcaaatcttcttatgaccatattacattgtataattcagtaataacttagtgaaatcttgaaaacatgaaagcacacattttttttttgcctttttagctttcatgtcactaagttattattacgatcatatcagttttgataattcagtaataacttagcaacatgatttcccatgaaatctcgaaaacatgaaatcaaatattttctagggttaagttctggacatatatacgcagaaataaactgcgatagttgcatacacagaaatagttataaattaataacataaatatttcacatcgaaacctaatagtgttactgaagaaaatcgatcggtaattactacacattttctcacatgtacatataatagttaatactacaataacaaacttgatcagccacttactcccccatatatatatgtgtgtgtgtgttatcccgcaatgctagctagcattagatcgatccaaaacctccaactgtatcggttcttcaaaaatcttttttttttgcatttgatcaatttgtactaactttttccaaaactgattgcattttctcatacagaaacatactccctgcgtcccaaaaaaatttcaattctagggatgaatctagactcttttttttttttggggggggggggggacggaggaagtacatacaaatacatcttgggaaatcatgcatgtttggtttgcatagtttatgaatatattggtattcatctatgctgactcctgacatatgtgatgggcttaccaagacaattttagggtgtgtttagttcacg

SEQ ID NO: 91015 - DNA, 517 bp, Oryza sativa
tactagacctggatactgaagcctgttttctagcattccatgagatcaaattagaacctaggaagactgcaaaaccccctgtagaccttctgtcatctaaatatcctgcccagtcagcatcagagaaggcacttacaacactagaaggtgatttctcaattttgagaccaagtttaactgttccctgcaaatatcttagtattcttttaactgctgcccaatgaacaacaaaaggattctgtaggaactgacagaccttattgattgagaatgatatatctggtcttgtaagtgtcaagtattgtaaagctacaacaatactacgatactgacttgaatcatttactcctaacttttctccttcatgagccgacagcttctctacagtggagagtggagtacttacaggtttgcatccagtcatactgacttgcttaaggatctcatttgcatacctttcctgacttagcagcaagccatctccatctttctttacttctatacctagaaaataatg

SEQ ID NO: 91016 - DNA, 702 bp, Oryza sativa
tattcaaggtcatctagtgtgtctagtcatcctttggaactagtcttttctgatgtttggggtcctgcccctgattttgttggtaataagaagtattacgttagctttattgatgactacagcaaatttacttcggtttattttcttaagcacaagtcagaagtatttcagaagtttcatgaatatcaagctcttgttgaacgactcactggtcaaaaaatcattgctatgcaaaccaactggggtggagaatatgaaaaactccatccattatttgaaaaaattggcatatcttatcatgtgtcttgtccccatacacatcaacaaaatggatcaacagagcgtaagcatcaccatgtaatagaagttgggcttgcactcctagccaatgcttatatgcctcttaagttttgggataaggcattcctcactgccgcttatctcataaataggacacctagcaaggtgatcaaccttgaaatgccactagagctcctatttcaccaaacacccaattatcaattccttcgaatttttggatgtgcatgttggcccaatctttgtccttataataatcacaaacttcagtttcgatccaagcaatgtgtcttcctcgggtatagcaacttgcacaaagggttcaaatgtcttgatattcctacaggccgtgtttatatatctcgtgatgtcatctttgatgaa

SEQ ID NO: 91017 - DNA, 1861 bp, Oryza sativa
ttcctagctactctttctctcaaaaaatgataatcaacttcaatatgtttaataccaggcataaaccccagggttagcagacatatattgggctccaatattatcacaccaaacctttgcagctttaggtgcattaacacctaattcttgtagtagagtctatatccacatgatttcagctgtcacatttgctaacgccttgtattctgcttctgtactagaccgtgacacagttgcttgctttcttgaactccatgacacgagattacagcctaaaaatatagcaaaacctcccgttgatcttctgtcatctatacagcctgcccaatctgcatcagtgaatccactaaaaaacaaggatggagatttactaatcctcaatccataattaacagggcaacttatcatgtgcactcagcacatcccgtgcactcatgcactcctgcaatctggtccttccgatctcaatccgatgactaggatctgggtaaggtaattttacaaaaaaaccgctcgcctcctaccctgtattcttgctgaaatccccctaacccctggttgtccatctttatcctcctgactccgtcagaggctcagagcatgacgctgcgacaaatccaaaaattccctctgaaccaaacttttgtttccctcgattccttctgattaaagcaaaacggtgattttggaggtgcttaatgttgttcgtgtgagttgatccctcaacaggaccttatctcccattccatgtagcagagaggaattaaagatttaggttttggagaaaacaaataggaccaggaataattttaggaatgtaagagtggatatctagtgcttgattccttatttctatagcctaattcatcattttgtatcagtcttcttgctggtgggtgccgccatcgtcctcgtcgagcagcttcatgtcaccgtctttgtgggagagacgaagagatttgggggtggctaaggcgaaagaacagaaaatccaagccagggagatttttgtaaaggtacaaggtaagaggtgggcggtttttttgtaaaattaccctactggatcctagccatcagattgagatcggaaggacctgattgcaggagtacaggagtgcacggcatgtgctgagtgcacctgatacgttgccaattaacagtatgcttaatataccttaaaattcttttaaccaaagtctagtgagtcacagtaggagtatgtaaatactgacataccttattgacaggataagctatatctggtctagttaatgtcaagtattgcaaagctcctactatacttctgtattgagttgcatcattttgaccaagtggtgttccttcatgagctgataatttttttgaggttagcaaaggagtgcttacaggtttacaatcttgcatccaactcggcgcagaatgtcattggcatacttttcctgagttaaaattattccactgttcacttttgctcacttctattccaagaaagtaatgtaaatcacccaagtcctttaaagaaaaagctttggtaagatcctgcagaaaagcagaagttgcactagccatagaactagcaacaattatatcatcaacatagattagcacaaacatggtgacatttcccttattatagagaaacagtgaagtatctgccttggatgatttaaaacctagctcatgaaattttgtactcaaccttgaataccaagcccttggtgcctgtttcagaccatataatgctttatcaagtttgcacacataatttggtaccttttcactttcgtacccaggtggttgtctcatataaacctcctcttcaagaactccatgcaagagggcattctgtacatctagctat

SEQ ID NO: 91018 - DNA, 794 bp, Oryza sativa
cactaagcaatttgcactgaaacaaaagaacaatggtatatcattaaatttctggggaggcaactaccacttaaagaaatataatatttagattaggaacaaccaaatgttatacaactgacacagtatagtttgtgagaatttacatatcacatatgaatatataaaggatgagacctcaaaactcaccaaatcctaaaatcactgaacaaagcagaaagcccaaaagggagaaatccattttgtacagtatctccaaaacaatgatgcaacctgttgaaaccattagatgtcttggagaagagaagaccagatgcaatctgcccgagagaataataaaacaatcaacaaattagagacattatatcatgaacaaaatgggagttcgctaaacaagttgttatgtctttgtgtttagtaagaacgtcagatattaagagatattaagttttatgtggaacacatgaagaatttaagagatattaattaagttaaattcataatctgctcagattctgatcagttagattagtgataaacaaaataattaagcctggtcaattacattaacagaagacaactgatggaaggatttgagcaatttttacatttcccttttaatagaagttgagattacccatctgtaagaaaaatcttacttttcctcggcaacattgtcaacatagaatataagcaccattccaaacaaaacagtactcaagtacgcccagcttggaaactgcagtttaactatgctgtcagatgccgagccctgtgatcaacacaacatttat

SEQ ID NO: 91019 - DNA, 2924 bp, Oryza sativa
gccagcaaacgcccccgcgagctcgtccgcaccctcggccgcttgccctccgccaacaccgccatggtcgccaccaccacatcctcaggtacaccaccaattctcacccccacactgtcaataatggtgacactgacgctgacaccgccatggttgtgtgcaggcgagggagacgggaggttcccgccggagctgagcgtggaggcggtgttccggtgcgtgcggatcggggcggtggacgaggcggacgcggagctggcgtaccagacggcggtgagcatcggcgggcacacgttcaaggggatcctccgggaccacgggccggcggacgaggcggcggggcagctgccgccgtcgtcggcggagtaccaccagctgacgggtcaggggagggaggaatcgtcgccggcggggagcagcgagggcgtcggcggcggccacggggcggcgactgcggcgacgtccgcggcggtgctcatggacccctacccgacgcccatcggcgccttcgctgcaggcacccagttcttccctcataaccctagaacctagcaacctagctacctatcatcatctacttccttccatgatcaaatcatcatcaatttgctagtttcatttgcatcatcgtctcaacaaaacaagatcaatcgaacaacaagaagaacaagaagaagaagatgatgatgatgagattaagagattatttgttatttcagccgatgaacactaatgcacggtcgatcgagagcatgtcattagctagagcttagctagtactactgcttgtcgtcgatgagcttattaatttcgagtttattaattaatgacttaatttaatgcaatgcaaagagagagagagaggaaaaaaaaagaaccaagtgtagcttcaatgatgatatcgaacttgttctaattaattaatttgcttttcccccttgattaaaatcccttcttttccccagttgattttggcatgtgatgagttgattaattactactgcatgcttaaaatttcttgagtaattaattaagtactccagcttagcttaacttagctagtactagtacgtgtacgtatgtgttgtgtgtgtgtgcatgggagaagctttctctggctttggcatgggtaaagctggcccttcacctgatggtgtttttttatatgatttgttgcatgttttaacccggtagtacctgcggttgtttttctttctttttcttctaccagtagtttgcttctttttaagcagctattctgtacattcagctgctgcctcatgccttgggatggatgagcaatcagcttctcctaccttagcttctttctcttcttcctgatccagatcaagggaaagtacataaattccatgcatttttttttgctgggattgatgtaggttttttttttctctttggctaatctactcgacaatgctgctactgccttgtgctatgcatcatctttggactctctttcatctctctctcatggtcatggcctagctattggtctctctctctctcctctctctagggtacatagtgaccttgtcacaccactgttccttcttttcctaggctactgtttttaatattcttatgttgaagtgacgtagagccatgttgcaatccttcaaaaaaaattaaaaaaaaacaaatgtaaaataatgcattataccaaccaatacaagtcacatggaatgatggaatgtcaacaatgtgtatggttggtttttactaacaaattaatcttacctagttagccctaagcaaccattagtctctctctacattgtctgaactgaatctatacaagctctgctaattaatgctaggagtatgcatgtttcgtcttcattctcatctctctgttcttcgatctgtacgtatctactagctagctagcactgtcttcttacaagagtacaatttttatttaataaaaaatatatgaaaggataaaagaacagttactggtatgatctcttgtccttcagtacagcaactatgcaaatttgcttcactcccggccggcctatacgtagagtgtagagtggtacagtagtgatgtatagtactgtccatatgctgcatctagctgtagcctcatctctactttgtttcttttactccatctgaacacttattctctttttattatggagaaaatcatcactgaacttttcatatgggggtgtcgtagtagctcaagtacacaatatagctactagctagcttgctaggagattgtaatgcagtgcataattcacagttgttcagcatatgtttggattaacgatgtacatacacatcaagtgcatttctgcgtttcaaattgtccatcattatctgtttgcatttgcactgaaacactttggtattgtgttgctagttattcatactattgcccacatgattaattagtatatatatatacgatatgttctacattgtgaggggcttttcaggagttcagattaagatttaatttgcgtaacttcattaaatgtgcttggagtgtcacaactctgttgcaagatacacattaactctatatatcgataaaaaaaagaattatacatatcgatcaaagagaggtatattgtgcgtcgctaaactacatgcatgtgcatatatataatactgtaagaaatgcaacacatttcccaaaataatcaaagatgaagttattttggaatagatggagtagcatatatataactgaagaacatatatatatgcacgtaccttcgatctgggtctgtttctgatcactgatttgagttctattatagtacaattcgtagcattttagtatactaatgaattctaagctagctatatatatgatataatttcatctaatattttaattatatgcatatatatgtattgatcttgttgttagtcatggttcaatt

SEQ ID NO: 91020 - DNA, 540 bp, Oryza sativa
acaaagctctttttgctgatgctatgagcatctcatcatctacctgcctgatctgacaccttattcttgaaaattttaccataaaacttctcaaggtttctcccggcatctgcttcagtgcgtataggtcatctgctttttttggctcttcatatacaccaatgaaacctgctcgaaaagtatctctcatatgctcccacgagtagattgacataggtggaatggtggtataccacgacaatgccactccttctagcatggttggaagtatctttgctttcgttgtgtcatctcctccggccgcttctaccgccgtctcatacaccctcaaatactcatttggatctgtatcacctttgtactttgtgatgtttgataacttgagatgtattggccaaggtgccatttgcagattttggctcagggggctctaggtatcgattgctctcgccggttgaaaataggattgtgctgatgcgaactggcctatgcggttggggaattgggtggcaaactgggttatgtttggatggggcattt

SEQ ID NO: 91021 - DNA, 1418 bp, Oryza sativa
tgcaagtgcgaacttattggccaaactaagcaaatttaagcagtgatggtggccacaaaagtgaagcaattaaagtaaggaattggggaagataaatatacacttatataggcttgtgcagatatctagatatacccttattactgcaccagaagaacatacatatatatactaatattgctgcattattaggcataatattggcagtattttttttaagataatggattgattaaatccggcctatatatccacaagagatgcacacatagtcaacagcttccaagggaaggaataaaatccacagtagatgtacacctatagccaacagtttcaagaggaaggaataaaattgtggtatatatatatatatatatatatatataaatttaaccagaaacaaatactgagaaaatgggcatggcttattcctgacctttttcttgtaggtttcagtctgtgtggtgatcacatgatactgcagaaattaaaaccgaattaatcatgagaaaactgaaacaaattaaaaggctaggatacatgaagcagaaagtttaatatgttacagtccaatagatcaatgagcatacatcctactagttgtaagataaaacaatagtacacataaattatgtttctataaagcataaaccttaaaattatcttgtttaatacgagcaagcaaccgaggccaaattaaaaaccatcaatataatttccacacatgcaagaagccaagaagggttcaagaaactcgtagatctgtagcgagaagcatgaaatatgcacggatctgatcatgaaccgtagatctagtgtgcacaaaatacaaggatctaccacccttgaattaaggaattgaacgacgttttagtattgagcaaattagggttcgtagtttaattagggcgtgcgtgcgtgcatgccttcctgtggcgaacctccttgagggcggcatcgacattttgctcaagaccgcgcagctcgtcgaactccagcccgtccagatcttctcccatcctttgcctgcacacacgtatggttgtttatattcagatccagcagtacatatcttgaaaaacgttgtaaatttggatctcttgttcaagctaaaatcccccagtaactatatactaagagggattaattaaggagaagagaggaaagtaattaaaggggtgaaatttgtgctggcctgatctcggtgcgcaggttgcggttgatgtccttgagatggctcagcgtgcgctgcatattctgatggatgaaaacaaaccaaaccaaccaattaacgagcagaaggagttgggacatagaattaaaggaaagaaactggagtgaaaattgagaagacgaatcgagcaaaagatgagaaaacaaatcataaggagagaatcgaagtgagcagcttggttgca

SEQ ID NO: 91022 - DNA, 3304 bp, Oryza sativa
tctcttcccactctctttcaagtgctgctgctgcgcttgcaaaagtgtcggtgtagcggattggcactgacttttgcctttgggaacgtttcatttactattcaagcccactccaaggatactacacgtccccacggacggcgccactgtcgtgaccttgacccaaggtcacggacaagattagggatagacgggaaaacccccttttcccgcctatcctaagaaatgagcccaaataccaaataaacacatactaagtgacaagacttttagtattccaagatatcctgcctgctacaggctttttgtctgctttatatagttcacagctttacatgtgagattacacttgcaccctttgttgggcccacatgaaattacaattatgcccttgctatatcagctaaccctaagggcattttggtatattatggaggtcattatagtcttttggtgccagctagatgaagtggttgagtggtcctcaggaatattctcttggcatctttgttgtctaagtcgccttcttcatgatcaagagtcttttccaccaccatgggtcttctcctcgaccgagggtcttttccaccaccatgggtcttttccatggcaaatagtcttttccagttcgaccacccttttcgacttatccggtagctgacctgttactgacttaggaaacattcaaaatggataataagacttagtgacaagaatttactcgaacggtattttctgactcgaatagtgttttaccgtttccctgttcgaatggccatttccactcggatacttagaataatgactcaatctctctctacagtgttttgggccgaatatggagggacggtggtcaccccctgctacaaaaagcccctcacgggtaagggcgatgtgtgttttcgaccgaaaccgtgttcgaatcaaaagctaggggagaaccgccgtcctcctattcggttgaaaaaacactaggatataaaattttgaagttcgaagctggttattcttgataatcattatgcgtttatttgaaccgaaaagttgtggttcgccgtagcaagtatcattcaactcgaaacatgaagcacattgcattttgaacacatgagaagttgctcttttctcaagcaactaattgtgatgatgaagagaaggaaatacattacgatgacacttgtatttttttcttttaattttttttaaatggcaaagagaacatcgagatggcagtttgcgtgacttcgtcgtcgagtttagaaaacgacgttcgaataatgcttcgagcagcattaatttttggcaaacctttagaccatctgagcgtcaacttataatatggaaaatgcgctactcaattgtctcttacacgggaatgccttctcctctcaatgtcatttttccttcttcttttccttttttaacaagcaatcagatgtaaatttgtcgtgtggtctttaataaaacagtttccgaatacttttctgatacaaaatagctaaggtaaaaatttattcgaaaaatgtcatcaagttggcttttcttctccgaagcgtgcggagggttttctcgatttggtatcgagttggattttcctctcctctccgaagcgtgcggaggattttctcgatttgctatcgagttggattttcctctccgaagcgtgcggaggattttctcgatttgctatcgagttggattttcctctccgaagcgtgcggaggattttctcgatttgctatcgagttggattttcctctccgaagcgtgcggaggattttctcgatttgctatcgagttggattttcctctccgaagcgtgcggaggattttctcgatttgctatcgagttggattttcctctccgaagcgtgcggaggattttctcgatttgctatcgactttgattttcctctccgaagtgtgtagaggatttttctcgatttgctatcgagtttgattttcctctccgaagcgcgcggaggattttctcgatttgctatcgagtttgatttttctctctccgaagcatgcggaggattttctcgatttgctattgagtttgattttcctctccgaagcgtgcggaggattttcccgattcacaatcacacaagacaactttttatacaggttcgggccttcattatggataacaaccctacgtcctgtttatatgtgttaacatcgagaagaaaagagaatcttacaaaggtggtcggtattgtacacttcaagcagcatgtttccttttattttcttttattttctttttttctttctttctcttttttttcttttttttacacatagaatttcttcaaggaaatagcattccaagtgtgctttaactcttctccatcgaggtgtgccagcttgtatgctcctgtttctaacttcctttttactatgaatggtccttcccatttcgattccaactttccaatagccacttcattgagtgttttcttgaggaccaaatcaccttcttctatttgcctgattttcactcttttttcataatagcttttggttccttttgtgctttgtgccattttgtctaatgcttccactcttatctcgtctaacatttccaaggtgatttctcttccttcttctcttgttacacattttagcaaaggggcagtgactccactcttgtacaactacccttctatcactttgtatttccttgacattaaccgtattcttcttgtttcttcttccttttctggaagttgttcacgaaccaaatacttcagaattggctctctccaatctatctcgccttgtatgttttccacttctcttttctcataacttggttgaattaacatatcaaagaatgaattctccaatggttggcctgtggcggctgcttttgcaagctcatcagcttccccattttcttctcttgttatagcttttactgttatccctcaaggaagtgtttttcattcagccttgcttcttccaagtactttgccattgtctcttattttgcttcaaatgtttttggaaaagtgacctgccaccagctttgaatgagttttgattatcaatcgtcgagcccctagtgctcttgcctttctcatggctaataaaactccttcgtattctgctgtgttgtttgttgatgggaaaactagctttgcggaatatttgagtgtttgcttcatcggtgtttttacaacgctgctacccctgcaccagtggcattgcatgctccatcagagtatactatccatggttttccatcttcttcctttttgtccaccctcattgggagtccattctgccaaaa

SEQ ID NO: 91023 - DNA, 2738 bp, Oryza sativa
tcctgcagccctagtccttattttgtaatttggtgtcttgcttacgttttttatgctcaaagaaagatcagttgccttccttattgatctgttcaagcggcttttcaaggatagattttgaactaaagtattattaacatgattgacctttggttagccctgtttctctgtcttccttgatatgcttataaaacacaagattaccttgctttaggttccatggtatgttccttgtggtggctactgctacggtgatggaaatcttgtgttccttgcaaatgattggcatactgcactactgcctgtttatttgaaggcatactatcatgacaatggtttcatgatatatgcccgttctgttcttgtcatacacaatatagcacatcaggtatgttgatctttaactttcgcgtgtgatttgtgtttgccctaagtctcccaatgaatcacctactaaatgcacaatccatgtgttacttctggttcatggaaagttaacgaatcaaatctattaaatgtatctaccaagttgaacaatcatatagtccatttttagtccttgaggtcacagattgctcatgaacgaatattaatagatctttcagtgtttaacttgtcctttctagaaaggaaaacatttttagctttagatagcagatagattcaagcaacatcatgatggatatctgaaacattaaacagagactaccatgcagaaaattgagataatacagagaagaaagttttagagaagtctgaaaacatttcaaactttcaatgaatagattacagcttctgtttgttgtcttctgttttctgttgaacaatctacatagtggctgtactgaattatgtggtttttttgcttcagggtacctgttattctgttgataataagtttacttaatttcacttttcagggtcgtggcccattagatgacttcagttatctggatttgccagttgattacatggatcttttcaaactttatgacccatttgggggtgatcacctaaacatatttgcagctggtattaaagctgctgaccgtttgcttactgtaagccatggttatgcatgggagctcaaaacagctgaaggtggttggggtcttcatgggatcatcaatgaaagcgattggaaatttcagggcattgtaaatggcattgatacaactgattggaatcctaggtgtgatatccacctaaaatctgatgggtacaccaattattctctagaaacagttcaggcaggtaaacagcaatgtaaggcagcattgcagaaggaacttggtctcccagttcgtggcgatgttcctgtcattgctttcattggacggctagaccatcaaaaaggtgtagaccttatagcagaagcaatgccatggattgctggccaagatgtacagttaataatgttgggcactggacggcaagacctcgaagatacattgaggaggcttgagagccaacattacgatagagttagggggtgggttggtttttccatcaggttggctcatcgaatgacagcaggggctgatatactattgatgccatcaaggtttgagccatgtggattgaatcagctctatgccatgatgtatgggactgtcccagtagtccatgcggtcggtggtcttcgagacaccgttgagcactacaatccctacgaggagtccggacttggttggacttttgaaaaggcagaggcaaacagactgattgatgctctagggcactgcttgaacacgtacaggaactacaggactagttgggagggactccaaaagagagggatgatgcaagatctaagttgggataatgctgctaagctgtatgaggaagtcctcctagctgccaagtatcaatggtgatcagtccaagaagacctcgacggttgttcagtcattcatgaccgaaatgcctttttctcgtgtcagctgctcagatgcggccaccatctagttccatggcttacatcttcctgtgatttggatgaacagagtttttttgtcagatctgacatcattttcaagaaggcacatgatgaacctacttcccaggtgaatacagcagcggacgatgcctttgttggaaggtggcaaaacacatggaagattcagccgtctgccagcatgcacctctgtcctaaggagaggctccaagccccattgtgcgctctggagaggctccaaaccaccattgttcgcccctgggtaggttgttgagctcggttagatgcttttagtacagtagaatagcagatactagcggatagactagttgatatttcccctatgcaccgagtggttcggttgtaccttatttttttcttggctcttgttgtccagttcttcgatctttagacgattagcgtcccgggatttcccagatgacattgacattgatactagtgggaatttcccctgcaaatttactgtcagcttttccattggtctgcagctatgatcagttaaacccgtggatcccatggtggctttcccttctacttgtgacttggggaggtaggcaacactgccccttgatagttgatgcatacgcttcatgcagattcctcgactggtccattggcacatgaaagaaaaggagattgcaagtatgcaacgaccgtgtgggtatcagcgtgtgcaatgctcgcaagctcgcatgaggtggccgcaagcctgcgacgccggatgcttagccccaaggagagacggtgacatacaaggtaa

SEQ ID NO: 91024 - DNA, 1371 bp, Oryza sativa
tcccttctatacccctgaattttgctcaatcccttacatacctctgaattttagtttggatccctttcatgctctttccgctagttgaccgttagttgaccataaaattcttttaaaaaagtccattttgccctttgctatgaagaatcataataaattaatgaagtacattgttagaatgtaaaaatttattggatgagactattatatttatgagtctgtgatgcaccatattatttgtgacaaatttacttttacatatgatataaaaatttaatacttatttattagttattaaaagttttttatgtagcatatgtgttttcatagtaatacaacatatttgtttattactatcagaacacatatgctaaaaaaataaataagtattaattttttatgtcatatctaaaagtatatttatcgcaaataatatggtgcataactatctcataaacatattagtctcatataacaaatttctatgctccagcaatatactctattaatttatatgcttctttataccaaagggcaaaatggactttttcataagaatttaacggtaactaacggtcaactagcggaaagggcatggaagggatccaaactaaaattcaggggtatgtaagtgtcacgcccagaaatttagcctaaatttccagactattttgtgtattaaatccctgttcaggaatcagccaaggtatataaaacgacaagtaataaacagttccaaacgtaaataaagcgtaaatacttacagaagaggctcttagtcctcacaccaaaaagaaagcagcagcagcggaaaaaggcgatcctagcggggattcagctccactccacaggcaaaactcaactgggtctgagccttggttctctaactccatcttcagctcagaagcactacacttttgaaaagggggaaataatagcaaggctgagtacaaccaccgtactcagcaagccacaccaaagatgcagacgtgcaagggacacaaagatggcttgaggctatttgcataaaggcggttgtaaagcattttattgagcaaatcagtaaaacggttgagtcatttaaggtaatattaaatctccactgatcaacgctacaccacgttgaacaggcccaaccaacccacatgaactacagtgcattggggcgatttattaagtgtgagactaatcacggttgacggagctcgaggctcctcaccgggagaccgcgcaggcccccctttgccggttcggccgggggcttagggtgagatcccaagctctctctctctctctctgtatgtggaaggatcgtcagccagcaagaaacgcgagacacggacgatctatacaggttcgggccgctcggaa

SEQ ID NO: 91025 - DNA, 5115 bp, Oryza sativa
tgtcggggagggggagcgagacagttggaagggggaggaaaagcaaacttgagggagatgggcctatgacacgagagtgggagagagggggcgcgggccgcaggagggggaaagggacttgggtcgaaaatggcccaagggggatggagggagattttatttgttttctttttattttatttgattatatgaactttgtattgttataattatttcttgagctctgaaaattcacggaaaaatccggagagtatattagggcacaaagaatattacaaaatattcccggccaatgatttttaaaggaaattttaatttcctccataatttcaccaaattaaattgattaaatttttatttaatttatagaaaatgcattattaaatgatttttattcccgaacgaaaaccggggcgttacagtaagggattgagcaaaattcaggggtacataagggattaggtgaactttcagggatacacaggggattttctctaaataaaaacagagaaacataaaaagtaaaagctttcatgagagaaagagaatgtatagcacaagacacattgtaaggccccatttagttccccaaaagtttttcccaaaaacatcatatcgaatctttgaacgcatgcatagaacattaaatatagattaaaagaaaaactaattacacagttacgggggaaatcgcgagacgaatcttttgagcctaattagtccatgattagccataactgctacagtacctacatgtgctaatgacggattaattaggttcaaaagattcgtctcgcggtttccatgcgagttatgaaattagttttttcatttgtgttcgaaaaccccttccgacatttggtcaaacatccaatgtgacacaaaaaatttcatttcgcgaactaaacaggccaagtaaaaaaaaatcattataggaattcgattcgacatcctacgctctgccttgctcagactagctttgagaatggaaataagggggtgtttagattcaggggtgtaaagttttagcgtgttacatcagatattatatagggtgtcacatgaagtgttcagacactaataaaaaaactaattacagaatccgtcactaaaccgtgagacgaatttatgaagcctaattaattaatcattagcaaatgtttattgtagcaccacattgtcaaatcatggagcaattagccttaaaagattcagctcgcaaattagtcgcaatctgtgcagctagttattcttttagcctatatttaataattcatataggtgtttaaacgttcgatgtgacatgatgtaaacttttgaggtgggatttaaacatggcctaaggctctgtttctttcagcttgggattattataatccagattattgggagtaagctgaaagaaacaaataatttattgaagtagtttattataatctggagtctagcttattataatctgataagcttatttaggtgagcttttttcagattattgggtgaaaaattacccaccatgccaccccactccctctttagacttgcaaacccaacaatctaggctttaataatttaggaaagaaacaactaaccgcttattctactgtacttcctccgtttcacaatgtaagtcattctagcatttcctacattcatattgatgttaatgaatctagctagatatatatgtctagatttattaacatcaatatgaatgtggaaaatgctagaataacttatattgtaaaacagagagaatagattataacaatctagcttatagtaatctgacttaataatctagattataataatcttaaactgaaaaaaacaggagctaactctgctcaatttttctttcccttaatagtacccctatagttaactccggtgggtttagatttagacttttccagataatgagcgagcaaattctcaatcgtgccgactgccgaccgctgacacgcaaggccaggaaaagaaaagctagcaaccgttctataataattgacgttttagacaaggttaagatcaaacttttataattttgactattaataacttcaaaagtaaagtatttagtttaaaaaaactagaacaagatatataaatttgtctttcaaaacactataataaaagttaacatgcatttatttattgtgtatattacaatagaaaaataagatcaaaggtatatttcgtagaccgtgttattatccaaaatatcaattaaaatgaaactggagggagtagtacattgccatctgccaatgcccaatgggctagcaacaaaagaccacatagtcttggttgaagggatgctgcggtgcagattagagcaggtacaatagcaggctataagccggctataaccatatatcgaggagaaaagagaagagagagaagaaagcggactacagatttatagccggctgcaacacagactctaagatattatgtgtgtatgagaggtgggatcagatattaatgatgtagtatatttttatagttaactattatatgaatgggctattagattggctataaatattttggagacagtagttggctatattattggcgccttgctcttagagcggacggccgcccgtaccgactcccgcgttccgacggagcacggggaattcttgcttccaacaccccagacgccgcacgcaagaatcgccaacctctctctcacgcgcaccgcgcacacggcacacgcgggatttcctcccctcaccgacacaaacgcaaccgcgcgccgaggaaaaacccccggaaaagccgacgtactcatccaccacccgtccacccgccgtctacgcctacggcctactacgggccaccaccaccacccaaccgcgcgccgcgcctgtctccgcggtttccgcttcgccggcacgccgcaacgccccccaccaccaccacaatctcgcgctcgcggctcgggtcgggagcggcgcacacacaccgccaagccgagagccagagaccgtcaccaccgcgcccaccaaaactcaccaaccacgaacacgcgtactagtactgcacgcgcccactaccaccaacaccaccacctgaaaaagcgacacgacgagtccgtccagccgacgcgcacggcgctagccagcggaccccacctgtcagccacatccccccggtgactgcgccgtcgcccgccgtcagatccttccgcacgtacggccgcgcccgcgcaacgagggcgctgctgctgctgggccccactgcaggtgggcccgcccgtctcggaagtttggggggggggaacgcgagaggtggggccagcaatgaatcctggctcttcccggtggggcccaccacgcccgcgcgccgatggccccgaggcgagacgagagtgagtttggcgccaaaaccccgcgaaaaattttcggtttccctcctctttccccctctctctcatcccagtacaaaaccatctcctcgatactctctctctcttcccccactacctcctcaaccagcccactctgctattccatctgcgtgagagagagaaagaggggaggggagagagatttgtggcgtcgtgggtgctcggttgcggcggttaccgcggggaggaggagggagttgtgctgttgggggtttggatctagagcgagcataggatgggagctgctggctcctgagctgcgccgcgcgttgccctccggtaaatcccgcctcaccttcaaagagatgctgttctttcctcggttgatttctccttctcgcgctatcggttgttcgttgggttgctctccgcggctgggagaagattcttgttggtgagcttgttttgtgggggatggatagatggataggccggtggcgtgcgatttaggagtggacgtcttgggttcttgctacaggcgattttcctgatgcgtgggatgcatatgcgtgttcttcctgaatctgtggcatttactgtagaatggggataaatttgcacagtagaaagcaaatattgttagaccctattttgctgtagtacatttcggcagattgggaggattggtgttcgttgcatgcaattcctcccctggaatcaatccgtttggttgctttatgctgttaattacttgatctgttatacttcatgtaattgggtggtctattattgttcaacaataaattggagccttttccaggattacttagggagccatgcatttaatcgatgataatgattattgtgatcttgaggattcgcttcaactgttatctgatgctgttcattaagcaaagcgttttattgctacatccctagtaatactgaatgatttgctccttaaactcttggcataaatatgactgccttcaatgttcacgcgctaaataaaatgttcagtttttttgtcaagatgtcccgttaagcttcaagtgtgaatgatctgtactgttcagattcgaatttttggcactgatgttctgctctggttcattcaggtaccatgcatttaatttatcccctaatctggtaccgtggtacattaaactacacaaatgtccagatgtctttgaatggatctgatgaatcatcagtatgaacttgattgataccatgctttgtataactatgttatttaatcctgccaatttcttcaagaatgtgagatgtgccaccagccactacttaaggaaaacattcgaagtgcttgtaatatgaaaagggactgctttctttgttaaatatagtgtatatacacagagcatttgtcctctttttcagtgttttccagtttagtaaattctcagatggaattttacccaaactctctgattttgtaaagagcaaagctccccccttacctttcttccacctctatttagctaagagaactgtcctgattcctgacccaatcttgctagtttggctacaataggccattttttttgctttatattttgttcctcttacaaagaatgaatcttgctatagagaaggctctgcctgaatttatattatttccttaagacaagttatccgtgttaagtgttctttttttctactgattgattcagggagatgaaattcgataagaatcaaagcttcacaacatctactgcgaaattggataggaatca

SEQ ID NO: 91026 - DNA, 2248 bp, Oryza sativa
gcaaatataaaagtatttatgtcatacttaaagaacatttgatgataaatcaagtcacactaaaataaatgataattatataaattttttaaataaaacaaatggtcaagcgttggtcaaaaagtcaacagcgtcatacattaaaatacagagggagtaattcatttgtcaataatgatttttatcttgccactagtgttaagtaaaatcaactcaaggtatacaaatcactagtattttcattaccgttgcccaaaagatcctccgaattttcctcatctggttctgaatacccagagtctgaagttagtgattcagatgaacctggaagagccactttcgttgctatctcatttggaggagcatatcgcactattaaaacagaaatggcaaccatagtaaatgccaatagtgtgcccacgcttacctgaacaaacaatcaagaaattattactacctggagtagctctccactcagcaaagctaccgtattacatggcaagtaacatattaccatccctgccaattctgagacgtccatgaaaagagccaggatagcagcacatatccctgacaatattgtgctcaaggttgggacttgggtcgttggatcaacagctgaaaagagtggtggaagcaatccatctcttgccatagccatcacaattcttggctagccaaaaggcattggaagtaattagtcagtttttttcctggtgtaatttggatgatcatctatcatatataaacatgagatggttttttaaaaaataagctaacgttaagaagcttaacttattacattttctagtcaagctatcagttatgtatcctgtaggatgagaaaggaattcaactgggaaggagatatacagatgctttagtttctcaattcacgtagacacatacctgagggagaatagcacctatcaaggatgctataagagcaaaaacagccccagtggaaataatgtacctacataataacagagataattacatggatgcttaacactaacatatatacagcatgagatgataatctccttaatagtcaagcaattcgatttaaatatatatatatctagtacttacactgcccattgcattccatatttagcaaaagcagatgaaataggagtgttaggatccaatgcataatatggcaccaagccaacaataacaatagaaaccatcatgtagaggaagcagcacaaggacaaggtcagacacattccccatggaagatcacgttggggattcttcacctgaaaagtaccttgacaaataaagataattgtgtaactgcagatttataatggccttccctgaagtaccagactctggatagagttaacaccaaataggaacataactaattgagtaattttcataaaatcgcaatatctttggtaaacaaaataaaacacatgtacgtattcaagcgaccattctagcagagcagttcttttacatacatttcacgaaaatagacttgcatggctattgtattgacaggtcggatccactggatagtctcacaagcttatccgttttagtaaatgaaataagtaagcttgtgagaccaccaagtggacccagacgtagtttagtgaaacattatgcaaaaggaagtatggttcttgtgatggttttaccacaaattttgcagttttgtgaaatttgctcaaaacaaattaattaataaatagcagaataaaagccaacctcttcagctgtgctagcaactgcatcaaagccaatataggcaaagaagagggttgctgatccagatagaacaccagccacacctttagggaagtaactacataccaaccaagcaaatatcagagctatatgcatatggaattctgtattgaaaatgtgaagcacaagtcttagctttacccttgttcatcattatagccactccagccattctggaatgctaagtatccaccagcacaaatgacgaacagcataactataacatttgcaatggtgatgatgccttccacaaatgaactctgagagggcatggttcatacttcagtactacagaattgtaagtagtaggtaattcatggacttcaagctatgcatagatatcgaacagcacaatttacctccttaattcccaggcaaagtaatgcagtaactatcaatacaagaatagcagcacaaggatcaagcggggtttcaaaccatttaacatgtatttgtgttaggaaaaagggaagcttctcat

SEQ ID NO: 91027 - DNA, 641 bp, Oryza sativa
ccatatcttgtccagaaacacccgacaagattcctaagctcttagtttctgcagggttttctagctgtacattaactgaagaagctccacttgtaacattcccagtacaatgagaagcagcgccaacattttcaacactggcaacagcaccatgttcatcactcgggccaacattatcatcatcgttattaccatcatcagcaggaaccatttcagtgtctccatcgttgctcttcatgtttgccactgccaactgcaccaaaaccatatgttaatacgaaaggaagttctgaagctttcagtaattctcagagaaaaagctcctgctacattcctaatataattcaaatcaaatgtaatcagcatagcacctcttccagacgtcccttctttaactgctcagctatactttcaaaagcatcacaatttgcaatggcactcctgatagtggaaataacatggccaagatggcgttcaagatacgaattttttgatttcactattctttttaacctcccagtggtcgcaggcatctgctttgctttagatccagaacagaaaggaaatggttagccaagtgaagccattcatataagcaatatatcgaaattagcaatacctatctcaagcagcgtcttatt

SEQ ID NO: 91028 - DNA, 14222 bp, Oryza sativa
  unsure (1)..(14222): unsure at all n locations
cccccccccaaagagactgattctgagaattcccggtgtcttagggctaaaaccagacaatagtagtgtcctgtagcaaaatttccgtatatttattgggttgttgtgctaaggtgcttggtgatacctgcgcgttacggctgaaatttgtagaaattgatgtattcagatatgttgttgaacaacagctaaagagagcaggagactatgcacttcgatcattttgtcagacaacgttaatttagagcaaagtggtaaaattataaaatgcactaattgtgtcctgagagtacgagactaaccggaccaaacagctcattcccttcttcagttggtgtgttctgaacattgagatatcatgcatcggctctagatcaaattgttctttcttttgcaggagaactcatatagaatcaagcatatttagtgccaacaatcaggggcggattcaatgtatccctctagacccaccagacccatggataccccctaagtccccccttcaacttttttgttatagttaataagataggaggtgctaaagatctcttaatagtattttatcatagtttaatactgagacgatgtgttcataccggtgtacttggtatgttgagtccctccaaccttttgttcctggatccgcccctgccaacaatatggataaattgagaatatcaatagaaaaatagaagcaccagtgtatcactacctcactttaccttgcagtacaaagttgcaaatggaaatctcctaaagaaaagaaggttatgaaaacaattaagaaaatcgaaagaatagttttcatggtcggagctttttgccacagcttttgcgaaaattcttccaaccgggcaaccggcgggggagcaaaaatcgagcactccccctggcccaccacgtgtccatacacacaactttattgcaacaaattatccacatattttaaaaaacctttgttaagggaattcgtttcattattggttccaccaaaaatgtttcacctaatgtactcataatgtttcagtatgtatagatctaatgttgcagtgaacggaacattcttttgcaacaaatcacccacatattttggaaaccctctattaagagaatttgttttattttttgttccacaaaaaatgtttcacctggtgtactcagaatcagaatgtttcactatgtatagatataatgttgtagtggactgaaacattctttcgctatttgctgaaaagctaaaaatttttttgtcggaatatatctatgtatggtcttgttttgaagatttaattgcagcgaatttaatggtgcaatcgaatcatgatttggataaataacttaagagaaaaattaatttaaagtggttttgcatgcatacgtggtgctgacgtcagcgcccgatttttgccaatccggatcgggcgcccgatggatagtccatttccggcttttgccaatcctttagcaataagtcaccaaattttagagtccgattaggcccaacaaattacacatcacatgggctcaatgttgtcgtcacatgggcccaactgtctaaaacaacagccaacttgtttagcatacacaaaggactgtggactgaggtgcccaagagaaatactcctatatgcagagatatgattgcttgtattacctacacccaaaaacaaatgtgacacacaaaacaagagcccattacaatataactgtattttgctaaaccgcatagctaaaaagagctactaggcaagctctgcccaaaatagaaatgtacatacatatattactaaacttaattacatatgtaactgcaatgtaactcacatataactaccatatagctgctgttcaatcatgacgtaagtgcattttaaccctgactttatgatttatcaccacctcgtgcattgaccaaagaaaagaacaggagaaagaaacagagtggcagccagttactgttcaaatacgagtatctcccgcacttaacaggtcgcagccacgccattcaacaagagagcaggttcgaaacgagctcataggcgtgtgacagcactgaaccacagatctgactgtaaccagcaaaaaaaaattgtgacgacataaatctagcaattccgttgttatatttatcatttttaaaatgctgcacatacattttgaatatatattaaattttctacctataatacttatttatacaataaacttatgaatattacagtcacacaataaataactatatctcgataaaaaatccatcaattgatactacctttgtttcaaaatataagagtaggttgttttggagatgacaaggagaaaggaaaaagaatatgtaatatgttgccccattaaatgagttgtttgtgggtagtggaaaggtatgtaaggtcaaggtggggagaaaaaattgaatgaagggttaggaaaagtagtactactcaatcccttacattttggtacaaatttgaattcttaaatctcttatattatgatatgaatgtagtgaatttgttccatgttcaagggtaaacccacatattttttacagccattaaacggtcgactaatgtaaaggatattgaatgaataaaatcaaaacttgggtgtataaaaaaagtaagagaaaattagaacggactgatgatttcaacagctggccaggacctattccctacaaagctgcacccatgcggctaaggccctgcttgattcaacttaggattattataatctgaattattagaaataagttggaacaaacagatagcttattatgatagattattataatctataaaccagattactataataatctagtaatccacctctaaaggtgcttactttagattgttaggtgactaaccgctaacaaacagcttataatatagagaaacaaacatctcacaacttattatatatcggtttattataattcaggttacagtaatctggctcaataatttaaattacaataattttaaactgaaacaaaccgggtctaagccgcttgcatatacagcctgtccgatcgatgctctcaagcatcgccatcggagcagtgcccgcacaaggcgaggttttgatgggcgcttgggcatgctatgctgctgaaaggatcgtggtggggggaacctaaacacgaaagcgtgaagcatgagctgttggatatttcgatattggttacagtccaatgcctaacgaaatgtccgagctaatatcggatatttcaatgcactaagtgtaacagctcatctttctgttgtccataaaaatgttttccagatgcaatacaaatgcatttcatgttgcgctcaagaaaattcccatccaaatgtattaaagttcataccatcactatataaacagttcccgccgcccaaaccaaccctcaattttcaacctcccccaaaaatcgtgattaaattattcctacagattctacacattgctggcagcctcgccttcaagtttcatttgattttgaccaagtttgcggaaattagaaattcaaggtactgttcacccggaggagctctccctctgctcatcacgttttctcttgtttccttgacctatctatccgatctattgactaggcaagctaagtaatctcgtgggacacagttttaatgttaggctccacctccaactcagaccccactgcctagtcaagcctaggctaagttgggtaggccctattctacaccgcccatgtgaaagtgagggtttcgcgtgtgcgatgtgttgggatacgcgcaggctacgatagcataaattaaaattttctaccatgtaaatcaggaaccaagcaagtattagatcatagatcgttaccgctcgacgcactgtgcagtggaagtaggcactaagtagccgaagaaacgtcgagggcgtagcacgcgtcagtgtagaggaagtagttgatcgcagcaactcgacgttctccttctcgtgcgttctcatcgccgtactctcaaactgatcagcaccgcaaactagcagcacctctaccaatatccacatgtacagggacagaacaccatgcgcagacgtgctagcatccgcacgcggctagggttttgctcggggaggggagtggcggctagggtttctcacgtgatacgatcacaccgtcagtcacacccctcacgaatatataggatccatgactcggcctccaaggtccataggactcctattcagatccctatccgaattaagctcatattcgatctccatccaatccttttattctggcccattaagcgtgcgaccctgtaggttcatgtacactcggatgtaatccgaaaactccttttcagtccacgtgtcaacagcggcccctagcagaacgtattgacccaccggacatacataaagatcatatcggttgaacctctagtgtatacttgtatgaacccctttgcctcacgatatcaattaagctcaaggctagatatgtgtcatcatctaatagctcaatcattcactcgaacttgtgatagattatataacttgtgtttgactcctcaatcaccttaggtatagccatgcacttccataatctataatatcgaggggcccagatatatctctccatatgaggggcgaatcttatcttgattattcatttcccactacatgtttcatagcatacccaaaaattatttttataactacctaattacggagtagtgtttagcagtccctaagtaagctactacatatgttgggaaccatgataatcttaggtctaagaattcaataccaacattaaatgagatcaccgatgacacaacacatattgctcttgcagtgtctcatgttgggtatatacaacaacatataccccaacatgtgtcaacattattaatttagtatgtctatatcatgatccataagacatgatcatcaattaatacatgtgctgatcatttaaacatatttgttccacatataatatttgatcagggatcctttagaaatagcaacatataacataaagagtctcatgaaagaatcacatattcattaaccaataataagttatctatttcaaggaataatgtcggataaatatgtaaatatagtttgtgatacaattatctctatgattgcctcttggccatatcaccaatacgatgcaccagtaccgccctaggcacactagctgcgtcagcaccttgcaccatcctagccaaggttgttaggatcgggatactaggtagtatcgttttgctcaaagtaatatcgtatcgtaggaccatatcgtagtatctatgatattttctattttaagtttaattaatatttatattaattatatttatattaattgtttctatttgcacnacatatatcattcctatattttttatatagaatggctatatataattattataaatattaattaaacttaaaaaagaaaatttgtatcctgancnatantacctagtatcccgatcctagcaaccttggagagtgccttcctcacgtcacagccatttgtctttagcgcttggccttaccagacctcgaaaccgcacgcgacgattcaccaacgagtgcgcctggctctttgcacctccggtctgtctcaactccctgttccggaccactatgtcccatttctgtatatactaatttgttgtgtacagctttgcagtgggtggcctgcctcaaccctgaggagtttcattcacagtgtatgattttgcttccttggaggttcctttctatttgcaccaaatcaagcggtcaaggcaaattctagttcatttaagagtaacggtgaagtctaaccctatatcggttatctggccatgatagtagctcacaggaggtctaccatcactccatcaggcagcttctatctctgtactcaacagttagtttccctttgctttcgtccgatacacggcatcaaaccaatctcatcttgggctccgagagccatctacaactattccccactgctttcactcaaagaacctaatttatacaccattcaacatcccatctgcataggtctatctcaaactatgttggatcatcatgaccaagtatgtccggtacccaagatctcacgagtacattatcacgatgtcacattattttcatctcgacaacaccacaaccatgaatccgtctcggatagaggtttccttggtgaatacaaagcttcacactttgcaccgcgagtttttacaattgcatctattttagaaacattgctaacacccagtgtcatttccctggtgatatgacaatcaggtataggcatacaaccaagcatgataaatataaaatattgccaaagaatacatcagctaaatggaggatctacaacatattcaaatccaacgagttttgtaatccagttcggtctctggagacagcactaacttcaaacggacccagcactttcatgtcaactccgatttgggcgatcttggattgttggaaagaatatatcgtcacctttcaaatgcatctggtctcatattaaaattcatcccgagtcaatgggaatcatcaaaataagcctgtgttgtttctgaaaccaaacatggaccctgtgccttgtaatagactaggcctatcttggaagtgtctccctagctctatttttctctataaatgtctatgtacaccctctaaaacaattgtgcgtcatcacctggaagatcaaaaacccatttcccctacacaaaaattatatgagaagtgtctttggaactcatgcttggagatcgtggttattgaggtaccgtaaaagtggaggaacaagactacataggttctcaacatcctacggacataactcaactaataggtaggtccgccagttcgtcacacaaactggggcttgtcaaatttaacgtgcacacttaaatgtagttttgcaaacaaaacattttataagttaggagcaatatcatgaaaaggtgacatgccttgggtcttcttcttcaaaacctctgaaattccacgccgaactaatttccgttatcgtcaactacacacaaaaaatactactattattaactaattgtgctattaggtatatctcaattttaatagaatttagaaacttgaaaggggtcaataggtgttacggattgggatttatgaatttttttaagtttaaagggttttatgaatttatttgaattgggaagtgtaaaattattcctccgctgacaagtggggcccattggtcagagagagaaagagaggaagggcttgtgtcttttggctaaggaggggattctaatttggctcgtatgcgctattaagcgaagtaacgcataccttatccaatctattttctcttccctcattggaatcttccaagttaatattcaaacattttcaactcagaattaaaaactttcaagtcaagatttcaaaacctccaagttaatatttgagactttcaactcagatttgaaaactttcaagcaaagattttaaacttttaactcaagacttgaaattttttactcagattttaactcggatttgaaaaaaaagtcaactcaaattttaataaattgaagtcaagatatgaaaacttaactaatgtttgaaaattttcaacaaaaatttaaaaactttcatctcaaaattcaaaacattcaatttaaatttgaaaactttcatctcaaaatacaaaacttgcaacttacattttaatctgttaactcaaattattggtgaaatattcaatttataaaatacaacaaaaaagttttcacaaaaaaaaaagaatttgttaaatttgggatgtcagattttgttgcacattatgattttaagtcatactagttatcgtgcacgtctaaggttcgttttggcattatatacacaacagtagaataataaatgcgaccttttttttatgcagtactccatataaattcttcacgtaaaaattgagtttcatgggatgatattttgaatgatctctacaaaaagttgcacagtctattcctagattgacaacataagatgcaatgcaccatccacctttattaatagatattccaaagctacatatgagtgcccctgaggaaaggatatctacacagattttatttcatttgtaaaaaaaaaagaatcaactctgaagtagagtcactatgcacattgtttctgtgagattgctacatctccagctagtaaagaaaatgccaacagctagcatctcatttttctcatttgtagaattgcattacagagagtaatattatggttagcaatcccatggcagtggacctcaaacagataaaaaataaccggggaactttaatgactcacattagtcggtggtttatctatgaagagcactttttggaatatatcacagataatgtatataatatctattgtgatgtacataatgacgccgattattagtccatttgagcctgtaaataaagaaaggcataccttatcaattgtagccaacagttcactttcatggtctctcagcgcccctcctcttactattaagccacagagctctccaaccagaacctcgacaagatgaaaaaaaaggataattatccctaatttaaattcaataaactaggaaggtagcccgcacattcgcgcaggtatgtattataaattatgtttgaaaaactgatataggtgaaatattaattaaatgacacctgtcatatttcaacagtattgtttgtccataatttttttaacggcattgcttagataattttttcaaactatttcttagcttctaaaatatatagcatttaatacatccatataaacaattatctaatatatagcatttaatacatccatataataaacaattatcttttattctggagttagatttaatttgttggaaaaacatgtctaacaaattaagtgtaaattaaaagtaaggtgttttgtcctgtttaattgaaagtttagtggctttttcaaccaatcctaaagaactattattgttaataaatatgttctatttggaccatcatggttggttcaaattgccgcaagttgctacatacttacatataaattatgaaagacatatcatagaactcacttcctcgtgacatgcacggtctatactatattttctaaaagaaaatactgtgttaacatgactccaaaaaattaaacttaatattaataaatataacttttcaaacaactatatactatattcttagcgtggcttatatatgctacgaacttattacattttctccaaatagttcaatttattgacattttctttttcttgctttattttctaccagttcaaaatataggcgttatggatcttcaaatcgttggttcaattgtgaatacaacaatagctagattagaaatcagtatgtatattttattttttttaaacatttctagctataaagaacatggagagtagagtgcagagctcaaatcgagagaagagcggactggtagtattgtgttgtttgcatgtgtgggggaggccaaagtgtagtggtggtttattttttttaatatgatttaagtgaaaaccgatgatccaatacttttcttagatttctaatttcttttttttcctaacttttaagatgtaacacatggcgcggtttaagattttcttttaaaaagtatatctattggttaaaaaaagagtttcttataatttctaagattttatttttatttaagacgtaacatgtgatgccttaagtgcactacggaggatgtacttgtgatattatacatatgtcatttttttgtaatgttttttgctatttggttaccacacaaaggattggtgtctatgatcaaatggcatacttttatttttatgtagtaaaatatggctaatatggatcttatatattttatttaactataaataaaacaaataaatatagttatatatttatttagtttaattaaaataaactaaaaatcatatataacttaagaattataatcattttacttttcaattattgatcatttttattaattagataaaattagaagatggaggaattgaatgatagaggatatgaagagagagggcatgcgcgcatataattataatatttttttacatgttacagtgaatgaaatattagttgtatgatttaaatgtcatagttgcttactttttagcataatttttgctttctaactaatatattttgggaacattactcatagttttcattttacttttaggactttatatctaatttgatcattatgaagttatgtacggtgataaaatctagaatattattattattattttattattttataattgcttgaacgatacgcaaaaaaaaaatataacccaaaattacattatagtgaaatttggtcttcaactctaaatttagtcatacataatttaaagatataagcagataaaaattagttgtatgatttagatgttatagttgcttaattcttcaacacattttttttttcttttctaacttataaagcataaaaataggaggtgaaataggtggaaaagaggagaaaccgaggaaatagttgagggggcgtacgtgagtaaagtacgtgcagtaacgcacgtattacctacgtgcccatgaggcccgaatttaggagatgaatttttctaaggtaagtctaatgatggtaaataatgggtcaccaaatttcatgaaaatcaattattacatgattggttttttatcagaatttttaggactgcctctattttactatagtgccacgtgacagcttagaagtgtttgtaggatgccacactatggttaggagtgttcgtagaaagtttggagaaatcttagtctaaaattgtgttataaataatccagctaatttaccactcttacaaacaaagcgtaactcatgttgccatgcattgcaattactataagggtgtttctggttgttaaacaaagcgtaactcaggctgtgtttcagacactataaatagaagaacattcatcacacttcaaaagtacaattactccatatttttttcattagcattgcaatttaattaatctccgcatcagttatttatagtcttcttcatcatccaaaaatagacttgttttacaagaaaaataaggtagacttatttttttagaacacgtctctagcaaattaatctattttttatgtagtggcttggactactcacattgagctgattttttcttattcactgagcggaatgtctatttttggtgttgcatgtttatagtttgtgttgttgaattattttatagtcttttgtggtgattcaggtgccatacaaaatggcaagttgtgccgtccattgataaaaacatgaatttatattattttattattgttataattttgatatctgcttatatgtttgtagactgatgtataatgacaaaaatagatattgataatatttcttaaatgccaaaatataggcatatgaaacggtttaattataaatagtgcttaaaattattatcttttcagtatctatagttattggttgtttcacttttagtgtaataccccgtatattaaaagatatttaagtttttttaagtttgggttgacttgttaaaataaagatgttaacagaaataaaaaaaaagaaaaatacttttagaagtgggccaacatgagaaggcccataaacccagcccactagttctcccctagaacctagagagaggggaaccgaatctcacctcccctcttggtgccgccacccctctccctggccggcctccaatggcgcctccttccttccctcctcccgtgtttatatctctcccctctacagcaaattgccctcatagatctccaccccaagaacctggatcaagaagcaaagtggaaaaacggaacgaggagacggagaggcgtaggaggggttagattagactcttccctgttgtctcctcacaagttctctaaagaaaccctagttttgctccataggtgtggagagatctggtgtggagggtggtttgtcgggttgccgtcgaggttaaaaggcaagtgcatgacgaactaattgtgtgattcatggattgtttgctctatctatctatttccgttatatttctatgtaatatgtgatctcttatgtttagattgttgttcatgtcatttagattttaagtttatcttaagtttacgacgttattcttgtttcaatattttggattctggttctggttaaataattcaagttccatgcttgacattgatgtgcaatatggtttgaatttggttttttgtttccagtttcaattattcatgttccatgcaagccatggatgtgctatctgattttctattcatgttcctgtgggtaagcgcagatcacgcttactcggctttgccggcaaatgctaggatgtattcactattgtccgggatggaaactactgtttcaattcatgcctgcccgggataggaactactatcttctttgacttggtgtttgaaaatgtgtttcctatcaaagaaagaaagacttctgttcatgctttattgccaatgatgtgtatatgtattttctagttccatattgtacttgttgagtatttttgtactcacttttatgttttatttggttttaggtgtgcattgagaccgacatgcatgggcgggacgtttatctgcacactatcaaactgtattgcctaggtccataatgacacttcaactatatcatggtccggccttgtaataatattttagatattttttagtttttttccatggattatatggatagatagtgctatgggaatgatgttattattagtttaatctataattgcatgtcgtggatgtccgtatttacaggggagactcttacgaaattttttaatgaatttaggatttagtggtttctgtatcgtagtgtgtagcattataggtaagaaaatacctggggtgttatatttagtttatagctgataatagggagaggaggctggagaggaatgaatagcgtagagctcgagcgagagatggaaataggtgagcattattgtactcatgtgatgggaggagaattaggtggagggattttgtatttctaatatttctaaacgatctaagtggaaactgatgattttttttattttctcgaatgtcattttttttatctttaagacctgactttttgcagcttcaagatataatgattgaaaacattgggtgtaccgatttaactgaaaaaacatagctacatgttttatattttgtttgaatgtctaaacttaaaacgtgagacatggtgacttaagagcgctatagaggacgtttaatcaatctttatcatgtaaaatgattcaagatggcataattaatagatattgttaaattttgtttatgtttccttcttctttggtagccatgcaaataataacgatctacgttcaaaattgggcaggtttattttattaaatatatatttaatggatccacttgtttgaattatctacatcattaaatctaatgtttaaaatagtaggtttctgaaaatggacagtaagatgttctatttcttttatattttttctatattaaaattggtataacttccaaaattattagctatagaatagaataggattatataggaaggagagagggagtattagacgaggaggagacgtacatactacgtgtatgtacgtacgtagttgtagtgtggcccggtgggagaggggattagagggaggtgggtcatggtttttttcttttttaaagataatctaataattaaaaatagtgggtccaccaatttattagaatgccacgtggcgattgaggagtgacggagcgtggggctcctcaccgggagaccgcgcaggcccccctttgccggttcggccgggggccctgggtgagattctaagctcctagtctgtggaaagttcgcgagaatggaaaaagcacaagacacgggcgatgtatacaggttcgggccgctgagaagcgtaataccctactcctgtgttctggtggatctgtgtatgaagaagctccaaagagttggagagccagagagctcttactctagaaaccctcttctccctttttttcctctcctgggatctactctccaaatcctctctcctttccttccctttctttttttctcctcagtggccaaggtcctccttttatatctcaaggggataccacatgca

SEQ ID NO: 91029 - DNA, 2430 bp, Oryza sativa
ttggtgaattgtctctacgaactaagacatattttataagatgtctctatgcaaatcatctcacgggagcagagtaaacacgcggtggaggaagtgcgggcagaaatcgtgatggagagggtggaattggtgggtggtagccggttgggacgggtgtgatgcgtgcgacgtggatggacggtagggatttaacctgttgatttcacctgtaggattgctagggtgaactcctttttatattactagaaaagatgcccgtgcattgcaatgggtaaagccaatttattttgtacatatatgtctgtggataaataatcacagtacattattttgcttattcatgtgcttatctgaatcacttattacaaaataaaaagattatttgtgtgcaaatattttatatatatgttcttagcgactcaaaagcaaatgatataaaacaaagtacgataaaaaaaccaagaactcgaattcaaattaagttctaaaatttaaaattcaggttataggaataagcataagccaaataataaggccttcaaacacaagttcgatttatcgtccagttttatcctaagttgggtaggaattgatgacaaacggaatcagcaacttcgatcatcctttatttcaattggcatgtttttttcgaaagtaaaattgattcttatggattatggtaacggtatccttgttagtatgtacgggcatgtgtggagactgacttaaaatcatgctaacatatttcaggaatcgcgtcgtgtaatacgaatagaattggatgatctgggcaatgtacgtaatatccacactgacacacggactctgcaagtttcgttcgcttggtatccacattgcacaaactctctttcgcagttcgcttatgagtcatgacttcgcaatgaatgttccgcgtgacaggaatcggatacgaatgacgtaccataattttgacaaaaaaaaggcatcttcaatttttaaattgcaggcgagacgacgcagtcccaatcagacatgcggcaagggaaaatcacgcgcgtgagggcattgcaggcccaattagtcacgcggaaaatagcgagcacgagggtgttgcggtcccaatcacgacggtgcacaaaggcgcgtgtgaaaaacagacttaggtgcgggcctgaccactgcgtgcgataaagggcgtgtgaaaaggtgcgggcccatttaattcacacatgtctcgaataagagggatactctagcgacgtaagaaaaaagggaaggatttgacataaacataaaattaaaatcgatctaaatacggatgacataccaaaaattctggtgaacgcaccacaatgaacaatttttataatagtagtgactatatatacgcttcgctaagattcgtgtagtaagtacgtaatcgactgtccctggtcaagctacgtaaggtgattagttgtcgtaggaaccacctaattaaatagtagaatctgtttttcttctcgtcctgattgcatccttttgctttttgttttcccaacgtaaaatttaaatttataatgaaaatacattaaaattacatatgtaattttagaacttatattgtaaatatattaaaattatatatgtaatctttaggacttataatgtaaatagttgactattttttcatgaaaaatgaaaaatatgacggcgtagttagtaaaaaaaaagtcgcccgtgcgacgagaaaaaacgtaattaatcacggagaaataaagggagcgctttcccttggaaaaaaagagccatttccctgaaaaaaagaagaaaaagaaaggaactagcgcatgtgtgggcccttggctgctaaatcgcgtttccgcacgttcaaatgggcctgttcagtacgccgagggaaagaaaggagaaagtaaagcccgatgtgggatggagggtcttaggtagtttttggtttgtgggataggatgggatgggatgggacgaacccattttgagaggtgtttggttgaggagcgagtgggatgggttggcccctataaaggaatattcctcccagatccgggacaaacccatccggcaaaatcggtcggacgagctcgtcccacttggacggagcacacggcgtctcctcggcgaccgccggcgctcgtccgcgcccacgcccgccgccttctacgtgaccgccggcggtcgtggcacggcgtctcctcggcgatcgccggcgctcgtccgcgcccgcgcccgccgcctcctctatgaccgccggcgctccgccacgaccgcctgccaccacctccacgaccgccgacgctcctccacgaccccctgcctcaacaccggtcgccgccacgagcgagatgctctgcgccatcccgccgctcatcgcgatgctcgacgagagcggctgcggtgatgtcgatgcggcgggctcgaatggcggcgaag

SEQ ID NO: 91030 - DNA, 2394 bp, Oryza sativa
ccacttatccaaaaatataaagcataacactttttaatcatgttccgtaatatataatattgggtgtgcatacataaatgtaattaactagcacttcctactctcttttattttattttttgaaatctttcgccttcaaaatctctaattctattaggtacctttaaccgtgaaattcggtaagcaccgaattcatcattggcctagagtcagtatcagcttcagagtcctgtaatcgaccgttggaaattatcaagttgccaatagtcggattcttgctatattcggttaaaaaaattaatctattcaaggaaacttatccagaaaagacaaagttcaaggaggatgcggtatggcaagttatctactaattatgaagagtatgttagtttccttttatcgttaggaaagcgtgtttagtgtccccaataaagactttatggttttcttttatcttgaggaaagtttctttcttgtccaataagaactcgtatctacccatcggtataaatatgtacacccgtggtcattgtaaactatctcaacgatcaatacaactactctcaccgcatcgccgccccctttaccgaggttttcacttatcatccggcaaaacttggcacctaacatgaggctgcatcggctttcgatctccggcgaagcggtaagtcctatgttttgctggcccttgcaattgtattggtttcatcggcgtcgttcaaggctgcatcagtacattcgacctcttggatcgctctggttcggttgatatatttacctacctatttatcacataactttgttaatttagtttggtagcttgatttacttgtatcggctgagattcgctttagggtttataccggtatcggctaaatcgctttgccagattaaattagctaaggtatccaccaccccaaaaatcagtcaaaggcttggttgcctagatattatgtttcttttcatacttagtgatgcatcagttaagtttgatctactaggtcaagtttagaaccataatctctagcatgtttcttgattgccaataagggtttcattggagtttcagctgatgagttatctggacattgcatcggcttataaggattacatacaagttggatttagccgatcgcgataaaggtttcactgtttattctatcgtggatttaatgacatcggacctccaaccgatatatgctttaccttcgaatcagtgcttattccattatatcattattagccgattggtttctactagattatatgattgttatattacattattatcagccgattgtctttgtatcattatctacattggatatataaccgattacttaaaaccctgtcactatcggctagtatcggcatcggctggaactactccatcggcttgtcagtcgatcggctcattgatctactatttgcatatcttgtcggttgcagaatcaaactgactggcacgcccgtatctcatcaacctttggacctgcactggagctaaacacatctcccaggccgttgtattcgtcaacttagttcgtgccaacacagtcccggcaccatcggccgagcgcggatttctcgtcaacaggtatatgcattgtatttattgaagtgatctaagtaagtaaggatgtgataataattgttttttagtctttgcgttggagatggatattccttatattttgggatggaggcaataatcgtcaatattgaccaacgatttggcaactataatcactaataaattttaaatgattagatgataaacaaagtttaatacttaatgtaatacacttcgataagatgaaatttatttaagtatttagtttttttttgaaaaaatatgaataataaagtttaaatttgaatagtgctaagtgacaagtataaggaaaggagggagtattagaacataaaagtcgagaattttctaatgcagcaagcaaaaatgacataatcagtacgccatgatcgtgagtcatgagaactttattacggaaaatgcggatcgaatttgcacgatattttgcaatagaagataactctcgtggagcaatccgatgaaaagcacacgcaataaaatgttgtgttgaatgaataaattggttggagtaatgcgaagaaccgtagcattcatgattaatatagaataaattagaagaaatatacgagataacctagattcaggagattcgaacgcggccagagcttcactcctgtcagcagcatttcagctgagccattcttaaatcaagttgcaggtagcagccttctttcagctaagccattcttaaatcagattgtgttgcactgtaacgattgatttttaagttgttgtagtgtattgcgccggcccgtcaaattattacacaaccataaaca

SEQ ID NO: 91031 - DNA, 1833 bp, Oryza sativa
cagctaactacatgtcgttgttgacatgaggtttctttttctgctagcactagtatacatatatgagctgcatcaggaagcacatcgatgagctcaatctgtcaaaactttgagacgtacatgccaacgtgcaagcacatatccatgaccctgatatgatcatatctggtagagctgttctggccatttggggtaagcgcgtttgtaaaggctcatgcacacggtatcatgctgctggacgctgctattgaatatgcatttcatagcacctgttaagcaagagcacggtgagtgaaggatcagcgatgtatcagacatgtcgaaatgggtctagcaaacgtaccatgagtgccaacagtctccttgattcggccacgtcgaccatgtttcgtccacaactctacaggctgcaaaacaatggtgttattgacgttgaatatatatggagcagtgtatgaattagctgtaaaacacttgccttaaaccacttgacatcttcaggattgtagaacatgtatcgcactactgctttcagttttgagacccgttgaggataactgcatgagatgtgaagtcagaaacatgaccggcataagaaaggacctaatcttttcctctttctcaaataatgtagtagaataacactcaaacaatcgacactttaagcatcaacattatgttcataacacaactttgagaactaacttcaattacatataaatatagaacattctaaaatcataatatgcaaaagaatttttcaagacaaatctacaccaatgatttttgtatgttcatcataaatatcaatagctaaatttgtacagattttgattggaaatcctgagtagttgatattttgttttcctagatattatataatctctgtcagaacaagaaaaaagagaaatcaaactggcacaaattgttgtagaaatccccactcccccactttggcaaatctgccaagtcagaacaacaaataccaccttacagagcacaagcacttgtcctcaatcctaagttctctcttttcattaattcaccaacacaaacaactggcaaacagctgtaagacaacaaacattttgttgcgaacagtattatattattccttcgaataacgaaacaacttttgaagactatacatgatgggatgttatagcacctatttgaagactgtgattggatgttatacataactttttcgatgcaaacagtattgtcatattttcttccaaataacaagatagattgtgtgaacattattataagaaatttttatccaccagcagtaattatttcctagaaaatatcgatagagcacatcaacataaatttattggaccaaaaaggcaaaatgaaaattgcagaactgtttgcctattaaaggataattcgaaacttacccagtcaaaacaattttcttaagaataatccggtccggatccacacttttcagtgaaccaacagcagcaatggcaggctgctccccatctctgctctttagaacaataagagggagtggaggaaagcaaattggagcatatacagaggcaacagaaaaccgcccatgatgtagaaacctctccatcttatgcttattgcaattgatgttgtcagttgaaaacaatggcctgtgatagattcataaataaccaatgagacatttctcaatgaaaagacgagcatctgttttttctgcattagcatgactgagcttccactacctacctagcagtaaactgccggaacccaacattgaaaattaaggagtcctttgatttgataggagcttcataggagtcatgtttctttatgctgcagcaaaaa

SEQ ID NO: 91032 - DNA, 654 bp, Oryza sativa
attcgggaaacagctttgaaaccatcttcatcggaatcggctacatcatctttatcggctgtatcggctgtcttttgtccgatccatctcagccgatgcatactctgtttttcgaatcgatctctttcttgaatctgcctcgatcccaatgtcgaacctggttcacaccttaccaaatttggtcgtcaatagaatcaaagcagaacaccagaggccagcagggctactgcagtcgctccgaatcccggagtgaaaatgggaagagataggaatggacttcatcaccagcctttgtaacaaccctccctcaagaaccgcgtagccctgcccaactgacgggcgggccaacttacacacaccaccccgcttacactttcgtccttgataaactagcaaggtggtactaaatatgcgcacacagctcacatgggccacacaggcttcatcctaattcggccaagatgtcatagccttccccgcactcaaggctgttatgattccatttgggtcgtggtgaaccatgtgaccaaggtggcacacttcattcctgtcaagaccacttaatccggcagtaagatggcataactctacttcgcccgcatggtgtacccactaaccggtacccagctcacctctatgttttggcagaaactg

SEQ ID NO: 91033 - DNA, 631 bp, Oryza sativa
atagtattttgaatgtgagaaggggtgttcttactgaagaaaattctatatttgtcccaattaggagtttgccctgatttcctacaaaatcatcaatgatattcttgatatgactagcttcttcaacagatgctaatcatgtaatgataaggtcatctgcataaataagagaatgaataacaggaccacactcactcaactttatccctttgatgtgctggttgtgtaaggcctcatttaactgtttagaaagttcattcacagccaaaacaaaaagatagggggaaagagggcagccttttctaataaccctattagcattaaaagcaccataagattgaccattgatattaatagcaaaagaagaggaattgatgcaggacaacacaagattaataaaatggggatggaaaccttttctttgaagagcagcagcaataaagtcccattccagtctatcaaaagctttagaaagatcaattttaagaaggaaagctttttgacagtaagagttgagaccaaaagaatggacaatctcttgagcaataatgatattattagcaattcttccgccaggaataaaagcatgctgtgattgacaaatgagatcaggcagtttacctttgatcct

SEQ ID NO: 91034 - DNA, 1069 bp, Oryza sativa
tgtcctccaactgtcatcaggaagtaatcaggagcgtacacgtgtaaaaatggtgatcaactatgccagaacgggatcggctggactggtggttcggccgaaccaaaaaaccctcctcccggccctcctttggtcgggaggttgcttaatgggcccgcaacatcatgtactattttttggaccaattctaagtggctttggttgatgtatgggccccctaatctgtgtaaacacgtcttgattgtccagaggtgtattttgttgcataacgggtgtgttttctccttaaagtacctgcatacacatatttcaccaatactagtggaaatgattagtaataaaccctagtactaagttggataccatattttatttcattataagcaagtattgacagtcagatattatgatttgaggaccgtcagcaaccatcttctttgtcggagattcaggtctggctgggtgaagatgtacttcaagctcttgtggtcggtgtaaacttcgcaccggttcccgatgagataatgctgccatattttcagagcatgcaatatggcggccaattcgaggttgtgggtggggtagttgccatcgtgcagtcgcagttgtcgcgaggcgtaggccaccacatgcctttcctgcattaggacgcaacccaaaccctgacgggacgcgtcgcaataaacctgaaagtctttgttaacatctagcagaacgaagaccggggaagatgccagcttcgttttgagcaattgaaatgccttctcacatcccagtcaaaaaaaatgccttctcacattgcagggtccacatgaatttttcttcctttttcaacaactgggtcatgggccaagcgatctttaagaaattttcgatgaaccggcggtaaaaccctgccagcccaaggatactatggatctgcgtgatgggctgcctccacttggtgactgcttcgaccgtggcggggtccactgccactccttgtggaaagataacgtggtccaaaaacttcacttttgacaaccaaaactcacatttactgaactctgcatacaactgatgttccctg

SEQ ID NO: 91035 - DNA, 4639 bp, Oryza sativa
ttcctgcagcccattaattggtcatcccaaagaatatcattgtgcattcatacaaaccttatcgggtggtgaaggctgtcttggggatatcttcctcgcgaattcgtagctggtgatacccggatcgtaggtcgatcttggagaaacactgtggcacccttcaattgatcaaacaggtcatagatgcggggtagcgagtacttgttcttgatggtgacctcgttgagagcacggtagtcgacacacatgcgcttggtcttgtccttcttctcgacgaacacattgtttagtagtttgggaaacgtgcgtatgaaaaatatagataatagaactcagccgagtatagaacttagcacacctgtaaatgtggtcaagcactatagtctaataagcactacatttttttaaagaagtttatataaaaaaatatatatgagctatatatcttttcttttggtatccctccgtttcaaaatgtagcaacttaggatgttgttagacccatcctaaattactatatgttgaaatgaagatcgcagtttctttcctaaattcatatatgtgttacgtggtccttttcttaataacagacttatccatcttcgcttgtaagaacctagctataaccagttattatagagtttacaggttgaacgactgtgaattacaaaatcataacttaattaaaaacaataaaactacttaaataccagcctaaagacaaagataacacctattgctaaatttctatatatctatggttggcaaaaatctgcacagtggctagcgagttgtgcatagtagtccttgtatttctcaaatcagcagctgatcattgtgccgatcaaatttcgcgttcgtcaccattaatgactagtgccgaactaaagcggcagataacgtcggacggtaactgagttataaatcaaccgttcacatagatcttgctagcaccacggccatcgaagctgattcattggggacatcttgcaccctgccgtcgtggaccgtggcgaggtagcgtcttacattttcaacatatgtctatctaataagctatcctaagcttaattcaagtttaatcgtaacagtgaaaattgtgatcttgcacacacttcagtattccattttattatttgcataatttagttttccattgtgcaattaaaacgagaggcggatctatccattgggtagggtgggacacccccccccccagcctctctcctcctcgtcctcctcatagtagtgatgggccatcaaaattaggtatagcaagttgtgaaaatccaacatatcatcccgcatcaagcatcaacgtagctagtgttggtctgcctcttcacaacacatgcacgcacgccacataggggtggacattcggtctaaccgaaaaattcggttcggtttctcggtctttttgaaaattcggtctttgtaatctcaagaccgatcggtctccaacaaatcttaggactgagcaaatcggtcttcggttagttcggttcggtctcggtcatagaccgaactaacagcaaaaacaaagcaaatcaacaaaactatatgtaaaaacagcaaaagcaaagcaaatcaacaattagtggaggcggcgcccggcggtggagccggcgtagggccggctgggggtggcaccaggcggtggaggcgaaggagtgccggctagaggcggcacccggcggtggaggtggcggtgtgccggctggagacggcgcccggcggtggaggcggcgcaccgactggaggcggaagcggcgcccggcgatggagcgaaggaggacgcggatgggatggagacgggagtcgggacggcgccgctccaggatggatggggatgaaatgatgcgtcgatgcctgtgacgcacctgcccctagggtttttattagtgggcttattgggccaactagatctattgggcctaattcggttatttcggtcaaatcggttaattgaggcccatgaccgaataaaccgaacatatttcggtcttttagtagttgagaccgaattacagaccgaatttttcggtctcggttttttcggttcggtcttattctgcccacccctaacgccagaaacaatgatcgaggcagtgattattcttcgtctttgcttcttcgcgtctttgcccgatcatgggatggcatgaagttgatgaactggtgcttttgtaggccaccaatataatttcatgtaagagccaagttttgggtttgaattaaaaagagaagaaaatactgaaaacgagctcaacacaacaccatgccttgccctgttctttctgttttcggttaatttcttcagtttactgtttacgtctgaaaagaaaagagtcagaacgagcaaattcagagagcgtgagttcagagttcgaagtgattcctgaaaaaaccgcagctaacgaaacagcacttatatgtatacacaagatattatcaccaatatttcatatataaacataggaagggtatgaagtattttaatttcacaggttgaaccaatacttaggtacatcaccttgatagtgccaagcctgaattatgggataaagttaattattcatgcatacaagagttcacacataaaagttctactgacacagtgtaatatctaactgatcagtctccttgaagaaggcacatgcatgattgagatagttgcatgatacggatccatatttatctttcatctgcaagtgcaaggaatgtaaacagtaaaacaaaattagttacgcgttgcatctgaacgtacttgcacaaacttgtctcgaccacattatttgtctataacttatgcctccgaattccttctataatttgatgcaagggaaatttgagttataattcttatggttgcaagcaaatccaaacaatacctagaatgtgagataagccctacacatttctgaccctgcaatataatcctcccaagaaaactcttcattattttttatttttttattttgaaaaacttgatgtctctaactacgactcagatgcttacaatgagaaggtaatgaacattcaaatttcatttgttgaactatgaactctgactatgttacactgagaatattttttacctgacataaaggcctttcggtcctcctgttcaggataatactgaggctgatgcatgatgttgaattgcaggaagtttcttggatcataatggatcatattttgcacgtactcgctcgtagatgctgaacccatcatgttcactgtttgcagtcctctttcactctcagcaaccttcacaataataattataattaattagtatgatgacgtagaatttcagtcaattaggtatgatttgctatatatgtaggttatttcagtaacttcaattcagatttaccatgtagctaggttaatctctttttgaaagcgaatctcattcttttttttttgcaatgtagaacagaatacttactttgctctttaagtacatgttgtcattctgcagctccgtttcctgaaaagattatactcgtgctgttatcttatgatgtcaattaactagaccaaataattttgcaagaaagaaaacagtggtattttgctgatagtatttacccttctctgcatatactcaatttcagcacacagcaattcgttctgcaggatatggaatgcttatcaaattagatgaattaattaacaatatgcccttttcaacttggaattctatgtaaatgtagcacacaattaatataccttccgtgctctaatctttcctaggcctttgtccagtctgccttccagctgcttaagttctctgtggttcatggtggtgatattatcacctactagggtcctaattcattaattaatggagaatttagttataaccagatgaactactttgtcaagttgaaaaaaattctaagcagctgagtgaaataatgaacctgttggagttctgcaggttggtgatctgttgcttcagcttagcagcttcctgctggtagtgctgcaagtttgtaatttgattttttttttagtactggtagttaaaatcatgacaagttgtgtcagtttgctaactggaatgtttgactcttcatgtttattttgttcaaatgtgcatcatcaaatcataccatattaaactgtgtaatcaacctgcatgcatgcatatgcatgaatgaatgacaaaagtgccaaaaacatgcagtgagccatttcaattttcaagcatggaatcatgaagaactttgtccagtggacaaacacagataggagtatgtctgttggtcaaaactatatactactactatatatatagcatcactggaatttccattgtgtaaagcactgtagcttctattcaggatgtccaatctgaagattttggtcagagaactcattttttacagcatagaaaccattggttaattacaaggaatgttgcattgttgctgaatgataaaagctccagagaaaactactgcatgctgcatttgtactgacagatgatttttttttgtttgagaattcagatgatgttacctgggcattgatctctgcaactgtactggcgttggaggtgtcactgttggctttcttgtacctctcaatagtttccttcacgctgcatttgtgcatagtagca

SEQ ID NO: 91036 - DNA, 1175 bp, Oryza sativa
ttcctgatggctgttctcaaatatatccaaatgtgtaaactgtgccgaaggaaaaattcatgggctcaagacacatgattgccatgttctaatgcaacaatttatgccaattgctttgaggggtattcttcccgatgatgtcacatccgtcttgtttgacttatctgcttacttttgaggaatatgttcaaaagttcttcatgttgatgagcttgaccgtttggaagaagcaattaaaatcacattatgcagaatggaaatgatatttcctcctggattcttcacggttatggtttacttggtcgtccatttagctactgaatgtaagattgctgggccagtttgctatcgatggatgtactttattgaaaggtactttattaaatatattagtatacaatttataatatttgtcatatgtcatatgatatagtcgtaacttattaattttgtgtcttgtatatatattacaagtacttgggtaaattgaagtcgtatgttcgcaacaaagcgcgtccagaaggttcaattgtagaatcatatttggcagctgagtgtatggcattttgttcacgatatttggaaggtttccctaccaagcataacctaccatcaaggaataatgacaaaccagatcagtttgagactcccatgagtaggcaagaatccactttgtttcctccagtaggaaaaccattgggaaaaccatcggtgtactccttaactgatagagaaaaattgcaagcccatagatatgtgctatacaactgtgatgctgtagtaccatatctaaagtacgtattcttttatatgtggcataaagtgttttgcttagccttttatgtttatttgttttgcagagaacatgttgctgatttaaaaaggaataagcgcaaaaggttaactccaaaaaacattgaggacatgcaaaatgaacaatttcctaattggttcagagatcatgtaagtatcaaaatttagatttttcttttcaaatatgagtaaaactaatgcatcttttggtgttgtgtagatcttgcagttggagaatcaaagaggtatcgatagcattgatgaggatattagatggttggcacgtggaccaattgaggtagcaaaacgacatagagcattcaatacccgtgggtacaggttcagatcaaagcgttatgaca

SEQ ID NO: 91037 - DNA, 676 bp, Oryza sativa
ttcttccatgccggagaatcagctggatgtcgaagcgcaccatcctctaagcgctcttcatcatgccaacgtgggagcgatgctgtttctctgcatatgaacaatctttttagcctatcctttattggaaaatatcgtaaaactttgcttggcgttgctttctttctttctttcttcgttaacttggtttctggctttttatctttccatctagaagccttacaagttgaacaaaaatcatcattaaccttatctttccaaaacagctgacagttattgggacatgcatgaatttgttgataatctagaccaaaatttgaaaccaccttcttagcctcataaaagttttttggcaattcttttccatttggaattgccatgtgaaggatatcaagtagatctccaaatgatttatgactccatttgttcatggatttcatattgaacaaaagcactagcagagataagtgtgatagttcacatccatcccataaaggcttctctgaatctttcaccagcttataaaatgcttgagcttctaaatttggcccatcagtgtgtgtacacgatgaatctgcatgatcactcataggcacatcgtcaaacacagtcctaagtgcatcattaattaattcgtgcatgttagcacgcatattttcattgtggggctgtggtt

SEQ ID NO: 91038 - DNA, 638 bp, Oryza sativa
attcctgcagcccagtcgggcgcttccaagcgttgccacaggtgcagcgggcggtaaaacccctgggtgcgcatcagcaccaccgcggcgatggcgatggcgtaatcgaccagcagcgtggcccaggcgcaaccggcggccccttgcggcgcgatgccccagccgccaaaggtaaaccagatcgacagcggcaccttcagcaccagggcccccacctgaatccaggtgaccagctgcgggcggcccagcgcttggttgagtgtggtgtacaggcgaaagaacagcgccgagggcagcgcccagccgacgatgatgaggtaatcgcgcacgctttcgcgcatcgcatcgggcacctcggtcaggcgcagcagcggctcggggaacagcagcacgcccatgcccagcacactggcagctgcggccaggtacagcgactggcgaaacgattgcccgatggccgccgtctcgccgcgcccgtgctgctcggcccagaccggcagcagcgcctgcagcacgcccatgagcgagacatagacgctgacgaacacggcgaggccacggacaaggcggccagcgcatcggcagaaaagcgcccggccacgatggtgtcggtcacgccaaaggccatcacggccagt

SEQ ID NO: 91039 - DNA, 2729 bp, Oryza sativa
ctgtaatcttaccaagtacagtcgaaacttctccagcaccaagtttgtctctgaatagctcaacactctgatcataggaaccaagcatacccatgttcagggccatagctctaaccacagtaggtcctgctcccttccaaagggcaaggacaccttcatcagcaataatacggtagagcgcatggaaagcattcttgtagttacggcgttgtgcaattggcaaggtcgaatcagcttgcatcctaatgagtgccaaatcagcagggctaccaacacatgctccaatagctccagcagtaaggccaataaaagctttctgaactaaaggcaatggctttccatcattcttttcaattgctttgtttgtcagaaccctgaattagataatcaaatatcaagttccaacctaaatattgacaaccatctaaatcagaataaatacttagaatcatgaagcaataaactcaactaatccagctttatgatgatcaaatttctctacacagtaaaatggaacaaccgcaggagaacaataaagaaaaagatgaaatattccttaaaactccaaaatagcaaatgatacatcaggccaagtgtactacaaaataattctgctaatagcatgattaaggctgtgtttggaactccaagttcccaacccctctccctcgttttccgcgcgcatgtttttcaaactgctaaacggtgcattttttgtaaaaagtttatatatgaaagttatttaaaaaaatcaaattaatccatttttaaaaaaaaattaactaataattaattaatcacgcgctaatggaccgctccgttttccgtgcggggagattgggttcccatccctactatccgaacacagcctaatcactcttaaaaaaatcccagaaaataaagaataatgatatccccggtaacctaattttcctcaaagttatcgagcaaaacagcattggcacatttctttcagttactcatcagcaagacagcaacagatagcaatcagcatagtttatgcacatgtttggctctcttgcccagtgaagcaggcccattcatcattgttaggtaatgatatagtttcgtagacctaaaaaggctttgttttgcttccagtaacaggacgtgtcacatcagatatcatgcacacacataactaaattttgagttcctggtacagtacaaaaggtgagaagaactggcactcttaaacttgaaacaaatatggtcatcgaattaatatgacttcccctaaggaatgtagcagaaagatcctagctggtaactacaagattcgagtcatgttttcaaatcgtcaacctaatcgcgattagtcatcctagtcagtaataaggcaactcaattataaccacaattagtcgtaaagtcatccaattagtattaatcgtcctagtaggtaccgaggagactagacgcaagtttccaatttgaaatcattgattctgaccattatgagaataatacaacaaaagcagtaaccatttaaaatatttctgcccatggaaaacaagtgatctatacaaacctgaaggatccaagacgagcagtagtatatgtcgcctgccttagtaaaccagctgacaaaccctgcaaatgaggtgctgaagaacttcaacaacatatcaatccaaaactaacaaccgaacatggtgtaacaagtgcaaaatagtgaatccttgttggttcaagctaaaatgctaacatagtatattgagacatttcaaggttaaacaaggatcaaatcattattgatacgaacaatatatactggataacaatgtccaagttggacccagtaaaatctcatagtaacctaacataaccagcattgagaacacacattaaaatgtttgaaaatgaatctaaagcaccttcagtagaacgaaccttgtaaaaggaaccaataccctcattagcaagcatgttctttgtgacctgagctgcagatccctctcccagctggatcttcacctgaaatcaaaataaaaggaagaattatgtacaggaagctcacgtgctaaataaagtaggtaccaaccataaaccaagccatcagcacattgatagtgatggctactagccaattcccatgttccaacagatcttgctgacatttttttccccattttgtgctactaatcgataacagatcacgaaaaggaatagcaaggaatgcatcttctccgcccaccagactaaaaaattagcacgtttgcatgccgctgcacaaatgtagagccatacactaaatctgctactgctacaattttcacagattaaatgttaatggatcatctcaggatcgaccaattaggcaatttactacacaatccactgacaaatttacctaagatggcgatatgaaatacctcaagaaagcacagagaacagcgagcaacaccaaactggcccggctctactacaatccgcatcacgtaaaacccaaactccacggatctaatagatcgtggcgaccgaactccatccgagacaataattagctaacggaaatgagttcccaagcatccgcgcggacgccatcgacaaattgcaacagatctaaagcgatccacacccagccacccctataagcgagctccactgcaccactcgaacccacgcatcatcagatccaacccactcctacgcagctacccaccagatccccctccattacaacggatccaagccctccaccccga

SEQ ID NO: 91040 - DNA, 1337 bp, Oryza sativa
cagattaggtatgccacaaactctgagatgctatgcaatatgtattttggtatatattatttcattagttctgggttggggtatggatatcaagtcttaaatatgagcatatattatgacagataatattattttgcattttgagggaacatttacatctaattcactttatgctgaccgttgcagttgaataattgtggtgtacctatatccattacattcttattgtgaagtttgctctgtattgttaaagtaattccgattttcagttgtgttatttttatcattgctataacaaaaagcttatgtaacttcatgtattttcaggggtgattttgcatcagagaattggaacattgaacccagtttgtttttccctaagcaatacttttctgagtgagtattttacacacgtttatcctcggtctgttttctgttgtttacagttgaacaatcttaatatcaatgctacaggttcatcttcagtgctcatatgaaagcgtttttgttgataaattcccagcacacttcattcttttttctatcatgagttcctgatgataaaaatgcacacttctcatatcaaacatttttttgtagtacctgaaattgattttactatctgtggttctatttcctgtagaacagaggtgtctgcattttttctcatttgaggaaaagcgcattttctgcctctggtattattagtcctaaagtctgtaaactctgaggctcactatttgttttcactgcatcaccactgaaaaattggaagatgttatctatcccaaaggagatcatgatgctgtttccattagcaaaagagatgttgagctgctgctacctgaaacatttgtcaacgatacaataattgacttttatgtcaagtaggttgattttttttatgctatctgatatattagttcgatttgaaattctatcaataggaatgcaaccacagttcttgatctttgatttttagatttgctgcagaattgttctcttgtcataaattacatttaatatttaaatcctcactcgcaggcacttgagcacaagaattgaacccgctgagaagcacaggtatcacttctttaatagcttcttttttcgcaagctggctgatcttgacaaagatcaagggagagctccagaaggtagagcagctttcctacgtgtacgcaagtggactcgtaaaataaacatattcacgaaggagtttctgtttattccagtaaacttcaagtaagacacaagacgatgaaaattctgttgatgcagtgataaccttagtgcactactaataatgtttctgcattgcagcttgcattggagct

SEQ ID NO: 91041 - DNA, 7401 bp, Oryza sativa
acatacacgaggccggtggctgaagaaatcatgaaagatggtatacatgggtcatcggaggtgtctcccgctatgtcacgcatttagaagaaagaagaaaatttttaacggtaagagagaacttcagcctggtcctaaagatttgtccggagatgaggtccaaaatatggtcaaggacataagcaatgagtttgggaagaaaagaaaacgtagcaagacaaagtagaagggtatgtggaagaaaaaatccatattttggtggctaccttactggaaagatcttgatgtccgtcattgcattgatctcatgcatgtagaaaagaatgtgtgtgagagtttggttggcctgatgttgaatattcccaagaagacaaaggacgggttgaacacgcgtcttgatctacaggacatgaatattcgcagtgaactccagcccatacgagatgcaaagacaggtagagtgtgtcatggttatggatatcacatacctaatagtagttgactaaatctcggcaggacccaccacataccatgtcctatacggaaaccgacttcagatatggagggagttccggataaggaaagacaaccagagttctacatggaaacgacaaggactactcggattgtatccatattggtttccctagttctacttggataagaggacacctatgggtataaatacaagcccctaggaggatagggggacacacacggaccatgagacgatcaacacgatcgggacgaccacttcatcaacacccaacacaatcaacatacaagcctatatacgccaagacacgccgccggatatcgacttcatggataggtatggctattcccctacggtgtctctggataccgtcaggagatacgaaagcgctatctctaatcttgctgggcacggattcgaggagtaaggctaccctgttgtcgactacgagtcagaccttcagaccgacatgtcgacaatagttagataggctacccacatattgtactggtgtgattatggtgaataaaagcaactccggcttcggccaacaggatgtagggttattacctgactgctcagggacccaaacctgtataaaaatccctgtctccgtctcttttacctcagtctcgcgtatatcctagcatcaacgatccccatactgtccaaataccgtagtcgagacatcaaacatcgacagagtgtacctccctctagcctgccacacattgtcgaaggatgagaagattgcaatgttatcatgcttgaaggatattaaagttccattgggctattcagcgaggataagtaagtatgttaaattggacgatctaaaacttgttggaatgaagtctcacgattgccacgtgctaatcacacaaatcttgccagttgctatcagaggcattctaccatcgaaagtgcgtcacacgatccaacgtctatgcgccttcttcaatgcaattggacagaaggttatagatccagaagatctagatgggttgcagaccgatattgtgaataccctttgtcacctggagatgtttttcccactgtctttcttcgatataatggttcatctccctgttcatctggtgaagcaaacaaaactatgtggcccgacttttctaagggaaatgtggccgtttgaaaggtacatgggagttctgaagtcgtacgttcgtaacagagctaaacccgaggggagcatcattgaaggttacacgaccgaggaggctattgagttctgtgtcaattacatgtccgatgccgatcctatcggagttcctgcgtctcgtcacgagggaaggttgtcaggtgttggcacaatcggaaggaaaagaattaggcccgatcaagcgtcgtacgcgcaggctcattacgctgtgctccaacatatggcagaagttggcccatactttaaggagcacttagcgaaaatccgagatgagaacttggggcgatctgatgcatggattaacagagaatataattcttggttcaacgaatggttcaagaatcttgtgacaatgtccacggatgtcccaaatgagacagtatagttgttggggatgggaccgtcttgcactatagacacatggcaaggatacgatataaatggatacacattttacaccgtcaaacaagatgacaaaagcacagtgcaaaatagcggcgtccgtatagatgcattccaggatcaagttgggtcaaacacatactacggtcgcattgaagagatctgggagctaaactacgccaagttcaaggttcctttgttccactgccgttgggtgaatctacgcactggtgtcaaagccgacaaggaaggtttcactttagtagatctatcaatggtgggatacgccgatgaaccatttgtacttgcgaaacaggtcgagcagatattctacataaaagacccttcaaactagaagatgcacatcgtgagggatggaaagcgccgaattgtaggagttgacaacgtcgtcgatgaagaagaatacaaccataatcttcatgtaagacctcacattgaccttgacgatgatccccaagagcctgtggcatatgctcgttcagatcatacggaaggcataaccttgtgaccgatgcatttgtacttatctattgtaatgaatgaagtattttgttttattgttttattgcaaagacttgatatgtgtagtcattaatatggctaattttgttttattacaaatgaccaaaagaaaagttgtcgatcttgatgagaggatcaactttgttgttgaccatatttccatttgaaatcatttagtatttacaaatgttgtttatatttgtcatatattcaaatttaatttcaagctgttgggaaaaaagttatatagaaaaatgaccaaaataaaacttgtagatcttgataacctctacaattttgttgttgaccatatttcgatttgaaatcatttagtatccgaaaatgtattatgactaataaaatgaattattatacagcagctatatattttgtacgcacaaatataaagacttgtttggaaaaatggaaaaatagtcatcgttgacgggccttagttaaagcctgatagagattaatctatctctatcgagcattatcttagggctcgtcacagatgagtcatccgtgacgggcctgaatgtcatctcaatcgggcattagtatggagcccgtcaccgatgagccatctgtgacgggccctatggcaaagcccgattgagatgactcatcactctactataactagggtttctcagatcggatcgaaaatttttctaagtcccgctacagtttcccgcctccttagaaccctagcgccgccgccaactcctccttcgccaccgtcatcctcccttgccgccactgccaccgagaccgccgccgccgcctccaccgagcctgcccccgccgccgccgccaccgagcctctacaccaaccggcgtcggccttcctcgtcgtcgccgcctgcctcttcaccgacacgaacagctgcccctaccgagctcggcgacgtccttcctcatcgtcgtcgcctactcctcaccgacgcccgacgccgacctgcccgaccggcgacgccctccaccgagcccggcgccgccgccgcgaactcctcctttgccgaggccgccgccgccgccaccgaacctgccgcctccaccgagcccggtgccgcctccaccgactggcgacgccctccaccgagcccgacgccgccaccaccgagcccccctcccctccgccccgcccccccccccccccccccgcccggccgacctcaggtgagtcctccatcgcgccgctctctgctacctgcatgtggtgaatgatgaaatgtagatgttgggatgaatttagtgataaatgattttagtgattgattacatgatgatgaatagatgaaatgtggtgcattaatgaatttagtgatagatgattttagtgaaagatgattttagggattgatgatatgtggtgaacggatgatttttttgattgatgacatgttgatgaatagatggaatgtggtgcattaatgaatttagtgatagatgcatgatacgtggatgaatagatggtatgaggtgaatttatgattttaggatttgatgatatgtttaatttatttatatgtgacattcaattcattctattactgtgagatgtgcaatttagtttatttatatgcttcgtttatttataagtgacattcaattcattgtaatagattgtagcactgaattgtgtattttcgttattttgaaaaaaagaagacgatgtctcagcaaggcctgctctcaaagacgtgaggacgacctcctcacgaaagtgttgggcaacaaggaacaccgtggacggacacggggcgttgggtcttctgttccctggaagtatggatttccagactacgcgtggcagtacaagaagcagacttccaacaaggcggagaaagatgcacgccttgaagccaagatccgggcgtcgataagagctgagctgacatctgaattcaatgaaaagctcgagtcgatgagggccaagattaggcaagagatccgagaagagcaacagaacccccaggccgccgctgctgctgcgcacgaagagttaggaagtcccaccaaaaaacgcagcagttgcgcatcaactgaggtggcggaaaatccaacatcggtcgacagcgccgtcgaccacatagcggtaaaagtttcgtccacaatgcatgaaagacttaacgaatccatatgatatataatattattaaaaaattgattaatctatcgcaggaaccaacgagctgcaccctcacaattaggttgatgccgaccttcacggttccagcagccgagggacttgcgtacaagccgaccccagagacaagagtgcatggagcgcaactcaagggcggccgtgcaaaagttcaagtcgactcggtgaagtcggaatacaagctattcccactaaagtatccaccgaacgacgaggtcctctcactaggaaatgcccgtggtaccttcatccaatggcccaaggacctcattgagatcagggttacagcgaggctgtcacgcccagaaattcacgaaccagaatttctaagctgaatgtgtattaaacccctgtccaggaccagccagggtacacaaacgacaattgttgacatacagatccacgtcttacaaaaatataaaagattacaaatgcagcggaaaaagtaaaatgagctaaacttgaaagcttgacttctgcagcggggcgactccactccacaggcaatcctcgacggcagcgacgaaaccgacctcaacgagacagctccaactaggaaaatctttagctctggtgtgggggaaaagagagcaagactgagtactacccactgtactcagcaagtcataccggaagaggaggtatgatgcaggatatgtccaagggaggctaaaggttcttttgcataaagctagcatttaaaagcagtagttgaaagcagtaaaatagttgtaataattaatcaatattaaccaatcactgtccaacgctacaccacgttgcaacaggcccaaccaaccacctgaactacaccagttcaaaagctaacaaggggtgagactaatcacggtgaatctggtcgaccgcccataaccgcgggcacaactattcaaatagttttactctgatcagaggtgtacaactgtacccacaagacacagcgccaccacacgtttccatgcgccgacatgccaccacgacataccggaaagaggccgtgacatgacccttcgcataaccccctctaaccgatcgcaccacacctcagggttcgcacccgtccccagcaagcaatgggcagcccccctctcgtgccgcggtgaatccggaagccgatcaactggacaccccggccgaaccaactccatcacgcccacccttgcctgggtatgtcggctagaggaaagctacactacaagcccagccgttgcccacgctggcttgtggtaagcacgataaattcttctagggtttcccgcgaaccggtccttaatcgccatgggcacgactagcaaaaaccatgcacccacagcccaccatgtagtgtattttaattaactaacaccattacggtgccactaatccaaagctataccaataatcaaagtctatgcattaatgtaattcccccattgtgtactagttgaactaagcatggctaagcaatccctaattcaacatctaatcattttgatacccaagttatcaatggcataaggtaaccaatatatggctgagtagtaggacccatcccacatgatactataaaataatgcaacatttaatagaaatgcgggacatttgtaaattgggtacaacatgatcaattgtaatgcatgacttgccttgctctcgcactgatgagaccacaacaacgtattcgaggaaccgtggatcgacgaaacggctgaaatctacgtgacaaacaaagcacacaagcaaaatatgctataagtctactgaaacaggaaacaaaaccatttttaatggattctatacatttttatgaatttactgagacttgaatggacttaattggagctcggatgaattagatataaattttagaagattaaatgtgtttttactataaaagaaaaggccttaatggatttcattgcgcaacaaaggtccctgctgacatcatcagggggggtggtgccgacatgcgggacccacgggtcaccggcacaagaggaggaggaggtggcaccgactttgggtgggccccaccgggcagtggctcaaggggagggggaggcgcccagtcggctcggctcggcttcaaaccggccggccggccggttaggcgttgcggtggcggcaagcggccactgacggcggcaaccggcgagaagacggtggcggccggcggcgcgggcggcggcgcatcgcgacgacgcgtatgcggggagcggcggcacgcgcgagaggaaggaaaggggagagaggtgccggcctggctcggtttggcttcaaagccgaccgacggccatggcgaccgtcggcggcgcgcgcggtcgccggcgacggcaaccggcggcgcgggcggtgtgaaagacggcggcgaccggcgcgaagggcggcgacgcacggcgtggcccggcactaggagagagagaggaaggaaacagagggggagggcacctcaccgtgagttggccggcgtgggggaagacggctgcgaatggtgacggcgagcaaccggggaacgacggcgatgggcggacgagcttcaagacctcctagggaacaaaatgggagggattagagggagaggggtggtccacggcgggcggaaaccatggccgaaatcggcggcagtggtgg

SEQ ID NO: 91042 - DNA, 2139 bp, Oryza sativa
gctccccccgcgcggccctcccccacacgcctgcatatatgctactgggccccaccatagtgcctgccccacctgcaattgcaacaaatcaaccacatattttgaaaaccctctattaaaggaatttggtttattttttgttccaccaaaaatgtttcacctagtgtactcacaatgttttactatgtatagatctaatattgcagtgaactgaaatattccattgcaacaaaaaacccacatattttggaaaccctctattaagggaattcgttttatttttttttcaccgaaaaatgtttcacctaatgtacacacaatgtttcactatgtatagatcaaatattgcagtgaactgaaacattctttcgctatttgctgaaacattgtttttatataaggtgaaacaacacccggtttaaacgagtgaaacattttcgatctacttagtgaaacaattccgatatacctggtggaacatcgtgcaacatttaaaaaaaattcaataataagctaatttttttttcgtcggaatatatccatgtgtggtcttgttttgaagatttaattgcaataaatttaatgttgcaatcagatcatgatttggataagtaatttaagataaaaataagtttaaagtagttttgcacgtaaatcgggtgctgacgtcatgctgacgtcagcgcacgattttttaaagatttttatcgggcgaccgatccctagtcatccccctgatttgtttaaaaataaaagacataagttagttcctgtttttcagttagcgttttcttgtgactaagatctcgctgatcgatcgtgggatggcgcggtcaagtgcgcgattttggtatgtgtttccgttttgtaacaaactcctagagttcggagtataaataagagatgagaaccgggaaaagctgctaagtcgttcgctgcaccaaaaaaccctgtgttttgctctgtttcagtttcgtcagagttcttcagttctctgtagctgttcgacaacctaaagaaacaacgagtttttcagtgaagtccaattagagagcaggtgagattcgagtgctaggttagccaattccaacatgcaccatggcgtgcgcgtcctccccggcaaacgtctccgacgtgttcgggcgtggcgggcttgtccttggccggcgccgtctgcgccgaccacccccgccccgcgtccgcactgcggcggcttcttgctccctcctcccgccacctgctgctgcttcgccggttgtctaggtcagagaggacggggaaaagcggcgaaggttgaggacgaggtgcgtgatgcgccgaggcggtcgttcttcgcgtggccggcgggcacgacgaggagaagaacgcgctgcagtccacggtcgcgtacgacgccgaggccgacgcatgggtgccgctcccggacatggcgacggagcgggacgaggccagggggctctgcgtcagtggcatgttcgtcgtcgtcgttgtcggcggagacggagctcgctcgggcagccacgacggcgccgcctctgccatgcacgccttgctcctcgccgccgcctccaccatgtacggcgtcggcgggcggcggcggcagcggcgtcaacacgccctccacggcatccgcccggcggcgcaaccacgaggatgaagacgacaacgatgacgagtagtccggcgaggggcgcgtcgtcgaggcctgggcaaggggcccggatgagtccgtctccgctgccgaccgtccgggtgagctccgcctccgccgtgcaggccttgcgtggttgcgccagcgagagagaaggtatgacatgtgggtcccaccattattgtaaaagaaaatgctgactgggttgtcacgcgtacaccacataggataaaactgccctggatttggtcgagggggtattttgtccggtataaaaagttcggggttagtgatatctgattttcgtgtccagggagtaattcggttgaccgcgatagttcgggaggtaattcgtactttttttcctaactattggagtaatactttttatgtcatattggtcccaacacaccataaatcatatttttgtcatttgaagtttatagagcgcacattgtgttttcttttttttttcactatttctatgg

SEQ ID NO: 91043 - DNA, 1431 bp, Oryza sativa
tgtaccatggaacatacgattggtagaaacagaagcagggcctggagaaatggagatgacaagcaaactgcaaaaataaccatttcaaatgtgctatcgatggtgttttttctatatatttcctgaaacaatcatccaaccgtttttgcttcactggtggagaaaccatctttcgtcggtcggctgaattccacaatagtctcggatgcaataaaaaccagggctaaagataatctttagtcccggttaaaaagggtaacggcatatttgatctttagtcccggtagatcatctttagtcccggttcaaatgctgtcagggcctgtcaggcccccaccaaccgggactaaagatcgtaactttagtcccggttggtaataccaaccgggactaaggatctcggggatctttagccctggttggtaacaccaaccgggactaaagtctcacccctatatatatgtcttcttcctcgtccagctgcccgagcaaacttcaaaatttcttcaaaaaagaggggaggtcatgccaaaatttctagtgaatttattttggtgattacatacaaatcggaggtgcctaaaaggtttgcaacttcatcctccaatgttttttttgtcatattacatttgcagctatgttttgcacacttttttgtctccaaaatttagttgtaagttgatgagagagaaaatttgtgtggggaagaaataatatatagaaatttagttgatttgctaaagaaggttttataaaatagttgagaaagaaaatatagtgaaagttaatcttaaataatagaaaacaaactaaaatgaaaattaaaagaagtaaaacacattaaaatttgtttaaaactttagaaatagtaaataagaattatttggtgtaatattttatgatttttgtatgaataaagatatgtcattattgtataactgttgaaagagtttgtaattatcttataattattgtatgactgtcattattgtaagaataattatttgtgtacgattttttttcgactcatgtagatggatcggcaatggatgtacgctgaccggcggtccaaagagtttattgacggcgcgcactattttttgagagtggccgaagctaacaggcaaaggggttttatttgttgtccatgcaataagtgtaagaatcagaaggagtattctgcatccaggactattcatttccacttgtttgagtcggggttcaggccaagctataattgttggacatcccacggagagcaaggtgttgaaatggaagaagatgaagtggaagacgacaatattccggactttgctcagtacgttggatttggaggaaatcaaacgggcgaggaggaaaggatgcggatggtaacgacgttgcggatgatcttggtcagatgttataggacgccaaggaggactgcgaaag

SEQ ID NO: 91044 - DNA, 2901 bp, Oryza sativa
cggtgaggagtacgagaacctagaagcatgccctgtttgcaaagcactacgatacaagattagacgagacgatccaagagaagttgacggtcagctaacaaagaagagaattcctgctaaggtgatgtggtatttccctataataccacggctaaggcgtttgttcaggaacaaggggaatgctagaatgatgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccctggctatgcatgaagaggaagtacataatgatgccgattattattcaaggccccaagcaacccggtaacgacatcgatgtgtacctaagaccactggtcgaagatcttaaactgttgtggaagaaggaaggtgtccccgtgtgggacgaggacaaacaggaggagtttaacttacgagcgctgctgttcgtaaccatcaacgattggcctgcacttagcaacctatccggacagtccaacaaggtgtacaaggcttgcactcactgtatggatgaaacagaaagtacgtatcttaagcactgtaggaaggttgtatacatgggtcatcatcgattccttgcagcaaaccacccggtacggaagaaaggcaagcacttcgaacataaggttgaccaccgtacgaagcctaaacatcgcagcgggaaaacagtgtttgctatggttaaagatcttaaagtagtgttcggaaaggggcctggaagccagcctatagagagcgaagatggtcacacggcgatgtggaaaaagaactctatattttgggagttaccctattgggaattcttgaacgtccgccacgcaatcgacgtgatgcacctcactaagaacctttgcgtaaacattcttggcttcctaggtgtatacggaaagtcgaaagatacactggaagcacgtaatgatctgaagcatatgaaacaacgcggcgaccttcacccggaaccaaaggagaaaggaagccattacttgcgtccagccagctacactcttagcaaggcagagaagaaaagtatgtttgaatgcttggagagcatagaggtaccgtctggatactccaccaatatcaagcgaataataagcacgaaggagaagaagttcacaaatctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgatgtggtgcaatgtctcgtcagttttgagttgatatttccaccttcatttttcaatataatgacacatctgctttgtcaccttgtcaaagagatcagtattctcgggcctgtgtacctacacaacatgtttcctttcgagaggtacatgggcgttctgaagaagtatgtttgtaaccgtgctcatccagagacaagcatcgccaagggatatggaacagaggaggtcatcgaattttccgtagaatttatcgaagaccatcgcccaatcggggtacctgaatcacgccatgaagggagactacgggaaaagggaactctcggaaggaaagcaataatgacggtagacaacaatttattccgtaaagcccatttcacggttctgcaacaatcttcattggtagctccttacattgaggagcacttggctctagttcacgccaggaacatcggtaagtccgatgcatggattacacggcatcacattgatactttccccgcatggctacgataacatctcatgggtaacgagtcgatcaaccaacaacttgccttcctggcgaggggaccgtctgggtcgatcgcgacattccagggatatgagatcaatgggtacacattctacacgagagccaaaacagtgctgttcgtgtcgatgccatgggacacgatggaacaactggcacgtattacggtgccatcgaggacatatgggaacttgactatggtcctctcaaggtccctctgttccggtgccaatgggttaggttgactggtggaggcgtaatgattgatgacagtgggatgacaacggttgaccttaacaaggttggatactcggacgaaccttttgtcgttgcgaatgatgtaacgcaagtcttttacgtgaaggacatgtctagcaaaggaaagaagggcagagggcctgacgagcctaagcgtcacgtggttctcccaggcaaaagaaaaatcgtcggagttgaggacaagacaacaataatttttcgaagtaattgtcattaatctttgtactttaaataattttaatgcattattttctattttagaagcacatatgtaatggaaaataatattcagtgcgcttatcagtagtcccagttcttaaccctaaccgggtttaaaaagaatttggaaatagcgggaaaatatctttactcccggttgatgagaataaccggaagtaaagaaaagaaaatatcttttctttagtcccggttgttctcaacaaccgggagtaaagatatctttactcccggttattctcatcaaccaggactaaagatctaggggtatatatattcccatgcgcgccctcatcttctacaccaacacttagaagtttttgcccgatcgatctctctcggctcctccttcgccgccattgcctacggcatccccgcgccgacgccgccgccgtatctcgccgt

SEQ ID NO: 91045 - DNA, 2829 bp, Oryza sativa
ggtcgccggcccccgccacgaccccttagttagcagccggatccggcgccgtccgtctccaccgccgtcgtagaaagcccgtaggccacctgtgtcctcttgccgcccgatgtgacgaggagctcggcggcgccacacggaggtcaaccgatccgcatcatccacgccacttaaagtgattatgatttgtgaatcaacggatttgagatttggtaagtgacctctccctctctcaggttttcctcagctcttgatgattttttttggatcttttatgtactttcttcatccgctaacacatgatgagtcgagtagctagcatctccatggcaatagaactaagaagttcaaaaaaattgtatgatcaataatagccttaacaaagtgacctctaagcaacaaatctactgtcccaggggaaaaattgtgatattttgaaggaaatgctatagtggttaaatacttaaatgttcgcatgttgaactgttaaaaacactcataacttgatgatctcttgacagaacctagacaaggaagggctcttggagcaactgctacagtcagctgctctactggttagttggtcacttggccgtcacttgtcaggtagtatgcacaaccttgtggtatatcatctgctttatgtaaattagtttggctcatttttactaatgttataactgtgtgtttagcctgacggtgcagcatttaaaagctaacttatacagtgtgctttatctctgttatagctgacctcggttgtaagttctgaattttgagtggtgttggtcagaacaatttatctgttgcaatattagcttttaaatgttattactgatcatacaatttttttaaaatgtattacgattcatgtaagtggctcctaacatatgacctgacatatgttagaataaatccatctctgtgtatacattttctggtgtgtccctgaaaatcttgcgaggcgttcggggaggtgctagttacatgtatgttacaaaattaagttttgtgatagctaattgatattgattttgtgggcggatgcagctgtggcctcggtgccggtgaagtgacctgcgcggtggacaagtgcaaggaggagctgagcaggtgccacgactagcaccggtggcacaaggtgtgtgaggcgctctccaagctgcccgtcgttgtcgccgattgtgagatgctcttttgccaacagtgcatcaggtaaccaatagtttgtcagatagaaaactaaatcttggtaattgatcttcaggctaagtatgatggggatgaggaggagcagaggtggcctaaatctgatggacaagattttggcagtttgggaagcatttgggatatggcaggtaatttacacaagcatgaaccataaaaagcaggatttctcctacatgattgcattagctcaagtatcagaagtaatggtgtaactggaatctaagtcttactgaggcatatatgtgtgttgcacttatcaattaacgtgtgactgggagagatcaactttactgcttgttgttgcatttacatatctttctgtctatctatttattatttgactttgtgattcttcacatgtattggatgaaattcatcggcaacctgcatcactttcactttccatggtctctgcccaggctccagaatccgtggttaattcattaccatgtaagagctacaaaaagcagacagcccaatgcagtgataacatggaacagtgagattcttaccattcaaattttatcatttacttgttgtcacctagggccaaaaatagttctgagtgtcattgaagaatgtcaagttcgccgctacaaatgcatcacattatcttacgcgtttgaaataactatgctgttcatgtccattatccatcaaaaaataaattgagaccctgtacaaaatccttattattttatttgccttacatcagccttctaatatggttgttgtagtcattttagagatcttatcaaataagcattttgtcatgggcattgggccaaaggccaaggtgtttagcgttttggatcatgacacatttgggggctaattctgccttaacaatattgtatctgtcataacgagctagaaccatgaaatatttgggggctaattccgccttcatgatattatatctatcacagtgggctatcctaaagttgaaaatcacagtgagattctattatataacaagttattcttactgaaacttgacacgattttttggactgcatatcatgatggcacctggatatgtggataacaagttaacaacatgatgataaactattagaagttgaggatgccctgtggtgctcagcaggagctttgaggctctgtgagttacttagtaggtcgctaacccttaatgatatgaatgtgaattatatgcaaatgtctagaatttaaatttccaattttctggacttatgaattttagacttgtgaatttatgatctaagtatatatgtgcaaattaatgttcataatttagacaggaatttttggacttaaaaattttagaccacaatcttttgacttaggaattttaaactaggcatattttgagttaggatatatatgcaaatgtttaggatttaaagataggaatttttggatttacgaattttgacttagacttgtaggtttttatatgttgtgatgaatggcttgtaggtttttattcgttgtggtgaatgtgaatgtgaatgaatgtgctgtatggatgtggggctgtagggatgaatttgggtttatatggaattggggttgaatggatgaatttactgcaattattttttttttggcccaaca

SEQ ID NO: 91046 - DNA, 850 bp, Oryza sativa
ccgggcggctgcaaggacagcggcggcggggctctctctctctctctccaccgctcgcagtggagctggacggggcgccggcaagacggagcggcaaggcgccgacgacgacgaccagatccagcgccaggatgcacggatccggtacccctatggccggatctgctgcttccgggcggcggcgacccgggtcggcaagtcgcggcgtcggcggcgtggaggtggcggtgtcagcggccggagggcggcgtcgacaactggagggcggcctcggcggcgtggagttggcagcgaggcggaggacacggcggcatgaccgtggctgcggtgacaaacggcgagcgtgaccagttctggccggacggctagcggcggtgcttgcggccgtggtgcagctgcggcggaggtggatggcgacggtggcggcggaggctggtgagggcgacgacggctgaggcagccgctgcggtggctggcgatggtggcgacggctgaggcagccgtggtggcggcaacggctgaggcagctgcgacagcgaggtggcggcggcggttgaggcagccgcagctgtggtggtggctacacgcagtgtcgaccgtggatgagggggaggaggcacggcggcctcggacggctagctgagggcgtggtagacggctgcatctggccggcgcagtagcgtttggaggaggggtcggaggccggcttggtacagagaggcgcagcggatggcagtggaggtcggctcagcgcgagaggcgcgggcggcggagatggaggccggcttggcgcgagaggcgcggccgatggagggaggccagattggcgcgagagacgcgtccggtggag

SEQ ID NO: 91047 - DNA, 701 bp, Oryza sativa
attcctgcagcccagaccaagctaacaacaaaggcattttcatagtccatagagatcacttaccgtcagagatccaatcacagagcatattcctatatacactgctatgttggtctgcccatagcggggagcacaatgcgccatcaagatcagtgagaccaccagtgcaaaggccacatagcaaagaaaggctgcagaaaatacaaagtacaattgtgatgactgacgataataaagtacaaagggaaactacaaggatataccaggttgtgtcgccaggtgccaaatctgctccactgagctcggtgtctcctcttcaggagcatgaaggatgatcactgttgatccgactatacagagcacgcagcccagcactcccatccgttgcagcttctcattcaggatgaaatgggctagaacagcactgctccacaaagattacgcattcaccacgcatgtgcatggacagattaaaactaattcaaaccatgggttctaaccaggaaattttacaagcaaagggaacacatcccagttgtacctaacaattatgctgagagcgccgaggggagtaaccagaacagccggtgcgaacatgtaagccacgaaatttgcaatctcaccaatgagcactacgaaattcggaaaaaaaattatcaagaatttcgaataattttgcactagcccctcaagaaataagc

SEQ ID NO: 91048 - DNA, 626 bp, Oryza sativa
gggtaaaaagaagctccatctcgtaaacaagtagccagagcctcccaaagcaagtacttaaaagataaaaatcaatgttatggacaaaagttaagataaaagaaggtttgcaaacttactgccgtttagcttctatatctttgttgaaatcaatgtcaggttcacaatccaagaccagagcagggacctacatagcaaaaagggcaccattatgtaactatgatgcttgatactggagctttcagagcaagctaaggtcagcaaaaataccttctggatgcttgagtgcatgtgatctccttccaagtaaaagacacgatctcgaattgctggaggcaaggaaccttccaaatgtgtgggcagctgactgacagataacacaccagtacctcctccttttgaaggaagcaaccagctctcgtgtttctcatgcaaaccttgcaagtagtcaagagtaacaccaccttcctctgctcttttccggagcatcattcttttgtggcaagtatctgggctagctcttagatagataaatccatcagggataagacctggaagcgatgacacaacaggatcaaaccatgagtcgtaaatgctgatctccatctcattcatccagttagctt

SEQ ID NO: 91049 - DNA, 1823 bp, Oryza sativa
ccgaaggggcaccagcctcatagtcgtcgtcttcctgcacgcccttctcggagttcttgggcaccgcgaggacggcgaggatatgccaccgtccgtcgtccgtagtgtacatcgcgctaggcagcgaggtgccactgcgcgtggataaggtccacgagctcgcgctcgggctggacgtcgccgggacgcgcttcctgtgggctctgaggaagcccactggtgtctcagacacagacctcctccccgctggcttcgaggagcgctcgtgcggccgcggcgtcgtggagacgagatgggttcctcagatgagcatactggcgcacgccgagaaggcgtcgcggcagcgattcgtgcagtcgcggtggaggtcctggaggaagaaagcagcaaagcgtttcaagccaataccaagaagctgcaggagatcgtcgcggacatggcctgccatgagaggtacatcgacggattcattcagcaattgagatcttacatggattgaactgaagcatctcaggatgtacacctacaactacaaaatccttggaataaaatgatttttgtttgcaaaggccgaacggtggggaaaattctaatcctgattttttttcattttttttcttcgttatttatcaatttgataccgtggaacgtctaattctttaattagtggagaacttaactttgcactcagcttgacaaattgtacaggcaagatatcaagatcatgggctttttcatctccaagcggcgagggcggggacacggcggctcgttcaggttccacacgacggtggaggcggcgcagcaggccatcgccaccgggcacgtggaggccgagagcgcggcgaacggcgtaggcctcaccaagctcatgggccggagcgccggccaccggggagaagagcggcagacagctaggcgagcggcgcaagagagagatggccgccgctgccccacgcgcctcgcgcgccatcgcccgccgccagccatgcgctgtccgtcgtcgcgccgcccgccgccgccgcgcggtccgccgtcgcccgccgtgctggacgccacccggcgagaggagggagcagagagatggggagagccggagaggaagaagaagatgattggatttggttatctgagaatgacatgtgtggcccacgtgggccacaccactgtagctgacatgtgggacccaccatttttaaattattttttctatggctgacatgtgggcccatgatttttattattttttaagatataattgccatgtcagcgccacatcaatgccacgtgggatggagaactagtcaaacaagtcacgtaggcgccacgtcatccaaaaccgccgagggactttgtttgcccggttttcgaaagttgggggacgggtcgtacccggttttgcggtcgagggatgaaaatcggattgtgcgacaaatagagggacccaaattgaacttattccttttcagaatatacttcccaaatccagcttgcccaggtcgaggtggagttgtgcagttgaaataggcgtcgaattagaagagcctcgttctgaaatttcagattcctaatacctaggcctccttgctctttgggcttacaaaccgaatcccaggctaccaattccaagagtaaatttgtcgcgaaactatcttggaactgcaacttcgagtccaatcagtttttactctgtttgcagtttcttacagttttggcagtgaaattgtagtttagtgaaattgctccaatgaactcaaaaacagagtattgcacaaaactgttttaactgctatctggacttctgagttctggcaaaacctgct

SEQ ID NO: 91050 - DNA, 703 bp, Oryza sativa
attcctgcagcccaggcgaggggctccatcttcaacacctcgtcggacacggaggtcatcctccacctcatcgcgacgtcgctgtcgcggccactgctgtcccgcatctgcgacgcgtgcgagcgcctcgcgggggcctactcgctgctgttcctgacggccgataagatgttcgccgtgcgcgacccgcacgggttccgcccgctggtgctcggccgccgccgcaacggcaccgtcgcgttcgcgtcggagacttgcgcgctggacctcatcgaggcgacctacgagcgcgaggtggagcccggggaggtggtcgtcgtcgaccgccgcgacatgtccgtctcctcagcgtgcctcgtcccgcaccgcccccgccgctcctgcgtcttcgagcacatctacttcgccctcccaaactccgtcgtcttctcgcacgccgtccacgagcgccgcaccgccttcggccgcgcgctcgcggaggagtcccccgccgcgggcgccgacgtggtcatcccggttcccgactcggggttctacgccgcgctcgggttcgcgcgcgcgtcggggctggagttccagcagggcctcatccggtggcactacagcggccgcagcttcatccagccgacgcaggcgatccgcgacctcgccgtgaagctcaagctggcaccggtccacggcgtgatccgcgggaagagcgtgg

SEQ ID NO: 91051 - DNA, 642 bp, Oryza sativa
ccgagcaggaacaccaggagcccgagcagcatcaccatgcccggcacgccgaagccgaggccccagccgacgttgtcctgcacgtagctcatcaccgccgccgtgacggtcgcgctggcgcagagcccgaggtaccaccagttgaagaaggtgctccgcgacgacgactcgccggggtccgtcgcgtcgaactggtcggcgccgaacgcctggacgcacggcttgtggccgctctgggcgatggccaccaaatagagagagacgtagaagaaggccctctgcacggaggaagaccggcaaacttgccggccatcgccggaggagctgcattgttggctctgaggcgacgagaacgtggacgacaacgctagcaagcccagtccctgccgttgtttggccatggtgaataggtgagcgcagtttgcgagatcaaatatatttaggtcctgttccgaggaattttctcatgcaaaaccgtaattgtaacgtcggtattttaccggattcaaacaagaattgaactgggatgcaaagttttagtgtatcacatcaggtattatatagggtgtcacatagggtgtttgggcactaataaaaaaaactaattatagtatgtcggttatagatggccatatggcccga

SEQ ID NO: 91052 - DNA, 806 bp, Oryza sativa
aacgagcacgggggagccgcggtgccccgacctcaacctcgagctctcggtcgggccgacgccgagctcgccgccggcggagacgcccaccagcgcgcggccggtctgcctctgctaccacctcggcttccgcggcggggaggcgtgcagctgtcaggctgacagcaagggcccacacgagtttagatatttcaggccgttggaacaaggccagtacatatgagatatgaccatgagatgtgagatggcttaattagcttcaattcccaacatgtgtaacacagggagtttttctagtggacgacaatactgtttaatttcagaaaaaaaaagggaaagaaaaaggttctaatctgttcatatttcttactattatccaatcttcatgatctcaatctctctctctctttattatttttctttgtagtaattaacttcatgttggttcctctaaaaaagattggtcgatgttattcagtgataaatattcctagatgatgataatcagatagtggactaaggttggtgctaaaagggaggaatcgttgggcatctgattctagtgctggctctttgcattttggatcatgtgaatattatgcaaagacatcatgtgttttgtttttggtaggtaatatatgtactagtagtattctttgcttctacttcacaaattctcaggatttcaaatggtatgaagttaggcactagggaacgttgggtaggtaattattcgttgagatgctattttgggagtatttggaactggtagtttggttgcaggaatgccataggagcctttgggt

SEQ ID NO: 91053 - DNA, 748 bp, Oryza sativa
gtgagctgggcgaggagtgggcggcggccgagtgcggcaggagggggtcgaggcggtggtccaggaagaaggcgagggggcaccaccgccgcggcgggggcggaggcggcggcggcgggctctgcaggagcagggaggaggcccccgcggggaggaagcgggtgatggtggtggtggaccagagctccggtgccaagcacgccatgatgtgggcgctcacccacgtcgccagcaagggggacttcctcaccctgctccacgtcctcccccacggcggcggcgacgcctccgcgctcgccaactccctcggctcactctgcaaggcctgcaagcccgaggtgcgtgcttaaagctacccagctttctaatcatgcaagcccaaatattaattttttttaggaatgagcacttcaatttctagtgtttttggttcattgatcgtgtagaactgcactgtttttttttcaacttatgaattgcacaatgtgatatgtttcttgttctcctatacttgtcattctgacttctgaggtggcacactgtgcttatcattttgaacttgagtgacacactgaggttgccattctgagcttgtcactcacttaatataattacggcgaggtgctttacatttttgcattccgagcttataagtggcagactacagtaaagggcgttctagtttgctcaggaacatataagtcatacagtgtatgaactatgaatggcaaaagtttggtttaattga

SEQ ID NO: 91054 - DNA, 765 bp, Oryza sativa
cacggtgatacgggcaaaagcgtgcacaccgggcggttgcacgtgacaaggggagacgagccaacggctcggattcgccggaggttgctcgacggcggcggattgcggcggcggcaaccggcggcgggagaagagggaaacggcgacgaggtcacgagagaccgattcccggcggtgagagcatccacgcgaccacgggaatccgatgctagcgtcagattggacggaactacgccgagcgaggccggcgacgagcgggtgctacggagctcgggcggcgacggcggcgagcacacggcgagcgacggcaacggtcggggcggcaccggctagctacggggaggctactcgtgctaccaccgaaaactaagggggggagatggagcgaggaggaagaacggagagaggcactaccgtgcgggtcggggcgctgtgacgagaggccgacggcgcgggagtaatctctccggcctcgggccggggaagaggaaggagagggcgcggccggagtcctcttccgcgtccttgctcgtgccggctcctccgacacgcgcaacgacgatcggcgacggcgaaacagaggacggcaatggcgcggatgcgaaaatgagggagtttggaggggaaggagctggggtttaaagggggcggcaatgtcggtttgggaaccgacttagggcggtcaaggcgcgagctggcgctcggcggtcgcggccaaagcggcgacagggaggatgacgccggcgggggaaaagggctgcagga

SEQ ID NO: 91055 - DNA, 1614 bp, Oryza sativa
ggcaaacaacgatcccaagtgccttcgaaatccaaggcacacgcacgtagcatgtcttctaggatttggtttaccctttcggtctgaccatcggtctgcggatggtaggctgtactaaaattcagatcagttccgagggcttcatgcaactgcttccagaaccttgaggtgaactgagtgcctcggtctgacacaattttcttgggacagccaaatctacatacgacatgggtcatgtagagttctgctagtttctttccatcataggaggttttcactggcacgaaatgagctgatttcgtgagtcggtccacgattacccaaatggagtcgtacccgttgggggttcttggcaaaccggtgatgaaatccattccgatctcttcccatttccactcgggaatcggtaggggttgcagcagaccagctggcctctgatgttccgccttgactctttggcaaatgtcacacagggctacgtattctgcgacatctcgcttcattccagcccaccagaagtatgccttgatatcttggtacatcttcgtacttcctgggtgaatggagtaggcggactcatgagcttcctttaggatgagatctcttaactccttcttggccggtacacagatgcgtggtccgcaccaaactgtgccttgatcgtctatggagaaatttgtgtctttcttctcctgtattctttttattaattcttttatcccttcgtcgtctttctgagcctcccggatttgcgactccagggtaggctgtattgtcaagctggcagggacacctgactgtaccacggtcagtcttaacttctccaattctctgcacaggtgatcttggtcaggccgtatttgagctacattgcaataggccttgcgacttagcgcatcagcgaccacgttggctttaccaggatgatagtggattccaagatcgtaatccttgattagttccaaccatcttctctgtctcatatttaactcggtctgagtgaagatatacttaagacttttgtgatcggtgtatacttcacatctgttcccgattaaatagtgcctccagatcttaagagcatgaaccacagctgccaactcgagatcatgggtgggataattggcttcatgaggcctgagctgcctggatgcataggccacaaccttttgttcttgcattaggacacatcctaagccttgtcttgatgcgtcacagaagatctcgaaatcttttcggatatctggcaaggtgagaactggggcagtggtcaaccttttcttcaattcttggaagctgtcttcacaggctgcagaccattgaaatttcttttccttctttaacagctcggtcataggtctggctagcttagagaatccttcaatgaatcttcgataatatccagctaagccaaggaagctgcggatctctgacacgttcttgggcgggttccaagcaagtacagcttcaaccttgttgggatctacttcgacaccgttggaggaaatcacgtgtccaagaaatgctactcggtccaaccagaattcgcatttcgagaatttagcgaatagttgatgatctctgagcttttccattatcagcctcaggtgttca

SEQ ID NO: 91056 - DNA, 686 bp, Oryza sativa
acaactactgttaacagaacgaagtctatctccttgaggcaaaatactattgacttttgattaaagtaacttcactgctaaaagaaaccaaacaattttcagtaggaattatcaaattggtagtgattttaatactaaagtaaagcaccaactctcaacaaccacaacttacaccagctttgttaccacaaggctagtaaaaggagattggaaactcaaactgcagtgactaaataacttcaactttgggaaaaccacttatttatgtttgcatgaataatattatcagcatgatgtaccacagaacaaatattcatcttctcatataagaatagccaagcattgattgactaaaactcagaaataattacctggagaaatagtttgatcatattctcttgtagaatgcaatacaacggtaccagaaagcacagtaagaaatccacagatctcagaagcaatactgcttatactctgtccagaccaatcctggaaaccataaaacatattctcaaatttttgttctagtaaatggacttaaactaactggcatttgtggaacttactaaaacctgcataccttgaacattatggcacttgctaaaatagtgagggatgtaaacatcgcataatagatgggggacacaactgcggtattgaaagtgtccagtgcctgaaagtttatc

SEQ ID NO: 91057 - DNA, 1057 bp, Oryza sativa
aaacgaaactattgaacttacaatactcaactactcatttctcaagtgcaatgcaatgcccatgtgcattacacatttacacaagcagtaacatagtcaatctataaatagaaccctgtccaatgtctacgagcgaacagtttgaaacggaacaaggatgatcaggcgagaaggtggtcgtgcagccacccccgcatcagcgcgaacgcgtcctcggcgtcgccgtcgtcctccagcgactgcggccggtgcgcgaacccgtgccccctgccggcgtacacggcggccctggcgcccctcgcgcgtgcctccagcgcccgcaccgtctccaccccgcacagcgggtcgccgtcgccgcacacgaacagcacgggcgcggcgagccgcggcgccagcgacgcgtccatcctggacccgtagaagcagacccccgcgctgtaggcgccgccgccgccgccgccgtcgcgcgccagcgtctccaccagccggccgcccccgtagcagaacccgattatcccgagcttcctcgacacccccgccgccgtgaactcgtccaccagccagttcgtgcacgcgtcgatgtcgcccgacacccgctccggcgcgtgcccggcgagccacgcgtcgaagccgtccttctccgccttcttccacgggctcccccggaacaagtccggcacaagaacactgcgtgcaacgatcgagcaacgagagttgaaagaagcgagagagagagagaggcggcgcggcgtgatttacttgtagccgtggcacgcgacgcggtaggcgaagtcccgggtggcggagtcctcgaagccgaagacgttggagaggaggagcacgccggtgccgttgttgttcttgacggccttgaggaggtaggcgcggacgccgtcgcccttcgtcgacgtcgccaccgatgacgaggtccgcgcagttcaccatctcgcacgcctcgtcgttgtcaacgctcgacacctcggtccggccgctgcggcgcctggatacgtcctcccagattccgcggcaaggtccctgcacgggagctgggaaaccg

SEQ ID NO: 91058 - DNA, 1126 bp, Oryza sativa
tgcggaaccgggggtggcgcaacaggtatagcattgcaataaccagcagaacctggaatggtgtcacatacagcacaatggcaacaaccagggacaagaatatgaagatggcggtggcccgagggtctctccagctaagcaaagcatgggctctctcaccttgtgtcgccaggtcaccaacgactgtctgcacacgacctccaacactccttagtctatcgtagcgcattcttacaatgtccgctggcctgctgctagggaatgaatcaaactcctcatcaagctcatctgggtttgtaaactcagcatggcatagcttagtgtccatgtaaggtggatgccttggcttgtaacggtagttccataatccaatcatgaacatgtagaggaagatggtaggcaggatgagctctgggtagcagatcagtattagaaacaacatatgcaccaacacggttgtaattgggtttcgccagcttctgatgccatcataccacttggccgtcgctgcaaaaccacagaacagcgaggtgatacggtagaagttggccttgctgcggcggagactgaacatgtgcgatcccacatcgagcatgtactccacaacctccctgcgaagtggaggctcggcacggctaagcctcgccgcgacaatctgcattgcctggtgcctcaggtaatccaactgcatcactgagattggctgtgtgtagtgcatctttggcagcaatggacggccatacagcgcaatcatgttcacccatgccgtacatgtaaatcgcacagccaaatgcaactctccagtcttcttaaggccactgggcttgagagccaacaaagggtagaaatgggtgtacaccctgtcagtctccagggtagagagccggattctcaccttgccgatactctcatcccgggcatcgccattcttgccaatctggttattgtcaaacaccaccactgtaatcaccgtgcaaggatcaaacacctcccaagtatactgctcattccactgaggattcagagtgttgagaatggttctcgtgcgcacccacttcggtccatacttggcaacacagtaagcatcggtggtgcgcccatctttcccctccattggtatcaagtt

SEQ ID NO: 91059 - DNA, 1549 bp, Oryza sativa
aatgtatctgtatcaaataagatgaatcaagcaacacagtgtaagaagatggcatttggaagtatgatgacatgaaaattcaattgcctgtcatgccaacctgaaaagggtctctgcagacttggctgcggtgcaaaagatgatcttgctcttggtgcgttgtgtgaggaacggactcaccattttgttagccgcaatgtaccaccatggcacgttgatgaaaatctgcatgtcatccacaattcagttcattcaattctacaaacatttgaaaggtcactccaatatcaccacaaatgtacccttgcgtgtcatttctaaacctaggagcaaaaggaggaaggggttgaagggaaaagatccctatcttgattgcacatttgcacaaccatatctagtctagttatcgcaagacaggcactagtcaacttccacccattaatcgtccaatcatactgatcagaaagaaacatcaacagcatatacagctaaagatcctactagtatctttaaccaaagtacgtacattgagaaaactgatcaggtacaaacataaaaaccttcaagtattgagcaaagtgattctaattttgcgctgataatgatgaaacaattcaggaatgtaaagattgagaagttatagagaattaaccttcttggcgatgaactcggggtagttgtcctggagcagggcgagcgcctggcgggtgacggtgcggtgcttgccgagcatgggcggcgagttcttgaggtcggtgacctgcaccatggagcagatgccgctgggggagaagtcgagctggtcgaggatgccgcgctcgaggagctggatgcgccacttcaggactcgctcccgcttctcctcgtcgccgaaggccttctcgtagaggtccttgtcctggaactcgccgtagacgttgtagcagacggggtggccctcgcggtcggcgccgcggtagaacaccacgttctcgagctccggcaggccgaggtcggcggccaggacggcgtcgatgccgaagcgcttgcgccacagcaccgccgccttgagcatcgccatggcctccttcaccttgaactccctggcgcggaggaacttgagcagcacggtgtccgtgcgctcgtcgtcgccggtcagcggcacgccccatatcagctcctccttcggcgccgcagcctcggcttccgcggccgcggccggggcggcgacgacgacggtctcctcgatggcctccaccgtcttgctggtgccttcatcctcggtgaccacgacggtcttctcctccgtttccggctcggccggcttggcctcctccgccgccgcctccgccttgggctcctcggccgcagccgccgccgccgccttgggctcctcctccttggcgggctcctcggtcttgggctcctcggtcttgggctcctccgtggcggcggcctcagcctcagcctcggcctcggccttgggctcctcggcggcgggggcctcggcggccttgggttcctcctccttggccggctcctccgccttggccggtgggggctgcaggaa

SEQ ID NO: 91060 - DNA, 687 bp, Oryza sativa
tctgaaaagtgaaaagtttctcagggaaagttaccttttcaccaagtgcaaatgaactcaaaactggccacgcagccacgctgtgtgcacctgctatagtcctcgttgagattaaagaaaattttctgttgtttgttccctgtgtgcttgaaatgcagcttcatgaggagcagcggcgaggagttcgtggaggagtgcatcaacagggcggactgcctgacgctggcggtgaggcggcagagcaagggcgtcggcggctacctcatcagcacccggtggcagaagaacttctggctgctggcttgacaaatttttactgccaaaggcgagcttctctcctacttctacaagaagagatcaataagttcagtgactagtaactacaccaataacttgatccccaaagcccatgtgtgctgtctgtgtgtatgtatgtgtgcatatgcatgtgtgtttgacagtgtgatggtgtgttgtgtgtgttctttgattctatccctctttggttagctgtagcctctcactttgctgttgtaaagaagccaaaaaagctgaccccgctctccctgtaatcctgtgctgttctctgcgtgtctgcttgtttgtttgagcagggacggtatggtgcataaagtagtaagcactctacaatttgtattatgcggtgtgtttgtttgtatgtctggt

SEQ ID NO: 91061 - DNA, 984 bp, Oryza sativa
tatataatgaagagcaataaataaatccaataacataagcaacatgcctgtacaaaattgctcgagagaggagattgagatcaacttccaacgaaaaaatggctttcctaacttgatgctatgataactcggcattttacacataaactcacttgttcaaacatgtgtcaagttgcaaatgatatctgaaccatcctagggctgcaaatatatatagggctctcatatattatacatcaaatcccggcatggcaaattgtaaggcaaatgtctccacctgattccggagttcaataatgtcattattgttctccagacctttcagaaaatccttctgaagccttccatgctccttcaaaacaatacttgctatatgtgctgccctcaaaaggaattctgccattatctcaaagtcactctccaagcaacctctagttgtcatggcaggagttcctgcagcatggtgatgagcacaaaagaaatctactgttatgtacatgtcataaaacagcattgaatgatcaaccagtgtaaggagaactaaccaatccgcacacctccaggagaaatcgaaccattatctccatatattggtgttttattaagagagatatgacatgcctcacagaccttctcaaagttcttccctgtgcatattttaaggagcatggctaggttagaattatggagacaagcaaatacgcactccccctaccccaggcagcaggttcttttcagcttatttaccggattattgccacagattactttctccatgtttctaaaaatatgttttctcaacaaaaaaaaaagttcctgcaataatccatggattactgcattgtttagactatttgttctaagctactccctctgtcccaaaataagttcagttttcatctttcccatacataccaatacaaaaccaaaaagactagaatacctccactttatcaaatctcaatacaattgggctgcaggaat

SEQ ID NO: 91062 - DNA, 682 bp, Oryza sativa
tacttgttggtgaggtggctgccgagcgcgtcgagcaccgcgcggcaggcgtagttctcggaggcgatgagctcgaccccgcccgcctgccggcgccgctcccgctccatcagctcgtgcacgtccgggtccgcctccgtgagcggctggcatccccacgcgcgcacggccgcgcggcgcgcctcgagtcctcccgccgccgcccgccgcttcgccgcgggcgagaggcaggaggaggagcagcacggggatgagtcgtcgtcgacgtcgacgtcgacgtcgtcccccaccccgcgcgcgcggggcgggcgcgggggccgcggccgcggccgcttgaggaagagcggctggcccatgagggagaaccgcccctcgccgccttcggcctcctcctcccccacctcctcggcggcggcggcggacgagccctcgggcggcggcggcgggtggagggcgagggacaggtcgggccgatggtccatcccttcgcccgcggcgcggcgccgcccccccgtcgcgcgatcgagcatcagcagcaacagcggcggggtcgcggcattcgattcggacgacgacgtcgcgtgatttcgtgggctcggttcgcgtcgcgactcgcgatgcgatgcgcgattttggagttgggtggcctgggccaaattgcggcgtattggtgggtggctac

SEQ ID NO: 91063 - DNA, 692 bp, Oryza sativa
attcctgcagcccgttcatgatcagcgtcttcctcgcgtcgactttcagtttctcctctgaaaagaaaaaggagcagaaatcatcggttagtttgaactgcacgatcttgcaattgcagcaagattcagatagctacttctacatggtttctgaattttacctatgatgattctgaattcttccatggtgccgggcaggttgatcagcttgccggcttctgagctacggtttctgacgaatggatggcccctgtatatgctcacccgtggccagtgcgcgccgtctgatctcgcgctctggcgccgcccattccggctgtcccccgacgagccgacctcccggatgacggctgcggcggccggcgacggcgagtcgacgacgatggtgaccgggtgcgcgagctcgcgcgtcttcatgagctcccgcagctcgtcgaccgacaccgccgccgccgcctgctgctcgttgtggctggccgccctgtcgacgctggcgccgttgaggacgaggagcctggcgacgtcggcgtggccctcggcgagcgcgacgcggagcgccgtggcgccgtcccggtcctccgagtcgacggcgaggccgtgcttgaggagctcccggagcgtgtcgaggtcgccccggcgcgcggcgaggcataggaggtcgccggcggcgtggtgcgggctcgagacgcgcg

SEQ ID NO: 91064 - DNA, 1824 bp, Oryza sativa
aaattagtaaattcgattcaaatttcggattcaagtcgaaatttgagagtttgaatgtattcttttggtcgagagggcccagtactagccttaccagtgcagtcttcccttggagtcaccgacgtcaggatccattccaactttcaggagatcctcaaggaagctgctgttcccggtggctgccaccgtcagcagattgcacggtatgttgccgtggtcgtactcgccggcggcgtcctccccgagcaagtcctccaccttcatgtcgtgcatctcgatctgatgctgcacaccacaaaccacacatctcagttcagtagtttgctcggaatccaatccatggatgagtctgatcaccgtgggacgacggtgtacatttgtgtaactaaaactttttttcttctaatatattaatgtgtattcgtacaattcttttgcgtgttcgtgaaaaaaaaaagacgacggtgtacatgttcaccgaccttgaggaagttcttgatgatgacgacgctgtcctcgggcttgctctgcatggcctccttgagcgcggcctggcgcaggcgcagcagctggcacagcgtccgcgtccgcagcgtgaagctctgcgggcggtcgctgagcgcgctcacctcgccgaacacgcccctcgtccccagcgtcgccaccacccgctcctcggcttcgccgtcggagtagatcacctccacctcgccggacaccacgatgtagacgtcgtccggcgcctcgttctgcacgatcacgtcctccttcggcggtatgtactccggcttcatcttcgtaacctacacacgaattaaatccatcctcattgttgtttgtctaatcttcttctcttcgggggtgtttagatcagggtgtaaaattttgatgtgtcacatcggttgttatatagggtgttgcatggggtgtttgggcactaacaaaaaaaataattacagtatccgtcattaaactgcgagataaatttattaagcctaattaatccgtcattagcgcatgtttactgtagcaccacattgtcaaatcatggagtaattaggattaaaagattcgtctcgcaaagtaattgcaatctgtgcgattaattttttttaacctatatttgatacttcatgcaggtgtttaaacgttcaatgtgatatggtgtaaaattttgaggtgggatctaaacagatccattgtttgtctgaataaaattgagtatggttaatgtgtgtggttaccatgagaaggagcacttctcttgagacacccttgaagaggtagacgtccttgacgacggggaggaagaggtactcgcagatgcccttgcagatggatttggggagctgatccatcagctgctgctggttcaggctctctgccctgaacttgaggcacatgtaggccagtatctgctgcttcagcctaggcggcaggtggttccggcccacgaaattggaggcagcacgaatgctgttcctctacaagttaaaaaaaaagagtaattaaactggtcggtacatgcaactcaacaaacacatgcaggttagtaataagaattcttacgaattccatggtacggcgggtgccctcaacgacgaggttggtcatgttgccgatgaggtaggcggtgaggccgaggttgaagagcatgtagaagatgttgaagatcatctcgacggtgttctgggcgtgcatgtcgccgtagccgacggtggtcatggtggtgatggaccagtagacggaggaggtgtagcggatccacaggctcgcctcctggaagtccgggatcaccgcgccgatccacgtcttctccctgtg

SEQ ID NO: 91065 - DNA, 646 bp, Oryza sativa
  unsure (1)..(646): unsure at all n locations
ccctcgttacggtcaacccatgcaataccaccagtcggtcacccaggctaaccgccagccaggntacgcccctcgtcctcagataaaccgtccggcacctcagccacagcagcgtgcccctagtagcgatactgcgcctaacagtgttacctctttcaagtcaccgcagggaccgtcagcagttcagtgtttccggtgcaaccagatgggtcactatgctagacagtgtcctcagaatcctaccaacaccaactcagggcatgctaatggtagcactgccagaactcctactctagcggcagctcagtctcgtcctagctctcaggcaagtggacaaggttcacgtgcttccaacaactttggtcgaggccgtgtgaatcacattcaagcagaaaccactcaggatgctccagacgttgtgatgggtatgttctctgtcaactccgtacccgcaatagttctgttcgattcgggagcttcccattctttcatatcgcaagcttttgtgaaaagaaatggttggaaaacccaaaatttgcgtgtaccaatgatagtacattcccctggaaggaatataagggcaactcaaatatgcccggaagttaaccttagaattgaggaagttgacttcctagccaaaccgata

SEQ ID NO: 91066 - DNA, 669 bp, Oryza sativa
atatatgctgccattgtagattgcaaggttgcatctaagtagagagcagatagatagatagatactgcaggaggagccagcttgagaattgagatcgatcgacgacgagacagcatagctagccgccgtcatggaggctgctgtgctcgccgtggtgttgttcatcggggtggcgctgtggtcgtcgtcgtcgtcgccggcggcggcggcggcggggacgaaggaggaattagaagacggtgatgaccagcgaggtgaggtgacgtatgacgggagggccctgatcgttaacggcacgagagtgatgctgttctcaggggagatacactacgccagaagcacccctgaggtacgtacgtgatcgcctccactgcatgccttgaatcgattaagctacatacataatttagtttcatattggacattgctgttttttctgtatatgtatactccttttcgttaattttggtccggtggtttatggagttgattttgagagtttttcatcggttcttggcaccttagcatacaacatacttcttattaggaactccttaaaacacatagttcttggaaaatataatactgttccttccattctcgaataattgacgtagataatatttaagtttaaaatttgacggcttatctcttttcagaagaattata

SEQ ID NO: 91067 - DNA, 2596 bp, Oryza sativa
tttatgaaatgacatacgacctcaaacaggatcagcaggcttcatttattgttagcttcattgactgtgcaaccaaagaatctgaatttcacttagggaccctgaaggttcttagaaatcaaacagataccgatcgagaagtgccatttggttggatcctacccagactaattgcccgtaaggggtccgttaccttggcttttaggaccgataacttatacttgatagggttcacagataaatatggaggttggtatagtttcaatgggtacaaagttttgatcccgggttccactgaattggaaattaatggaggatacggagagggtgggatgggtgggtttagaaaactggaagatctacccctaagcaggagacatgccttagatgctgtagatattctttgggattacgacccatctactacacccaaggaagtcctccaaaatgcaacagcaacactactgttagtaatccctgaatctgcaagatttaaagaagtgtttgagccggtcattgctgattgggacagtaatgagggcatcagcttaaaggaaaagattaaaagcataggactactgcataattggggtatgctttcaagtgtgggaatgatcggattaccatgggatagcagcgaagtgcagggctatgttaaaaaaatgagaaaagacgaagtttatataaatagcaaagaggatgcactccgacctcttaaggttttacttatgtcgaaagcaatgagaccaaaagaactcgtcatcaaaaggattaatgacccccagtcctagagtgtgatgtcaacaaacggtatgatcttcaacttttaatatgattggagtctaaaattaattttactctgctttgcattcgtaacaatagatccttggaagtaatgggtgctcatattttctttatgatcaaaatattagtaaatccctagaagtacatgcacctgtagtaggttgctaggatgcactcagaaattgtgtataacttctgtaaatcttgcacactcccaattactaaacttccataatacatgtactagatcgatcccagtcattataaaaatatttaaaataggtataacatatattcttagtttaatgtgtaccttttcttgtacaatgcagtgatgctttgaggaagtgatatttgctagaaggaccacaacaaattttagttgcagtacattggatggaactgtgtcgatatgtccagttttattgaattgaaataaatttggtgcactctagcaatgttagatttattgttgaaaataacaatcgtaggcgtatattatttacactgtggatcaattagcagttaggtaatgccaggttgagatgaattgctgttgtggtatgagtaaaggacgaaacactgagaaaattcattcagcacaaaggctgtgtttagatccaaagtttggatctaaacttcagtccttttctatcacatcaacctgtcatacacacgcaacttttcagtcacatcatcttcaatttcaaccaaaatataaactttgcgctgaactaaacacagccaaagtcctatttggattaatgcgtcagttgccacgtcttggcatgctagtactgctagttaattagtgtagtgctagtttgcttaatgcaaattagcctgcgccaaaaagttagccatcaacgaactgctttgccaaaaggtttctttgtcaaatgtgtgcgctcaaacaatattcgctagattaactagctagctgtgccccccgcgcgttgcgcgggcatatgatgaggcaaactgtaatatctcaagataagaaaagagcacatcacaagataacatgcaacactgttccacagtaatagctctgcatatcataagataagtgcaacaccgttccagggtaatagctcaagatcaaaaaggacatataacattgttctcaattttgagtgatgtaatcaaaccgttgaatagtctaacattagttgtctaaggacaagggacctaggctgtgtttggagcaatatgggttcctgacatgcatagtgcgcacggaaaatggagcggtccattagcgagtgattaattaagtatcagctaattttttttaaaatggatcaatatgattttttaagcaactttcgtatagaaatttttttacaaaaaaacataccgtttagcagtttaaaaagcgtgcgtgcagaaaacgaggcggaggagctgggaatcagtagttccgaacacacatccctaagagcaagtttaatagtatagccaactagtggctccaaatcatttatagttaatctaataatagccagttcatacaatagttaccaagcatatactacacaattaatatttggtcccacctatcatacacacatgcatcttggagtatgtactgcagctggctataaatctgtagcccactgctcttctttatcgtcttttattttctcgaaatatgtttatagctggtttataatatgttattgtacatactctaatatataagtgagggagcccttcacctcaatggctagcttttgaggtggcaaaggcatcttacgattctacagttggtattagagcctggctagtt

SEQ ID NO: 91068 - DNA, 1233 bp, Oryza sativa
aagaagacatccataagatagcttttaggtgttctggtgcaatcggcttgtttgagtgggttgggatgactttcggcttgaagagtgctggcgctacatatcaaagagctatgaattacatttaccatgatctaatcggctagttggtcgaggtatatattgatgatgtggttgttaagtctaaagaaatagaggaccacatagccgatttgaggaaggtttttgagagaaccagaaaatatgaattgaagatgaatccgacaaaatgtgtttttggtgtatcggctggccagtttttaggatttcttgttcacgagagggggatcgaggtaactcaaaggagtgttaatgcgatcaagaagattcagcctccggagatcaagacagaactacaagagatgatcggtaagataaatattgttagaagatttatttctaatctgtctggaaggttagaaccttttacaccattgttgagattaaaagctgatcagcagtttatttggggggcagagcaatagaaggctttggataatattaaggagtatcttagttctcctcctgttttgattcctccacagaaagggataccttttagattgtatctatcggccggtgagaagtcaatcggctcagtcttgattcaggagttggatggaaaagagcgagttgtattttatctcagtcatcggctcttggatgctgaaactagatactcccctgtggagaagctatgcttgtgtctgtatttttcgtgtacaaggttgaggcattatctattagccaacgagtgtactgtcatatgcaaggccgatgttgtcaaatacatgttatcggccccaattttcaaaggaagggttggaaagtggatattctctttaaccgagtttaatcttaggtatgagtcgccgaaggcgattaagggacaagctatagccaattttattgtggaacatcgtaatgattcaatcggctcggttgaaattgtgccatggattttattctttgatggatcggtgtgtactcatggttgtggtatcggcctagttataatttctcctcggggggcgtgttttgagtttgcttgtactattaaaccttaggcgactaataatcaagctgagtatgaggcagtgctcaaagggttgcaattactcaaggaagttgaagccgatgctattgaaatcatgggggattctttgctggtagtcattcaattggcaggagaatatg

SEQ ID NO: 91069 - DNA, 1260 bp, Oryza sativa
tttgcagagcacacttgatcctcttctagcgttattcgcgctggccgctagttggtggatttgttctgtgttcacagcatatagagctccaaagtcaatgacactgtgagtcccttcagctatctctggtctgtgtgcacgttcactgtcattgaagtcctcaacatgctgattctgctgcaggaagcaaaagcaatcaaaggcttctactcagccaatgtataataaaggatcacctaaccctcgccaaatccaattcttaagcccatccaagagggatattggaagaaccacatcaaacagttcagccacacagtatggctggagcaatttagccaatggaggtaacataactgctactgttgtatgccttcctggaaatgattttttggggctggtctgtaccccctatagtgaactgtcagtaagaatattaacacatttgaacttttgaagtgctgttttaatttttgtctgtgtgttgtactagaatggtgctcttttaagcatgattaacttgagtatctttaaaagcatcgtatttgtagcatttgaaattggctttctactggtttttgcaggactggtgtctccaacacttacaaagagggtggtacccgataatcaagatgaagaccactactccaccttccacaatatccaaccaaggaaatattcaaaggaagaatgggatgacttcacccagaaatccaccagaaaggcacttatggagtgcacggcaaccccagagtttgctagatgggttgctgataatgctcaccggctacgagtagagcagcaagatgacgcctcggaggacgagctcatcgagagttcctcaaattcatccgaagaaacagcacaggaagctgataccgggctgttcaggtggtattgatcttggcatgctaagaggctatgccgaattgctgatgctgtgcacgctctgtagaagtaggaggcagtaagaaagctagttagcagtagggttagcatttctattatttccactattgttcccacggttcatgcttcttggtgactgtagttagttagcgatctcaagttaactaatggtagatttagcttagttcgtaacgggccatggatcggtagttagctagttgcctagagttgatcgacttaccagagggctcgaacttgtgtaaatgcagtctattcgatccatcataattgataaatcaatcctgttggaacgttggatcggtattaggattacagtggtagctcatcttatgg

SEQ ID NO: 91070 - DNA, 734 bp, Oryza sativa
tcagaatcggacacttttagaaaatctccatcccaaactttttcagataaacaatcaagaccatccatttcccaaagagccaaatcggcactggcaacattaactaacctgtcggctggtacaatttcaatcttgtcgccttgccactgaatcaagcattgatgcatagttgaaggtatacaacaattagcatgaatccaatcccttccaagcaaaaagctataggaacccttcccatcgatgacaaagaacgttgtagtgatggttttgttgccgccaaagtccttgagcaccatgttcgtcttgataaggtcttcagcatttctaccaacttcctgaatgtagtataaggcatcaagtttaccgcagccccaccatcgaccatcatcttggacatcggtttcccattgacataaccatttatatacaatggcttaagatgacgattccctgtaccttctggcttctcaaaaaccgcttgttgtggtgacaaaacaaacttagccgattcttattcaacaacaagttcatcactatcggatatcggcttgtcgtaccccaaactcagcaggcagcgtgaaaaccatattgaccggagcggttacaacactttttcctttagctaacctttttgcctcatcatctggggcctcatcggctacaggaacctgattcttaacacgccactcctgccttggctttgttttcttcagccaatggttaatttcctgttc

SEQ ID NO: 91071 - DNA, 690 bp, Oryza sativa
tactttgtaagactggtagtgggaagacttacacgatgtgggggccactgtctgccttgtccgacgatacggtcagcaaagagagggggctgactcctcgtgtttttgaactactgttttcacgcatcaaagaggtacgtcatgatttgctatatagctcccttttttcctgattgcaaattaaaggtccatatgtactgttaatttgcaggagcaagctaaacactccaataaacaactagtataccattgctgctgctctttccttgaggcaagtgctatttaagcctctaaaatcacaataattatgattctctcttgtgatagaaattcagaattactttttaagatatgcagatctacaatgaacaaattactgatttgttggaccccgtgcaaagaaaccttcaggtgaaatggagtttcagaatttaattaaaatacttcctaggctgcttctgttctgatacgtctcgtacattttcagattagagaagatgttggtacttcttctgtttatgtaggctgcttctgttctgatacgtctcgtacattttcagattagagaagatgttggtacttcttctgtttatgttgagtcattgacaaaggaatccgtgttcacgataaatgatgttacacagttgctagaaaaggtaaaactgtttgtcttatcatctaaaaccttat

SEQ ID NO: 91072 - DNA, 579 bp, Oryza sativa
caaaaacttggtggtacttaatgttgcgaacaatcaaattggaggctcttttccatgttggatgcatcttcttcctaaactccaagtccttgtcctgaagtccaataagttctacgggccgttggggcctactcttgctaaagatgatgaatgtgaactacagtatctccgaattcttgatctagcttcaaacaacttctcgggagtattgccttatgaatggtttaggaaactaaaatccatgatgtcagtctccattaacgaaacattggtcatgaaagatggagatatgtacagcacatttaaccatataacatatctttttactgctagatttacatataaaggactggacatgatgtttcctaagatcttaaagacctttgtactaattgatgtctcaaataatagattccatggcagcattcctgaaactattgccacactaagcatgctcaatggtctcaacatgtcacataatgctcttacaggaccaattcccaaccagcttgctagtctgcatcaacttgagtctttggacctctcatcaaataagctttctggggagatccctcaaaa

SEQ ID NO: 91073 - DNA, 660 bp, Oryza sativa
cagctcgcggaccgagtggctcgcaaggaggaggcctggacttggaacccctccggttccggtgtggcagcttcggccgcccttggatccgccgctcagacagggcggcgtgacaggaggaggaagaagaggtcagtccattccgatgacgagggtcatgtcctcgccgtcgagggcgcttcgcgggccacccaaaaggggaggcctgcgagcgacaaaaagaaaaaggccggcgctcccagcagggagcgcccagccggcaagtggtgcaccgtccacaacacctccctccacgacctcgtggactgccgtgcggtcaaaagtttggctgagcgaacgaggaagtgggaggaggagaggaggcaggagcgccgagagggcaagtccccggcggttccttccggcaatcggcgaagtgaggccaagcagaaggcccccgccgaggacatcgatgacggcgatgatggcctaggtttccaagagcctggggccaccattgccactgtcgatgggggagcgtgtgctcacgtttctcgccggagcctcaaggccatgaagcgagagcttctggccgcggcccctactcatgaggcgacgcgccgggcgcgatggtcggaggttgccctcaccttcgaccagaccgaccagggctgcaggaat

SEQ ID NO: 91074 - DNA, 972 bp, Oryza sativa
aaagaaattttgtggtttacattaaattgacaagtacataaggcaatcaacaggcatagtcactagtaaaacaaaataagtatatgttacaaccagcccatgtaatcattggcagccacgaataactatccaaatgcttgtacaaaagttcctcaccatacctccaatcgaagacccaacggtgttttggatggaccaagctcttgttgagcaccatctttacctgtgggcttcacctctgtcttaacttcaaccctcacaggattcctcaaccctgctttcgccagctccttaacagcctccgtctgagttgccgaaaaaagccctgttctcctcagctttggcaacttcgaaataatcgacgtaatctgcttctggaatcctaaatccaacagcctatcagcttcatccaggatcaaaatctgcttcgaaaacacatacacaacaacaatttatgtcagatttgcatttcaagcacaaaagaacaacacatgaattttcaattgcttccaaaaccacctcaagattcttgtagttcagagtgtctaagcgctccattacgtcgaacagcttccccggggtgccgaccagtatgtttgcaccctcttcttccagtttctttagctccgccttgatgtcgaacccaccaaccagtagcatggatgagacgcccttcagcgtcgcgaagaagggctgagccacattgtatatctgcgaagacagctctctcgtcggggagatgatgattccaagaaccttgcaaaattccatacatttttctgatcagaagtgaacaagagatgcaatgcaatccagcaactttgcaagcaacgcatgaacagaacaagagaggatggggtggagccgtgagcactgagcagacctcgtggggcttgggaggcgaggggcggcggctgaggatctcgacgacggggacgacgaaggcgagcgtcttgccggagccggtggcgg

SEQ ID NO: 91075 - DNA, 664 bp, Oryza sativa
ctcacggagccaagttttcagaccttcatagcaaaccggagcaatctgagagagctctaccttgatgagatggacctctctagcagcggggcaacttggtcaagcgatgtagcagcttctgctccacagattcagatacttagcttcatgtcatgtggcttgtctggtttcattgatccctccttctcacgactccgttcactgacaatgatcaacgtcagactcaatgtcatcagtggcatggttcctgagttctttgccaacttctctttcttaacaattctggagctatctggcaatgcttttgagggtcagttccccacaaagatcttccaactaaaaaggctgcagtttattgatttatactggaacaataagctttgtgtgcagttgccagaattcctacctggtagtcgtctggaagtgttggatctcatattgaccaaccgttctaacgccataccagcatcagtggtcaatctcaagtatctaaagcatttgggccttacaacagtagaggcttcaatgaattctgatatccttttgatcagagaactccactggctggaagttctccggctctatggaggatcaggacaagggaagctggtgtcgttctcttggataggcagccttaaacatttgacatacctggagcttggca

SEQ ID NO: 91076 - DNA, 2954 bp, Oryza sativa
atttcccgtgtaagttgttttgacaggtatgaaatgagcaactttagtaagcctgtcaactactacccaaatagaatcatgtcctgccgacattctgggtagaccggtgataaagttcattcctatttcctcccatttccactctggaatcttcaacggttgcagcagaccggctggcttctgatgctccgccttgactcgctgacacacatcacatagagccacatattccgctatctctcgtcgcatgctggcccaccagaattgttgcttcaggtcttgatacatcttagtgctcccaggatgaatggaatacaaagtttcatgagcttctttcatgataatatccttcaactacttattatcgggcacgcaaattctttctcctagccacacagttccttgctcatcctctatataaccaatggcttttcctcttctcatgttctttttgatttcttgggtatcgggatcattcacttgagcctctctaacttgatcaaaaagagtaggttgagcttctaaagcggcaacaaaacatttgttgactattcccaatttcaacttttccaattcctggcataactcccaaggtagatgtcgaccttctgacatattacagtagcttttcctgctgagagcatctgctacaacatttgctttacctagatgataatgaatttccatatcataatccttgatcaactctaaccatcttcgctgacgcatgatcagatcaggttgagtgaaaatgtacttcaaacttttgtgatccgtatacatctccatacggttaccaaaaagataatgacgccaaatcttcaatgcatgaaccacagctgccaactctaggtcgaccgaaatgaaaaagttcaacaaacgccaaaacatgatttttggacatattgtagtttattgggtgcgttcatgggaaatactcacttcgtgattcgcgcggcgaacttttgtcaattaatgccaatattggcatatattggcccacgtgagtgcgatgtttttgaccggaatgaaaagttcaaaaagaaccaaaatatgattttttttgacatattggagtgtatgggtgcgttcgtggcaaaaactcacttcgtgattcacgtgtctaacttttgtcaattaatgccattattggcacacgagggtacgatattttcaaccgaaatgaaaaagttcaacaaacgtcaaaatatgatttttggacatattagagtctattgggtgcgtttgtggcaaaaactcacttcgtgattcacgcggcgaacttttgttaattaataccattattggcacacgatggtgagatatttttgaccgaaatgaaaaagttcaaaaaacgcaaaaacaggatttttggacatattggagtgtattggatgcctttgtggtaaaaactcacttcgtgattcgcgcggtggtgttttgtcagttaatgccaatattggcatatattggcccatgtgggtgcgatgtttttgtccggaaagaaaaagatcaaaaagcaccaaaatatgatttttggacatattggagtgtattgggtgcgttcgtagcaaaaattcacttcgcgattcgtgcggcgaacttttgtcaattaatgccaatattggcatatattggcccacgtgggtgcgatgtttttgaccggaatgaaaaagttcaaaaagcaccaaaagatgatttttggacatagtagagcatattgggggcgttcgtggcacaaactcacttcatgattcacgcggcgaacttttatcaattaacgccaatattggcatatattggcacagactggtgcgagctttttgaccggaatgaaaaagttcgaaaagcaccataatatgatctttttgacatattggagtgtattgggtgcgttcgtggcaaaaacttacttcgtgattcacacagtgaacttttgtcaattaatgccaatattagcatatattggccgacgtgggtgcgatgtttttgactgaaaaagttcaaaaagcaccaaaacttgatttttggacatattgaggtgtattggatgcgttcgtggcaaaaactcacttcgtgattcgcacggtgaacttttgtcaattaataccaacattggcatatattgcccacatgggtacgatgtttttgaccggaacgaaaatgttcaaaaagcacaaaaatatgatttttggacatattagagtgtattgggtgcgttcgtagcaaaaacccacttcgtgattcgcgctgcgaacttttgtcaattaatgccattattggcacacgagggtgtgatattttcgaccgaaatgacaaagttcaaaaaacgccaaaacatgatttttggacatattggagtgtattgggtgcgttcgtggccaaaactcacttcgtgattctctcggcaaacttttgtcaattaatgccaatattggcatatattggcacagaggggtgcgatgtttttgaccggattgaaaaagttcaaaaagcaccaaaacaagacttttggacatattggagtgtatttggtgcgtttgtagcaaaaactcacttcgcgattcgtgcggtgaacttttgtcaattaatgccaatattggcatatattggcccacgtgggtgcgatgtttttgaacggaatggaaaatttcaataagcaccaaaacatgtttttcggacatagtggagtgtattgggtgcgttcgtagtaaaaactcacttcgtgatacgcgtggcgaactgttgtcaattaatgccattattggcacacgagggtgcgatattttggaccgaaatgaaaaagttcaaaaagcaccataacatgatttttggacatattggagtgtattgggtgcgttcgtagcaaaaactcacttcgcgattcgtgcggcgaacttttgtcaattaatgccaatatggcatatattggcccacgtgggtgcgatgttttt

SEQ ID NO: 91077 - DNA, 10300 bp, Oryza sativa
gagtgtatagggtgcgttcgtgtcgaaaaatcacttcgtgattcgcgcgtcgaacttttgtcaattaatgtcaatattggcatatattggcccacactggtgcgatgtttttgaccggaattaagaagatcaaaaacaccaaaatatgatttttggacatattggagtgtattgggtgcgttcgtggcaaaagcttgcattgtggatgccctaatttgccgatccaatatattattactttcttttttttccttccttccccccccaaccgaatccaaacagatctgctatattctgccttcttcctccacacacaagcacggcaaaaatacaagcacgctatctgaagatgaaaaaaatcggaaaccaaccgatctaccgattgtagcacaccatccaaaaaccgatctgctatcctcttctttcctcttcctcacacgtaagccagacacggcagagcaccacactacagcaaccttctagatgcaactcaactccaaaccgaccgacagaaacttctgagaactataaaaatggaaccatggcggaaagacgattccgttttcgtaggtctcgatgacaacaaagatacggcggcggtgacgacagtggtagtagacgtgacatgaactcgaaactctaaacagactagaagctaagaccaacagcacgatgtaacgatgcaacacaaaaattcaacaaagcaaaaactgaaaagaacaatgcaatggcacaatatggctagctaaatgatacaattttttgtctagatatgtcgggtcccaaaactaatgattcggaaaccgacatgtttaactgtatcaagccttggatcagtagattgatacaggttaaatgatctagatcttcattgcatgcatttgatcaagctttcaaagaagatattattacaaaatgcaagggtatttacaagcttgtggctaactaacacagcagaagctataggatgacttaaccctaatgtttggctatagacttaaaccatctatctaatctatgtttgagaattaagttaaaataaaactaacttatgtgattgaactcccagcttcagaaaaactcctaatagacaatgaaaaagaggggttgaagcaagggtgagtacaacgtactcagcacgctattatattcaattatgaaggcatgatatagtaatatttgactagggctatgattacttgtagaaagctgaaaataaagagggagaaagcctggaatgtttttgatgcaacaatattaataaaatctggaattatgtttctaaccaaatatcatatgtcccgatactcaagtccgtgagcacggctattcgaatagttttaagaatattcatactgcagtagatgtacgctttacccgcagtccataacttgtcaataatcgttagcttagtcatggcccagtattaggttactaacaatagtggcacctgttccatgaactctagtcctcatgcgctctgaacgtaacgttatcagcagcgagaggagttctggcgttcccgaggtttttagagagaactggttgagagacccccgtcatctcaaacaggttttcacaattcatacacacagctcgcgagacaatcaagatatttacgtgcgcctcggtaaatattacaatcgccctgctcggcataagtttgcctcctgcgtgaggacataaataagaaccactacacacaggtaccacattgttaattaacataataactaggtctatccccattctagaagctacggtcgtactcgttcgtttgacataagtatttagtggcaattatatcgaccgggacagtactagccaccgggaaatcaaccaaatcttacgtactgtcccaatctaagttcattatatttttgtgcagtctaactaggcagggctaagcaaaagctagcatatctggtttgctatatgttcaggttatgcattcaaaatcatttaatggctaatgcatagaatagaaatgtagaatatagggtaattatgctcaagggcaggaataataacttgccttgctccaacgcaaataaatctcagataggcaacctgattattcagtcctcgaaataccacaggttgccatccaaaagacaatagactctactaaagaagaggaagaaccaaattcaataaaattcattgaataataagaaaaaacaaaaaaatggcgagaagggcaaggtttagggtgtaaatatctcctttattggatatagggattattgggctaatatttcatgtgtaagttctatagggttggaggctagaggggattaagcaaccatggtcgcttatattttatgtgtgggcttggtcgctgaaaggataggatgtatattaggtaattgaactggttcaactggtatatggctagttttggctggtggtagggttaggtaatattatacctaaggtttagttgtatttgagctgattatggagtagggcagtatctcggctagggtttggttatttactagtcgttgctagagttgggtagcatgacgactaggttttgtttcgtttctagccggtgtcgatagacaacatatcggctggaagaataggaggtgggtgcaggtttagtggggtggaagtgttattttgacaaccgtgagtggcggcggagcggctaggatcgcacagagctcgagaactaaatgtgtggtgtgctgtggaggtcgagaaaatagtaaagctccaaccactatacgcatcaaggtgtgggggtgccaggagcagcacttcgaccttaggtttggttttgccaggctttacaaccaacggttcgacgtcggggcgagtagacgcgaacggacgtcaccatggaaggcgtaaagtttcaaccggtggcttttagtgggtaaaaggtattttggagtaaaaggagatatttgaaaagcaaatgacatttaaataaattaagaaaattcaaatgaaattataaaattgcaaattgggtatcaaaatgtagcttttgaatttggatgaatttaggtccaagtttcatcagaattggatctacggtttaggagatatgggcttctaaagtttggattttgaatcaaatctagaaaatgtgaaatagtactgtaggggcccacctgtcagtagctgtcctttttctttttctttttctctcttctttttcttcttcctcccgattcctttcttctgttccttcttcccgtgtaatagcagagagagagagagaaggggcgccggtgctccgatggtggaacggcctcgacggcggcggccaagtgtgttcccgagcgatgcgcccccggggaagtggtcgcccagcgaaggagttagggaggaggccggaacggcgagcgtaaaagcttgcttcggccggttagaggaggtggcgttggcggcttattttggcgggggaaaggaagaggaagtgagggaatggattcgtctcgatgagacgaagctagtggcgcgagagcttggccgacaacgctccggtaagggagatcggtggacggccggccatggctagagagagaaaagtagagctcggagctcagatgaccttgccgactatttatatgtcgtggagaggcggttgccgaaggtggttgtaaaggcggtcgtcgatttggtcacggcgacggtaacttggaggaggagaagacggcgccggcctcgtcttccgattggtcgacgacggcgtcgcgtgcacgtggcggccgcggcagggctgggcggtggcagtggacaggcacggaactgctacagtggcggcgcgacttggtgcacaacagtagacaacggcgtccgacagcatcgtctgtgggcggcgacggcggcagtgatgcgtgcatgcatcacgcacgcccacaggaaggtggagggaggcggttgcgtcctgggccggctgggccacaagagagagggggtcaaaagagagaaaagaaaatctcggcccataaagaattatttatgaatttctaatggaataggatttgtatttggagggaatttttttttaaattacatagtacagcgcagacactcacaacgcacgcgcacaaaccctatacgtcgctcccatgaggagtcaaacccaggacctcaggtgctactaaggctcttgtaaccactaggctactggccctttcgcgtatttggagggaattttaatacgaaggttgtacaaaggaacttggacaaaatttatatttgaatggaatttgctcagcaattcttggaaggaatttgaatattggaagaaagttaaggataggtttagaatcaaaggatgggtcgacaattaaatccaataaaattggaatcgtttggtttaggttttacgacaatagtggagaatttattggaccataattcataaaaatagaaagggatttcaaactaaatttgaataaaataatttttgtcaaaagaagattttaaaccaaatcaagaaatacctcaatttaaccaaatatatatttttaaatgaaaaacacaaaagagattaaatactggagagattttgtgcgagttagttttgtgaggtccctctaattataggacgcctaggtttaggaagttattaagaacataagaagcgacatgatgcaggattagaaaatgatacattttcaggatgttacaggtatttcttggttatgggtagataaaaactcaccgagcaacgaaagatctgataccacctgatgaaccctgagttccactcgacactcaaggctgttgttggcccgttctttcggtgagttgagataactacgacttgggagaaacgttgacgacccgactacaaccgtacaagacgttgcattgcgccttagcgatcgatactcctctctgtgggctgttgatcttgccgatgcaaatcaaccttattcctgcaagcaaatcgaagaaacaagcaagaacaagataaaagcaatctgaattacaaataggaatgaatacaaatgataagttggggttccgaagaacaatcagacgggcgatctagccgacacgcgctgcaagcaagtagcaatagctaaactttaatctaacaaaacccgagaaaactctgaaggggtacctaacaatttaaggaggtgggaggacgacctaggggtccctagggtcgtggtccacctggttggggtgcagcccctatgggccggggtcgcagagaatgttacatgcccataggcccactattggtgatgcaacaccttgtttctttgattgcggccaactgagatggagtttggtggtgaggctggatccgttggcaagaggactccgagagctttccatcaagtactcatgggccaaaaacggaggtcgtatgcagattcggtggccctttgaagtaagcagagtagtaggtggtcgaatcggattccagcacttggagatgttaacaaccaaatttggtaatttaagtatcggagataaagaagaaatcgaaacggagttcgcgatggagattgtcctggaaacagagtaaggattggctggagtccgaatcggctgtgatcaggatcggcatagtctgagttggagagggttagccgattgagttgaatccgacaatgtgacacggtatacgttgtcgggttaggttaatgagcttcatgaggattgccacgcatggatagagtcgtgaggaggcaattgtatctattaattaggatattttatgtaatttcgttaaagatatttttgggcgaaagtctgccgcaaagacttatgttatcttagagtttgttagagataagagtcgtgtccgatatgaacatattttgtaatctcgggtataaatagaccccaagccccatgtaatcaaactaacacatgttcaatacaatctcggtgcatcgccatcctttttactttcttttgtttcgacgagttcttgctttcgggttgagctgcatcggtttcgatcttcaacaagtggtaaaacttgttatggtggattgcgttctcgggattagtgcttccatttttatgatactctaatcttgtttatgtaatttgtcgagttatcatatatctcatataatctccggcaatatcgctatctaacctccaatcggctaacgtctgctactagaaggcagccgatctggttaaataccgattttgacttagattatataggatatctaccactctatgaaacatccaacggcttgattgtctagatattgtttttcttttcaaacttatagctgcatcagttgagtttgatcttatgagtcatgattagaatcttaatctctagcctgcttttggttgccgataagggtagcatcggggtttcagccgattttacctgatttaactacatttatcttatatgctttattgacatgttaaatctgccttttatgttaagatcttgttgcatttaagtatattaggctttttgtttggtatattctacttgctttaatatcttaatatagagtggtatcggagtattagccgatacatgctagatctatctgatcggctatgctatgaacatatatagtattgttgttaatatatatttcagcctaagtgatttatactgtctcggcatggcgaccgatctatcctaatcacttgatttaagtatatatcgacataaggattatatatcgttaatatgtacagccgatcgagtagatttagttctttcttacttatttatgactgccgatcgatctacatgtgacatcggctcaaagataaatgatatgtcatcggcaactagccgatcgggtatcgtttatggatttaaccgcggtttctttgtctttgtttcttgttgattgcaggatcaaatcaactagcacgcttatacacctaaaggcaagcttttgggcccgcactggtgatgaaccctgagttcctctcgacactcaaggctgttgttggcccgatctttcggtgagttgatgaaaactacgatttggaagaaacgttgacgacccgactacaaccgtacaagacgttgcgttgcgccttagcgatcgatacacctctccgtgggttgttgatcttgccggtgcaaatcaaccttattcctgcaagcaaatcgaagaaacaagcaagaacaagataaaagcaatctgaattgcaaataggagttaaatacgaatgataagttggggttccgaagaacaagcagacggacggtctagccgacacgcgcgctgcaagcaagtagcaatggctaaacattaatctaacaaaacccaagaaaccctgaaggggtaactagctatatataggggtgggaggacgacctaggggtgcctagggtcgtgctccaccagcttggggcgcaccccacatgggccccacctgggccggggtcccaaatgaggttacaagcccataggcccattacaggtgtcacagcaccttgtttcttcagttgctgccgactgagatggaatttggcaatgaggcttgatgcattggaaagaggactccgagagctttccatcaagtactcacgggctgaaaacggaggtcgtatggagcttcggcggccgtttgaagtcagcagtgtagcaggtggccgaattggattttggcacttggaggactcgaacttgatatcttgttgttcatccatgatgtgagcaacggatgtatccgtagtagccatggtcacatcatcctccccttcttcacggaaaaccgtcctcggtttttccatatggtgttcttcatatagtccattcaaaataacctgtttcatccaatcaaaactagagaaactcgaaatagtgtgattagcaataacatgtttctctaaatccaaacaaatgaaaactctatgcaccaaatatattcctctatcattatatttgccaaagatatgaaaaatagcattagttagacatggcaaatcagacttagcaaataatttctccttcaaattatcgagctcacaaaaatcatcaaactgaacatagcccaaagtatttaaagaagatagcaatttacgttcctcaacttcattaacaatatgaacagcatgcttaaaatcagcacacaaagaaacactaggaatagcatgttcattcactagttgtggcatggatataagtgaagcattatcacacaactcttctttatcacaaggaacagcgagtaaatcaacttgtgacaaaggaattccagcatttggttccactaacggttgctctacttttgcatgaaaagtggacaaatttacttcgttaacaatgcactcaccttgattaatttcagtaccatttactttaccttggatgtcctctttagatgatggaggtgtctcgaacttgagtgtgaacaatggaattggtggctctttcatgtctctctcctccttttcgtgattacgcacttcctgcaaatagttagtaattggaggcaaagacatagcgtgtttctttttcatatcctcctctattttactttcagcattgcaagcaagttgtaacaaatgagaaagagatgtatatctttgacaatcaagcatgtcctgaatttctttgttaagcccacataaaaacctcaattctttagcttcttcgcattcatctaaaccacaacgtaataaacaagcttgcatatcatgatagtatgaagtaacagttctggtatcttgttttaaacattgtagtttgttgaacaaaatgtcagcataatacatgggaacataaacatctctgaaatatcgtttcaggtctttccaagattgtggtattttgttatgcctacaaagatgtttccaatcattagaagcatgtttaattaaaacactagaggcacacataaccttttgtttctccgacaagacatgcttttgaaattcactatcaaccgctagctcccaattaatgtaagcacgaggatcatagtttccctcgaaataaggcagtgcagatttgatcttacctagaacatcatcacttacctcataatggtcatgttgatccctcctcatgtctcgacgaagatgtcgatgttgagcacagctatccccaattatcttgcatatccctgccattgttagtagaaaacaagaaacatacacaaaaatatgcgcgttcctattaactactaggtagtggcagctcaaaaatcgcacacactcaagcttttaaccaagctcttacaagatcttaccaatgcaagtggaatggtgacatacaccgactcaaccaagcaccccaatgaaggttggatgtatcgatgccttggcaaacacttgcggtacggctgtaatcaaatatgtggagctctgggtaggcttaaatatgtagcaaaggaatagcaaatgctcaaatcagataatgcaaagttgaataattgttcaaagtcaagtaccgtgctggtcctaggctagaacgtactagagacgcgagcctagacacaaacgataccacaagatagcactaggaacaactcatgcacaactctaatatatgaagttcagctcaaacataacagtattttctcttttctttctttcttctttcttcttttctttttttttctttccttttcttttctgtttttttttggtgcggcttttttttttttgcacctttctgcctttttttttcacttttttcttgattttttttaacaaaaattgactcaaggaccttaatgtaagattacagggactcaaacataaatataaaatttacagggactcaaatctaaaagtctaaacccaaaattaaaattatacaaaaaatggaatgctgaatttatgccggttccgtttttccaaacagatctcgaaaccgacaccaaacaaaaattcgccaaggtgtttgacacaactcggaaccgtggaagagagggagggagtcggactcggccaaaggggcgagtgggactcggccaggaggtggagtggatggcagccgaatttggtgtatgggataaaaaggaaactaatttttaaccaatccaatctactatatctttccaaaacaatcttgactacttccaaaatcagatatggtaattcaccttcctcctctcgtgcacgacacaggcacggccaaaacaaacacacacaaggatcggcaaactctagatgcaactcaagaactccaaaactaaccgacagaaacttctgaaaactacaaaaatagaaccttggcagcgagccgattccgttttcgtaggtcccgacaacaacagagacacgggggcagcaacgactgtggtacaaaacgtgaccagaactcgaaactctaaacgaactagacgctaagtccagcaacac

SEQ ID NO: 91078 - DNA, 698 bp, Oryza sativa
gtccaaaaatcatgttttggtgctttttaaactttttcattccggtcaaaaacatcgcacccgtgtatgccaatatatgccaatattggcattaattcacaaaagttcgccgcgcgaatcgcgaagtgagtttttgccccacgaacgcactgatgtgaccatggctactacggatacaaccgttgctcacatcatggatgaacaagatgctatcaagatcaagtcctccattcactggaatccaatttggcctgttgctacactgctgacttcaaacgtccgccgaatattcatacgacatccgtttttgacccgtgagtacttgatggaaagctctcggagtcctctttcaaacggatccagcctcatcaccaaatgccttcacagtcgtgcgcaattgatggaacaagttgctgcatcacctgtaataggcctatgggcttgtaacttcgtttgggaaccaggcccaagtggggcccatgtggggtgcgccctaactaggtggagcacgaccctaggaacccctaggtcatcctcccacctccttaaatagttaggtaccccttcagggttcctcgagttttgtttagattaaagtttagctttgctactttgccgggtaatcccgtgatcggttagatcgccggtttgctcgtctatggaacccaaacttatcatttgtgttcaattcctatctg

SEQ ID NO: 91079 - DNA, 627 bp, Oryza sativa
cctctacccctgctatcctagagaagtattcctgtcaaactcttctcgaccatggagcaactgctttttcagctgtctgctcgtcggggcgaattctatgagccaccactttcatcggaacccatttatacaactggctatgaaattcgtcccgaactaagtatggttagggaaaatcctttttctggctttgatctagaaaatccctaccatcatctgcgagactttgaacaagtttgctcatgccttaagattcgtggcatgacacaagaaactgtgcggttgaaattgtttccgttctctcttcaagagagagcaaagcaatggtacacctctaccgttggatgtgtaagcggtagctgggagaagttgcgagacagattttgtcttgccttctttccagttactcgtattactgcccttcgaatagaaattctcagttttaagcagatcaaaaacgaatcaatcgatgtagcctggtctagattcactaacttagtgcagtatggaccaacctgtccttacaggtttggataaggagtctgcattctatctagacgtaaccgccggaggatcattcatgcaaaaaacgccgtcggaaggacgaataattttggaccgcattct

SEQ ID NO: 91080 - DNA, 1561 bp, Oryza sativa
ttagctggaagtcccttctgatccgaaccgttctgcaagtagtcaatagcccgcaacatacccgcatgacgatcatgtataaggcaaacgttgggcctcatacgcaccactgcaatgtgcactctcttaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttctatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaatgaaactgcccaatgcttcaccgcctccttcatctcatccttatgagcataccttgcaccctcaattacctcgtactccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcattaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttct

SEQ ID NO: 91081 - DNA, 622 bp, Oryza sativa
aaagtatcacacaaaatatgatcaatcgagcaacaggtgagtaagtgtcaaagaaatcttcgccttctttctgagtatagcccttagcaacaagccgagccttgtacttttcaatagtaccctcaggcctaagcttcttcttgaacacccactttcaccccaggggtttacacccatagggtcgctctgtcacctcccaagtcccattagcgataatggaatccatttcactacggacagcctccttccagtagtctgcatcaggagatgcatatgcttctgaaattgacttaggagtgtcatccatgaggtacacagtgaaatcaccaccaaaggacttagccgtcatttgtctcttacttcttcgaggagcttcactgacatcctcctcagagacatgttcatgtgtatgttcagtttgttctggtggtgtgattgaactgggaattatttcagaaggttggctcgaaccactatgtgtatccttcattgggaaaaagctctcaaagaaggtagcatcacgagactccataattgtaccaacatgcatgtcaggtacctcggatttaactattaaaaatctataggcaatgctgtgatgatcatatcccagaaagacaca

SEQ ID NO: 91082 - DNA, 523 bp, Oryza sativa
ggtaatcttgtttcttggcgaaccaagaagcaggcaatggtggctcggtctaccgccgaagcagaatatagagctatggctttgagtttgagtgagatgctgtggatgaggagcttgttgactgaattgcgagtgttaagaagtgatactgtgatgcttcattgtgacaataaatcagccatcaacattggaaacaaccttgttcaacatgatcgcactaagcatgtggagattgataggttctttattaaggagaagattgatagtggggtacttatgctagagtatatcaagtcatgtgaacaactagctgattgtctaactaaggggttaggtcctagtgaaattcaatcaatatgtaacaagatgggtatgattgatatcttttacccatcttgagggggagtgttggtgtaaataagtgatgttcctaggacccatttgtaaatgttaagagaatataaaggaggagatgtgggaacaggggagtaaccctgaaaaaccccccaaaattagacaatat

SEQ ID NO: 91083 - DNA, 650 bp, Oryza sativa
  unsure (1)..(650): unsure at all n locations
tttcgtcttccacaaaacgaaccatatcttcctctcacccgatggtgcatcgctagacgaggcatctgacctaccatgattagataagttccaggccaatctacatgcactcttcacggtaaacagtcctgatttctccaaatgccaggctggaaaatcatccggttggcattccaataacctgatcttgaggacctcttcggcatcatccttcttcatcacatgacgaactaggttttcattccagcttttcaaccccggttccattagttcattcacatagattagcctgttccttgcatttttccacaggacattgactcgctcaccctgtgccaccatcttctccaaattnnnnnnnnnnnnnnnnnnnnnnnaccatattggactcctttccaggtaggtaaagaaactgtcgggaaagctgtgtccaacagacttccacttgggaagtatttcgcttttaaactcgggcgccaagactctcaggagttgtgatcagcctccaagcttgtttagttaacaaagcttgattgaaacatttcatgtccctaaaccccaaacccccatggatcttcgggctagtgatcttttcccacgctatccagtgcactttcttttttcctttctcatgaccccaccagaaattg

SEQ ID NO: 91084 - DNA, 1286 bp, Oryza sativa
tacacgtcgttatttcagtagtacgtacgttggccgcgttcgtggtttttgttcacgatgcagggggacgtacgggttctgtataccctacgtaccttgctggttcaaacatagcaactgtatgcagcatttatactcacaagcaattggcgttttgttgtcttgtgctgcgcattgagaactgaaattgtttggagcaaattttgttgaaacatttgttacgcaaaaaatttatgaagggaagccgccgctggactggcagacgaggaagcggatcgcggtggggacggcgaggggattgctgtacctgcacgagcagtgcgacccaaagatcatccaccgcgacgtgaaggccgcgaacgtgctgctggacgagtgccacgaggccgtcgtcggcgacttcgggctcgccaagctgctcgaccacggcgactcccacgtcaccacggcggtgcgcggcacggtggggcacatcgcgccggagtacctctccacggggcagtcgtcggagaagaccgacgtgttcggcttcggcatcctgctgctcgagctcgtcaccggccagcgcgcgctcgaggtcggcaagggctccggcgtcatccagcaccagaagggcgtcatgctcgattgggtaagcatgcacttccacatttcttctccaattttcagctttttttagctgctgtttgagccgtgatcgaaaagatgttgcactagttcttgtttgacgaattaaaagcctcggttgctttgatcgagcccgtacgtgaatgtctttggtaaagttcgcaaatcttttgcgaaagatccatccagtacactagcatgtgcgttcattgcgcgcgcggtcactggctcactgcactttgaggcgctgctcattcaatagcaacttctagtgaatctgatgctcgaatgacagtagtcagtaggcgccccaactgtcagtctaagattaattgcgagtactatgaacctgacatactaacgcaatcctgcaagcattgccactgcatgtttgaatgctgatcgtcctcccacgtactgttcactctgcatatggcatgcaaatgacttgcttctgaaaaatgacaatgtcttcaactacttaatctccatgtgtaaatgatctgaaaattttcttcttttttgttttcgttcgatcgtgttatcaaaatgaaggtgaggaaggtgcaccaagagaagctgcatgacttgctagtggaccaagatttggggcctcactacgacaggatagaggtggcggagatggtgcaggtggcgct

SEQ ID NO: 91085 - DNA, 994 bp, Oryza sativa
aatggaacatcttccggtgcaccttgtgaggcaaacaaagtgctgtggtccagcattcatgacgcagatgtatccttgcgaaaggtacctggggatccttaagggttatgtacggaaccgttcacaccccgaggggagtatcatcgagagttacaccaccgaagaggcctcgaattttgtgtggactacatgtcagaaacatcttcaatggattaccacgatctcatcacgaagggaggcttgacggtgttggtactgttggaagaaagactattaggttggatcgtaaggtgtacgataaagctcatttcacggtactacagcatatgactgaggtggtgccgtacgttgacgaacaccttgcagttatccgacaagagacccaggccgatcagagagttgggtcaggaataagcacatgtcttctttcaacgagtggctgaagaaccgaattgccaggttgcagaacttgcctagtgaaacacttcagtggttgtcacagggtcctgaatggagtgccaccacctggcaaggatatgacataaatggatacacctttcacacggtcaagcaagacagcaaatgcacagtgcagaacagtgggttacgcatcgaggctgctagtgacggtggtcgtcgtgatcaatactatggtagagttgagcaaatattggagctagattacttgaagttcaaagtcccgttgtttcgttgtcgatgggtctatcttcgcaatgtaaaagttgacaatgaaggtttcaccactgtcaacttggctaacaacgcgtacaaggatgaaccgttcgttctcgccaaacaagttgttcaagtgttctacatagttgacccgtgtaaaaagaaactacatgttgttcgtgaagggaaaaggagaattgttggattggacaatattgcagacgaggatgattacaaccagcacgtccacggcataggtcaagaaatacctttagaagaggaggaggaagaagatgaa

SEQ ID NO: 91086 - DNA, 720 bp, Oryza sativa
caaaatatattacatgtttccttgaggtattttctacaggatacaaaaactaccaggacggccaacaccaatccatggagtgaaagaccttctcggcgagtggcgccatcgacttcgccagaccgtctatctctgcggcagccctccgagaacatgaaaacccttcgtggaggaactcgagatgcagctgtgggcggtgatctcggatacaggccagcacgtgccctccgacaaaccggctcgaccgacgacactcctgcttcagggcctcgtcgctacgcttgccgatgccttcgagctgggcgcaggccccattcaaccacgagatatatctggccgccgactcctcgggattcctgcgaggtacctggagttcccggcagactccagccattgccatatagcagctcctgaggtacgagttgaaccacacctcgcgacctcggagcgcttccacggcttggtcttttttcacttccaccatggtcctctcgagttcggccacctcgaacttcgtccgccagtattggattcgacgatctctgtcagccaactcactctcgaggtctgcccaaacacggaaatgactaagtcaagtcattcttctctctcgagaacacgacatattaagtcaacccgaacaaaagagtaaaggaagtgaaaaccaaggcacgaacctagggaagtcatcgccatgtccgctcccacggacaagcttga

SEQ ID NO: 91087 - DNA, 1414 bp, Oryza sativa
aagggagatctggcggcggcggctttcacctcagagatgcggcggcagcggaggaggcggaggcggcggcgaggacgacgagctcgagacgacggcgagatacggcggcgtcggcgcggggatttgccctaggcagtggcggcgaaggagagaggccgagagagatcgatcggccgaaaacgtttaagtgttggtgaagaagacgagggcgcaccgggaatatatatacccctggatctttactcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatgtaaagtacaaagattaatgacaattacttcgaaaaattatttttggctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgattttaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgat

SEQ ID NO: 91088 - DNA, 3409 bp, Oryza sativa
cggagtgggaagtgggagatcgctactaattgaaggggtgttccactttcgatataaaccattggatgaatagatctaagggtcagaaaagagatgtttgatgaactcgtgctttttttgttattctagatgttttccttttctgtggaaaaaaacgtgcaatagattagatcgatcgtttccttttctttttaaatctctttttcttccttggaaaaaaagtaattttctgtttgcgtgcgatagaattggatcgatcgtttcttcttttatttttaaatctctatttttccaaaaaaatgtaattttagttttttaaaaaaatctagttgttaaagaaccagcatgacatgcatggtgagcactttgtttttttttttaccattatttcttaattacgtgcacctactgtaaagaaaattttcgtcctttcatgaaaggaaatattatcaacaaagttttgcaaagtaaaaaggataatatttcttgcataaaaaatacatcatcttagtagtttctaggtgacaaaggaaaacaacattgacaaacaaaatgactaatccatcggtgcttctcaaactcccccttgatagcattgatagcatgttgcctcatagcaagtttaaattcttttccattggggaaattgacgtttttactaaaatttgggtcctccctattatgcacatagatagggagtgtattttcatctagtggtccatcatattcacacacaaaaagtggatcagactcatcgggaacatctgagttacaatcatagaaggtattgttgcctctttaatacacacggtatcatcaaccccatataagtgctcctcatcaacaccaattggctcatcttcctcattcaatctatctgggtcaccgttaaaagcatcagtccaaaacatagcctgccattgtgatatatcatgtattgtggtgccatgctccttcccaccagcaacatctgcatctacattagtggcctttgtattagcaacatctactcctatcccaggcttctctatcccgttagcaggctcctctatcctgttagccgcatctgcatcaactacaacccctacttgatttacgttggttcccctttcaggaatagccctggaaaatacaaagttgattctaccgttagttcatacctacgttatagtctaaatattctacttgggttaaaaatcacaatgaaaaagaacataaaacgtacccgtgaagaagcgcttcgtctgagggcggcaccatcactcgtatccacagaaccacgatgtcacgcccagaaattcacgaaccagaatttctaagttgaatgtgcattaaacccctgtccaggaccagccagggtacacaaacgacaattgttgacatacagatcgacgtcttacgaaaatataaaagattacaaatgcagcggaaaagataaaacgagctagactcggaagctcgacttctgcagcgggcaactccactccacaggcatctcttgacggcagcgacgaaaccaacctcaacaagacagctccaactaggaagatcttcagctctggtgtaggggaaaagagagcaagactgagtactacccactgtactcagcaagtcataccggaagaggaggtatgatgcagggtataaccaaaaaaggctaaaggttcatttgcataaagcaggcatttaaaaccagtagttgaaaacggtaaaacagctgtagtaattaatcaatattaaccaatcactgttccacgaaacaccacgttgcaacaggcccaaccaaccacctgaactacaccaattcattaagcgaaactaggggtgagactaatcacggtgaatctggttgatcgcccataaccgtgggcacggctattcgaatagttttactctggccagaggtgtacaactgtacccacaaaacacgattccacacatgtcaccatgccccgaagtatcaccatgatactgcaaagggggaaatcgtgacaaaaccttccgcataaccctcccctacccatccacaccacgctaaggtttcacccccacccccaacgggcagtgggcggtcccctcttccgccgcggtgaatccggcagctggacaaccggacaccccggctgacccaactccatcacgcccaccctcgccaccggtgcctaggaaagggtcgagctataccccaggtcaagcagttacccactcccgcttgtggtaagcacggtaagtctcccagggtttcccgtgaaccggtacttaactgccatgggtgcgaccagcaaaaccatgcacccacagcccaccattcagtgtattttaattaactaacactattgcggtggcaccaatccaaagctatgctcatagtcatagtctatgtaataatgtaatccccatttgtgtactagtggaactaagcatggctaagcatttcctaaaccaacatctaatcattttgatacccaagttatcaatggcatatggtaaataatatagggctgagtaataggacccataccccttacctctgtaaatgtatgagacactgtagtaaaattcaggagatttgtcaatagcgtacaatatgatctaatgtaatgcatgacttgccttgctctcgcattgatgagaccacagcaacgtcttcgaggaactcgcagatcgacgaaacgatcgaaacctatacgacaaacaaagcacacaagcaaaacatgctataagactactgaaacagagaacaaaactatttttaatggattctagggatttttatgaatttactgagacttgaatggacttaaacggagctcggatgaattagatatgaattttagaaaataatctgtgtttttactaataaagaaaagtccttaatcaatttattgcgcaataatacccagggctgacgtcacccaaggggagggggcggcgctgacaggcggaccccgcgtgtcagcagctcaagagagagggagggggcgccggcacgtgggccccatgggtcagtggcacaaggcggccggtccaccgtggaccgggaccacgcgggtggtccaccgccggtccacgggaccgacggtccagatcggccgggaggccgatcggacggcacggcggcggctaggcacggctaggctcggctcggccggccatggggagcggcggcggcgaacggtcgccggtgacacgggaggcggcgacgactgccgaaagcggcggcatgggaggcggcggctacggccgaaagcggcggcacgagggagaggagagaaaggggaaaagaggaggcgggaggcctcaccggggtttcgccggcgcgagaggaggcgacgactaacggcgacggcaagcggccggaggacgactgtgacaggcggacaaactccgggaccacctatgggacaaa

SEQ ID NO: 91089 - DNA, 3434 bp, Oryza sativa
gggaaaaaggaggaaaaagaaaaagaaatagaagaaaggatttttcctgggatttaaaattgcactttggctcatttttaattggttaaaattacttttaaggctctgaaaattgcactaaaaatcctgttaatgcattagggcatggggaactcaagaaaaattccaccacgctatttctgattgttgattttcatttattaattagggaattagctctaggttaattcaaaccattttcttcgaacgatttatttaacaattttttaaagaaagaagaagaggaaaacttccgggcgtgacaaacctaccccccttaaacggaatctcggccccgagattcggaagagctggcgaaaaggtgcggatgggtggccttcaactcatcttctcttttccaagtggcctctttctctgagtgatggctccactgaaccttgcagaatctgattactttgttcctggtccttctctcactgatttcgaggatacgagtcggcttctccacatacgtcagatcttcctgaatttcgatttgatccggacttgcctgttcctcaggaactctcaaacatttcttcaactgtgagacgtggaacacattatgaatgccaaacatgttggagggaagctcaagctggtaagcaacttcacctctacgttccaaaacccgatatggtcccacaaagcgtggtgccaactttcctttggtttggaagcggtgtactcctctgagcggagtgacacgaaggtacacatagtcccctgcttccaaagtgagctccctttgacgattgtctgcatagcttttctgtggagattgcgcgattctcaatctttccatgacagctctgactttctcttctgcctcatttaaaacttctgtaccaaacaactggcgttcccctgtctgattccagaagagcggagtgcgacacctccgtccatacaatgcttcaaacgttgccatttgcagactagcctggtaactgttgttgtaggagaactcagcatatggcaagcttttgtcccatgctccaccaaaatcaagcgcacaagctctcaacatatcctccaatatttggttaactcgctcggtctggccatcagtctgcggatggtaggctgtgctgaagttcagacgggttcccaattcttcttgcaatttctgccagaactttgaggtgaattggcttcttcaatcagacatgatcttcttaggtacaccatgtagacacatgattcttgccaaataaagctctgctaacttcttccctgagtaggtagtatgcaccggaatgaagtgagccactttagtgagtcgatcaacgactacccaaatggaatcatgtccagatgatgtcctgggcaagccggtgataaagtccattccaatttcttcccacttccattctggaatctgaaggggctgtagcagacctgctggcctttcgtgttctgcctttactcgctggcagacgtcacagagtgcgacaaattcagctatttcccttctcatgcttacccaccagaatttttccttgaggtcttggtacatcttagtactgccgggatgaattgaataccgagtttgatgagcttctgtcagtatcaagtcctttaactccttgtttttaggtacacacaatctttctcccatccagattgttccttgttcatcctcaacaaaacctcgggcttttccaactctcatgttctttttgagctcggctatctcaggatcacttgcttgagctatgcgaacctgctccaccagtgtgggctatgcctctagggcagccacgaatccgtgctcaactataccaaggttcagatgttccaaatcacgttgaacctcacaacacagtttctctacccatgcaacattgcagtagctcttcctgctcaaggcatctgctaccacattagccttgccgggatgatagtgtattcccatatcataatccttgatcagctccaaccatcttcgctgtctgagattcaaatcaggttgagtgaagatgtactttagacttttgtgatctgtatatacctcacaacggttaccgataagatagtgccgccaaatctttaaagcatgaacaactgcggccaattccagatcatgggtcgggtagttgccttcatgaggacgcaactgtcgtgaagcataagaaaccactttgccatcttgcatcaacacacatcctagcccctggcgagaagaatcacaatagaactggaaatctttcgtctaatcaggcagaattaaaactggagcagacaccaaccgtcgtttgagttcttcaaaactcctattccattcagcagaccagataaacttttcctccttcttcaagagctgtgtcattggcttggcaattttagagaagttctcaatgaaccggcggtaatagcccgcgagtcctaagaaactccgaatctgagtaactgtctttggtgaggtccatttggtaactgactccacatttgctggatccacagccactccttgagcattcacgatgtgaccgagaaactgaacttccttaagccagaagtcacacttgccgaacttggcatatagctggtgctcttttaacttttcgagttccaaccgaagatgctgctcatgttcttcctgggacttggagtagatcagtatgtcatcgatgaaaaccacgacaaacttgtcctgaaattccataaacaccttgttcatcaaattcatgaagaaggcaggtgcgttggtgagtccaaaagacataactgtgcattcgaacaacccataatgactgatgaatgctatctttggaatacctcttcgctgatcgtcaactagtgatagcctgatcgcaggtctatcttagagaacaccgtagctcctttcaactgatcaaacagatcatcaattcttggcaacggatacttgttcttaatagtgacctcattgagtgtgcggtagttgacacacatcctcttggttttgtctttcttttccacaaagataaccggagcactccaaggcgacgtgctcaggcggatgtatcccttctatagctgttcatcaacttgctacttgacttccgccaactcgttggctcccattatgtaaggcctcttgtggatcggtgcagttccaggtgccaagtcaatccggaactcgatatccctttttggtggcattgttgtcagatcatccagaaaaacctctggatactctctgactatgggaatatcctccaacttcttagtggttttctccactgctacctcttgtccttcaccaacagcctggttcaaactgatccctggcttctgcggcactgcagactggaaggttaccacttctcctttcgcattggtcaacttgatgatgcggctagcgcaatcaatcactcctttgtgccgtgtcacccaatccatcccaagta

SEQ ID NO: 91090 - DNA, 2313 bp, Oryza sativa
atgagccagcaagggatctggtatggcgacgtgttcccgttgaccagaagcctcgcggccaagcccatcgtgccgtgggacgcggcgacgatgcagtcggcggagaacctcgtgttggggaagacggtcaagggcggcccggccgccgccatggagttcgcgacgagtcgtaacgaggagatgggcgtcatcggtcatgaccagtccacggacgccaccgctgagcatggcgtcaacatctccgataccctcgtccccggcggcggccgcatcgtcactgagttcgtcccggccaggtaatcacactgttgcatgaacacagttcgtcgttgccgtctctccgattgttcgagcaggatgatggcgccgccgcccttcgactcccgcaaccctagctccgcgtcgcagaccgccgaagaagtgcgcagtgggcggcggccagctgccgtctccgccccacttgccggccggcgcctttttccctctccgtgggcgctcaccggccggcgaggaacgatgccaggagggagagagaggaggcgctggtcgctccctctcccagtctctcgtcgtccaatcgttcgtggatagtgaggatggtgggacccactgacaggtgggtccactctttttccctttggtctaactatatgtgggccctatatttttgtttttgtttttaatttttatgttttccttccagtgacacgtcaccgccatgtaggacgcaaaccggccacgtagatgccacatcggccaaaaccaccgtcaaaaccgctgagggacctgctttgcaccggttttgatagttgagggatccgttgtatctggttttttggttgaaggacgaaaatcgaattcgttgacaagttaagggacctcaagtgaacttattccctccagtttcaacgttttatatgggccagaccaaacagatcggcctatgagtaatcaaacatcgccatctccctgcactaacccccggaggcccggacgtcccaaacatcagcgcttcgatttcgcaggggtaaccctggggtcaactctgctgtcatgctattgctacctcctgcatgttatgtcgaacaacctgatctttccattgtggagcgccacgacatgtactatcgagcaacaactgaaagatgttgacaccaacgtagtgaacagtacgcatcaccatctcatttcccgacacattttggcagacagatccctaatgcgatcatgcggaaaataaactaatcgtttcttggatcgctgctccgttgctttctcaatcccggatcatgcatgaagcatcaatttaattgacagatgctatatctagcagtaagtaaaaacagagggggggggggggggcacaggtatcatcggtactcaactgaagtaggagtacatgatttttatcggaaaaatttatgagcaattaataatgcatgctgctatttcattgatatactatcatgcaagaaatcgaaatggtcccggagacaagatcgcgcggccaagtgtccggtcgcccaacgaaatcacaggcgtgccgcgaccgcaagcgcgccctcgccgtcgccggccggccgggcatgtctccggcatgggggcgttagagcaagtttaacagtacagcccactactaattttaaatcatctatagccgatgtaatagtcaattcatacaatagttgcttactatattattaatacctggtctcatctatcatacatatattacgtcttgaagtccgtgctacagctagctacagatctgtaacccgttgctcttttttttcctttatctttttaaaatatatttgtagctggcttataagcctgctatatttatagctggcttagggcacccgcaatggttatttataggctctctataagagatccatgtcagcatattatcctatctggaagagattaaatgaagagagaacaaaactatctattaacttagagatagtctgtagagaaaaacaggcaatggattagagagctatacatacccatgtagacatactattaaggtgatttactattaatctagtctattgctgagatgtacatgttttatagagagcatcttactttaccattgcgggtactcttatagcctgctatttatagctggcttaaaatatatttatagatggcttaaacgagaccggaaagcatgcgtggggcagcgtgctaggagcgagccagcgaggcaggcatatgctcagcacagggccgtacgtccttcgaggaaggggcaagcttggtacagcgtcacatgcgtgcttgggcgtcggaccagcgtct

SEQ ID NO: 91091 - DNA, 766 bp, Oryza sativa
cgccgccggcgtccttgtggtgtccgtcgactaccgcttagccccggagaacccgctccctgcaggatatgatgattcttgggcggcgctccagtgggcggtgtccgcccatgcggacgactggatcaccgagcacggcgacacggcgcgcgtcttcgtcgccggcgacagcgccggcggcaacatcgtgcacgacgtgctcctgagggcatcctcgaacaaaggaccgaggatagagggcgcgatcatgctccacccgttcttcggcgggagcacggccatcgacggcgagtccgacgaggcggtctacatagcctcgaaggtgtggccgttcgcgtgcccgggcgcagtgaacggcgtggacgacccgaggatgaacccgacggcgcctggcgcgccggcgctgtataagctcgggtgcgagcggctgctcgtgtgcacggcgcaggaggactggctggtggcgaggggccgcgcgtactacggcgccgtggccgcgagcgcgtggctcgggagcgcggcgtggcacgagacggagggagaggggcacgtcttcttccttcgcgatccggggtgcgacaaggccaagcagctcatggaccgcgtcgtggcgttcatagccagcgcatgaacttctcttcttcatctgtatatgcttgcggacttgcagctgtatcttgcttgcctgagattaataaatcaataaaatgttatatattgtggcagtggaaaacatgatcattagtccattttacctgtattgcct

SEQ ID NO: 91092 - DNA, 1993 bp, Oryza sativa
gtgcaggacgtgctcttaagggcatcctcgaacaaaggcggagtatagaggggcgatcatgctccacccgttcttggtcgggagcacggcaatagacggcgagtccgacgagccggtctacatagcctcgaaggtgtgtccgttcgcgtgcccgggcgcagtgatcggtgtgtacgacccgagcatgaacccgacggcgcctggcgcgccggcgctgtaaaagctcgggtgcgagcggctgctcgtgtgctcggcgcaggagcactggctggtgccgagggaccgcgcgtactacggctccgtggccaccagcgcgtggcgcgggagctcggcgtggcacgatacggagggagaggggcacgtcttcttccttcgcgatccggggtgcgacaaggccaagcagctcatggaccgcgtcgtggcgttcatagccagcgcatgaacttctcttcttcatctgtatatgcttgcggacttgcagctgtatcttgcttgcctgagattaataaatcaataaaatgttatatattgtggcagtggaaaacatgatcattagtccattttacctgtattgcctgcgttctagagaagttatatatgtttttgatcacgcctttgagtatagccatgtggccgcgtggcgtatagtagcctacaggtactggttcttgttcacaatcgagggagtgattctaatccctcgaggggatatcccctcgtatacctttttcttctaaattcgatgcaaatggttgtgaaaaattctgaaaaaaaaattgacaatgtagagtataatgatacctactagtccaccaaaattcatgttcaaatttgatctacacatcgaaaaacaaaaaagacaaatttagatataaatagtacgctactattcatacgctgaatttgtcttttttatatctcgacgtgtgagttgactttggacttaagattttgtgaagttgtatatatgtgttgtatgaatgttgtcaaatttttccagaatttttaataaccgtttagatgattttttgagcaaacgagggaacttcccctcgagagattagaatagtttctccacaagggatatctttatgcacttatatatatgtgtcagttgtgaaaccggtacttatgaaacaccttatcagagctgcctgacagataccaattacaaattcaacatcaaagaccgggtttacaactgatatcaaagcggttttctgtgccggatatcaaatcatatctactccctttttttacgtcatgtgatagggacttaaaagttactatccaaacatccgatgtgataaggatttaaaagtttaatatttatagttagtgtccaaacatccgatgtaatagggacttaaaagttttagtcccatctaaatatggtcttactttggttagttttttttttctataaggggtttgtcccatattgcttgtctatatcgttaggaaaactttgtttatgtgtatcaaagattctgttcggctgcactcatttttattgtgttgcagccaacaggcacaatgtcttctgtgtgcagccactgcagcgcaactgctaaacataacagccgaacatgcccaaagaagcagagacagctgtccgaaggcacgggcggcctatcgtgccttctttaaaataagtctattttccccctctctcctttttgggttatgatatatatatatatatatatatatatatagttaaaataagtctattttacgttcctattctttgggccataccatataatatgtgtatttttcctccctatactttctgcggtgccttacacatggttgaaataagtctgtttcacatccctgaatttcgtgccggcccagcgtgttgaggtagcagcctagacacggtgcggttgttgggccgggccggcacgggcacaacccgagttgggctgtgtcgtgtctgggccaggtgaaatcgccgggccacatggccatctacaccccccccccc

SEQ ID NO: 91093 - DNA, 2497 bp, Oryza sativa
gttttatgcatgtgacttcaagcctcttccttggtaatactttccacaaaccaaacatgcatacacgttcaagtttgataaggagattgagcagaacttctcaaaatcaaaatcaaggacctacaatgtagacaaaatatatacaacaatcaatgaacatgtgaaatagcccatcaatgatacagtccagcacacattctgccagaagagtgtaaaacatatatagaatatagcgtggaagtgattccatagattttaattgtacaaacaatcacatcacactggccatctaaaacagaaggatagatttaaagatcctacaagagcttacaattgtttagtttaaagctattttaaggatctattttagaaaaaagccaaccacagctcacaagatactgtttagtttaattaaagcttttatgtaccggccagtgagaacgaggaaataaagggatacacaagttgaacggataagaacttgaagggaaaagcctacagttctttttaaaattgcagcaaacataagaggctttctgatatgtcctaagggaccgtgtctcagttaagaaacagtccatagtggaatggaccagcgttcaacccaatacacccataaacccaatagccaccagagcaaggaagaactaaacataattatttgataaatatgttccgttcagttattatagtaatgtacacagtagagtagcagtagaacagtgctctcgaacaaaaaaaaaaaaaagataaagtaccaagacagacatatgacaaaaaaataatatattacttcaaatgaacaggctcacatgttgcacactacaacaaaaataaaatcaattggaattcactatgaagatataataacaccatgaacattaagtttccctttagcatctgtatatgttgttcagctctattaaatcaaacatacacacaaaaaaaggaacttctatcacaataccagcaattgataatcaaaatactaggcgtaaatggtggatcccaagtaaattggagatcgtgaacataatgaaaaactatatttcatcgaggttattcacatcaatcgaatcacacagaatgtctaaaaaattggcacctgaaacgctgctgctgctaaaagccatacctggcggttcacggtgtcgaggtaagggcagtcccggcgcagctccacttgcctcggcctccgctccggagccctcctcacgtcgttgtcaacctcgtcgtcgtcgtcgtcctcctcctcctcttcctcgtgtcggccattcgcgcggcgcctccccgcagcagccgccgcctcctcgtcctcctcgtcctcctcgtagttggcgagccccagcagcgccccgccctccggatcctccccgcgcgcgcgcttctgggcggcctccccgtcgatgacctcctcctcctcctcctcctcctcgtcgcggccgcgcttccgcgccggggatgagagatcgtccgcggccatcgtcgtcgtgcgccggaaccctagctagctagctagctagcccctgcgcggggaagccgggaaatgacggcgagcgaagggcggagctgcgcccgcgcggcgagattctagggtttggggaaggaggagaggtgggcgaggatggagcgacggttaggccgtgaggatcgccgtgccgtgcgtgtggacggagacggggtttgggcccggatggggatgtcggttcttctttgtgggtttcgtcgggccaggccggtatgccaggttcgtcgcacaaagtttaacggcctttgatgtttctaggaaaaggcgaaacaaattcgaaggacttcaatcgtatgaaaataattcctatagaattgttcattctgataagggattttagagagatagttagccaaaggtcctttgagcctatatctcttgtccgattgcagcgttttctgggatccaatcaaatggttatttatacgttctttttttattttgtgatcatccgttttacacttgtatgaatgagatgaatcctacgttttcctatttactacatttttacattctttcgattcaaaggggccatatctatgctttgataattatttgaactttgttctcctgacatttttgcttcatgaaaaggttaatactgttaatttaagcactaaaccaaaataattttttcaattcatatactacaagtaaaataagttgatgataaaaaaaaacttgcaatgatagagccagcatcatcgttgaacccggacaattaatagtgtttcatggcggtcgaccaaactttatacttattaaccacaatcagtaatggaggcggctgtggcgaagcttgggcaatcgccccgacctacccaggagctgcccctaccactacaaacttgtttcggatttgtcctgcaatagcttctttctctaaaacataagacattgaaatgtatcttccttcgctactccaaggtagcaactatcatgaacaaatttcaatcggtgctaaaccct

SEQ ID NO: 91094 - DNA, 1481 bp, Oryza sativa
attcctgtgaagaccacctatggggggaataaactagcggagctctacttcgctaggatcgtgagtctccatggtattcccaagaaaatcgtatctgataggggaagccaattcacctctcacttttggaagaagctccaagaagagctgggtactcgattgaatttcagcaccgcctatcacccgcagacagatggacagaccgagcgtctaaatcagattctagaagatatgcttcgcgcatgtgtcctagacttcgggaagacttgggataagagtctcccctatgccgagttctcctacaataacagctatcaagccagcatacaaatggcaccctatgaagcgttgtatgggcgcaaatgccggacaccgctattgtgggaccaagttggagaaagccaagtgttcgggactgatatcctgagagaagctgaagctaaagtcagaatcattcgggataatctaaaggtggcacagtctcggcagaaaagttatgcagataaccgtcgccgtgatctggaattcgcagtggatgactttgtgtatcttcgggtcacgccattgcgaggtgtacacaggtttcagacaaaggggaagctcgcacctcggtatgtgggtcccttccgtatcattgctcggcgcggagaagtcgcttaccagctggagctgcccgcctccttgggcaacgtgcatgatgtgttccatgtgtcgcaactcaagaaatgtcttcgagtgccatcagagcaggctgactcagagcaaattgaagttcgcgaagacttgacctacgtggagaggccagtgaaaatcctggacaccatggagcgcaggaccaggaaccgagtaatccgttttgcaaggtccagtggagcaaccacgccgaagaagaagccacttgggagcgtgaagacgagctgaaggcagcccatcccggtctcttcgctagttcttccgaatctcggggtcgagattccgtttaaggggggtaggtttgtcgcgtcccaaatcgactctaaaatctatcctcgaaattgtgcaaagaataagtaaaaattcatgtgaaagcccccaacaattaaaatgtgcaaagataaaagtcaaatgaggcttggaggatttttgtatatttcctaaaagcctaaaatgcttaaataaattttagtggaattttcagagcacaaataataattgaaaagaaataaacaaagttaaaaaggtttataaaaagaaaaatcctaaaagaagttctctttcccccccctcccctcttgggccggctcggcccattccctccctctctctctctctctccctcccggcccatcggctccccgcgcgcgcgcgcgccgctgacaggcgggcccgcccgccgctctcgctgacgggtgggacccacctgtcatctccctcctcgcgccgcgtccgccgccgcgcccgtgccctagcgccgccgccgccgcggattgcgccgcatcccg

SEQ ID NO: 91095 - DNA, 873 bp, Oryza sativa
taggcttgtgccagatgttctattgcttacgacattgttgacaatgtatgccaagtgtggggtgatggagactgcaagggagatcttcaattcaatgggtgaaaagagtgtcccctcgtggaattcaatgatcatcgggtatgggttgcatgggcaaagcgaaaaggctcttgagttgttcttggagatggagagagatggacctaggccaaatgaaacgactttcatctgtgtcttgagctcatgtgctcatggtggtttggtgcttgaaggttggtggtgttttgacaggatggtcaggttctacagtattgagccaaagtctgagcattttggctgtatgatggaccttcttggtcgcgccggactgcttgaacaatcagagaatctcattgagaatttgcaaggtaaggtgtcagaagcattgtggggcatactaatgtcagcctctcaaactcagaacaacatcaaacttggagagtttgtcggaaagaaattgatcgagatgaggccaacagaagtcggtccatacatccttctatcaaacatttatgcggcagaaggaagatgggatgatgttgagaaagtaaggaaggtgatggaggagaagggggtggagaaggatgcagggttgagcctggtaggatcaagggaaggtggtcatttcattaatgaaagtggagcttcagctccaaggaatgatgtgatgctgtgcatgctgggtgagatgagtgtgcatatgaagcaaccatctgaagggtccaactgcaggaaaagaagcccctctgctccttgaaacttgaacatacagggcacattattttgctgtgtgactgtcaaaggagaacacaaagatgggatgtttatgcctca

SEQ ID NO: 91096 - DNA, 538 bp, Oryza sativa
ccggcccaagaaaggaagggggggaaaaggacttcttttagggtttttctttttataaacctttttaactttgtgtatttcttctcaattattatttgtgctctgaaaattccactaaaatttatttacgcattttaggcttttaggaaatatacaaaaatcctgccaagccttatttgacttttatcttcgcacattttaatggttggaggctttcacaggaattttacttattatttgcacaatttcgaggatgtgttttagggtcgatttgggacgtgacagcagcggtggtgcatgctctaaaaatctggcggcactatctcattgggaatcgctgtgaaatatatactgatcataagagtttgaaatacatcttcacccagtcggacctgaatcttcggcagaggagatggttagaactcataaaagattatgatgtgggaattcactatcatcctggtaaggccaacgtggttgccgacgctctaagtcgaaaaagccattgcaacactcttaacgtccaaggcattccacc

SEQ ID NO: 91097 - DNA, 1279 bp, Oryza sativa
atataccaggagtatttctgcgtcattgctgggaattatatttctagtaatgtcgttaagaaatactaacaggcggggtgtctcagcatcccgtactgttgacgttcttctgcgtgccatcgcatcaatcttgcatgctctttgttgctgaacaaacgtctgagccatggtattatagggcaaataccacattaccttagcaggaattctcttcctcgaaggctgtccgtcaacaccacctggatcgtctcttctaatcttgtatcgtagtgtattacagaccgggcatgcttctaggttctcatactcctcaccacgatagaggatacaatcgttcgaacatgcgtgaatcttttgaacctcaagtcctagagggcagactatcttctttgcttcgtatgttgtttcgggcaatttgttttcctccggaagaatgttcttcactagtttcaatagctcgccaaatgccttgtcattgacaccatttttgtccttccattgcaacaattccagagttgtacccaattttttgtgcccctattcatagcctgggtacaacggcgtcttgtgatccgctaacatacactctaatttctgagcctccttttcactttcgcagtcctccttgatgtcttgcagcatctgaccaagatcatcgtcaacgtcaatatcttcaacagccccttccacctcgcacgttgtatctccttcaaatccatcgtactgagcccagtccggaatgttctcgtcttctacttcatcttcttccatttgaaccccttgctccccgtgcgaggtccaaacattatagctcggcataaagcccgtctcaaacaagtgaatatgaatagttctaactgcagaatactctctctagtatttgcaattagtgcatggacaacggataaaaccattattctgcttgttagcttctgccactttcagaaaattatgcaagccatcaataaactcttttgaccgtcggtctgcccgcatccattgccaatccatctacataaaaagcacaaaaatcatgaaaaaataatccacgaaattcaaaccaattaaacaatattaacaatagttatatatattattataaaataataccacaaattattcatgttttcattccacataaaaattgtaaataaatatttattttgttgtacttattttaatttaaattaacttactgcactattcttttacaataattttctatcattttctttctcatctttttatcacaagtttttttcttccaaattctaaataa

SEQ ID NO: 91098 - DNA, 746 bp, Oryza sativa
cgcaaaagagttgattttccacccatatttgggccagtaagaacaataaagctggcatttccaggcccacccatcttaatgtcattgggtacaaaagatccactgcctaaagaatcacttcggagggtggggtgccctaaatttcttgcatggagagtaggagtatcatctggaccatatgattctttgataattggacagcaagttggtccctcaaaaaaatcactggcaatagcaagactaatcaaaacatcaagctctgcatgttaaaaccaaaggtagcatttagagacccactaatataatgcatgtgaatgtgggccattgataagaacttttaactatgcatcacattacaagtcacagttatctactaatcttactcctcaagaaccaatcaaataatcaatacaatcatgtgtaaactattgtaaacatcactattgctattttcatactcatcatgttatcagttgaattacaaagtaatcttttttgtactaagcatgtccttagaaattgatatcatcattgctacctagcagctagtttttgttttcaaatacagtaccagcatcttcaatatctcttttcaaataagatggcagatcagagtaaagtgaaaaggataggtagcagtcagacaacagagaattagaagagtggcacagagtactgctcatctaagttaaaactacaattggttacagaaataaaataacattagatgaaggggctgcaggaat

SEQ ID NO: 91099 - DNA, 705 bp, Oryza sativa
tgcacccctttccctctctctttacatcggattcgctcggatttattcccgcaaagctcgccggcgcatcaatggcggccggatcttccgcggccgattccccctcatccggccgacctttctcactcccgacgctatataaacgtttcccgtgcctccctcctccgtttccgccactcgccactctctctccccgtcggattcgagctcgcgccgtcgccctctctctccgccgtcgccgccgagctccggttcgccgccgtcgtcgccccggacctcctcccgcttcggcatcgcctccttcggcttcgccgcattctcgtcgacctcgtccacccctccgtttcgcccgccgaccgccggaacgccgccgtcctcgtcgacccgagccgcgccgccgtcttcctccgctccggtcgtcgtttccgccgccctcgtcgtcccggggtgagccgtggaccgcccctttcgcttcccccttccctcctctccctcgggtgccgctccgccgcgccgttggtcgccggcggcgaccatcggggcgcgggcgcgccgcatcccgtcggccgtgccggcgaggtcaccttcgggtgcgccccgcggctgccaggtgggcccggcccgtcagccgcccgcgcccgcgggtgcggctgacgcgtgggacccacggcgccggccggcgcacgccgcgtgcgcccggtccac

SEQ ID NO: 91100 - DNA, 642 bp, Oryza sativa
gcttgtggtatcctaagggttgtggctttgagcttttaggctattccgattcggattatgccgggtgtaaggttgatagaaaaagtacaactgggacttgtcaattccttgggcggtcccttgtttcttggtcctctaagaaacaaaattccattgccttatccacggccgaagccgaatatgttgccgctggttcttgttgtgctcaactcctttggatgagacaaaccctaaaagactttggctacaacttcaccaagatcccactcctatgtgataatgagagtgccatcaaaatagccaacaatcccatccaacactcaagaaccaagcacatagacattcgccaccacttcttgagagatcatgagactaaaggagacatatgccttacccatgtgagaaccgaaagccaattagccgacattttcaccaagcctttagatgagaaaagattttgcgagcttaggagtgagctcaatatcttagactctcgtaacattaggtgatgggtggttggctaattcatagccaaacatgtgtcactaaaatgtaaattaaaaaaaagagcttttgtgtcttgagatcacttcttgtgtagaagatggtcttgataccaggaataaagctcaaacattccct

SEQ ID NO: 91101 - DNA, 1914 bp, Oryza sativa
tttcatgcctactcctgagtcatgaccagcttcgctacgcgcctacgccgaatccagagcccagcatgatacttgttccatgggggccatactgatcatgagatgccgacgggcgccttatgatttttgcgtcgcatgtggcgtgctccgcgacatggaccggatcactgcactggacgggatcgatcacactgggctctttgattattggctttgccaactctagctgccgagatgggagattgggagcacgtttcccttacgtgaaagtaaagtgaactcctcgttgttgtacgaagcattcgcggatctggccttctccggtctcccggtctcgtcccttcggcgtactcctctctcgatgccgtcacgcttgacgacaccaagagaggaggacagaacaccgtgcagggagaaaacggcctgtgccttcacgtacgcacagtacgccgctaattttgattcttcgagattaaaatggaaatccttgtgtagacttggggtattccacgaaaatcaaatctatcatctcctatgataaatggatctaatacgagatacaatacatcttagtattatcaatgtgttgactcatgatattgcacataaatcaaatgtattcctcccgtcctataataaacaataggatatgatatactccctacatcccataaaataccaacctaatactgatatgacatatcctagtttgtttagattcgtagtattagtgtgcatcatatttgataatatgttggttttctattaaacggaggaagtatcttctaaaataaacttaacaacataatataacataatatgagatgtgacacataatgtgttgaacttatttttatcttaaaataaacaacgagatatgatacattttagcacaatcaatcgatcatataccgtatgttgggcgtatgtagggacgaaggtagtaagagataatgtcaaattcaaagctggaaagtcgccgtggttcggttcggctccacgaatgattagagccgtactacgttggcccctcccagaccaacagacgaccactatcctgcttcatttagcccaaaacagtagccacgtacacggcaatcatgcacagtttttaaagccccggtgcaagccagtctggcacgagggaggacaagaggatgtcacaaagcaagcagaatcatccaatctctccccctgcttgacatagattttgagccgtacttgcaccaattatatgccgcctaatttctgcaatccatcgctggtgattggaggcaagggtacacaatggagggtaattcaatacttggacgctgcaaaatgatgtcggcacgttggggagagaggggccaaaccagcaagcaaagtggagctaactttcagaaaacatggagcctcaccaaagcatttgcaaggacacacgcagggtgtagtagtaggactattggttctgaaatctggagcaaaccatttagaataaccaaaaggctcgcgctgtatttgcacattagcacccgtcgagtccactccgacagtgttgtgttcacagcagagcacctagcccagccatgctggcatgctgccaaaacaatcacagctgcattgtgagtttgatttagattattggacggattattatcactgattatctacttactataggagtaaattattttttaaaaaaattaataaattatcaggattatggataccacatacctaatagtagtagactaaatctcggcaggacccacaacataccatgtcctatacggaaataacatgcggatataggagtagttccggataaggaaagacaaccagagttctacatggaaacgacaaggactactcggattgtatccatattggtttccctagttctacttggacaaggagacacctatgggtata

SEQ ID NO: 91102 - DNA, 1234 bp, Oryza sativa
tgggccggctctgctcccacgtcgtcgcgcgcagagtggagctcgacggcgcgggtgatgccgtgctggtccttcctggccgttgtcgaccgcgtggccgtcgccgaggtcgagcttgtcgcctcgccacggtctgctcccgggctcgacgcttcgcctcccccgtcgcccgcagctcctccccccgccggcacctcgtgggcctcgtcccctccctcctcgtcgcgcacccgcctatctcgcgcgacgctagcgtcgccgtcgtgcatggcgtgacccatcggctggtctgcccaagtcacagagcgaagaagaagagtgatagagatgaggaaggagagaatgtcacgaccagaaattcacgaaccagaatttctaagctgaatgtgtattacacccctgtccaggactagccagggtacacaaacgacaattgttgacatacagatccacgtcttacaaaaatataaaagattacaaatgcagcggaaaagataaaagcgagctaaaccgggaagcttgacttcagcagcggggcgactccattccacaagcaatccttgacggcaacgacggaaccaacctctctgagacggctccaactgagaagaacttcaactctagtgtgggggaaaagagagcaagactgagtactacccactgtactcagcaagtcataccggaggaggtatgatgcagaacataaccaaaggaggctacggggttcatttgcataaagcaggcatttaaaaccagtagttgaaaacagtaaaaacagttgtagtaattaagcaatattaaccagtcactgtccaacgctacaccacgttgcaacaggcccaaccaaccacctgaactacaccagttcattaagctaaactaggggtgagactaatcacggtgaatctggtcgaccgcccataaccgcgggcacggctattcgaatagttttactctgatcagaggtgtacaactgtacccacaaaacacagccccacgacacgtttctgtgtgccgacatgccaccacgacataccggaaagaggccgtgacaggacccttcgcataactccctctaaccgatcgcaccacaccttagggttcgcccccgtccccagcaggcaacaggcaacccccctttagtgccgcagtgaatccggaagccgatcaaccggacaccctggccgacccaactccatcacgcccaccctcgcctgggtacgtcggctagaga

SEQ ID NO: 91103 - DNA, 1483 bp, Oryza sativa
cattcataccaagctctaggggcttgtttgagcccgtagagcgccttgtggagcttgtacacatggtttggcaactttggatcctcgaaccccggtggttgctccacatagactaactccgagataggtccattgagaaaggcactcttgacatccatttggaataacctgaaatcatggtgagcggcataggctaaaagaattctaattgactcaaggcgagcgacaggtgcgaaggttcaccaaaattgagaccctcgacttgggtgaacccttgcgcaactaaccgggctttgttccttacaaccaccccatgttcatcttgcttgttgcgaaagatccacttggtgccgatgacattttgcttgggtctctccaccaaagtccatacttgattgcgagtgaagttattcaactcctcttgcatagccatcacccaatccggatcaccaagcgcatcttccaccctggttggttccaaagaagagacaaacgagaagtgttgacaaaaacttgcgatacgagagcgagtagttaccccttttcttatgtcaccaagtatgttgtcaacgggatgatctctttggacaatgtgatgtatccttggatggtgcactggggggacctaagcctgatcagaatgctctaaagtgccctcagcatcgatcccatccacttgtgccattggcacgtcttcactgccactgatccggaggttccggactgtagaacccggaacttccgggcctggagatgtccggaggttccagtcaataggacccggaacttccggctcagcagacacagcacttgtagggctattggatgtcgatgacgcggaggttgatccctatcttcttggtcatcctgcgtctcgactggtcgtatgtctccaatagccttagtacctatagcttgatttggatccacatctcctacaatatgtacaacaacttgctctccttgggagccattagattcatcaaatgtcacatccctagtgacttcaacaataccggaggttttgttgaagacacgataggcatatgcatttgattcatagccaagtaagaatccctcatccaccttaggtgagaacttagatgagcgaggcctcttacttaaaataaaacatttgctcccaaagacatgaaaatatgaaacattaggcttcttaccactcaagagctcatatgaggtgttctttaggatcttgtggaggtacaagcggttgatggcatgacatgcagtagtcatggcttccgcccaaaagacatccgaagtcttgtactcatcaagcattgcccttgcggcttcaatgagggttcggttcttcctctcaacaatgccgttttggggaggattatagggggcggagaactcgtgcttaattccttcttcatcaagaaatttctccacttgagtgttccttgaattctcctccattgtcgcttcgcaccctcttgatagtgagatcatagag

SEQ ID NO: 91104 - DNA, 1892 bp, Oryza sativa
atccatatgaagaagctcgagtggtcttgttgtagtcatgatgttttttataggatgtggactcccaacttgcttcccggcttggcagcactacacacacgatctttctcaaaagaaacattagatagaccaagaatgtgttccccttttagaagagatgccaaattcctcattacaacatgggctagcctacggtgccatagccaacccatagaggatttagcaatcaagcatgcctccggattcactctatctacgtcgaaatcaacgagatagagatcaccctttaacacacccttaaattctatggaagagtcatctcgcctaaaaaacggtcacatccacatcggtaaacaagcaattaaatcctaacttacacaattgagacacggataataaattgtagcttaatgaattgacaaggaggacattagatagagattgattctttgaaatgacaatcttaccgagacccattacctttcctttaccatcatctccaaagacaatattttcacgacttccaccctcctcctcaagacttgtaaacatactcctctctcccgtcatatgattggtgcacccattgtccacaacccaacttgagccaccggagaagtatgcctacaaaagagatcaagcttgggatttaggaacccaaacttgtctaagtttgggtcccttgatgttagtcaccaaagcctttggcacccacacacaagtgcggtacttatcattgtaattcccattaaaataagcaaccactttgccctctgaatttttggaaattacatatgaatcatagtaaagaccctctggccggaacttcctggcattatacccggaacttccggtcagccccttcggcctatcagaagcccgaaacttcctgacaaaatgtccggaacttcctgtcttacagggcatgaacttccggtcattttgcctagaacttccgggtgtctgaccagtgaggggacaagtcacctcacttgcttatggagcttttccttctcttacaaacatcaagcattctttcccatttaccatcacacgcttagacacaggacttccaccagaaaacccgagcccgtgtccatccttgttaggatgagcggtgatggtcttgtaaagggcatcttttgaatggtatgttttcatgcatccatatttcaccaatgtgcccaacctttcattctctttcttaagagcttgcatagcatcaacattagtagcatgagagttcaaatcaatattgtaacacctagcacaaccattgctagtagatgggttggaagaattagaaaccacatttggttgagaagtgctattccaaagagtgtcaaattgaacttcaagatctttatgacttttgtctaaactagcaaacttctcttgaagagtttcattgacattcctaaggctagctagagaaccattagtaaaaattaagctcattagctagttgttcatttttagcacattctttagctaggatctcctctaaggcaaggtttcttttcttctcaagaataagtaattcttcttgcctttcgagagattgttctttactatccaaagctctcattaacttagccaaatgttgcatagcgggtttgctaaagctcttaagcacatcatctaattcattatcactttcctcatcactagaatcaatatcaagagaggtgtgagagggcttttgagtcatcaccttgcggccttgggccatgaaacaagagtagtggtagaagtcatcgtcgtcatcactcaagttgttgaagagacgcttattgcttgaagaagatgacttgaaggcgacggtagcaacaccaccttctccttcaaccttgtctttcggcttgggcttgggcttgacctctggatcttct

SEQ ID NO: 91105 - DNA, 642 bp, Oryza sativa
ataaatctagggctggcgtcatccaagaggggcggcggcgccgcaggtgggccccgcttgtcaccggctcaagagagagagggaggggcgccggcacgtgggccccactggcagtggcacaaggcgggaggggcgcggctggtggctcggcttggcttcaaagccggcaggcccagcatggcgagcgacggcggcacgcgcggtcgccggcgacggcaaccggcggcgcggacagcgacggcagacggcgcgaaaagcggcggcggcggccgaagacgacggtgcgcgcgcggaggacagctgtcacaccccgaagttctcctcccaagcctaaaatttaatttataagagaccctaagaaaataccggtgcaaagcaagagtaaacccttttaaatcaatgcaaataataatcgagtgggcatgtggaatttttcttgagttctacatgtcgaaattcactaacaggatttttagtggaattttcagagcgctcgaaataattttaaccaattaaaattgagcaagcaatattttaattctagggaaaattcttttctcctttttctttttctttttcccctccttttccgaatgggccgctggcccattctctcctttcctccccctcctccctgctggg

SEQ ID NO: 91106 - DNA, 2846 bp, Oryza sativa
tcccatgagcgccgacactccacgttgccttgacgtcaacccggacgcgccctttacctgcggtaactaccaccgcagcagcggctgcccccacgcgccagccatccgcaccgcacaccaaccaatctctctcattggcaactgcttctgcttcctcttccatggccaccgccacattcccacctcacctcacctcatcattgattactgcgtcaaggtagtagtatcagcagcagcagcagcaggcttgcagtgtcatcacaagtgaaagtgactggcttccggtgtgtagatatagtggtctgcagtaactttatcacataccagcatttctcaattctcaggccacgaaagcaactgccatgccatacacactgtgcactactaatctcccttcgcgcactcattggctcatctctcatataattttccattcccatttacacagccacagaaaactaatcactgacaggtggcccgtgaacagtgggcccatggggagtcatctgttgacaatataatgggggtagctacctaggtagcgtgtagatgtaatcgcgtttcgcatggaaaaaagtcattcatagaaagggtgccgggtatatataggatcctagctatagatagctggctagcgcccttttggagttttgaccagacccgtttagagtgtcaattgagcaagctgtggtcaagctgagacagctcacttcaagctcgctagctgtatataatgtatacatcaaacacagaatcgtaatgtgcccgagcgctttaagcatgtgattacggtgtgatcgctcgtagtggcacaccatttcttttttctctttagcgaatatatatgtagcccacgcacgcactcgtgatcacctctaagattttgactcccggccacaaatatcccaaaattttatatttaaccgggtctacgagtataactgttatttttatattccattcttaacattatctctcaaaacacaattgcattgcccatacagttaattttttttggccattttctcgttctctgatcgattaacacggtataattttagaattcaggagcaaaccccggtggttactactcgccaaacgatagtgcacacacacatgcatgtacagcagtctgacatgtttgttaggggatgcaaagtgtgatcgtcatcatccatgaaatgaaggacacaccatataggagcagccaaatggttggcaggcagagaccaaaatggagctatccaatagagtggaagcacaactggttttttgtacgttgaaactttaaacaagtgtctaaagttaataattactagtactactgttaggttataaaaaaagctgactagttactggtgtcacctaaaggttactactcctccactagaggggccagcgcgttaaacgacagcttcgcatcattagctcacgtatcaatattccgtgtgtcaggcgcaccatgtgtcaacatgtccaatgtcgggtggtcatttcaattcatcttgcacctgctgctgctgcttgtgtacacctagtactcctatctcggttacttagcttttccacctcccatgcgttaatttactgcgtgcaccacgtgccagtaggcttttttaccgtacgtgcgtggtatatacgtacgtacacctactcatacggtctgtatatatgcatgcatatatatgggctcaattgctgccatccgtgtagtcgaaagcgagctataccactcagctcgaacaattcagatattttcttaaaattgttgtgaaacttgtatgaactacaactagatatgaacggggatatgttaattgaaaaacctcggctctcaagcacaaatggtgaaggccaacgtctccttttatagaggccagggatggcgtcgcctatgcctcctgcttatctcttcgctactgtatcttcacgggagctggctaaagtcgaggcctttccaccgaaagttttactcttcacagtgatatgtcattcaccgcaccctatattgtccccttatcctttatagggtgtccttctggattctttcttgggtaatcttctgaatttcttttattcttttattcttcttccacgcccaaattgttgatattctattatcaatatatattgaaaaacatatttagcttatattaatttattcatctggttgcccatggccaccaagatccattgtgtccaaatcagaaaaagaaacttctaatttctcatctactgccttttttatttgctcaaatttctgatccatttcttgttttaattctttaagtatttcttccttcaattccttctttaactgtggggaggcttcttcaaatttttctattatcttccaatcaatatattccccatctaatggatccactccttttgttaagcattccttgtatgtgggttttttaaaaaacccttcttcttttatagtcatcttaataggtatttctgaagtcttctttcctttagcttttttgcatttttgaatatattcttttgcagcaggctctagataataatttattcctaatatttttctagcttggcttaatgcttcatcaatatccttatatttcttccaagatattcctcccattaatttagcatctattttttgagccacaatttcttcaaaagaaatgtagaccccagggagctttccatcaaatactacatatataggcttttgttggattacttcatgatcttcattggcaggcattaatgacccatttattaggtgaaaatattcagagaggctattcaatattgataacaaataccctttttcttcccttttattattgtattggtaccagaaattatccaag

SEQ ID NO: 91107 - DNA, 1557 bp, Oryza sativa
cagacattgattacccaagaatctattagcatcgcagaggtttataatgttgttgatgccttatcaaaagtaagacattttttttgcagatgttttattctagtgtcttatgaccttttatttggcttacacatatgctattttgcagcttgcaatcaggcccagttctcctgaatcgctgcagcagttgattgaaatcgctagaagttttgcttccgtgaaggatgaaaatattagacagtcaagggataaaaaggtcaggagaccgataattggtcataccttccattgttccaatagtaaatgttatgctgactccacaaattacacctaactggtttcaggttttatccggtcgtcctttggtgaataaagaggaaaataatgctaatgatgttgcgttcactgatgctgttggttttcaggagaaggttagttgtacacactatatcagttttcgttgtggagacatcacacaggattttatctcctgaaactattagagatagaacaataaatttattttctttatcgatttaactttggttcctgttcggttacatcttttcttcatcatgaacagcaaccaaggtatgacatatgtggtgtatgctctagctgcttcagtgtcatgcaacatgtatcttaatgcagtttactccaaacagctcctccattctcaaaatagatgtcatcgtcaaatcttcaaatgttaactccctaacatatgccaaaaaaaaagagatagaacgaacgctttgatgcgaaaaactgaaaatgatatactagttttcatgagaaagaacgctttcatgtagttatgaatttgtggttagaaaaggcagtgaataaatatttgatttggagactctgtcaatgtccttcaaaaagacttgggagcattcattagtcatttaacagttctacacaggaacattcattttttttttgttcacatggcttaagaaaaggaaacattcctgtgtcaccttctgtacaaaaaaaaactgtgcccccctcaaccagacttggtggtatgaattgtttgttagctggtcattttttttattttgcatacagataatactttgtaacgtgtgcactctgtacatgttctaacaaaagctgacaaactccttgtgcatattatgatggtttcacacaaataactagagatgcctttgttgctaatctcttaataagttgtcactgttcctcagtagattagtttgattagatggatgcatgaaaagggaggaacttgttgaatgctaccaaagctcaagtcctcattgggtgcctatttattcttgattaaaaaagtcacctagatcctcgtaggttttttttttcttcttaaaaaaagatggtctagacattaatattctttgcagactgcagttatgtttattatgtttgatggaatattattttgaatatggttagtaattgattcttaaaagtattgacctctaaatgtgttgatgttacatattattgactttgaaattaacctatattcatggaaagctaatgcattatttggggctgcaggaa

SEQ ID NO: 91108 - DNA, 3627 bp, Oryza sativa
gttcattccgatgttcatcgcatgcagcatttttcttcttgagctgctcttggtaatatttcaggtaagttattgcttggattacttcctcttttattttttttttggagacaatcacttccttttgcttcaattattttttatatctggtggttgttacacttagtcagcatttctataactgttacaaagtgtagcttctgctttgagctgcatgaaccgatttagatgttttccagtagataatggttgagtattgttggagttcattatttgattgttctcattctctgtcaaagagcatggacgatcttactttggttatagctttacacccttttaataaaaatagatgggttaatatatctgaccatcaagtgatctttgttgtaaaccactattttttgttatcgtttccatctttctgggccccgcagcccaaaccttatgtgcttaatcaggaccccctagaaggcccttttactgtccatgagcaattatattcgtatggaagtaaatttagctgagttatgcttccataatccacgttgtgaagtttgcttatccttttcttctgaaaagtaagtttcgctggtacattaatcgtatcatgccttgtgtatatgtttttgctgaacagtttttagttaaatcttggtctagtcagattcaaatatgacaatcctttgaagtagagcgcatttgatcatagaatactttttggtgatgaacaaagcctgtcttatttatacgattatctctcacaggtcccttttcagatggctaagaagcacttccttgggacaaatagatatcccttgcgtattcttccctcgtattactttcttaagtcgtggggtatcaaggaaccttatattgtggctggcgcatacattatatcatgcctattgacggcatttgcaggatatcttggtcttgtttcagcgtaagtggaagcttaggttacttactattctttcattctttttctgtcgctcctaccttattcttttcagaaagtttgaacctatagcattcttttagaatggtagttaccaagtgtatgattcatacaacaaacatagaaaatgtagatattggacctagtaggattcctaacaattgtgggaattgggtattatagcatgatatcgtgagctacgttttctgccttgcataaagaattgtatccttttgtgacctaaattattgtagttacaaaagatattagactatcaaggaaaatagcttatgattcttgatttgttttctccctggtatgaaagtttcaataatggattggtatgctttgctagaaattagttttgaataaatgcctaaagggctagcctacaactttctcgaggaaaaagagtacagaagttttagccttttagggaaaaagtttttgaaagatagataatctaatcggtgtatcagtgattcagacattcaatgtatgtgtcacagactcacagttgggtcggatacatattcagctgtttcacaagtcggaggtagcagtcagttttctaaaacgcactgctaaaagtgcaataagttagtactacctccgtattataaatataagacactgtttacggcattgatgtgtaactttattactatcttcatcccaaaatgttataatctaagatgtgatttgactcctgacaacaaatctggacgactagcttgcaacattttaggacggaggaaatacttttctatttgatataacaataatgtctaaaaattacaatattataaaagggcttataaaacatagttattttgagagctatctatagtcacagttttaaaagtttgaccaaataaaatcaataggataatatatttaaatacacatggtaatagtagcaatgttttttttttgacctttacttttgcaatgatgagtttagggtttgtttcgatacgtgacgacacaacttatgcacgcaggagtgatcttgcacgtccaagtcaaaggtccaaaatgcccctgacatatcgtaggcaaataacggttgatatgaattcagtggaaaataaggaatattcccaaaaatatttacaggtaacaaaaagaattctgataaatgtacatgctaaattactgtacactagtatgaaacagatttctacaagtggtcagaacacattcgctggtggttaggttaagttgttcactcgaaaaaaatgattttgctgaaattaattcccagaaaaatgattttcaacgaacgagatgaaaagtgaaattggaatcggatttgacgatataccaaccccaaatgaaaacattataatagagatacagatcagaagaaagagagtgagacgtgggtaacaataataaaaggggagctataagacacgtgccacaaacacaatcgtgcgaactgcacgttattacacgtacaacggtacaagcacgaacatgcaattatgcatgacgtagagagcttgttattactcaccgttgacttttacgtgtttgatcatttgttatattaaaaaaaatttaagtaattatttattctttttatatcatttgatttattgttaaatatacttttatgttcacatatagttttacatatttaacaaattttttaataagacgagtggtcaaacacgtaataaaaagtcaacggtgtcaaatattttcaaacggagggagtactaataactgtgttgacgaagagaaccttggagggagatgactggggaaatgaaaggagcggcggggcaatgaagaatgaacgagatacgtaatgcccatgcagtggaggtggaggaaaagaaaccgagcggagcaggactgggtaacgggaaccagctcagaacgatggcaacttgactcagcgctgcttgaggtagacgacgcagccgtccctcggcaccatggtcggcatgtacaccggcacgtcgcagccctccgtcctctcacgccggaagtcgacgagggagacgaagagcgccatgaagatgacgaggtggttgagcgcgtaccgctgaccgacgcactggtgcgggccggcgccgaacgcgaggaagttgcgcttgtacaccacgtcctccctccgcgcctccgagaagaagcggtccgggtcgaacgcgtcagcgtcttggaacccttggaacgacgactcgtacaccgatgggaacaccatggtgcccttgggtatagtgtactgcgccgtcagctggaacgcctcgacggcgatgtgcggcaccagcgtcgccggtggatggtaccggacaacctcgcgcgccaccgcctgggtgtatttcatcgccgacatcatctcggcggtgatgggttcgccggactctggcgaccagagagcggccacctcagcacggacgcgggcgagcacgttcggatgggagtcgagcgcggacaccgcccagcagagagaggaggtggacgcgtcctgcgccgcgaagaggaagccgaacaggagggcgccgacctccacgtcgctggtgtgcggtggtggcggcagccccgctgccgtggcctcgtcgatctcacgcaccgtttcctgcatcaagtagtccggaggcactctggctcgccgccgccaagcatgcgttgcctgctctgacgtgcgcagt

SEQ ID NO: 91109 - DNA, 970 bp, Oryza sativa
accttttttctgcttggagtaattaatcatgtttttaatgcattcatattgtttggattctcagacctgctgattctgcccttgtactctggccttccgcggggagatcaagtaagtgatcatcagtagttttgtagtgtgaaatctgttgtgtttactgcttagctattcttctctggcattttaggacctcatttttactccaacttcaaaaggtaaaaggaaggttgtgatatcaacaaacattgctgagacgtcattaactctagaggtaatgcatatgtatatgtatgctaacaaattccatggtggttgttactaactgctctcaatgtcgtgcagggcgtggtgtatgttgttgatagtgggttttccaagcagaagtgttacaatccggtgctttctatttatactcaattatatggtccactgttcttctagatatactacacttctacaatttggctaccctagatatatctatactcttgttccttttcatagaacctttttagtaaacttttttctaatctttcttgtatatttcttggtttagtccttttcctgtctataacttgcatccttttggcctagatttctgatatcgagagtttagttgtcgcaccaatatccaaggcatccgcaagacaaagagcaggccgagctggaagggtgcgaccaggaaagtgctttaggtctgttggacagttttctcattgaagtttgtgtttttattgatagttcccttatagtgatttgtatctatcctcttctagcggcaattatatttggtcagttatgctggtgttgtgtttttattattatattataaaatgttccatgattctatttacctgagtctgtgttttctggatgacttgctgaatactttgagctattattttatctactattttctttgtatgtttcaatccttcatcttgaatattttatgaataaatctgcattc

SEQ ID NO: 91110 - DNA, 3579 bp, Oryza sativa
aataagacaaatggtcaaacatgtgctaaaaagtcaacggtgtcaaacattttaaaacggagggagtatatcattggggtcttcataaacccaaaaaatgcactagtagtatttgtggaacggaagaacacaatcgatgcctggaatctcttcttttggtaattggtcaatggtattttcgtacggtgtagtgtagcgtgcttgactttctttttaaggccaaacatatattgttcaggctggcatatataaaaagtgatgagaaattctagcttctctttcttcctgtcaaagtgtaacgatggaataattccggcatgcatgttaagatggttagaactcaaaatggacaaaaacaaaatgagctctacaattatatattcagataacttcaaattcatctcaagtttggctcagacaatatataatcgttctcttcccaaacaaaacggggcctttaaacgacacgagttgagttcgaagaagctggaggccggagatacgtacgattccgtctgtctcgtggctagctcatggcatgcgggcatgcaagcatacagtggacgcatcactgctctctcttttgcgccacctccctcgtgatctgttccccctatctgttcatatgtctctcactctctctgctgttgccagatgaagctgatggcaatgcaaatgcaacttgatcagagaaaaaaaagaagaggagctatgcatgaaagacaccttgagagagagagtgcaatgatggaaaaggaaagagcatcgggatgttgtccaaccgggcatgggggttgggttggatgggatccgaaggagcacactagcgggccatggaccatcgtggtcggaccgtgaaagtgatcgatggcccggttaattcactcactctgcaattaagccgtgctcgtaccatttgtactacgtacctagctgcaagctcgttgttcatatgaacaggttccatgaacttgctttaacttaccaagcagtactgtaaaccgtctagtggtcgaaggcctgcctttttttgctttggctcccatgatgatggatggttgatttgtatatatagccatgcttgaggtacatggaatgtggatcgacttgcacgtattgaattactaatcactccggtagtccggtctaaaacacaattcattttatatatcgatctataacacgagttaataactttcacaataaattaaaaatcatttaaaatataggttttatagctaggtatatcaaaatgatatattcaaatatgtgctggtacaagagttttcataatatcacacttatatatagcataacttaaatttataagaaccagctggtagtcaaagttggctacccacacaaaatatatttctcactccggttgcttccttggtgaaccagaaccttgaatggccatgaaggtaacttgcatctgggtgtgatgctatgaagtgtctccatataatgaagattaaatatagtccagcaatcaattaattggagcagggagtaaaaaaatatgtatatatacatgacaagtcaaacttttgaaacctaattttgagcaccaaaatattttaaatatttgatataaaaatcacaagtctacatttttgtatcaaaaagtaatgtatatcacaatattttatatttcttttgagctttagtaggagtatattataagaaaaaagtatgtagttgttcgaagttgcatgttgaaaattaatttggtgtgtctgaggcagtatgtttcataaagcagggaattagcggccgccaagtccattaattaaaaataatgtatatcagtagtcgttggatcatgaaaactcaggaagaatttagaaggcacctatatatgctcactagctagcttgtcatgttttgtttgtcagcatgcacccttgaaacttgacaaatggacattaatctctaggctggctacacacgtagcctttggctaaatcaactttatcttgtgcaatagtataacagactatggtatagtagatggcttcaggttaatccttcgttgacttgttttcttaatttttggggataattgcttcagcttgtctgaaatctctgaatgggcaagttagtcgtacgtgcacgtacgaccgatgcttttcaatcgtgtttgatcacggagacagtatagcttgtggcacagagtttaaaatgtacactaaaatatatttttggttgagctcccaaatctacactaaactagtactcctagctaaacctatctccgtatagctcaccgttgccaaacaaaaaagcttcagcataaacataccaccacactacaaccttcaggccacttcccttttcttaccttttcccccttaactgatataaaaaaaatcatagcataaaaaaactcacaagagaaattaacctcactgcaagaaagagatattccccaggaaaaaagatagagaggccttgcttagatccaaaaaattttagccaaaaacatcatatcaaatatttggacacatgcatcaaacattaaatgtgggaaaaaatcaattgcacagtttgcatataaattacgagacgaatcttttgagcctaattacgccataatttgacaatgtgatgctacaataaatatttgttaatgacagattaattaaacttaacaaatttgtcttgcagtttatagacggaatatgtaatttgttttgttattagctcatcatcaatgcggtgcttcagcccgtgcccctagcgacggccatccgcttttccgtcggcgtcatccctctgcgagagagcgcgtccctcagttgggacacgcgccccccacctccttttcgcccaggtgccgatggaagaaacccgttgcgtgggtacgggtgcttgaggcgacgccccccgagcgaggatttcctcttccacccctctcccctctcctcgagctcctcggcgacgacctggggacgaaggaagagagaggcgtggcacggtggcggcccttctccggcgacgggagagatacgcggcggtgagagggcgaaaggcaccgctcacctgcgcctcagcttcctccgccggcgccgccaccatctcctccccgatctggccggggggagaggggggggccagattcgcccacgaaggcggggtcgacgacggcggtggggcagggaggtcgtcaacggcggcacggtggggagatcggtgacggcggcgggacggagtcggcggctgcgaggagccggcgcgggaacggggcgaggtgcaccaggctcgctcgccaagtcctggcgcgaggcggagaggagagctcgcgtggagtcctgcgacggcgacggcaaggagaggagagacgagaagcggaggggaggaggcgagtacgatggagacgagagaagcgaagccagtttggtagatactagagtaaatgagagggagagagagggaggaggaggaggataagagagggttagtataataaaataccttcgtggccttttaaggttagggacacttgttgggccgctagaggtatccttcattgtaggggtagttgtccggcatagagtgtcttttatttagatgccc

SEQ ID NO: 91111 - DNA, 537 bp, Oryza sativa
agataatcttcaatctggttttccaatcaagtggatcagcttggtgattctgaaaaatccatttatccaaagatccattaggcatgtactcatagacaagaagcctatgagttttttcaacacaaaatccgattagcctcaccaggtgtatgtggttaatgcttccaattgtctgaacctctgctaagaattctcttttcccctgacctatgctatccaatctcttgacagcaacatgcttatcaccgatctgtccttcaaaaacagaaccaaatccccctgccccaatctttcttgagaaatctcctgttgctgatttcaaatccacaaaagaaaatcttgtgggtagccctggaagctgatcaataaaatattcatcttctaatggttcgtctctctttcttctcagaactataagcactgcaacaataactgaagtaacaaaactcaaagaaccagcaaccaaaacgattgctcttttctctttagataataaggatttgtgggtagagtcctgaattttgagaaaagcagaag

SEQ ID NO: 91112 - DNA, 841 bp, Oryza sativa
atgaggctgtaggcccaagctccggctgccgcaccggcgaacggtcccaagatgtacacccacagcgccgtgtacttgctccccaccaacgccggcccaatgctcctcgccgggttcatcgacgcccccgacaccggcctgcgcgcccacgtcatccatgtcaaatagacccccaaagttagtgtgacgacatcatttgcgggtgtgtgagtgtgagtgtgcgtgtgcgatggtgcgagcccatacccagcaaacagcacattgagcatgatggttccacccacagccactccagccatatgacccacctgtaaaaacagagtcagatgaccgataagtcaaaactgataagtattcgtgacgtggatggctgccatttaccgcttggtcatcggtggcgacagccatgatgacgaacatgaggtagaaggtgatgacgaactcgatgacgagcgactgcgcgtgggcgccgcccggcagcgtggccggcacgggcgcgtgccggccgccgaacatgagccgcagcaccacgctcgccgccgtggcggcggccgtctgcgccagcgcgtacgcgggcgcgcgcctccacgggaagcggccggcgacggcgaagccgagggtgacggccgggttgaggtgcgcgccggagacgtggccgacggcgtacaccatcgcatgaccgccgcgccccacgccacggccacccccgggaacgtcaccgcgcccttcttctcctccaccgtgatggcgcccagccccgcgaacatcacgaagaacgtggccaagaactcggcgagcagctgcacgcagcgtcgtcgtcgatcgacgaccaaattaacca

SEQ ID NO: 91113 - DNA, 4028 bp, Oryza sativa
aagcatgatttgcgtatgcttgggaatgcctaactaataatcaatgcgtggaagctccttgaaatagcagcactgggatatacttcatcaatctctaatagcaacacttggatatatttcatcaatctctctgtttctttcccgaaaaactatttttatattttttgttaattaatgtcgctgtggacttagctgactgcttcttgttataatttatcatgacaaatcagggaacccacacatttgagcaagggccaaaggttcatcttgctgaaaataacgtggtaggcagtgctggtgttggtgatgtctatgaatacagcagggaaatgaccaccatgcaggagttagtagaaaacacttactatgattgtgctcttcgtgatcaaactggcatgtgggtacctccatcggttccaccgatgacaaagcatgaccacgaggagtggcaaaagggctttggtgctaatggtgggtacttcgctgaagaagatttgtgggatatagatgaagaaaacaaggagatgacaatgtgggatgtgcttgctgcgatggtttctgcgggaaaagataaagtattgtctgttgtatcatatgatttcggaaggcaaggcatgtctctgatttcacatttgcttcttgaagaggcttgtaaggataaggctgatacacttgaagatgctagtgttggtctcgaacatgcactccttgaggcagaaccaacagtctggctgcctgacagtgctgctccttcttgcatgctttgtggagctcgttttcatccaataatttgctcccgccatcattgtcgtttctgtggtggactattctgtggtggttgctcaaagggtagaagcttgatgcctccaaaattcagcacttcagaacctcaaagggtttgtgatgtttgtggagtacgtcttgagtgtattcagccttatttgatgaataagatcagccgtgcttgtcagattccaacaaatgatttgacagacctgagcaccttgaggtcgtggttaaacttaccatgggcacgcacgatggaatatgagatatacaaggctgtaaattctatatatggatattttaaggtatggccatcctataattctaatacctgtccgtgttataacttggttgctttgcattcctctaatttttgtctggaactctgtattctcatgtatatcgccccaaaatgtatgttgttatgcttgtttgctttctgacaaatatgtctgcttaactaaaaattgttgactgtctatttttatcaagttcatgactatcaaattggtactaggaaccaactgaacatgcctaaaattccaattcttctgcgcagctgaactttacacaacacaaccgaaatcgcgtttgctataactctagccagctttagtccaccacatacttcatattcaaaaccattgcagcaaggttgataatccaagttcttaatttcctatcaaacctatactcagccaaaccatttttctttcaaagccttttcattagtcattatgttccttttaccattccaggccatggtgagagcttacatgattgttctattctatccacaatgtaaaaaattctggtgtcatgctaacaattattttcacaaaccagcatcacatgaagttttaatttgaacatttattagtgtgagcatttattctggatttcagatgattttgtaggtttaaatcccagcatatcctttgtagttcctgaggaagaaaataagtggtgtggtctgtatagcattttctagaagacccttttgaaattcaaatgaatccattccttttgcctttgacaatgttgagattgcactatggaaatttcaccttctcttttccagctacactaaggctgggttcgtttccaagttttcccaactcacctctctctttttccgtgcgcacgcttttcaaactgataaacggtgtgttttttgcaaaaattctgtacgaaagttgctttaaaaaatcatattactccatttttcaaaaaaaaaagattaatacttaattaatcgtgcgctaatgagttgctccgttttgcgtgcgcgagggattagttcccatccccaagtgccgaacacagccactaaatgctgctatgaagcattgttagctattcagtgttgaccacttcatatattcaattacaacctgttcttaaatttgtgagaccatgataaagttttaagacttttgtccagcttcttgttcgatcagtcattttggaatcagttagaacactaatcgcattttgtgtgcttcaatgcaattttaagttggaagtttgaaaccggagaagtcaatccctgattcgattcttagacaagcaaaaggacttgctataattactgtggtaaatgttggaatgatggtcacatacaaaattggtactggattggttgttgctcgaagggcggatggttcctggtcacctccttctgccatctctacttatggtgttggatatggagttcaggtcattgcaacggctcaagtgttcttgtttcaccaaagacatatgttgaacatatttatttatttatttatttattggccttgcaggctggaggtgagttagccgactacatcattgtcctgaggaatactgatgccatcagaactttcagtggaaatgcacacctgtcagttggggctggcattagtgcttctgctggtcatcttgggcgagtggcagaggctgatttccgtgctggtgatggtggttatgcagcctgttacacatacagttgcagcaaaggtatgattcaaacaactagcagctgaacaaaactgaacttcctttccattttaccattgtccgtgttggcctacagaagtactcttcctttcttcctgatttattcaccagcgcacaaacctgcacatgattaagtttccttgaataccagatagttcagggagtagatgcttggttctttgagtttttaatgaactaaactaatctgggagtgcgacgcattattgattgtgagctccttcacattttactttcttacatgtagttaaaagaaaggtaacttataattgttgataccactaggctggttgcttctgagcagctcttatcttttacctggtgctttttagccaaacagagatgggcagcactgcttggacttgctgtcaagaactagtttttgctacacactataaagtcaaatactgcacacatttgaattttgtgattattgtttagtccttaatttcttcttgccagtcatttttgttcaacataccaacgttgcttaaagacttttaaatatctgtatgatggtttgttgtttagaataacataataaataaaaggagttctggagaactttaaccacgtggccatttccagtagccacttactaattatagcttacaacaaacattcagacaacaagaatctgcatacttgtaattccgtgcagttcaatgaagtgagatcatgatggtttggaattgtagctagccacttcaaagtactacattcagataatttaataaaggataagtccattttacccccctcaactatagcgtttgtctgaaatacaccccttaacttcaaaaccgggtataatacacccctcaattcttaaaaccattgaaatcacacccccccctcctgtcctgaaatatggtggtttcgccaatgtgtggcgctgacgtgtcaatctatgtcagcaaaatatattagaaaataataatgtcccacatgtcagactgattcttcatcttcccttctctctctctcttcccaagccagcagccaccgggttggtcagctcgagcgctgatgccgatgaacgcagcagacagcgcaaagaggagagccacgccgcctggagctccccgacgccgaccttgaagcctcgtcgagctccaccatggaagcagatcgagcgatggcgagctcgccatgcatgcggtgtggttgcgctactgccactggtgctgggtgtagcccgagtccgggtggaagaagaccgt

SEQ ID NO: 91114 - DNA, 1141 bp, Oryza sativa
tgctcttgctggaccttctcgacgcaccagcggcaatggagtttctgtccttgcatggtgtaccggcggcggcggccgcccggagcatcaccgatccatgcaaaccgtccatagtgaaaccgttccaccgtcaagcgtgcatcaccgacggagacaagctgctcgcggcgcgcttcgtcatcttgctgttcgatcaatcaatcaactccagcggtatgcgattgcacagcaaaacgcatcgaaaattaaatgggagcatgcaatttcgatcgatcaattaaatgacgcgatcatcactggcggcaacgagctgctcgccggctacgtgatttgcagatccggagattcccattgattaattgcagaaactaggatagaaaccactcgcggggggggggggggtgtaaactgcgtggtattgaaagttcagggatgtaaaatacccggttttaaactttaagggtgtattttagacgaagtgaagagttgagggggggggggtcaaatggacttatccctttaataaatcaatacatcatactcaggtgcctggggagtaaattattagatataacataaatttaatttgtttatttgaatatttttgtacggagagaagtgagagaaatggctttgcagctttctgactgtgttgcttaataatcaaatctgactaaaagaaatgtaatggttttgaatcaaattaatagcattaaattcatgcgaattcttctgcaaacagtgattgctagaacagctgaggatcatcttcaatgtttcagcatatataaataatataattcagttttattttgaaaatgaaaactggaatgttatgaaatgcatgctgaaattttatatcctgctgggagcttcccccgacggtattctatgtcctagctatagatatgcacatgtatgctcaactcaatttctatctgtaatctctgttccattatttcccttcaccattttctattcttcttctctggcaggggcatttgtgggctgtgcactcaatggaagtgttgtatcaactcgacattcggcgaatgcccaattttatggtggtccaataaaggcatcagaaatccttcttggttcagtgagcaggccagctgctgccgctaccctctacaga

SEQ ID NO: 91115 - DNA, 2730 bp, Oryza sativa
ttgagtaaaggccgggatattatattctattatctgaagaaaagacgcagatgtcagtaggtctacgtctatgatgtggatttatcgtaaatgtgaaatgtaagacactaatagaaaaacgatttttcacaaagacgattacaatttttataggctgatgttatttttagctgtgaatatgcatgcgaagttatgtagagaaggatctaattttttcccgcttgcaaaaatagatatttttttactaacggacaacttaaaaggagccacctatgataatatttttatttttgcaggcagatctcttccacggcggaacaacccaaaaaaataaattttcaatttgttcttgtccccacatctccccaaccactccctatctatccttatcttctcctctacccctctctctctactagactatcagacttctctcattctcctctcaccgtcctctccctagagcgcacaatccctagagcgtacaaggaggagggctggtggcgggtcggcggcatctcggcgaggaggaggaggagatccggcagcggcggcggttcggcatggcgaggagggcagggtcaacgaggtggtctggcaacggcggctcggcaaggaggaggagggccaatggcagggtcggcgtggctcggtgcggagaatgtcctgcaacggtggcggctcggctcggtgagaccatgaggaccggcagcagatccagagttcctccgttgttcttctttctctagatctagatctgtaatttctttttttttctctttatttctgaggactatgtgaatcttgtttctcatttgtacagtgacatttgatatgtgaatcttattcttctcatttgtgtggtgatatttgatttgatttgtactgtgcttaatctgtgcaaatggtagctggatggggatatttttaaatatatttttttgcccaaaattatcttcgtaggcggtttgctttagatgtccatctacaaaaatctcatttttgtaggtggaccgcttaacgaagctgcctgtgaaaatgatcttctttagagaatgctaggacaacatcaaggcggacgtgttcttagtcttcaactccattttcaatctcagatgtgccaacctgagccttctaaattcaacaaacatcatcttgattccaaatattttaggccaatataattagcctgattcacaacattgccagaaatcctctctaagctgttttcgatgagactgaggcccctcatgaaatcccttatctctgtcaatcaaagtgccttcataaaggggagaagcatgcacggcaactttctcttcgtgagaaacattgcccagagatatcaccgcacgaaagggccagtgctagttttcaaacttgacataatgaaggcatttgactctgtctgatgggactacctcatggctttgctgcagcaacgtgccttccctccaagatggagaaactggttgggggcccttctctccacctctacctctcaagttgtccttattggtatcctagtgcacaggatccaacattgcagaggactccggctaggaaatccgctctctacgcttctcttcatcctggcttttgacccgctgcaaaggatcctcggtaaggctactgagctaggcgtgctcacaaagcttcgaggtagaatggctcgccttcgaacctctatgtatgtggatgacgctatcatcttcgtcaacccaccgcgagaggatgtcatagctcttaaggaaatcctatgacgctttggctcggccaccgaactcatcaccaatctccaaaatcccaggtggcggccatcgatatgagagcattgatctagagggagtccttcagggcgtcccagatgtgagagcgcacttcctgcttaagtatctgggactccctcttatcctcgatagaatgaagaaggctgacaaatagattgttgggcgtgtggcgaactagaggggaaaaaacatgggcctggctgggaggaccacacttgtcagagcggtgctaatggcatagccaatatatttattgacggacctaaaaatgtcaaaggacgccttggagcacctgcacaagtagcggcagcgcttcctgcgggctggcacttggaacatcatcagagagaaatgcaaggtcaactggacaaatacgtgcatgctgaccaggcagggaggcctcggggtactcaacctagaaaatttcaaatgggctttgtgccctcgttggctatggcatgagtggaaagacccgagcaagccgtaggtggggctggagacgccttgcgatcaaatagataatagcccttcgctacttcaacaaggataaccgttggtgaaggaaacatgacgtgcttctgggactccgcatggataaatgagcagaggccgagagatctcatgccactagtttacgcaatctctacaaaaagagggaagtccctacgccaaggaaaggaaaatgatgcttcggtcggggacttggccttgcagtcaaacccacaaatcacggttgccttctctgaccagcttgtggccttatggaccgcagtccgcggcgtgcatctagatgaggaagagtctgatcaaatttcttggaagttcacagctcacgaacagtattcaacatcttcggcctacaaaactcagtgccacgctacacctgacaccttttgacacgctgatatggagagcatgggcaccggggaaatacaaacta

SEQ ID NO: 91116 - DNA, 853 bp, Oryza sativa
cagtttaatacatttttactgctttccaaccactgttgagtaaccacgtccttcgacgtatgcagttgtcatttcgacaatagctggcgccgacgttggggacctccgagcgaaaccactgagagtaaatggcaccgaagagggtcgtgaaggagaaggttgcaaagcgaatggggagtgaagcaggagaggagatggccgccgaagagggagccgagccttcggcgccatcgttgaaactgggggagcaccgtcggcttcggcacctgcgccgcaaccgccaccttcagctcttgccacttcgtcagggctggtgccaaacacggtcgacgcggcgaaggcagctacggcagcaagggcgctccagatcagggcagagatcctttcgacgagccagctgctggtgccccaagccgcttcgtcacagctggcaacagcttcgaccgcgcttgccgctacgcaagtcaaccccagcctcgaagcacaagccgaagccgacatggaggccatgcgccaaaacatgacccgactccaagacatgcttcgccagatgcaagaacaacatcaagcgtacgagacagcacggcaagccaaggtcacttcggccccaatcctccggtattcggcaggctacattccaccccaagcctaaccgcaagcatcaactcaggcccttccgccacaagccatacaagcgccagtgtacttcgctgggcagccttcggccgcaacggtacacccgacccctcatgtacaaccgcagttcggccggtcgttgccaaagtacaccctggccaaatgtcacaagcaatggcggaaggggcctcggctttgcaggcacagcttcaagctt

SEQ ID NO: 91117 - DNA, 754 bp, Oryza sativa
caagtccatgatggccaggtctgataatgacacgttagtcatggaaaatcaatattaccatgggcagacataccagtttaccgctgcagttacatacaaagggaatgacaggacaatttccaagatcttgagaagccttgtgataatcgatgtctccggtaacgcattccatggtgccatcccagataccattggtgaacttgttctgcttcgtgggcttaacctgtcacacaatgcccttacagggccaattccatcacagttttgcaggttagatcaacttgagtcattggacctctctttcaatgagctttctggagagatccccaaggaactagcatcactgaattttctttcgacgttgaacttgtcgaacaacacgttggttggaagaataccagactcatatcagttttccacattttccaatagctcttttttgggaaacacaggtttgtgtggactaccgttatctagacaatgtgacaaccctgaagagccaagcgctataccatacacttcagagaaatccatagatgctgtacttctcctcttcactgcattgggatttggcatttcttttgcaatgactatcttgattgtatggggaagccacatgagaaaacgacactgagagtactttgtgtatgtatacaactctagcagtattgagtgaggccaatattcttaactgaagctatgaacgttctgatttgagcaataatcctgggactgttgtaacatgaatccctat

SEQ ID NO: 91118 - DNA, 3122 bp, Oryza sativa
acagcatggcaccgacgtaaacagtaacttgaccaaactctgaaggctctcctgggcaaaacgtcgaacagggtgcctgcacggtaaggcttgtcaaaattgggtaggcggatgctacaacccggcgtcctgagcacaaatcgatcggccgcaccacaccactcacatacctctagcctttaggcggaagatgattgctgagttcaggtgatatcagatcgccgcccgcaaatctcattcgcttcctgtggcaagcagcaaatgcaggagctaatctcccatctgtcacgcgggagagacctcccactcgttctcccctcacctgccgcgccttcgtggagacgacgagtccctctcggcgcccttctcccgcgtccgtggtccgccgccgctcggagggttcgggctcggtacgaaagttgttttctactccattcgtgtagctcgcgtggggagtggagtgtgttctttttttttttaacggaaaacagcgctagtgtgctttttcattgaatagagcttgagaaaatacaacccctaatgataaaaaaaaaagtcacggtaagctacacacgaacgcggaataaactgcaagggcctagagactagcctcctctttgatcttcgttaaaaggaaactcattgccatctctttgtggtcgaaaatctgtcggtttctctccttccagatctcccagacaactagcaggatcagagatcgaagtcctttttctgggacagcggacgtgtttgctaggttctcccaccactattgcacttactgggccttcccattgacctggttccatctattggtagcccacccagctagacacaaggtgccagattctcttggtgtatctacacgtggtgataaggtgcaaggccgtctcaccttctcgccagctagcatagggggcattggccgttgttttgccaacccctggtctggattttgttctagaatgctgagttcggcacccagacctagagttgggaacttctcacgagcacgctttttaaactgctaaacggtattttttttaaaaaaattatatacgaaagttgttttaaaaaatcatattgatccattttctaaaaagaaattagctaatactttcacgcgctaatatatcgctccgttttttttcgagagtgattcttctttagaaaccatgtgttaacttaagaaattcggctacagcgcaagtgtgaatcgaaatgacaaaatagcacagaaggcaacatttgtgtcttccgttagacttgagttgggcccacatattggtaaatgataccgtgaaatcaacagatttgttttgtttccttgtggttaaaaagggtctatttctacagacctatagtgtttcctatatgcgtactatagatatcttctgtgcttttaaaactctcactgataaatactgagaactagtagaacctctggtttctttcaataaataaacagtccgcaatgggaggaggtggatcaataatgtgttcagattttgattagttccagaagtactatgctgaattgatctgttgatttttcacatgttgattactgatcagttggtaaactctgaatttatgtgccaaacatgcatgccatttaacttgcacaacaatagagaccacaaacaaagaacaaagtgatataatataatgtagaccacgaacttctctgaatattctcaacctagcattacatgtaggacagttgtcttccattaaccatgatatgtaattcttgctgaacggagctgctatgctgctcttggagaagcatcgccggctcctgctcccagcttcactgccttgagcatccgcccagtttagtgttatcaaagcaacaaatatatgtggcttgaggaatacatcccaactgaagctcaatacataaagaacatagtaaaaatggtgtaaaccatatatatacattatttctgcacacggtccatcacttattctgcttttcctaatgcctgttcagttttaagcaattaaaaactgatatggcaaaccagaacatgtcgttcttcagttgaacaggggcagatagcggagttggtgctgccctcgacctccttcagatttattgacgcctctcggaaccgggttggtgacgcgtggggatgaacatcgcctgaaagcggtctccgaagtggccaccgccgtcataatcgggcacacaccggaggaatggatcagagggcgctagcggagctcttgcccgcgcgcgcacggcggcgaaacggggtgacaaatgatggacaagaagttggggaaagaaccgcctatgagagcggccgccggaggccggagcagattgctgcgtgcgctaggatgcaccgtcgagtaggagagcgatacaacctgatgattaatggatactcttctttactctttttcatttacgaagtagtactgataaaatcatactccctccattccaaattgatctacatatttcataggtataccaagaccaagaaaaactaataactctctcatactatatttactctagcaacaaactcgatgcatgcactatccctaatatttcctagccaatagcaaatcaagatattgcatgtgggttataaatacttgtgtgcatagatgtatgcatcaatgtccatttactctaatgcataaataacgagacttaatggattaacacaaatatgtagatcatttaggaataacctcaaaaaaactatatgtagatcaatttggaatggagggagtaaataccagcattaccatgatgattattattaaagtacttatatgtccttacgaaccaatggtctaaattgattctactgatagtataatactactagtagagagcttcctttattcatgggcttccgatggattatgctggctgggccgctggggaattttcgaaattttaatggaaactataggacaaatacggttaccgacaaaacggtcggaaaaacctccatcccatttccgctaccatttccgaaaaatattaccgtttccatttccgacaccgacaattactgacaacgactgaaatggtcggtgcaaatcggaaatggcagccaaagatcttggaaatttctataccattttcaccccta

SEQ ID NO: 91119 - DNA, 1584 bp, Oryza sativa
ccaaatctcaagcagtcaagacaaagaggatcaaatatctatggctcgatttcaaaggtggcaaaaacatttctcgaggtgctaattttcaaaggatttccccagaaagctcatttgacgagaggtctaacaattcaagttgtttcaagttagcaaactgaactgggattggacccgtaagagcattatgagacatgttgagagcacgaagcaacacaagttccccaatgcttctagggattctaccatggaaagcgttatttgagacatcaatgagtacaagtgttcttaaggtcttggaaatcgtcaggccactacctttgtatgagattccagcagtgaactggtatgactgcatcttgccacggtaatacagatgttggtctctcattaacatatcattatcacacgtgtccattatcattgatttgagcatcttgaaccactcttctggcaatgtgccactgaggttgttcgatgacatatcagcaaactgcagtttcgtaaattgacagttgtttccacctccagtataagaaggatccaatatctgcccaatgaacttgttagacttgaggaccaggacttgaagttgaggaagtttactcatccaacatgggaaagagtcactaattttattgtttccaatgtcaaggatctccagattcctgcaagcgaccaaagatcttggtagttgtccttgaatcgaattgccgctgaaatctaatgcgcttaatgcacaaccttccttgatattatcaggtaactcgccggtaagatgattatcctttagacttagcacctgcagtgcatctgcatcctccatcagacacgatggtattaagccagtcaaattgttgttagagagatcaatgagttgtaaactcttaatcctatcacagatggatggtggaatgtttccagatatgctattattggaggccttgaaaaggacagtatttgataggtaagtagagaaattgagaggcagagatgagaaccggttgttggagtaatcaagggtgacacttccttcttttggtataggtattaccccttcaatattgttgaaactgagatcgaagaattcaatgtaaacaggaagcaaagggtgatcagatccaatactcgtaaacttattatgtgataggttgaacaaggcaaagcctaggttcaaggtcttccatgcccacagaggtattgctccttggatttgattatacgaaagatcaagaaaagtaatctcatggagatgctgcaagatgttagggaagctagatatactgcaagatgctagtcgtaacaagacaatactagggtaggacactactgaagaactattttcaccatccatcacaactagtctattatttgagagattcagggcagagagattttgcattttggagtacgatgatagctccactgtgccaactaaattgtttgaatggagcaggaggtattgcaaatgagtcaaatttaagatctgtggagctatcactcctgaaaagtggcaattgtacagtgccaattttgtcagtttttttaagttccctatggaagctggtattcactactacagat

SEQ ID NO: 91120 - DNA, 1199 bp, Oryza sativa
ttgtcatcagtgacgggtcgtaagttacaacccgtcagagatgagtcctcagtgacggtcaggtagttacgacacgtcactgatgactcatctgtgacgggtgacaagttttaacccgtcagagatgacttatataccggtcagagatgggttatctgtgacgggtgtttcatccatcacagatgattttgtcatcagtgaccactaatcactgaccaagaccaaacccgtcacaggtgagggtttgggcccgtcaaagatgacctggtccggcgtaatgattggtccggacaagccacatctgaagaacttgataacagtaagagaagtcaggtttgagatccatgatggtatggatcctactagctctaacccatacacctctatataaagacaaggatttcagctgaccaatggaggagggcagcactccagagaaaccactagctccaagagccaactccttgagagatctaatgttgctgatagaacctggaattgtccctgaaaagttggtgttgctgacagataaactctgtgagctactgtcacctgagaaactactaggcaaatttccggagattcctagatgtttggtgaggttaatagttgtaagtttctcatgctggaagatgatgggagggaacaccccttcaaacatgttatttgaaagctgaagaacactaaggctggggagtgcagccaagaactcaggaactggaccagacaaatgattgtagtgcagctctatcactgaaagtgatcgcaaggccgagagcgagtggcaaatgggaccggagagtgagcagtacggcatgctaatgaccctcaactttggcgatgacctggccatggcgtcgcaccaccgtgcagtgccgtagttgctcgacatgttcaccatcaccatgcccaggcgaagctcctccaggttggtgaggtttgcgagcaaggtctccaagctcggctccgagagctgtgccattgtgtccgagtagtagtacgtgatgctgtactcgtcgtccaactcctctacaaaaaatgtcgtcgacaggtcaagatagttcaggctggtgaggcggccgatgccggcaggtaccagaccagcgaagtttgtgttggagaggtcaagatgggtgagtccggtgagcatctcgaaccctgtggctgggagcttggacttgctgaagtcgttggaagag

SEQ ID NO: 91121 - DNA, 716 bp, Oryza sativa
aattcctgcagccccccgactctttgtttagttgggaaacaactgaacatagagtcgagaattatagcttcttatcgtcgagtagtcattgcttgattgaagatatgtgttgaagatgtccaagtagaaatcatgaatgttggagagccacttgttgtagtaaaataacacggcatcgcatgccgagatgtcgagattcacaacaacgtcatggttggtgatgtagcaaaacttgtgaagtagcagcaatagagtttgctggtaccgaagataataaagatgaagtcgctccaccatgatgacaaagttgtgttgccgtgatgaagtgaacacgagtcggcggcaacagaagcaaaccggtagtgaagacgcgcagttgtgaagataaaagcactagtcggcggcggcataacacgagtcggcggcggaagacgatgatgtccatcagtagtggtagctgtataaaccaaatgtagaggcgagggcactagtcagcagcagacgagacgaccggcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccatgcaggcggtgacacca

SEQ ID NO: 91122 - DNA, 1343 bp, Oryza sativa
ttctgactgatccattcctgcagcgtaagagataagcgtaaagccatgaatcccttttatgcatatctggatctggatcctgcagaacaaacatataggatgagtagtatctgatataaatataatactcgagaaaaattcaagcagtttataaatacgtatttcttctcttgttaattttgatttccccgagcagatgactcattacgtttaaacactctgcccgactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaattgtttaaaaaatacgatataacatctatagcccccgactcactagtcaacggcgaaccagttgatgtagtgaggcaaaggaaaagacaaaatatcatataaagaataaaataaatgatgacttagctttgtaatattccctcggtgacagcagaagtagccgatgtgggaataaagcagtccatcaatggtgacaaaaacaccagtcggcgccagtggaaccaagccagtggtgtagatgatgaagcccattaacagcggcggagtccgccaaccgtataggcaaaaacaccagtcagtggcggcagaggcaagccggtcggtgaagtcgtagacgcccaacagcggcggcataataggccagccgtgtaggcggaggcaccagtcggcggcgacggaggcaggccggcggtgaagtcgtagacgcccaacaacggcggcataataggccagccgtgcaggcggaagcaccactcggcggtgacggaggcaggccggtcggtgaagtcgtagacgcccaacaacggtggcataataggccagccgtgtaggcggaggcaccactcggcggtgacggaggcaggccggtcggtgaagtcgtatacgcccaacagcggcggcataaaggccaaccgtgcaggcggaaacaccactcggcagcggcgaaggcaagccggtcggtgaagatgtagacgcccaacaacggcggcataataggccaaccgtgcaggcggaaacaccagtcggc

SEQ ID NO: 91123 - DNA, 2268 bp, Oryza sativa
tacaccacgttgaacaggccctaccaacccacctgaactacagtgcattgggtcattttattatgtgtgaggctaatcacggtgaatctggtcgatcgcccataaccgtgggcacggctattcgaatagttttactctggccagaggtgcacaactgtatccacaagacacaatccacaggcatgtcaccgtgcctgcgcagacacgtcaacatgtcgagtgattgtgacaagaccctacatataactctcccctaaccatccacaccatgctaaggtttcacccccaccccctaccccggaggtgggcagtcccctcgtgcgccgcggtgaatccggcagctggacaaccggacaccccggccgacccaactccatcacgcccaccctcaccaccggtgcctaggaaaaggtcgagctatacttcagatcaagcagttacccactccagcttgtggcaagcgctgtaagtcttccaaggtttcccatgaaccggtccttaattgccatgggtgcgactcgtaaaaccatgcacccacagcccaccactcagtcgcattttagttggataattacgaccatgaaacatggccagatgtcttgagcacacaactcattatgatactaaaaaggtctaatactgcaattatcccatcaactgagctagtggtaattaagcatggctaagcatatagttctagctaggtcacataagtaacatgagctagtcgatttattacccaaggttgacaatggacggttatcaagtaaacatgctacaaaagagcagataggtaaaccctgatcccatgtaattagcaaaacatgcatatttatttgcaaacggtaaagaatttgtaaattaggctcaatatgctcaaggggaatgtgtgacttgccttgcttcttcaaacaatcttctggactcttttcctcatgatcgcgggcttccgaaacgatggattgtacacgctggcatgcaaaacgaggaaaaactctaataaaaccaagcaaacagtacataaaaattaaacaaacatgtagatctcaattttagatgaatttcacaagttgaatggcccaatttggagttcgtatgaattagatatgaattttagaagttttgagccatttaaatgaatttctataattattaccgaattatcgcgcaattattaaatatttttccaaaggaaaagggacatgctgacatcatcatggggaggggcggcgccggcaagcgggccccgcacatcagcggcacaagaggataggcgcacggtggaccaagtccacacgtggccacgggtgcgcgtccaccacgtggacggcccagatcggcccgagccgatcgggcggccgatgggagcggcggccaggggtactggcgcggccgagaccggcctggccggccatggcgcggcggcagcgcgcggccaccggcagcagcagccggcggcacgggacggcgacgagcggcagagaggaaaaaagaggagggaggaggggtcctcaccgagggcggcgacggcgagatggcaccagggaagcggccgacggcggcacgggagtcgacgcgtctccggcggtgggcggcgctcgggaggaggtggacggcggtggtgcatcatgggattagaggagtggtgttagagaggacggggcagtgacatggccggccgaagaggaaaagaaaagaggaagggctcaccggcgcacgggaaaacggatgtccagcgagtttccggcaacgggaagtggtggccgaggttcttcctatccatgcggagccgagggaggcgtcggcatagagcgggatggacgggagtggcggccggaggcggcaaaaggcagtggcggctcggtttcttggtgggatggtgtttcggtggtggttttggggaggggaagcggatgctggggtgcggtggggtgtggcaacgctatgggtggcggtggcacgtccgggagaggcggcgctcgccagcgggaagcggctggaggcagtggaggcggcgatagctcgggttcaccgtggagagggcggctcgggggtggaaggggaggacggagtggatgccggggcgcggcatgacacggaggatcttttggcggcggcggcgcaacgcggcagcgactggagcggcgggaagcggcggctggaggcacggcagcgagcggcggagcgcgggctcgcgcggggagagcgggagagagcgcggggaggtcgggaaggagggggaaatggaagaggggagcacgggggtgc

SEQ ID NO: 91124 - DNA, 3673 bp, Oryza sativa
aaaagagtgcatcaccgacaacggcaaacaattcgattctgacaagttcagagagatgtgcgaagggttaaacctggaaatcaggttcgcttcggtcgcgcacccacagtcaaatggggcggccaaacgaacaaatggtaagatccttgaggcgctaaagaaaaggcttgagggggcagcgaagggtaaatggccagacgaaatgctatctgttctctgggcccttcgaacgacccccacaaggccaaccaagtttagcctgttcatgcttctctatggcgatgaagcaatgaccccaactgagctaggggctaattcaccaaggtgatgttctctggaggcgaagatgggcgcgaggtgtcgctcgaactcctagagggggtgagagtcgaagcattggaacacatgcgcaaatacgccacaagcacttcggcaacttacaacaaaaaggttcgaccgacagagctattgcttagccatctcgtcctaaggaagaaggcgaacccggtggcggtcgggaagcttgaattgaagtaggaagggccatacctcatcaaacataggtccaggataggctcctttcgcctagcaacgctggaaggcaaagagttcgaccattcctggaacgctgcttcccttaagcgtttctatgtctagaacgggtggcacccaaatcgccaacttgtaaaaaatgtacatactattgtataggccttccggcatctctcattatgtaagcctttcggcacaaaaatacaaaaaaaaagaggaaaatgaaaaaaggaaaaagaaactggatgtagggctattatccaccttggaggcccgaaccagtataaaagccttgtgtctttcgcacttgtgtgaatgataattcgtggaaaaaccccaaggcaaacgcctgatcagcgaaaacgccgggggggggcgaaacaaatcggccgaagcattgctcaccaagcgttgaaaccgcgatagcttgtttcgggaaataactaaccaacaccgttacactcgatccatgtgaaaacataagcgcttccttcagctcggaataccacagaccgaaaacgaaagacgaaagctgaaaagtcagcatacctatttcgctagtatacgcaaaggggccgacacagttcgacctaacgaaagcacgaaaggtgacaatgcgaaaaacagcgaaaaggaaataaaacacatctttattaacttcgaaaaataatcggaggatgcaatcatacaacatgatacaagtacaaatagcaccggctttacagcctagcttacaaataaattacgtctccacccccaaagcaatccccactccctaaggaacgattcgacgaacatggttcgtcgtcactactaatgtcatacactatcctaaggggggagggggggcgaaacacaaactagactataatgacgctaggcgatcgcttcctgacgatcagtcctttgatggtttcgccaaaagcaaaccatgtcctcccggcgttctatatggacacaatcgtagtcctccagggatcgcctggggtgcgcccgtatccagccggcaaccttcaaaaccttgtagctgttgccatttattatcatctcgcagtaaactggccaaaacggacatcgcaccttcagcaaacccttcaccgccacgaacttctcgttcttatttcaccaattcccaaagggaggccgaacaaatgggcgaaaagagtagacaccctttcgcacgcgaaaacaaggcgaagataacgcaatagttgactatactggagtcatccattcatcatatatcaaaaaggctgtttccggctacaataagaaggggagaaggccatcggccaaatttacatcgttcgccctccacggcaaatgccaaaagaaaactacaaaatctaaagagagggcggtgggcctcacacctctgggtgatcttcggcatcgcctccaccctctctggccgcagcatcttccccttcgccctagtccgccgcctctgcctccgctagttgctcaaggagatgcaccttggcagtggatcggccgtccctctgccagaactgtttacgctaggcacgaagcgcgggcgaaacgtcctgcgcactaacctcctagtccccattcgcaaagttagggaactcagcgacgtgctcacagccgaactgctgcaggaggcccatggtgaaggccgccgacatgcgtgcacagcaatcaccatatgcagtggcgcagtccgagaccgcaccgcgggcctgctgagtccactccgagaagtcaaaggcggaagcatcttcgctagggactccacgcaccctcgcccccatgtcggaaaggcaaggcggagcgtctggcaagcggtcttcacaaactcggttgccttcaccatctcccgcgcgaaccgttgcgcctccctcttggtttttgcctccgcttggctaacctcttggcgaagagcctccatcttcggctcagtgaggttgtagtagtcggtcagagcggcggaatgagtttgctctttttttagctcggccttgaggcgctcgatctccgccttcgcctcactccctttttccagttcagcctggagccgcttgttctcggccttcgtctctttaagggcgtgggcgaggccttccatttccaggctcttgtagcccagttcgtcgtccttggctcgaagacggttcttcaaaccgtcaagacgagcccgcatggttcgctcggtcaaacaatgggctgcgaggatctggttcgaagataagagagagaggacgaatgttaagacaagttgtcgaaaaacaacaagtaaaaaaaacaacacaacatagttaagctacgtacccgaaccaccaagctcttaatggcagagcatccctcgtcgaactcgtttagctccgtgaacaggctcgagctaccagctggggagacgagggcgctcaccccctcgacaaaagggataagttccgcccgagtctcgaaataggcaggggcgaaatggggcgccgcaagggagtaatccgaaacggatgtttcgatcgccgtcttcctccccttcccaaggccgagcggcaaaatgaccggctagcgaactgggatgctcaagaccctagccgcggtcttgacaacctaatcggccgaagccgaggtcccggcaacactccctcccgctccacccgcatcgatcgcggtgccaggagcagtcgaaagccccaagctccggccagtaggcgaagtaggggtttcatcggaggactcgtcatcgctaaaagcgcgaccgacctcgacgagccctatccttttggaggtcttcttgaccggaccccgctttgccaccttggccgacgcgatcgcgaccagtgccttcgccctctccatatcctttcggcgaaggggggagcagttcgactccaccccagtctcaacgtgctcggggcttggagttggagtgtagccaggcatcccggcgcgattgtcggcagcctcttccgcagccttttcggccgcaacttccgtctcccccacatcctccccctccactccgtcgtcgttgtcttcgacgatgtctttgtcatcggcgtcggagtcagtggaggcaagggcccttcgcttccgaggggccgacttcacttccccacgcatccgctttcgcgaaggacctgcggcgtcatcg

SEQ ID NO: 91125 - DNA, 1826 bp, Oryza sativa
gtcataaacccggttcgcccgaccagccgcctgccgtttgagcagctggctgaactcggtgaccgacacatcgccgatcatctttcgggcttcggcgtcggcctgatcaagagtcaacactgcgaaaacaaaaggtgtaaccatatcaagcgtcgaaccggggaaaaagggcgaagcacagatgcacataagaaaagcatggactcaccattcacccccgcaggcggaaccagcttcggcaagccgtcgacctcctcgtcttgatcgaccacaacttgccacgactgggagagggggaaaatgtgaagcatgcagaactcctccaccaagtcgcggcaactaaggcgggaacagatcttgcgcagcagggcgaaccgagcttccatggcaccgtcaacagcgaccttgggcttcctgttcggtgcaatcgccctgcgccgacaccgtagggctttcgccgcttcggacccagcctcgaaggtgatggagtagtagtaccacttcgccatccaatggcgatcccacttcgacatggcggcgttcaccagccagagatcagagcgttcgaggcgaacattgaagttcacactcccgaacgccgtcttcttcgtcctagccagggtgaccaccgtcttcgagttcatggtggcgaagaatacggcaccgaagagctcggcactcggttcgaacctggcggtccagcatgcctagtcgaagatggcgatccgaacgagcgccgatggactcagctgggggagctccacctggaagaggcgaaggatctccggcaaccacacgttgcatggaaatcgaagccccgcctcaaagaagatggcgaataccaccgtccggttgtcaccgggcttcggcaccatggccttccccggggtgaaggcctgctcctccaccaccacgccggagctgaccaacttcgccagctcatcgtcatccacgagcgaagcccctaaaaaggcggtagtgtcatcgtcgatccggccgggatcggggcccgtcgctgaggctgggtttggcttgcgaggagccatggcgaaaagcgtgcgctgtggcgaagagggagaacaggcgaaagatctagcaactcaaagggcgccgtggaagaaaagacggaggagggaaagctcgcggtgaaaatgacgggggtgtgggggtgaaaaaggggaaggggggaatatatagcccacccaggcgacggttcgccttcccacccaatcacgacccaccacgtatcataagggtaggcgaaacggtaaattccacttgaccgagccgcacagtgacgagcccacaaagaaaatcccatcactgtttatttcagcccagtgaaagaacaagaacagctccgccgttcacagaaggcgaaagctgcaaaacattactgcgtgttctttgcaggattccaacgttagtttcggtaggagcatcggtcgaaagggggcgcctcataccataccacacggtttgcacggtctcggccgaagctcctatctcacccttgcccgtgaggggcttgttggcgatatgtcatgagacccttcgaccagacctgccgaaaccatgcaaccagctagggttcaggctcaaggcgttaagcttatcagggcgaagctccatggcgaagacaatgcagcgaagacgataaatgatgaagcctcatggcgaagagcgtgcatcctgggcgaaggtcgaagggcgaagagtatacgccgaaggaggatgacttcgccatatcgaggccagctccgggaaggcccaaggggccatcccagccgcttcggcccgttggccattgggccagcgatcgccaa

SEQ ID NO: 91126 - DNA, 3048 bp, Oryza sativa
  unsure (1)..(3048): unsure at all n locations
ccatgcttagttcaactagtgcacaatggggaaaatcctattaatgtgtagactgttggttctaatggtattgttggattagtgccaccgctttggagttggttaattaaaatgaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagccgatgcatccaggcaagggtgggcgtgatgaagtggggcgggtcctgcgacggcctctgtcgcttccggattcacctaggcacgagaggggactacccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtttagtctaatgaaattggatagtataggtggatggttgggcctgtcgcaacgtggtatagcattggacactggatgaataatattgattaattatcacgactgttttcttctttaaacttctgtttataaatgctcgctttatgcaaatgaaccactctagctctcctttgataaatccctgcatcatacccctattccggtatgacttgctgagtaaagtgggtagtactcagtcttgctctattttccccaaccccagagtacgagtatgtgtcagatggtggtttctccgaggagtaggcttcgtccgtgccgtcgaggatgcctgtggagtggtgttcccgctgcagttcaagtcaaggcttagctccagttatctttcgtttttctgctgcatttatgtaagacttttatgatgtttgtaagacgtggatctgaatgtcaacattgtcgtttgtgtaccccggccggtcctggacggggattttaatgcacattctgcttggaattctactcaggaatttctgggcgtgacacaaccacactccacgacgaatcaggtaacatatttaaggtaaatggtcaacgcctaaagattttccttgagccaaaggaaactttagatgaagaagtggatgttattgaattaatcgattatgaaccatgatgattattgtcggtccttaaatcataatatttgaccgtcaatacctacatatagtgaattaaaacatggtatccaacttagtggtagggattattactaatcatttccactagtgttggtgaaatatgtgtatgcaggtattttgagaagaaaacacatccgtcatgtgacaaaatgcaccttcgcgtattcaggatgcgtttacacggattagaggcccaataagtcaataaaaatcatttagaattgggtcaaaacatagcccaggttatcgggggcccactaagcaacctcccagcagaaggagaggccgggaggacactttttgggttcggccgaaccaaccagttcaaccgaacctgttctgtggccgctcatcgctatcttccacgtgtacactcctgatcacgtcccaatggcagttccagggcattttggacatttcgcataggctgtaaccgtcatacctgcctataaaaggaggagctcactctcattctaagacacacaactttgagctgaattacaagaggctctattgtatctattgtacactagaataaggtagagagtgaggggaagctctggaggagtgccctgaagtttggcgcttatccgacttctacctcgacgagtgtagctgtcggtacactctcctccaggttcggagtacttcttctattaagtaagcattcgtgttcctttcttttgttatttaattatttagtctgagtaagttatatttccatctttgcgagttcattgtttagtattcatactaagtgctctattactaggactccggatagagaaggaagttcccgcgcaagtattagagtagtaattaataacttagacatggtgtctaggttagagattacctttgtttgttgtgtatcccacggatttgtcagaggtaagcggcaggtggtgacagccctgaattccgtcccagtaatcctccacgttcggatatatcatagagctatagccggaaccacgctggcagaccagcaggggtcggtgcccgaagcaacagataggaatttacctttgcttaccgtgcataattaaaacacatagaaagtcctctctagcctagcctacctatcatcatttgttgtccttggatagccttagccttaggtagattacacacattccctgagttcgatatcctttaggggttacccgaaggtgaagtgctatagcggtattccgggcgcttgcggatttatctgtggtcgtaagaaataccaacaagcatttctggcgccgttgccggggaacggttgctaatttatccgagtctatgtcatcctcgtatctttatttttatttcttcttcttttattcctttccttgatggagcaacccacaattcaaaacctttatgctcctcgggctgatctttgtgagccatcctgttcttcaaaaccaatcctttccgatggctacgaaatcggtcctagctttatagccatgattcgagagcaaaccttctctggtagtatcagtgaaaacccatacatccatcatcgggactttgagctagtgtgttcaggcctatccatcgtaggcatgacacatgaactgttaagtggaaattgttcctttttctcttagagataaagcgaagcaatggtacacnttctgttctgtcccaagaaattcccacggtgaatgggaggagcttaagtgcaaattctaccttgctttctttccattaacctgtctaattaatcttcgattagacatcctgatctcttt

SEQ ID NO: 91127 - DNA, 2554 bp, Oryza sativa
aatgaatggattcatgaagaaatatacctgctggaccaagcatggagagcaagaggcgcatgatgtcgtagctgaagaagtattggatcaggatgtagagaacaccaccgtagcttgagaaggcatgttcgtaccttctcctttaggtggagagaccatagatttggacactcaatgtctatctacaatgttgcatgacattgaagatgcagaggacaacgacagagattttgagaagtttagtaagttggtggaagattgtcagatgccgttgtatgatggatgcaagtcgaagcatagcaagttgtcatgcgtgttggaactcatgaagcttaaggctaataatggctggtcggacaagagttttacagaacttcttgaggtgttaaaggatctgttgccagaggggaacaatttaccgcagacgacatatgaagcgaagcaagtattatgtccgttgggcctggaggtcagaagaattcatgcatgtccgaacgactgcattttgtattacaaggaatacgctaacttggatgtctgccctatctgtgaggcatcaagatacaaaagagcaaagagtgaattgtgaaggaagtaagtcaaagaggggaggcccagcaaaggtggtgtggtatcaagcgaggcacatcgcctactgcaacagcggaatgagcacccgcatcggctgggcaccgcagggtacatcggcaaggaggcaatatgggcccaagaagatgcagccgctgcagcagcgaatgtccctgccccgttttcagacatccctgaacaaagagctcgcaactgggcgcgggcaaggggtaaggtcaacccggacggctctgtcacatttgagaacaaaagtgatgccgtcgtcaatcaggaactggtgagttcactacttaacctaactaatttccgttcgtataaagtacaagttcgtgtaaacgactattttcttttgtagttgggcttgattgctgaacaagcttcacaaagcgaggttgagtccgcgccgaggaggcgcgaagatgacatcctcacaaaggcgctcggaaccaaagaacatcctggccgaactcggggaattggtagcgatgtgccctggaagcatggactccctcagtacagttcccaatacaggaaatggaaagtctccaaggaagagagggacgctcgttgaaggccgaacttaaggttgaggtcattcaagaactagaagctagcatgaatgcaagggtggaagaaagggttaacaaggtcctcgccgacatgaatataccccgagtcacaacacctgctgtgcaaccaactcctcgtgcacaacacgacgcgagtccgtcacagcataggagtagttgtgcatccacagaggtgccggcccctggtctcccgatcgcaccactagctgcagtggatcacatcgaggtaattgttgttatccgatccatatgtaataaaagacatttacacgttccaatattaaattcaaactttcaccttatgcagggtgcagcacagtgtgtcatactagcgagagtccacccaacttttgctcctaaagtcgctgagggcatggctttcaagccctcggttacagacaaggtccacggcgcagacctgctagctaggtatgccaaggtgtccatcgatacagtaaaggacacctggtcaggctatccgctgcccgtgcccccaaatgatgaactcatgactttgggcgatgcgcgcaagacgttcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgcggcaaggggaaggtcggggagtggcgccggagccaaaaggggcaaggctgcgacgtcgatgccggtgagcaaagcggggaaggtcgtgagggcgccagcccaatttgagctaggcatgccattggtggaggacaatgtgttagccgtgatgggtattgcttgccgagagctacataagcaatacatggagctaagcaatgccaagcagaaaatgagagagtcatccatagttggacgtcgaccaccagccgttcctatcgtcgcctgcctatataactataggctttgatgacctcttcgaccttttcaggatccggaagttgaacactggtcttctaaaatgctactccttgtaagtgcataccttctatacttgtgatatgattggactatatctcctaattaaattagttctaatacataaatgttttatggttgtgttggatcgagagtcgtcgccttggtaatcaggttgggttccttgatccatccatggtgaacgaggttaatttacgacagagcttcactgaggtggttgactatgtcaaccggtgtttatgggcccatcaag

SEQ ID NO: 91128 - DNA, 805 bp, Oryza sativa
ttagttgtgtaaggttgccaaccgatggtggaatctccccactcaaattgtttccatacaacaacagccggtggagactagatagctgaccaatatcaaaaggtatgttgcatgtgaaaatgttacctgccaactctagtacagttaatttgcgaaacctccctatccctgcaggtatggtcccaaatatttggtttcctccaagtccaatccatatgagctcttgcgagaggttgacaagtgtattcgggataaatccagaaagcctattgaattgaagatctagtgtcactagttcactacagttggtcaaggatgtgaggaaatccctgtcatttggtgtcttagcttcaagaatattattacctaggtttaatcttgtgattgtgccggagctccagatgttcggtggtattcgtccttgaaatttatttccatggagttgaagatattctagtttggaaatatttgacaaagagtctggtatcgggccttcaaattggttatagattgtgctcaagaaaactaagttaggcaacttggggccaatatccatcggcaaaaagcctgatagcatgttcaggccgatgtacataatttcaagggatgtaatattaaacagctctgggggaaacacaccttgtagcttatttcctaacaagctcaaagctaaaaggtttgttagcccagctatatttgatgggacatatccatggaagacattaccagcaacgtttaaatctgtcaaattagtcatattgccaatccaaggaggaattcgcccattgacatagttatcagcgat

SEQ ID NO: 91129 - DNA, 547 bp, Oryza sativa
gttgtcctccagtggctcgccgtcaccgttcgccgtcgttctcctccgcgccggccactctcggtgaggcatacctcctcctctattcccctccctctccctcctagccgcgccgggtcgagccgccgccccggtcgtgcgccgccgcttttgcgccgccgcctcccgccgctggttgccgttgccggcaacacgcgcgcgcgccgccgaccttgccatggccggccggccggctttgtgccgagccgagccgagccaggccgccgccgcaccgtccgatcggccccgggccgatccgggccgttgatcccgtggaccggcggtgaaccacccgcgtggtcccggtccacggtagaccggcccctgtgcgccactgacatgcgggccccgcctgtcggcgccgtccccccttgatgacgtctgccctgggatttatttcgcaataaatgatttaaggacttttgttatagtaataaatacagtgaatcttctaaaattcataactaattcatccgtgctccgtttaagcccattcaagtcttagtaa

SEQ ID NO: 91130 - DNA, 722 bp, Oryza sativa
cttctgttggaaataaattctagcacaattgctttaaattcgttaccattatagtctaagctgtcacacaccgtgacaaccttaacaagtttccgatgttgtatcctcctcaaggcatcgcactcagcaaaaaagccctgtgtttgtcccttttggcgaagatcaagtactttcatggccaccgtagctgaattcacaccagaagttaaattccctttatatacatatccgaaacttccacggccgattaagttttccgaggacaaggaatctgttgcagcatataactcaacatatgatatcctaggatatttctttatgagaagcgatgtgatatgctcttcatgatcaatatcttttgggattgttcgttggtccttaatgaaatagaaagtcactagacatgcaaatatggtaaatcctccaacaacacaaatgatcaatataagctgcacttggtgctttgaatgactattatgagcaagagatgatgggcattctgaaatccaaagtataaagggcctccgcatagcatatcattactcgagagtgatacagcagtgggattacagaatattcctttatttggcacaagaccagagaggttgttcaaggaaaggtttaaatgcttaagaccttggaaattcccaagaaaatcagggatgggtcctgataagttgttgtttgatagatcccagtcttctagtcctctaagtgtactg

SEQ ID NO: 91131 - DNA, 630 bp, Oryza sativa
aaattgatctgtaaacccgcaagtttctcaaatgtacggggtacaagtttgagattttttgcttcatcaagatcatgttccatcaagagaattgtgtcatcaccatattgcaaaattgagaagccgttgtcaactagatgaggtatgactccctgaaatctcctctgatccttagccctttgtattaagatagatagcatatctgccactaaattaaatagaattagtgataggagatctccttgtctcaagcctttttttgtttggaaaaagttcccaatgtgatcattgaccttaacagcaacacttcctccttaacaatttgttaaatccagttacaccaagtttgcgaaaatcctttcatcctcaaggtttgttgtaaaaaagtccaatctactttatcatatgctttctcaaagtccaattttagaataactccactcctcttttttctatgcatctcatggattgtttcatgtaaaattaccaccccttacattatattcctccctggaaggaaggccgtctgtgaagatctaatgactttctgagctactagagctattcgattagtcattacctttggaaagattttgaagctaacattcaacagacatataggtatgtatt

SEQ ID NO: 91132 - DNA, 3805 bp, Oryza sativa
agtggtagatcgagtaagcaaataaaaaggtgtcaaaggagtaagaggtagcgactgatgtgacttttaagaactatgaaattattagaatcacgggaatgatagttttaaataaaatcatgtgtaaaaatagattattttaaattgatgctagttgcgcaattgcgcgggttgcccaactagttttttgaaagtagaacaccatcacataaatttggatgctttaatacacgtttctatatttttaggagctacatgtgaatttttcaggggatacatatgaaacggtcacagggaaaactaatttaagttttgaaccatggctaactggctgcgtgtatgttttccaaattttcattttgcttattttcacatacttatcccttaccatatatccatttttttgttctacaattattattatttatctccagagcaatagaaaaagaaagcaacctacatcttcaggagcagcaaatagtactggaacagggaatacagttggcccttcaaccaattctccaccatctactccatccacgcataccccaggagatggacttgggatgcctggcaatatgcgccacgtcccgaaaaatttagtgatgtatggtgctgacggaacaggactagcatcctcttcaaaccaaatggttacaggcttacaacttttctcatttcattcaagatgtttagttggatgtatgtaacgattatttgtgtcagatgataagcatcgtattttctgtacttaacaggatgatctcgagccatttggtgatgttggctctttggaagataatgttgaatcattcttagccaatgatgatggagatgcaagggatatttttgctgcacttaaaagaagtcctgcagagcctaacccagcggcttcaaaaggtaataccctgatgttttccgtattctgtaaacatgaaataacacaccttttggtttttaggttttaccttcaatgaggttaattgtttgcgcacgaacaatagcaaagttgtctgttgccatttttcttcagatggcaagatattggctagcgctggacatgaaaagaaggtatcagtaaatggacttcattttacactgctggtttttgtgggtttagtatggtaacttgtttgttgtctcttaggctgtactttggaacatggacaccttccagagccagtatacatcagaagaacacagcctcataattactgatgtccgtttccggcctaattcttcccagctggcaacatcatcctttgatagaactattaagctgtggaatgctgcagatgtaagttatgtttttgtatatgtatatgaaagtggcataggagattattcttcctggagcaatggtacccacaattagtgacatgcactttcttttaatgcactggtcattgcaataaaattttcacaaatataccatatcactaatatctgacagcacaaagtatatatttgtggtcacgattattagttggcattgagagttgagtatgtccaacctattaatctgaagttccgtatatgtacttgcatttaattttattatgaaaattgttgttttgcagcctggattctgtttgcatacgtttgttgggcataatgtccaagtcacatctttagattttcatccaaagaagacggaccttttgtgctcttgtgatggcaatggtgaaatccggtactggaatctgacccagcttagctgcatgcgtgccatgaaggtttgccatcttctttttgtttgcttaagacgttttcggcaccttttgtcttatgaagaattcatggtttgtatggtctaggttcatccatctgattctgtttttgttggacagggaggtactgcccaagttcgattccaacctaacactggacagtttctcgcagctgctgcggagactatggttgccatttttgatgttgaaacgcacagcaaaaaatacacactacaggttctgttcttgaaaatcaataacacatctatgattcagcactgtttgttgtgtaacccgcagtggatgttttcagttatttttgtcttttcctgtagctgaactagctttttcttaatggaaaggggaggagctattgctcttctgttttttttttaaaaaaataaaaaatctatgattcaaaacatgcacatctttatttccatgttttgtagtatacctcttgtttcagaaggggtgggaacctgttgtttatccttttttgcctgtgatcttgtatctgaagtctttattatcacagggccataacacagatgtgcaatcagtgtgttgggacagcagtggggagtaccttgcctctgtcagtcaggacttggttaaggtctggtcaatatcatcaggagagtgcattcatgaggttagctccaatggaaacaagttccactcttgtgtgttccacccaagctatgccaatctccttgttattggaggctaccaggtaactactgattttctttcagtttagccatatgtatgtaaaatttaccctttttttccctgaaagatagggagagacatgtttctaacaatcaattttagacatgattccttttttttttcatcttgcaacatcccatggtcatttttaacaacgctgctggtttaccaacgccacaaaaaactatcctagtgccagacctgccagtgacgcaatttcttgccatatcccacgttatgcagtggcatttcattttttggcattgagttctccgccacaagaactgtggcatggctctcatcagaatgctgtaatatccaagccaaggcatagtctgatatttggtttggaatctgagaatcgttacttctgatgaacactctgtaccttgtttgctgtaaatttctcatggacactgtaacaatgcagtccctggagctatggaacatggtaaagaaccagagcatgacgatacaagcccatgaaggtctaattgcggccttggcgcaatcgccagtgaacgggacggtggcttctgcgagccacgacaactctgtcaagttgtggaagtaacaacaataacgtacctagagataagaatagctgttccaggtaattgatactggatttcttcagcctaggctagtcatagaatggaggtgagtttgatgtactggttgagttgtgttactatctcagaggcaaataaggaagagtaggagccgggcgattgtcgcggttgagctgttcagtgcgtattgcagtgagtttgtgggaggggctgtttctttttttttttttttttttaccttgatgatagatgttgatgtagcacaaaaggaagataaggaacgaaggcctaaagttggctctctgtttcatgttgttaatgttctagtatgagatgtaaaatgtaacaatattcggtgttttaatgggaactcgctgcaatttgtccggcggttgatagatgatatataagcccccgagtcttgagattatgttgtacagtgatgttaacaacaagggactatcgcaggcagttgtaagtttctgcaggcagctatgtacgctgatgtttaacagtctgtacgtttgttctgtaaagtccagcagatagtgtgacggatgatcgttatcagaacgcttccatgtgcattcaatccgactctatttttagcagacgtgtgaaagacagcctgtgtgatggacagcaagggaaacaattgaagaagcaaatcttggcatttaagcagatgtcaggagcgttgatgccgctagcatgcggctaaatataatatcagtatgtatacaaggcagactaagaaggcaggagcaa

SEQ ID NO: 91133 - DNA, 522 bp, Oryza sativa
ctggggtagatgaaggagtaccagcggtcgaggtcttggcgggctccggcggccagaggtcgaggccaccggcgctgccgtcggcggcggcgaggtcgcagaggaacttggtgatctcgatgctctcgttgcacaccacctcccgccgctccgcgtcccacagcaagggcaccgacgccctcccctcgaacccgccgcggcgtgcggaagcgtacacctcgcggagcttgcgcttgccgtagagcgcgtcggggctgtccggcgtgaaggaccacgcgccgtcgtcccccgggacggcgacggagagcgggaggcggcgctcgaggccgagcagcgcgcggacgaggagggcgcggtgagcccaggggcacgggaggccgacgtagaggtggaggcgcgcgctgggggtccccacgacggcggggaagcgggacggggtgcgggtgaaggcgccggtggccgggtcggagggggcgagctgccgcatgaggaggccccacgcggcggtccagccatggcgga

SEQ ID NO: 91134 - DNA, 906 bp, Oryza sativa
tgcacccccgtcgctaccaccacacataatcggagcacgaatcttagtatggatccaactaagaacaaattcgactcaaattttttagcattagatgtgacttaaatataataatcccctccattattttgcttacacaagatataatcagtatatgttaccgtacagttcctactaacgctactactactgctcagttttacgagtaccatactacaaggttatcactgacaaaacagagttaagcaacacactgctcactgtcactactacatacaagtggcctggtcactgccggccgccggcgagcggcggcggcggcggccgctgcagcgcgagctccgccgtgtccttccacagccgcgcctccatctccttctccatcagcctccgctccgcccgccgcagcgccgactccagctccgccacccgctccctgtccctctcgtgctgcacctcgcgcagcctcctctccagctccacgccggacaccccgccgccgccgctgccgccgtcttcctcgtcgccgccggcgacgaagccgaaccctccctccagctcgatgaactcgccgtcgtccgaccactcctcttcctgcagcggcttcttgatctcgacctcgccgttggccgccggcgaggaagccgcacggccggcgctagaggtgttcgacgaatatcccgaagcgagacgagtcgagatcgacgacgacgacgacgacgtggtgcgaagctcgcggcgcgcggcggcggcgatgttgcgcttgcagatggcagcttcgtctctcatctcgctgaggagcgcctccatctgcgcgcgcacctcggccatcttgttgagctcggcggacgttcttgccaggaggaacagcaggctgagccccaacccggcggccgcctccgtcgt

SEQ ID NO: 91135 - DNA, 4678 bp, Oryza sativa
tatcattttactagaattcagatttttcacatattggcagaaatctatctagatgaagatgcctctaggtctatcattttactagaattcagatttttcacatattgggcatatatatacctagattgttgaatctcttttaggctcaaagatacttactatggagtatatatgttcctgttaacattaaatttaatatcaaaatacaatttggtatttggtagtcgacacagtcaaagagtatacggactgaatcacctaagaaagtgagccatgctgcatcaatggatccttcaatgcatgatggatatccagctgtaggtgcacgggtagatcactttataattaggcatttcttaaattgcaatttacatctagattcgtacgagtagtatggaataacatcctaaattctaaaaaaaaactatatattttaggacacaggtaattcatatctacttcatcctatagttcagaatagaggtaatagtaccataccagcatacattttcatttttatcctttgtcctaaaatatagcaatatatgactggattatatacattttatatcatctgtctaaatttattgaagtaagatgtgtctaatccaatattaagttgctatacacagctagtccctttgtcctaaaataagaataacttacaacatccgtcccagaatataagaaacgattattaagaaagtaggtaaaattaaataaggagatgttctgattggttgagaaatgtcgaggtatgtggaaaaagtgaatggagggttgtgattggttaggaagggaatattagtggagaaattgttagattttgagacaaatcctaagtgctaaaaattgttatattttaggacgaagagtaatttctacggttcataccctattccacagtaaattgatttttgctcttttagctttgtacttggacttgggattactaaggtctaaggtctaaggggttaaataggtaggcaaaagatggtcacaagtgaaaaggaatgggattggctttgtgcggaggaaccattcttgaaacccgcaatacccattccttaaaaagtactgcaaattcattttccctctagaaaaaaaatttgtccagcgtgagtcaaaagtaatacttttttctatttcccttcacgatcaacctttcggattttagaagctaagcaacccggtgaaaaaagcaaccgtattaataggggggctggctgctcacttgaaacaaagagctgctctgggtccaagaagcgaagggaatgagcttggcttctgctcctccacgcttctttgggcctgtttgaggtagcttctagcagctgcagcttcttccagagtcagaagctcccctaaacagttcagcttttggtccagattctgagaagctgtagttgagaaacccagttttttcagattctgagaagctggctaccaaaccagctgcttcttataatcttaagctctccaaacagggcctttatttttccgtgccctttctgctcgtgcgaattcacaaactaagaagttttattactttaatacccttatctatcgattcaccaatagtaatttttcttttcattttgtaataactttttctccttttaaaagtgccttaaaatgtaaggggtggttttttttgggtggatgataatgggccggatactccctcccctccattcccgaatataaatattttgagcgtttaaatttcattcataatttggtttacaccatcagacgttatttttccgaatcaagtaaacttcatcagtatgtccctaatttcaactcaaccttaatttgtgttaaaaaaaaaacccccttgaaatgccttaggatggtattttgttactttttagctgtcatattattgtaggcattgctacggtcaccactgtcacttctgatcattgtcgttttaattaagtaaaatatgttaaaaattcagtggtgagtattttgttgaccaattaatctagcaggatttagaactatcattttccatgtgacataaaaaaaaactgtgttgtcaaagtgttgggatataacggtatatatatgtgtgacaacggtcttcatcgacattagtacatcacattacatcgttctctctttcagattatacgcagctgcaaaattcaagacataaattttactacgatacttgagtaatgtgaaagttctatgatcttaacagggcctcaatcttggcgcggctggagacggacactgttgaataaattggaactgatcgaaggctcgaagcacagattatactagtatacacgagttctagatggatgcatgttgttagcctccagatatcgtgtttatgttcttcctgtctctacaaaatcttttctctgtatcctccaatgtacagttatgcttttttatttaatttgttttgatttctgtatgtataaggattgcctcatgatcacaatagtgtatatgttgtatatatctatcaacaatgtataccaagtttttccacataaccttatctgaagcatcctttaataattcaactcatatccctgatgatatacacattggttgttcttattatctgcttttaggatgaactcccagaaattggcaatttgccagagatatcgaactgaatcaaattagtgagctatgtaaactctgagataagccgtcggtcaaaagggatttcttcagaaacctatcaaagcttcgacatcagcatgctcgcgggtgaattttgagggggagaactttgcctgtgaagctcctgcaataatcaagataccatcagggatatgtatgtgatcatttttgtcagaatcggaaaaaaaaagttgtttcatccagctatttatatttgatatggatttttcagaatgttccttcctcattctgctaatgatcataaatatgagtatctatgctatcatatggttgtttttttccaatttcaccttttccttttgcttaagatgtagaagaagttaatcgataagcgattggatttttaccttggtattggaggtcttcttgatgaatcctttgtcttccagggacttcactgcttcatacaggtattcatgcacaggtgtgaacttgatgcctagatccttcagaggttggtttgtgaacttgtagcccttctttggtggatttatctcatccctgcacctgtagaagtaacatgtaacagattagattgggcatcaaccagaatgtattccactaagtataaaaacattgtttagtaatctacaaggaattgcggagttcagacatcacatatgttatatcttgaaaacaatcgtgttattgtctttcaagcaaaggaaagctattgttgtgtcttcagaattcatataccactttctattttgtccacaacaataaattgccatcacaaggaaatataggagggctttattacgcacaggcgcacagtaaaaggaaagaataatttccactgcgattcatagtttgagttatccaaagtactaaccatggcattctaaaatgatcttcaagccactgactaacctgagattcaagtacctcatggcaagtcactagtgcagtagttcttcagtttcgatattaagaatttcagaatactatcatataatgcagaggtagagttttggagaaagacccatgtcttcccttttcttttttctagatagaaggaaaactatcatacacccaaccaaacacatcctaattgtgcaatccagattagttgactactggctttctgacaaagcaaattgcaaaccatgggaaatactagttctcaaactctctagtccctactgcctttggtagtacatagctgtcagcatgagtgcatatttggctacttgacaagttgacattctgcaattgctaaaaatcgagcaaccgaacatagctaaaaaaaattgatcaacaatcacaaaattccttatgaatacagccttggtatgaaacagaaagatcaatcagaattgctgttagtaccagtttggatgtagaggccggtttaatccattatcaaagaaaacaaaagtaccttgtagggatcggatactccgggaagaggccggcgaggatccggcagagctcgccgcggtgcagggtgcgctcggcgcagatgtaccggcgtccgccggcccccggcgcctccagcaccctgacgtgggcctcggcggcgtccacgacgtgcacgtaggcgtgggactcgttgacgtacgtcttggcctcgccggtgaggtacttgagaatgtgcttggtgctggtgttcatccctggctgcagcagctcgccgagcaccaccaccgggatcaccaccgccatgtccaccccccgacccctcgccacctcccacgccttcctctccgctatcgtcttcgcgtagcaataccaattctgccattccatcatcgcaatttgcacatttgttgattcgcaggtgatcgagaaatggggatttaaagtatccaaatctcaatctttgcaatgcaagaaatggggattagaaaaccccaatctttgcgaggaatggggattgaaaataaaaattcagagtcttctgccatttcattccattgcacaacttgtatgagagaaaaaaatggggattgaaaaaaaaaatcaatcaatggaagtatggggattgcaaaaaaaaaaa

SEQ ID NO: 91136 - DNA, 1086 bp, Oryza sativa
ccgccgccgcacccacacgcggcgccgcaccacatgcacgtcatgcccggcgccgccgccgccggctacgccgaccagaccgagtgcacctccggcgagccctgcaagcgcatccgcgaggagtgcaagcccaagatctccaagctctacgtccacgccgacccatccgacctcagcctggtacgaatccccaaccccaattaacatccgatcatctcatttcatgtgcctaacttaacttctttttgttctgaattctagccttgattaattaattaatcctgttcttgcaatgaatccatgcaggtggtgaaagatgggtaccaatggaggaagtatggtcagaaggtcaccaaggacaacccctgcccaagagcctacttcagatgctcatttgctcccgcctgccctgtcaagaagaaggtaacttaaattcctctaactaattccaaagtgatttcgtaagttttgctaaatttagtgcaaattcgagcctgtttctgaactttgttcgtggttcaaatgttgtttcaggttcagagaagcgcggaggacaacacgatcctcgtggcgacgtacgagggggagcacaaccacggccagccgccgccgccgctgcagtcggcggcgcagaacagcgacggctccggcaagagcgccgggaagccaccccatgcgccggcggcggcgccgccggcgccggtggtgccgcaccgtcagcacgaaccggtcgtcgtcaacggcgagcagcaggccgcggcggcgtcggagatgatcaggcggaacctggccgagcagatggcgatgacgctgacgcgtgacccaagcttcaaggcggcgctcgtcaccgccctctccggccgcatcctcgagctctcgccgaccaaggattgacgattgctactgatcgacgcggcggattcgatcgcttcttcttgcaactgcgggcatggccattgccatcctctcctgtctctgcctctctgttcttggtggcgccagcaagaacacgatcgacgcggtgtccatccatggcggagttcgatcgatcgattgatcggctagggaggaattgatgattcgctg

SEQ ID NO: 91137 - DNA, 3107 bp, Oryza sativa
cctccatgtctccccccttcttctccgaccagcaacggccatggcagcggcggcggtcgaagcttggatcgcaccggggatgcaggtcttcgctgcggaagacgccgccgccggagaggagcccggagggtggagaggagagcagcgacgccaccggcaatgccaagcccagcatccaggtccgtttcccctcctctctgctccaagatttccctctcgtagaggtgacttctctcatgtggttttctcatgtgattccatgggtggccttcctgccctggtctaactgatgaatataaatgcaaatgaaaattgcacacagttgattatttattttttttgaacgaatcgacgaggctgccaatttcattgaatagaggagacgaaaactgtacaaaaaggataaggtacaggaaaaaaaaaacagggccgtggccctaactataggcagttacattgtcaaccaggcggcgagattttttccgcccgccaacccccatgtttttcttcctcctttatcttggctagcagagttagcgccggcaactccttgtgctggaaagtcctccggttacttttgttccatatctcatagctaaagcacacagttgattagaggttagctcatgtggactatcgtcctgcctcctgatggagacttatattgtcgttaaatgccctgcgatatgaatatcagcatcaaatgtgcttcttgtttactgttcaacttggtttaaacatgttgaatgctgactggacaggactagatatgaggcattccaaacttagttgacaggcattgttttgacagcgtaggtggtttatgaaataatttatccttttcctaatgttgactgccactgaactattttcattcttttcttaatgttgactgccactgatctaatttcatcgctccacgttgtgtcaagacagatgaagtgggatgtgacaggaggggagttgttttggtggtgagtttgagtaccagtggtatatatttttgcattattgtgagtagtcttctctagtaaattactgtttcagaaaatagtttatttatctgtttgggcataatttacaatgtcttgggactaaacattatcatccactgtataatatttctttaatgatgacttggtgccaccttggcaccttctcattttcctgattctttccagcaaatctactatttttcctagtcatttgctttcttaacttcagtacattcctcatgcaccagcaaggccaattaaagggtattgttgttgcatcttcttttttgtctaacttttctaataagatcttttcttctttgctcaagtggatcactagctgattggacgtttttttttatctctggcaaattgtagtttttagaaatctagaattcagcgcatagtttcatgcaggcagattggaatgattatgcgtattccatgtccacattgcggtcttcattaggcttaggtatggtgtcaggacctagtcataagttattctcagtctgcatatgagagccaacaacaaatatgcttttgtgtctttaatttgtagcctcctatttatgttagttctttagaccaaaaaatatcaaagaatgttctttgaatagtttgaataaattttacatgacatctgacataaacaattgcacttttgtcttgatacaaacagaatatcttttattctgttctgatgtcactaagaaaatgatttatatgcacctcaatgttgacttttaaacttgtccttttgtctctactaatactcccttatgtccttttgtcgctactaatactcccttactcccggtgaaaaaaaaatgtcatgtagttccccttagaccatcgcatttcctcgcttgtttgatatcgtattcctaaccatttaaacatcatattgttatctagtatctttcatacaggttatttcatttcctccaaactatctcttgtttttctttgctattcttggctacactctgtggacgatgctagaggaatcaatctgtcagtggtcatgactttgcttcttatgatcttatccaggttttagaggaaaaataggaggacactaggttatgaacataattatttgttcttttgtttgtatgttgtttgtatctggtattattgtctgaagaaaatccaagttatgattaggtttatgagggccttgtccagggcctactgattagaatttgagttccttttcatgccatatggggttggtacgatgtgatcctaaaatggatatttttcttctatggacttagtttaactggccccatcaaattgatgtctgaaagtttctttttttttaaaaaaaaatcctgggatgtatgaatttaatatatcatatgtgatcttgtgcaagatgaaaaaattgctacaatataagtaatcacacccattttttattatcctttgctttctgaaactttactcattcagtcaatgatagttctttttttttttcagaccagagaattcttcagatgtaattgttccctttgaattttctgattgatgacagcaagagaggacccaagcacaggctgtctgaatctgtgatttgcacatgtgttatttttctcttgttacacagttaatctggtccattttgatgatggaatcttcagggtttagacttagtaggaggcaagtgctaattgaacttactacactattggggtgtaatttttttttatctatattccaagctgcaaatttgcaatgaatttctttttttttttttgcatccatttgcaaagcttgcagctcacacacgtcatgtatggtgatgtatttacaacgtcgtcagaataccaaaactgaatggagtttcagaattcccgagggtccacgaacaggacggacgacggcggcgccgtcgtccagtcgtcgtcgtcgccggcggcgggggcggcattgccgttggcggcgacggacgtgattttcttgatgcaccagacgtcctcgtcgcatgagaagcgtcgccagtgcggcacggcggcggcggccgggtcgtcgggcgcgacgtcggcggcgacgacggcgcacgccgggttgttgcgcgccacgttgtgggcgtggcggcagagc

SEQ ID NO: 91138 - DNA, 659 bp, Oryza sativa
aaaagtttcaacaaataacatacatgggacctatttggggtagcttatagctgctgcagcccccaaacagtccagattgttacccagattctgagaatctgtaattgtagaatccggaactagaatccagaagctggaaaacccagcttctccagattctcggaagctagctactaaccagcagattcttagaatcttaagctcccccaaatagggccatggactgctcttatttatttttatatcttaagttgtcttctcattcctgaatcaggagatccaactgaatctctaatcgaacgtaactgttgtgccaactctatttagcatgaaaaacctaccatggtagtttcgtatgacatgcaaatttaatctgatagtgttttttctttgtcagataaagaacttgatgtgattgaaatggctgtctatggggatgtcatccgtcctggaaagcaatgtcgctgcaggacagtagctgagatgcttgggaaggtgaagtcaaagaatcagatggctgcttgcgagttgccacataatgatgcctcctagcataagtcatatcgttctgcacaactacaccagattcattatggtccgcacgggcagcaagcctgagatcactaccctgatttcatgctctattgtgataatgaaca

SEQ ID NO: 91139 - DNA, 1870 bp, Oryza sativa
tatccttgttggcttgtcttgtttgtccatgaaaatctcatagctactgaacttactactttgcattgttcagataccgcaagggttgcgttggtgccgatgctgaacaagttcaactcaatgaagactaacaagaaaggacttgtcgcgatgatggagtataatacacttgagacggcgaccgggaagttcagtgagagcaatttgcttggagctggtgggtttgggtgtgtgtacaaggccaattttgaaggaggacttgttgctgccgtcaagagatttggccacaggggacaggactgtgagaaggaatttgaggttggtgattgtttatgtccatggcctgaaatttgttcttgatgagacttgtcttgttgctaagattgtttttggttacctctgaattggcagaatgagctagatttacttggcagtattcggcatctgaatatagtgtcccttttgggcttctgtattcatgaagagaaccgtttcattgtttatgagctgatggagaatggatcactggaagcacaacttcatggtaccttctaatttgctttgttcttcatttgtttcctcagaattgtgagtatgatcaaggagaagtatccatttttaatctatttgtttgtttctaggaccatcacatgggtcggctctaagctggcacattcggatgaagattgctcttgacacagcaaggttaccatccatttttattcactttgcatgattaaatatatttttataccgttatcattgattcctatcatatgcgtctgtcaactaaattaaccaggggattagaatatcttcatgaacactgcaatccaccagttatccatagggatctgaagtcatctaacatacttttagattcagatttcaatgctaaggtatgcctgcttatcttagttcttgtcaattagaatattactgtcaatcgtaacacatatcactgatcatctttggtttgcagatttcagatttcggccttgcagtgaccagtgggaatcacagcaaaggaagtttgaagctttctgggacattgggctatgtagtcccgagtacttgttagatggtatgccctctcttttctcatgtcccacctgtaatcgtctatgtagactaactctcatgtcccacctgtaatcgtctatgtagactaacttttttctcacattaacatctaatttaattatctgcaaccgcatgaaattcagggaagttgactgagaagagtgatgtatatgcgtttggagtagtacttcttgaacttctgttgggaaggcggcctgttgagaagacagcacaatctcagtgccagtcaattgttacatgggtacccaacattctgatacttgacatgttgaatttagttcaattaaaaaacagtcattctctcgatatgcatagaatatttttaagcttcatctcctgaatccaggtggttaagttaaattttcctaatccattggcatctgacatatggaaatcaaatgcaggccatgcctcagctaactgaccgatcaaagctccctaacataattgaccccatgatcaagaacacaatggatctgaagcacttgtaccaagtaaactccctcttaatttctatctttatcctcacaaatcttttcaactaattcaatttgtgtgattcgctacttcgcaggttgctgcggtggctgtgctctgtgtgcagccagaaccaagttacaggccactaatcacagatgtactccactctctgattcccctagtccccatggagcttggagggacactgaggatttccccggaatcaccttgcgcaactcgaaagcagtctccctgttgagaaagaaaaggaatgcgtgatcggaat

SEQ ID NO: 91140 - DNA, 670 bp, Oryza sativa
atcctctcgatctgacgcggattctgctcattccaaatcgaatccaccaacatcccccccccccccggcattgatctcgccttcatcctcgcgcgattcttgcgaggaattcgattcccggcgatggccgccgccgtcgtctgcgtcaccggcgccggcgggttcatcgggtcgtggatcgtcaagctcctcctcgcccgcggctacgccgtccgcggcacatcccgccgcgccggtatgggtttttttctttttgattctccgccgcctcgccgtcgccggcggcggcgtggattgggaggtgacgagctcttggattcttgcgcagatgacccgaagaacgcgcacctgtgggcgctcgacggcgcggcagagcggctgacgatggtgagcgtcgacctgctcgaccgtggcagcctccgcgccgccttcgccggctgccacggcgtcatccacaccgcctcgccgatgcacgacgacccggtaaaccaccaatcccccccctctctctctcccccaaagaaatggtgacgtcatggtggtggcgcaggaggagatcatcgagccggtgatcaccgggacgctgaacgtggtggaggtggccgccgacgccggcgtgcggcgggtggtgctctcctccaccatcggcaccatgtacatggaccctcgc

SEQ ID NO: 91141 - DNA, 6078 bp, Oryza sativa
atctgcccattcgaggcagtgatctccttcagaacagccttaagtctctcttcaaattgaccttggaatttagccccagcaagtaatgctcccatgtccaatgaaataagctgtaattttttgcatatgcatgtaacaaaataagaatggatagcacaataaattactatctatttcttcttcctttattttctcattgcattaacgaactgagaatgcattgtcctattggccagaagtattcctcttaatggatccacctgacgagaggtagatgaattgccactactcatggaaagatctcatggtatatctatcctcagctcatctggttgattgaatctgagtatgaaataaaagcaaggctactatcctagaaaatgttatgataaggacaagcaaaaaaggctaagaaattacctttctattctgtaaaggttcaggaacatctccccgcacaatacgctgtgccaatctgcacgaaataaatgcagacgaattgctcagcacatccttaaaatgacaaatgctgtaagctgtaaaaagtaacttgtattgagagagagagagagagagatagagatagagatagattttacccttcagcgatagcagttttgccgactcctggctcaccaataattacaggattattcttagttctcctgcaaaggatctgaatgcatcgtcgcacttcatcatcacggccaataacaggatccagttttccacgtcgagctaattctgtcatgtcaataccatacttctctagagcctggtacttcccctccggatctggaagcagcaccataaaaagagttatgattcctaaggttatcaaacagtcacactgggtacattttaatgctaacatgaaaaaccatctggctgaaacaaaaccattgccattggcagagtctcccctcaagttgtgaatagagagctgaacaaagagatacctctgtagaaaaacaactgcacaaaagaaagtaacaataaaggatgaagttacatagacatactctgatctgtgacccgctgactgccacgtacagcggagatagcttccttcaactcattctccccaattttgagatctctgaacagctgttgtccaaacctcttatcttctgtgaatgctcgcaatatgtgctcaacagatacaaactcatcagcatattctttcttatgcttccttgcattatccaaaattgatacaaagcttgacccaatgatcggtccacttgtatcgccaacaacctacaaatgcagcagactcattgttaacattgatgcatatatctcttaacgaattaactactacggccaatcagcactacctttggctgtctcgagatgaactcatcagtagcttgcaggacagatgtgttatctattccagctttcgaaaatattctgcgcgctaaaccatccttctgctccagaagagctttcatcaggtgctctgcttccactacttgttgcttcgacattctagctgcatcaaccgcgccgacaaccccctcccaggccatctcagtaaattctcctggagttatctgtttggtcgccgaaaaaaattacccatctattagtcagctgttgttggcaagagggaactttcccatattgtctatatatgactatatatccacaaactgcaaaccatatgttctcagttttcatagtaatcaccaagttttatcaaatctgatacatagctgttctcagttttcaccaaacctatagaatgatcagcaactgctttccttcaaggttttctaggcatgaaattgttaaacactgacacattgcacatcctaaattgcctgaaactaaacacttttgcatatgcactgcaacatgatcactgagcatagcagaacattacacatgtaaaccgtagtatccaattaatgcagtagattatcaaacatgtatcgcaaattcgcaactaaactaacagtttcattcacaatagcctcattgccgacacatgtacagcatccgcgagattgaattcaccaccactatagcaaccaactgacaagagaaaaataattgcacgggcgtagagaagcgaacccagacctgagacgacgacgaggtgctgtacctcgccgcctgcgtggggtggaacagcctccgctgcggcggcggcggcggaaccagcagcccgcctccaccgagccggcccatgggcggcgcgaaccacgcgggcctcctcgccccaccaccagcggaagcggaagcgtctccagcgagcgacgcgagggcgcggagcgggtcccggccgccagcgtggtggcgccgcgccgccgccgcggcgcgggcggcgcgcgcgagcctggacacggcggtggcgcgtgacatcgtggcgagcgggtgggggggtcaggggttcaatggcgcctcggactctcagggtcgccgggtgggagaagcgcgcgcgctctcgcggcgattttagggcggcggcggcgaagggtggcgatgcttggagaaggggcaagaagaagaagaagaaggtggagaagagaatcgaaggttggagaagcttctgcaatctgcaagttgcggattgttttgtttttgtttttgtttttttcttttttttatttaatttaactttgatcgtgttcggcagccaaaatcatcttatccggcccgtttatttccgaatcgacggtctgaaatttgggcccatatgagcagggtttccaacttgggttcgaaatttcctccctccgtttcatatctactttgaccaaatttgaaaaaagatttagtaatatttatgacaccgaattagtttcaataaatataatattgaatatattttgagagtgttagaaatattgctatatttttctataagtttgattaaacttaaaaagttcgattaaaaaaatcaaaacgatctatgatatgaaactgaggtagtacactgtacggagctatttcgtccaaaatttgcaagatttattcaaattcggtcgaaattcctccaaaatttatgtttcttcgtcccgaaatatggagaatttggttcagtaatcagttcaggctgtagttcaaaagcttctcttcagaaatctgcaatttcaatatacgcagctcaggtcttaaccggacacatgaatttttcccatcttcacaaaactgcaaaactaaaacaactacctttccaaacagcaacattctgctgaaatctcataagatgctggcattgcaactttgcaagcttgataaacaccgtcacgaaaaagattaaagagccaagagaatttcgatgattaacgagaattttaccaagcatactatattatcaggataaccggttatacctgaactaacatagttattatagtataagtcatgataaaaacacaccacatagccgtttctccacataaatttcacagactgactggccaactaataatcactaagctgaaaaaagaagccaaatgtgaaatgcacttgtgatgaaggctagccactatgaacaccactttgtgctgacaagtgagcatggaccaatcagcagccgacaccgcgaatgcagaaaaacctcgtacgcggactaatgattgaaatggaggctggctagaccagctcccagtccccatcgatgtaaggaacgccgtcgtcttcgcggtcctgcatcgatgaaagatggcgttgtcagatacatagtatactcattgtttgtacttcccagcatggcagttaacatattgattaagaaatatgtggtactgaaactaaacttagaaatctcttcagaacgaatatgaaatatttcaatacatatgttgctgtttcatactataataatatagtgcagactgcaaaggattaaaggtggtactatgcagcagaaaatatcttgaaggaatcaaacatgaacatgcttgtggactacatatgaatagagatgagtaacgcacatccatagaaaagtgagtgtttgatagactactactgtgtccagaaattttcataggtcactaaagactgatctgcttgaacaacacaaagcaatagaattctgaaacagaataccaatatagaatactcttctaaaaaataaatacaagaaagaatcataccggcctaaacatgtcaacaacaatgtcatctagaccaccactgagacccctttgcagcccagttgtccgcataagatcgtcattatagtttagctgattgctaacagcttggtgatgaatccttccatcttgcatgggagaaacaatgcccgtattcccacgatccagtgtctgccttggtacagccggattgtctaagctaaggttgggcaacgatgtgttgatgctggagttactaaatacatggctgttatttagcatgtctcttgagtttgtgctgcttccatagttgaatggtgatgtgtcctgattgaatgctattggaacattgctagctagtgatgctacttggccctgcatctcatttcccagcagcggaatctgattggatgatgtgaagcttgagacaggttcaattttggggccattcatatgcagggtggcttgcgacatgttatcattgtgaccacgatcctgaatgttggatggaaccgcagtttgccaagtattggtggttcttccaagatcaggaaactggggagactcaccaacaagtgtgctaaatggatctgcagaagatgaatgcacccgactaaggtgttgctgattgctcgactcaagaggttgcagtgatctgtttgcagttgccagcggtgcaccattcgatatgtttggaaaggagttaccagaaggaccagttagaattgttgacatctgtgcacctctgatcatgttaccattattaagccctcctaaatcattcagtgaagtgctcagattattttgggcatgtcctaactgaattggctgtgaatgcagcaaaccatgaacaccaacgcagaaggggagttcatcctagtaagaatgttgtttgcctgggtatggccagcagttgggactgtacggtatctaccatatgcgttgtagtttccaaatgaattcatgtttatgtaagcagggttccttcctccaaatgcagctgcaaggttagcctgcctgcttgcatcagtgctcaaccgtttaaggtacagccgatacttctgaaatgacaagcagagaagaaacatcagtgaagtatacttgtaggtgcaaacaagaggaaaaaaaatagctaagaaatgaataggttagcaaaactctgaatttaacactggtgaattagtacttacgattgcacaatcaatatactaggaaaatggtatgagaacataaatgttatattttgcttctcgtacaaatactgaaaaagaactcaacaaaatacagaacatgcaacaatatgaattaggaatattttagggctgtattatcatatattaaaaaaaatcctctttcagatatctgggacaataataacaataatttggtgcagtgataaaccatagtaaacaacatgatgaaatgaacggtcaaagataaggaaagaaattcgacctgcaaatgactagcaacattctccctggtgatgttctctacattcatgagatccaatattttctttggaacagcctctgaaaaaacaagcatacaaatattaacacatatgacattgaactaagaaaaatagccagccaatattctcagtagctaggttgtgagaaattatcttactctcgatgccaagctggttaacagcagccacaaactttcggtgcagctcaacagaccacacgacccttggcttcttctgtgttgatgagtctccattctcattactgttctcatcagaatcatcaccatcatctccattctcatctctacttttccgtgactgcctcttgttgcggttagcaccaatactctcaccttcattgttcattccctgtgccttctgaccagcgtcatcatcgttaccacggttcttagcatcacaattcttacgcctaatcacatgttgccatatcgtccttagctgctcaagacgcactggcttcagaagatagtcacatgcaccatgggttat

SEQ ID NO: 91142 - DNA, 1979 bp, Oryza sativa
gcaggagttaaacatctaacacatgaaactaagtagaagctagataagaatgaagctaatcagaataagaccaaggagtattcacaatttctataaatcaaccgtttattgcaagatgtttaagaaaatttggtgtagtgagtatgagatgttaactaaaaacaacctttgcacggattagtggactataatcttgggaagcatctttgaacttcacctcagcaacatatttaccaatatgaattcttcttgacagggcctacaaagaaatgatcaatacatttcacagatatacactgattggaaacaatttaccattaatttgcaataatttgtgcaaattttgctttcgcgtgctgaaagattgaaagaacatatcctagtagcaactagatttatgttttttttaaagaacgaccaaattgatggaatatctaaaagaaacaataaacacagaacatgtaccttcagacatgcaaaatctaatgcaactgtttctgcatagttaccatcatctccatccacagtgaatagtggaagcaactcgttgaaatacatcttccatattgcatcattcacactgactgatgatgcaaaagagtgcaaaacctaacaacaaagcaataaaaactcagaacctcaacaatcattagtcatcagttcattgtaactaatattgtaaagcttagtatttacctttgggtaatctttggtaggaaatagaggtgaagggagatcttggggaaagaatggaacatcttctggcttttggtattgtccggcctatcagatttcacagatgtaattagattctgtagagggatgcttggaaatggtaatatgctaatatctgactgtcaacatagctataccaatgctgtattttatgttgattgattttgacagttttaataggatgctggataagatatacaagttgaaaaatagcataacaaaatttcccatttagtaaagtacaagaaaaataatagtaaatcatttatgttttctattattaataggggatggtacggttcaaactttttttctccatcgtcactatttttcccttctgatcactttcacttgttgaatgatccgtaaatggaagtgcctttaaaacacatgatttacctacacatgtagcatagccattcttttgttaatataaatctcatccgatactgtgtgtccgttcgaggtactcaaaatgaattcgtcaagccaacataagccgcaatgccgcatgattaccagaatggacatatcagcatcttaccctccgatgctatctttcaattcatcatggtacagtggagaccaaggtagataaactactgccaaaaaaacaatgtggtaacgaaatacaagcctagcctgtaagatctgtgtgactgaatttcacatacgaattcctcagccatgagtttactaatcactaaggtgactgaatagaaagattggcctcagaaatttcaccaggcaaaaaaaaatcttcctgtacaagttcatcatggctatgctacactacaacatggtataaaaaggatcgattttggtaaagaaaacgtaaggggatctagttgggcaggatactgaatcatgaatcaatggggagtcaagactcaagaacaacgagaggtggcgggcttaccttggcgtgcagaacctcggcttcccggacgaagaactcggcgagggatcggccgccggcggcggcggcggccgcgtatgccggcgcgttgcgcgggcgcctggcgcgctcgatgagggcgaagacgatggagtcctcctcccgcaccagcgcgtcgcgcaccgccgccaggctcagctccgcctcgcccatcgatgatctctcgatccgccctgtgatgactgatgagctcgcgagctaagggaaagctgctgctgctgatcctccacagctccactctgctttgccagtggtgccactctcctaggggcctctttggcttttt

SEQ ID NO: 91143 - DNA, 865 bp, Oryza sativa
tttccatgtactcgctcatatcaatccgtattagagcattctctgtgttgaaaaggaattcagctagtgttttccccagttcggtctttcctacacctgttggacccataaacattaagcttgctatgggacggttagggtctgataggcctgccctagaacgacggattgcattagccactgacttcactgcaatatcttggccaataaccctcttgtggagtacatcttccaatagcagtagcttttccttttcagattgttgaaggtttgacactggaataccagtccacttgctaacaatctcagcaatgtcaacatcagtcacctcttctcgaagcattgacttgcctgactgctggaattccatgagtttgttctcagcctcttcaagctgtttttgtagcgacagaagtgttccgtacttgagctcagctgcacggttcaaatcatactctctctcagcagcttcaatctccaggttaactctgtcagtctacaacaaagataagaaaatatgagttagagactatattacgtgccatggcacaacaaataacaattaaaagaacaaaccatgagcctacctcttccttgatcgatcttatgcgagtcatcaaggacttctcatattcccaatgttctgaaaggtttttctgcttctgcttcagagattctagatcagcttcaagcttgctcagtcgctgtttggaggctttatcggtatcattcttcaatgagagcttctccatttcaagccttatgatttccctatctacctcatccaattcaataggtttcgatgttatctccattttcagcttagcagctgcttcatcaactaggtcaatagctgcccatgacg

SEQ ID NO: 91144 - DNA, 3084 bp, Oryza sativa
attcctgcaccccgaatcgtcatgtagtttttgcagcacgccggcaacgctgtagcgttgtattttctttaaaatttctagttctttctgaactgcctgttctgtatcttctgtaatactctttttggttgtgctaaacggagtgaccattacatttcgtcaaagttgtcatacctgtgttatattacatagttgcatcttccaagagcatttcctcttcaatttggttaaatgaaatagatgcttgtgctattgggactttgaactgtgaagagtgactcatcaccatattttggtagagaaatttgcctcgtcaccatattttggtagacaaattttaggtacttgagaaaacatctcaaggtatttaaattttgaacttttcttttgaacgaacgaactaaaattatgcgttttggtaagagtacactttccaaaacatctcaagtcatcgttggaaatgttgtgtgggtcggagaaattggcatgcttcactctcgtcgaacgtacttctggtgttttgtgtgtaagtagtgttttgtgagtaagtacgacttcttgctatgcaaaggtaccctgaaatcctgaatcctgacgctcatggagtcatgactgtttcactctggtatccctttgacttggcatttgttttatgtgtaagtacgacttcttgctatgcaaaggtaccctgaatcctgacgctcacgagtcatgactgtttcactctggtatccctttgaattggcattttagccggctgatgcatatagggtgtgtttagttttttttttttttttggaaaattggaaccatgccattataattttgcgttccaattttccctagtttttttggcgtaaagtttttaaagtatatagacacacatttgaagtattaaacgtagaataataacaaaacaaattacagattccgcttgtaaactgcgagacgaatttattaagcctaattaatttgttattagcaaatgtttactataacatcatattatgaaatcatggcgtcgtctcacaattacatgcgaactgtgcaattggctttttctcccacatttaatgtcccatatatgtgtcaaatatttgatgtgatttttggctaaaagttttttaatctaaacacggccatagatggggaaatgaatccaagatgaacgtgactttcgtgtgctttgtgtatagtcaaccacctactttggatgcaaaggcaatgcttacaatgtaaagtgttgacaacagaaatttttttttttaaaaaaaaaaacagataaagagagtgaataaaaagaagaacgactccactggggatcgaacccagaatctctggttccgtagaccagcgccttatccattgggccatggagtcgctgatgggaggagcacaaatagttaataaataaaatgtagtgagatattttcaagtcaagcacatcacaaaataattaattaatgaatgaatatattttagagaacccatgttttatagtcaatagttacatagcaccctaaatattatgactagtggtgtatgaccctatatattatggcccaccccaatacatgtaaagtacagtagctgtttacttaaaatttgaaaatataaagtgtttatgaaaattttaattattcatttcttgattaaggcagttggtttttaacgactcttcactactttaaaaagtattgtttcatatatcctaaaactaattgagatttaaatgaaatattatttcataatcctaaagctaagttcttgtgctttgatacgactagaaggaaaaaaaaatatcatagtattgcctaaaataaataaaatcataattttcatgaaatttgtttccgtctttttgttatagagaatactcaccttagtttgattttatatgtaactatccatttatagttagttggtatgtaatgttaaatttgttgacctctttttgttatagagaatactcactttagtttgattttatacgcaactaaccatttagagttatgttaaatttgttgcccacttttttgttatagagaatactcactttagtttgattttatatgtagctatccgtttatggttgccacaaatcataatatatcctaatatatatggtattttaaacttttggcacaacttataggttctctgaaatttactttttaaaaaacttcagtacagaattacagataggttttctatataagcatgtttatttttttccaaaattaaggacaattacagttctttgtccggcacataatgtcgttgtagtatagtggtgagtattcccgcctgtcacgcgggtgacccgggttcgatccccggcaacggcgatttttattttattttaccctttttggggtgctttggccatagattatgcggtataaaacatagaaacttcagggaatttttgtctgtttcaaacctagatgccgctgttaaaaattacacataaatattctctatactcgaatcggcactgacaatccaagctacctgaaattcactgtgtgtactaatttgaagtctgaactctgaagcgacctcgatttccctgaatacaaaactctcagcaggaacaaccgcctgctttctgttcttcttgtgcttctgcccctgaaggtatttgcccggaggcagcaggccgtaggtttatgtccaccatgtcttcctgctttgccgatgagagcgcctccattccaggcagcgatgcagcgatcttgcgaaacagtggctgtggttcaagttttcaatcagttaccatcaggtgttttgagcaatgatggacaagaacagtggtagatttgcttgtcaaagtgaaacaaagtaaaggctggagaccttgatgttgaatccagcttttgcgctggtttccatgaacatggcgccgtgctcctgtgccttggcttctccttcgtcagtggatatttgcctgttgacattccaatcgacagaaaggagtaggttaactgatatacctcaattttttaatatatcacaccgttgacttttttttttaaaaaaataattatctttcgtcttattcaattttttttaaaaaataaa

SEQ ID NO: 91145 - DNA, 692 bp, Oryza sativa
tattggtgcaaagtatatgacagctaatcctgtttttgatgctcgcaccaagcatatcgaggtagattatcactttgttcgtgagcgggttgcaagaaaacttttacaagtggaatatatatctaccaaagatcaagttgctgatgcttcaccaagacactgtcagtcagacagttagagatgtttagaaacaatctaaaccttacaggttcagattgagggggagtgttagatatttctcacatatgataatgtaacaaatagcgaaggataagagttgttgggatgtttagatagataagataagtttcctatgttttagtagatgcacaacaactctatccgagctatatatacctgtattctgttaagcccggttttgtggcaagtaattaacacgtaaactcctcgctgaaggagttctctccacagtccctcctggggctctcgtcaaatatgacatcgatcgcgagcgagatgcgcatgtacacgctgtatccttgcatgaaggacacgatacccccatctcatctttgtggccgatgaagacgtcggctgttctgcggtcgtcaagctcacgcacatagtagtttagatccttcacgaacgctaggcctctactagaaaaagcattttccccaacattagagtcttatttttacagtcggacatgacttttggagccaaatgac

SEQ ID NO: 91146 - DNA, 654 bp, Oryza sativa
cgatcagacaggccggaggccgtgcctgagcgccgctcccacacgacgtcgatgcggtccacgtcgatggcgcccacctcgtggtgcgtgtacccctccaggaagtgcaccacgcctccggcgtggcacgcgtgcaccaccccggctccagcgagtactgcacaagatcagatcagtcatgtgtgatcgatctgcaaaccagcaaaggaagacgacgaggaggaggctgaattgatttcaggttgtggttctgacctcgcaggcgccgaggccctggacgtccttggggaggcgcatggcggcgagcttgccgtaggtgcagtcgcggcggaagccgatgattggggggacgacgaactggtggaagtgcgtccccggcggcgcccaacgctgctccctcggcgacagccacttgccgacgatccacgtcttgcagtgctgcgccgacctgtacttggtcacctgcaccaggtactgctggtgctccggcgtcgcctccctctgtatcttctggaatctctccgtcgacagcgtcatcatctgcaccacacatcatacgtctcagcaacagcgaccgatcgatcgccatcaatatgcagctagaaattagtagttgggtggtggtgttggggttgattaccatgacgcggactt

SEQ ID NO: 91147 - DNA, 1167 bp, Oryza sativa
taaaaacatgtttattagtttaacctgcaaagaacgtcattcccaactagcccatttataccttctccgtgccaatctttcttcgacatggttgagagctcataccttcaacaagacaaggctgaaaaagttcggcctaaaacttattaggaaaaagtccactttaactcccttaaatatacaccgaatctaattcgtacccctcaaccagaaaaccggttaggacgactcccccaattactaaaaccggtataaattgactccctaagtggtttttgaggatggttttgctgacgtggcatgctgacttggtctattgtgctgacgtgtcagcccagtcaccaaaatacagatgaggcccacatgtaagtgataggagaaaatataaaaagcgtagggcccacttgtcagccatcttctccctctctatcttttcccccaaatcccccaaaaagaaacagcagagcaagcggtcgaggaagccgagcgcgtagttgctgtgcgggcactgcactgcacattgtcgcaggtgtagacgagggtgtggttgttgctgctcagcatcagctctggctcgctcctctcctggtactgtgcagccgcgtcgccggacccgcacggccccgccagcggcctcgcgcccggcggcgacaggtccggcaagcacttcgccgaccgcttgctcccgaaccgccccggtgctgccgctgctgccggcttgagcgtgcccctgccgcggatgagccggtggattccgaggtccgccaatagcggctccatgtcgacgtcgagcaggatgttgctcggccggacgttgccgcacgaacttcttgtcgtggaggaaggccagccctctcgccatgccgcgggcgatgcgtcgtcgctgccgatcctgcgcacagccagcacggcgccgtcgtccagcaccgccatgtacacgatgctgctgcccgccgcgcccaggatgtacgccgacgccttcagtagcgtctccatctccagctccacgtcgccgtccaccgtcaccagcaccgcgccgccgccgccaccgtccttggccttcttgccgccacatcgtccgtcttggcggcgacgacgccctccttggtggcgaaggacgccgacgtgtcagtcacctcctccgtgtcgtcgctctcgtctccggca

SEQ ID NO: 91148 - DNA, 734 bp, Oryza sativa
ttcctgcagcccaatttgctacaggtatacacccatggtacctcagatacatcatgttccagccgttgaaagaaagttgcattcattctggtgattcaaactttctggatcttgaatggctttcaacttgagacaactcaagcgatgaaaggtgtttactttggcattgctattgcatttttttttagcgttttcgactgacataatatcatcttcacagtgacagtcaatttaatttacacattttcttttgccttagtgtaggaaaacattaaggataattattagttgattctcctgtaaatttcttacccttcatgtttaatttcatatcaatctaaattctagagttcttttgctctcactgcatttccatgtaataaatacaaatatgtagtctcgtgttgtatcacttgatataactatctgtattgagaggtaaaatgaaaattatgttgccacacttcctaaatccaattaataagtgtcttctgagcttccagtatgttcactgatactgatttgaagatatcctctgaaacatttttttttaaaaaactcattaatactgatggattgtacttggacaggtccattgcaattaatactccggatgtgaacctttcagcggagaatgttattgccacaatgtcttcttttgactggtagatttgtatgatcaaatatagttgtatcatcaccatggacacattactctgatcattatgtaaaac

SEQ ID NO: 91149 - DNA, 1992 bp, Oryza sativa
ttcctgcagcctagaaaaaacacacatctgaaaacattgaagcaatactagggttcctacaataatcctactgttggtttcacaatgtctcatatgaagacttttgctcttggcattgttgtccttgctacactagttcttgcatctgagagtcaaatttctcgtaaagacttaagcatcgaccttggtggcggtggtggtattggaattggtaccggaattagtataggcataggtggtggcgccggtggctccggctctgggtctggttcagggtcaggttctttctcaggctcaggctcgagttcaggctcaggctctgcttctgggtctggctcaaggtcgagtgctggttcaagcgtagggtcatcagctggatctagcgctggttctggagcaggctcatatgctggctctggtgctggttcgggatctggttataatcaaggtcaaggaacaggtgaaggtgaaggtgaaggtcaaggtcaaggttatggctctggccatggagcaggcacagggtcagggtatggcgagggacatggtgaaggaaatggctttggctcaggatatggtgaggggcatggcgaaggctacggtgaaggaaatggctctggctcaggatatggtgaggggcatggtgaaggccatggtcaaaggaatgcctctggctcaggatatggcgacgggcatggtgagggccacggttatggtcaaggatctggttatggtgaaggccatggctcaggacatggccaaggatcagggtcaggctatggtgaaggatatggtaaaggttcaggcaatggatatggaaatggttcaggctcaggctatggtgagggccatggctatggctctggttctggccatgggaaataagacaattaattgttgaatttgccaccatgccagtgtctataaatttatgtttgctcatggaaattctatatgtataaaaataaataaataatgaactcccgttgttaaaggtgaacaaatttgcactcccaaagatgaatgttgactgtcaagctgtcaacattcttcttgcttgacagtttcaagtgtaagggcaagcccaatgtatgtgtgaaccggggacaataaggtggggcccagtgcaggtagcaatagctaagtctctcttcacaatggttagtgtgagtgggaggtgttaaagtgggtcccggtggtcccaccatgtaaaaaaaatatcgacacctatctacaaccatggagtcattcgcgcgagaaaaaatcagcgtcctcagttcctccgcccgatccctaatttcactcgatccccaatttctctagcggcggcgcggaaatttggccgcgtctacctcacagctgctcctgcccatgccttatccggtcgccgagatctgcgaccggcgggagcacctcgccgtgccgcaactccgaccttgtgccaccatggccttgcctgcagatggcgtcgtgctcatggagcctgatggtctggcggtggtcgccttgctgaacgaggtccacgttgccgtgctcctccgcgtctgtgccttgacgagtacgcgtcgactccgtcggggtttcagggatgaggtgattgatcccttcttcttcatgttcttgcttacattccatcgggtgattaaatccatgatttgtttttggttgtgcaagtcttgccaggaagataaactatgtttgcatcatgtgaatcgttgctttcaccttcccatggatttttggttgagcgtttagttgtgcggcatcaaatcttaataaaaaaaactgagaaacaatacacttgtgctccgtcgagggattaatgcaatagtactgctgcatacttcttagcttgtgatgtagtgatgcagaggtcatacaataggctagtactaagggatcccttctcaattacgaatacaagtaattttgatgatttaaataaaaaagaaaaatacaaggttcataatggactgataaactctagttttattg

SEQ ID NO: 91150 - DNA, 1536 bp, Oryza sativa
agatgccccaccaccgccacctcactccgtctgcctcccacgaggagcacgagaccccaaacccctcgctaaccctcctccaatgcagctcgccgccctcgcctccgacgagcccccgccgccgccgccggagcaatccccccggcggatcgtggtcgcccacaggctccccctgaacgcgacgccggaccccggatcccccttcggcttcgccttctccctcagcgccgacgcccacgcgctccagctctcgcacggcctcggcctcgcccacgtcgtcttcgtcggcaccctccccgcggaggccgcccgcgcgctgcggcgctccgacgagctcgaccgccacctcctcgggtgcttctcctgcctcccggtgttcctcccgccgcgcgcccacgacgagttctacgccgggttctgcaagcactacctgtggccgcgcctccactacctgctcccgcacgcgccggcggccaacggctacctccacttcgacgccgggctgtaccgctcctacgcgtcggcgaacaggagcttcgccgcgcgcgtcgtcgaggtgctctccccggacgacggcgacctcgtgttcgtccacgactaccacctctggctcctcccttccttcctccgccgcggctgcccgcgctgccgcgtcgggtttttcctccactcgccgttcccctccgccgaggtgttccgatccatccccgtccgggaggatctcctccgcgccctcctcaacgccgatctcgtcggcttccacacctacgactacgcgcgtcacttcctctccgcgtgctctcgcctcctcggcctcgcctacacctcccggcacggccgcgtcggcatcaactaccatggcaggacggtgctgatcaagttcctctccgtcggcgtcgacatgggccttctccgcaccgccatggcttcgccggaggccgccgccaagttcagggagatcactgaggtggagtacaagggccgcgtactcatggtgggcgtggacgacgtcgatatcttcaagggcgtgaggctgaagctcctggccatggagagtttgctcgagacgtacccggcgttgcgcggcagggtggtgctcgtccagatccacaaccccacgcgctgcggcggccgcgacgtggagcgcgtccgcggcgagacggccaagatacaggcgcgcatcaacgcgcggttcggcggtccggggtaccagccggtcgtcgtcgtcgaccgcgccgtccccatggccgagaaggtggcgtactacgccgccgccgagtgctgcgtcgtcagcgccgtccgcgacgggctcaaccgcatcccgtacttctacacggtgtgccgggaggagggccccgtcgacgcgaagggcgccgccggcggccagcccggcacagcgccatcgttctctccgagttcgtcgggtgctcgccgtcgctgagcggcgcgatccgcgtgaacccctggaacatcgaggccatggcggaggccatgcacggcgcgctcaccatgaacgtcgccgagaagcaggcgagg

SEQ ID NO: 91151 - DNA, 581 bp, Oryza sativa
cccgatcgtgtgtatataaccgcctcgccccgcccccaccgtctcctcgctgtgagccgccggccgcctgcgcacttgagctccacttcctctcgcgggaggcgtcagccgagagccacagccaacagcaatgggggccggatgggaggagtacaagccgtgcgcggcgatggtggcggcgcagtgcatctacgcggcgctggcgctctgggccaaggccgtgttcaccgggggcatgagcaccatggtcttcgtcgtctaccgccaggccatcgccaccgtcttcctcgtccccatagccatcattgccaacaggtaacccatcaaccaatttatatttcctttttgtttttcagaacctcaatctagaagaagatgtgtataatgaatctgaaacatcacttcttaggttggttttttcgactgagggagtacatctctcgagctgtcaaacttgacagtttcatttgtacgttcattcattaattcatgcatggtgtctgaaatgatctgcagaaggaagaagaaggagacgaggctaggaatgacgggcttctccttgatcttcgtggcttctcttt

SEQ ID NO: 91152 - DNA, 1146 bp, Oryza sativa
tgccagaggttggtttcagtagaattgtttggacattctgatcattgcaacgaggtctcgtcagatatgtcgttgtttcttctcccctttgctacatctgcatcctgcattgtcagtaacgttcacttaaaatcttcagattgccatgaacatagctgttcagacgcgcagcaggcaatgctgacagtaacatctgcatctgcttctccttaaaatattgaacaggaatatggtcttggaaaggtcaaaggtatggtaaaacaacatatttcgtcaaacacatcaggcaatgatatggtaaaacaacaggtaatctaaacataggttaagcaaaacgaaacaaaattgacaggcaaaagcaacctctgacgcacagctcatcactgtcccaagtccaacaaatctttgatttctaaagatttctccggtgcaaattgcacgtttattctgatctttctcactgtttctggtaattgctaagcagtttaagctaccattttcgcagcaagcaaggtagcttcttccccgatcgatggatgcagcaatcaatcttactcacaccggaggagggacttgatatcgaaatccgccggccgccggggagccgccgcggcgcggagccgggacgacggcgacgagaaggccaggccatggagcatgtcgacgacctcctccttgtcgttgaggtagtagctcgccatgctcggcttgttccccaccgtgcacgcaaacacctgcgccgccgcaaggagcgcggtggtggtggtggtggaagacaaagcaccgccgttcttgccgccgccgcagaggctcgcgagagccccgaacatgtcctcgtcggagcggtcgtccccgacgcacaggacgaaccccagcgcgccaccgcggcgcgccgccatggccgacacgatgcactccgccgcgacgcccttgctcacgccctgatcaagaacgtgattgatgatgaacgagcccgacggatcggatggaagatcaccggcattgccgtttggtgatcgttacgtacctgagggatcacctcgacgatcttgtaaccgctgcgcacggcgacgggctcgctggcgagcacggtggcgaggtggtcgaggagctccttggcctgcaatggcgccagcctcgggtcgg

SEQ ID NO: 91153 - DNA, 2281 bp, Oryza sativa
cagcaggaacggctgcaccgagaagggcgtcgacgcgaacgtccgcagcacgaacggcacgtgcagcgactgcatcacgtccaccacgtgcgccaggaacacgaactccggcacctcgtccacccttgcacacacccacaccacaccacaccgtccattcgtcagcttctctgcctcgccgcgggtggcgcgacacgggtctaattaaaatcgtcaagaaaaagagaaaccaagagcagattctgtacgtttttttttggccgtgccagccgccggcgatccgatacggtcggagtcgcggccggcgacagcggcatgcagcgtttaaaagcgagagacggttggatggcatgtcacggtcggggtcgctccgtcgctgtacgtaacgtgtgtagcggatagatcattacggcgaacaggacggtctactcctgtgggcacctgtcctctcaagacggatacatacactaatttggccctggtccaatcgtgcactaatcatcggcacgcatgcaaaaccttccgcgtacacatgcatcgttaattttccacaacaaacttgcttaattactaattcgagctttaacggcttgagtgattttacgataattaagaaggtattgtgagttaagagttatggaagatatcaaatttgcattaaaaatttgtatctccgaggaactgtaaaatttctctaacggcttgcggttgatctgagaaaacgcatgatgcatgcatggtgcctatcaacctaatctctcttgctttttttctgcaaagactaaaaattggttggattggaacgctccctaacggcaggtagctcgggtcgtccatgcgtcacgcaaaacgcaatcgaacagcagcagcatgtgaaatttaaggccggtgatatgcgcatatctcgtgcatatatgggccataattaaacacaatccaaacatctctctcgcgggcgatcttaattaaatttcgattcgatttgatttgattcatacctgcgctggttttcttctgcatctcccaggactgggcgtcgagggtgccaccgatgaggtcgaacagcggcatgaacaggcagaagttggcatcctccttggtgtgatggatcgtgtggtacctgcagggattcggaccagcagtcacacacacgcgcgtacgggagagaaccaatgatcaggaagcaaattaagccggtgtagttcagagatccgattaatgcgtgtgaaaaaatgcgaaaagggcatgcatccaacgcatttaatggtcgtctgaattgcgtacgcgattggatgaagacatcaaccatttgatagttcattcatgggatgaatggtgagcagtgaagtggttagggtggtcgctacccggcaagaattaattagagcagccgggaagcttaattaagctgcctgttcttagggagatagagtttggctcgtctgccggcttttgttgccttgcaagtacagcactacaggttgtttggtcgatcaggttcatcagaatcactgcatgtctctagttggaatatttgcagccagagccagtacatgttgttggtcggggggtttgtttccgttaattttgatgaagatttaaattttgggtcagaatttcgaaactgttttctgaatttgaaaaaggaattgaaatggagtgtacgtacgttggggtgtagataaggtatttgaggacggggagcgactggaagaggccgccggggaacacctcgacgttgcagtggcccatggcgcggaggttgtcgaaacccagcacgtaggcgaaggccagcgcgacggagccgtgccccgccgcgcacgccgccgccagcggcaccgccatgagcgcccccagcaccagctgctccagcggcgtcgcgaaccccgctgcgcatgcaccggcgatcaattgacggagttaattagcttcgatcgatcgccggcggcggatcggtactcgatctgtgggcggcgcgcgcgagatgcatgcttacctgtgaatggctggggcaccttggcggagtggtgttgcaagtggtagcaggagaagaggtggccgcggtggaacgccctgtgcgcggcgtagaacaggggctcggtggcggcgacgtggaggagcgcggcgacggcgaggcccctggcgtcccacagcgggaggtgccgcagcgacgggaacgcgtagaacgccgccgccgccatgtgcacctgcagtatcaagaagttgtccctgcagaagcaaaccccaacacacagattattcagctggctgatcgatcgag

SEQ ID NO: 91154 - DNA, 775 bp, Oryza sativa
ttgcttcagggtttcgtgcaccgttcagcaccccgccttcctcggctaggccttctgttgtgccccccacaggtacttaaaaaaacaacattacttcgacaatcaatttacatacattttatgtcttagcttacaagggtcctgttgtcgatgtgtaggtttcgcccagttcgctataacgcaggccgcccacttctcccaggctgcagggtcagcgtctcaggtagctgtgtcgacctcgcactcagcgcagttctggcagtacaccgggacttcgtcacaggcagccggcacgtcgagtcagggtccaccactggaccatgctgggacctcgtcggaccgcttgctgccttgcaccttgctcttcgacatcactgacttcgacttcgcttcaggctcgacagaggacgtcattggcccctcacagctgggaggcgcaccgccggtgcagacgcaggaccaggcgcaggccactcctccgcgggacactcgtgctacccgtgctgtgccaccggatcgtttcacctactcccaggaccacgtgcgagcacaggcccggaggaccaagcgtggtcgcggcgcggggcagggccagtagagcagtcttctctttgtttacttgcttcactttccagtactgtatgcttgtgtaatgactacgttgttgttatatgtgcacgatacctttcggcgcatgcacgatacctttcggcgcatgcatgactactttctgccgcaccgatgcagcctcctttattcgcgtggggctgcagga

SEQ ID NO: 91155 - DNA, 617 bp, Oryza sativa
gcataaacaaaatatatcttaccaaaattgtagtaaccagttaactcatcatcaggcaggaaagagttaacgtcagagaacggggcaccatggccaagatatccggaaccatagtctgcgtgggaggagccacggccatggcgttcttcaaaggcccaaagcttctgaactacacgcttggtgacctgaacatgctcctccactcgccggcgatcagcaagtgggttctcggcgcgctctgcctcgtcgtcagcagctcatgctggtcactccggctcatactgcaggtaatttcttttacaagtgaatggcatttcgtagccagctagcttgatctgttcttcattcacaacttcgacttgatcgatattttttttccttttttctggttacgatctttcaggattgtaatcttatattttttttctgctctatcaataaacttcgcatcgtctcgtgcgagtcattaaaaaaaaaccttcgacttgatcattttctaatattttgatttttcaggtgccaatctgcaaattttatgtggatcctctgtctctgtcggcatggacctgcttcttctcgacgctgcaatgcgcagcgctcgccgtcttcctggtccc

SEQ ID NO: 91156 - DNA, 1385 bp, Oryza sativa
agtaaatagatacctgatcacttgaacttgagctttgatggtaagaacatcatcaacaacaaagccttcatgtaatttggttagctccataaattttttccatccccaatcatgctctttcttccaaaaccggtgcagtgtatctgaaatattaatttctttaaatttcacattaagaattcaagtgaaattacaagaaaatcaaatagtgtaccaaactcaccagaatacttggatttcttagggtctctattaattacagctatggtaaactgtgcaaagtgactccatcctgaaacataagcaagccatgcaaaggattacgtttctgccgtcaaaaaataaaagcttatcactgctggaggcatctacctgggagcagcttatcatggttggctacacaaagaaagagtgacaagtgattgcaaacatcacatccttgtgggtaaatcaagatgtacctgaaaaatcaaccaatagatctcaaaattgtggtgcacaagtaaatcttaagcctgtacgatctcaaaatgtggtgcatccgcctatcaattagtaaacatgtaccaatgaagggaaaaaaccattaataaaaaatgttaccacctattgaacagaaaccaatagaaacagaatagataaatatatcatcccttaattctgtgtaattgcgtatgtaaatgaaataataaggtaaaatagcatccagaagacagaatagataaaagaaaaatgcaatgtactacagaccctagaaagtgttctaaaagtcggcgctaggcgccgcctaggcacccattaggcgctaggagccaggtagctgccgcaattagacattaggtggtgttttattgctattttagtgtgatatagtctagtttttatgtaatatgctggctaatttcttaggtttggctaattggtctgacctgggtgccccctaggagccgcctaggcagggcctaggcaccaaataggcgctaggctccacccagccactgactagcgccttcttgaaccatgccatagaacaaatagcgcagttttatatagaaaacaactatatcttaagacaaaaaaaactaattacatgacacatatcaaaatatttaggtataaaatatctgtatttcttgtgatctgtcacgttttataatacaatatcttttctctatagcactacaagctcaaatggtcatgtcagggaccaagtacggcttaatgaactggtatgaagttgctagtgggtagttagagagtgcctctaaaagggcgcaaggaaaatgtgatatcttatgcactcatttttcaacaacttatttgtacaaaggttgtgcttagtattgtgaatggtctaccctaagtactacaaccactaattcgtt

SEQ ID NO: 91157 - DNA, 2819 bp, Oryza sativa
taatctatctattattaaaatgatgttttttcatgttgcagtttcaatgcattctggctaggaatggatccaagtgtgcagaaatatatgacaagggaaaagactgacactgtattgaaagttctagtgaaacatttttttatagagaaggaagttacatcaaccttagtaatggactcactatatagcggactaaaggctcttgaataccagaccaagaataaaaagggggtgcccaagctagcagagactgtccagatggatattcgaagcactcctatggtgcttgttgatcaggacatgtttgtcttggccgatgatgtgatacttttgcttgaaagagctgcattagacactcttccgcatcaacctttgcctacaaaggatgataaaagctcacagaaccgcacgaaggtatgcatgatatcagcaaccctgtacagctagtttattaatatttcttattatggacaatcaatagatataagactgaaatttatttttcatatccaacttagaattaatagcaaattccttcatggttcacgctggtctcaattatttgcactcattaaattattaagaattccttcatcatactggtctcaaagatgtcttagtagctgtagtcttaaatgaggtatggactagaaaaagaaaaggttctctttactacttttggcttgatgagattttattttatgctactgtaataagtcaagtaaattgtgccttatgtggttgcaggatggcagctcaggtgatgatttcaacaaagattcaattgaacgtgatgataaacgacttgtagagcttggctggaagacactggaattttttgccttggcccatatattcaggtaagagatttgtttaatgtgtccatccagtattagttttttttttgctccataaacgttcaattacagacagtttgttaagaagttgatttctagcccttgatggtacagttgacatgctttatttctgttacttgaggctttagtgcataaatgcaagatgctatttcctagttggcatttgtggcaagacatgtcacttctgttatcagactcttttttaatctatatcttgatctgaattagttcttccttcggttgtcttgtattctcaccttataagtcttgtatcagccgaatagaagtggcataccaggaggcagtggctttgaagcgccaagaggagctcattcgtgaagaggaagctgctgggcttgcagaaattgaacttaaggcaaaacgtagtgctgctgagaaggaaaaacgcatcagaaaaaagcaggtttgtttctctttcttgtgcaatcttgctaattcatgctgcctatcaatttttttttcttgtgctaaatttgatgtaaactactttctgccacggtttaccctggccttgtgtggtcgttattttgtgtgtgaaatgggattatcaaagattgtattgttgtaaacattacaatagtattattggctgcatatgacataatgagcactattgtcttccactttgcctaggctaaacagaagaaaaacagtcggaaaaataataaagggaaaaatgagaaggttgatataaaggaaatagtaatagagagcagcagcccaccggatgataggatcctggatgatctctcaagtcaagcagaagaaataacatcaaatgcggacaaccctgaagaagtgtctgatatctctgataacagagatgatagttctgagttgcttcataacgaccttgaagacagtgaatccagtcctgttaattgggaaacagatgcttcagaaactcaagctactgtgcctgaaggtggtgaaatgaaaatgaacatgcaggaaagaggacttctttcctggatgatagctcatctacttgttcatctgattcagttccttcagttatcctgaatactggaggtgcctggacaaatgtcaaatcctcatcaaataggtatactttgatttttagcatgttcccacttctgtcaattggtatttatggcactgtattttgtgactcagaggaaacaacaggaggaataacaaggatcatgatgcacgaagtgggcttggacatggtgggttgaattcagtgccaaatggtattgccggatctagcagtagtacttctgttaactcaaaagaccaccaacatgaggtatgccatctatcttaaatgtcttacatagtgacttctgtgcattcattgggaaatgcgccataaagcagctgctatagaagaatggtcttttcaattgtacttatttctccatcaatgtattaagcatcgcaattgattgagtaataaacatataaaattactatttcaggatgacagagttgtatcacagaagaagcaaaatgcacatcggcagactgatgtcatgagtccgtccaagttaagaatgacagagtcttctgtcagccctattaagaagcaacacatcttttcgcagcagccaaaatcttcattagaaagcgccaataacttgagttcccgtgcaagtgaagcttcaggtgctgtgactgctagttcagtaatgggtgtcactaccactccaactgctcagttagtttcaaataaaggacctctgacaattcaagcaacccataatgagaggtcagttccagttgcacgacatccgcaggtgcctacggtctccaaatctgaagctcagaagcagacttccctggtaagcagtggtacagcaacccaggcaattacagtatcgaggcccttgagtgctccacaagtccctgcagcaaaacaaacagcacctgtggcttcagcagttcaaactgtac

SEQ ID NO: 91158 - DNA, 1938 bp, Oryza sativa
ccatgatgagggtatatgtaactccaataatctccaaatatgcatcaatcctcacaattgaggaatgatcaatatgggaaagaccctgtcattttcatatgattaagggtacttctcaggccatagctttcgacagcccgattggcagctcgaaaaccatctccgtatgcctcagatgaatccgtttcgatctgatgtttgatgaatgctccgagcttcttctcgaattcggtctttgcgcccttctttgatgtggttggagttgaagatgacgacgacgaagatgccactgaggtggctgatatgtcgatactagaaccaaagatgatctctgactcgagccacatgtgggaaagaacttggcatatgccttcttcaacctgaggactaagagaccgaaatcctagagagagagaaaaaaaagatgttactaacactgattggaaagggaacatggaggtggcatgaagtaatggaagtgcacatgattgtttgccagaacaatgagcagagtaaatgtacctttcagacgtagataagcatgcatcatttcatgggcgagaattgagccagtttgtaatctgcatgacaagcacgttataacgacagtgattagtggtatgttccgttttttcggactctgatgtaacatgagttgattatgaaagattctaacaaaaactttggtcagtactaaaggaaaaactaaaacttatacaatgtacctcggcaacccatataatatcaggattgcagtcacttcacatcgtctttccagcttatatggtgctgtgatcatatctataattctgtttcccggtccaattattggtcttcttaagatctggatgcattacattattcatcacatgcatattttttgtgtctgccagttatcaaatttatgcagtaacaaggcggtatttaactcaccgttctgacaatttgctcttcagaaagacatagtccccttgtttcaggaagatgatgcccctgagatgacagaaattgaaaaccttgtaagttcaaaatatactaacattctgcgcaaaaacataacaaaactctcatgttcatgccacttacatttttctcagtttctaaagcctcatttagagcctgtctctcaaccaagagtattggaacttgttgctccactttcatgttcagaccttcaaaaaattcctgaatgtccatatacagctgttgacactctggtgtatccattattgaagaattgagacattccaagcagagtttcctcccatcatctaatgtgatgtatttgatgtccatcggctgaatttcagaaggatgaaaagaaatgaattactagttcatccacaaatgtatactgaaattcataagtgccatataaatgtcacatagttaatcacatctgatcactagagaaaagaagtaattacataattaattgaaataaccactagtgacacaggagctacttgctagctgttaggcagtcctatgctgagccagatattgacacagaagttacttctttgcttttagaatgcttgagaagtttctgttgaattctacattgagccagcttttcaagaacctatcactaattgcaagctattgctgagaaatgaaataataagaatgggaatatgggaaccccagttacagcactatctgcatctatataaactggtgatgaaatgatcgcatagattcaaaacaaatttaaattgttattttccaaatggtagtcaaaactggctggtttctttccaggaacaagaagtgacaagctggggaaactggtctcattgaggatctagatccctgcactgacctccattctttcacaactgcaacacctaggagtgccatcatcttcatgggaaggacagtacttttgcatccagaatggatgtgctcggtattcgatcagcccattcctgttcg

SEQ ID NO: 91159 - DNA, 3739 bp, Oryza sativa
acattttttggttggaaacaagcagtacaagatgacgcccactatgtgttcgacagaatgcttcagccccaatgtcgagcccaatctcgctgttgatgtggttgttacgtgtgccaccacttctatgacctctgttgatctggtatctgctgaggacgcaatcggtgcaacctacatctacaatcctgtacagcccatggtaacgcccgccaagtgtttgacaaattgctccaaccccaataacatcccagacctcaccgtggcagcagtggttacgtgcacctccacttctctggcctccatggacctggaagttggtaaggacgtcgcctgcaccactgaaattgatggccctgactgtcacaaggagacgcacaccaaatgttcgatgttaggccttgatgtcaagggtggcgcagaccacgtcgggggcgtgttcctgacaatgtcaggtgtggccaagtctgttccaatatctatcgagtcaattgacatcttctcagcaaggttggtcagcgacctcaagcaggacataccaacacccaccgggtgtttgttgagaatccctcgatatgacagcaagacacagttcaataaaaagctaaggctggaggggattgaattgaagccatggccacctccaacctacagtggagtgattagcggactggagttccgaccaatgccctggccagcattcatctattgttggcttgaagaacatctacttgatccttggccaccaccaactgaatgggctgagttggaactgtggcccccaccacatgagaatgacatcctgcccttattgatcaatggcttcacccatatcctggtggatcgaaaagcaatttcaaaattctggaaagcgatttggagtgagttaggtgaagaatggtcattgtttgttcctaagctatatgagctgcacttgagtggtctccttcagcattcagtaagcatgatatcacaacagcttatgtcaaggaggatatggtccactaaggctaaaatgaagatgttgaatggttgggattctaaacagtacctgagcattatgcggcctattccaggattgtttgttaaacttatccaagatatatctccaaagagccatcatcaagcttatatagaagctcaagttgctaaaaaattcttggaaaactttggtgaagataaggtacactttttggctcaatcaattgctgtacctgacactcaccttggacaaggctgtattggctgttgttggttgtatggcccaaatgcaattagcacattccatttactaatagccatactgcatattgtgagaccactttacatggaaaatattttcactaggacttcacatgtagcaaagaaatgggctaaagacttgaaaggtgttgtgtttgattggaatacactgggtatagtggttcaagaggtcaattacattgaattgatctgtgaccgggattcgtatggttgtagtgttcagaagtgctatcctcagtctattctattcatgcacaatggttggtcttttggtggattgcttgattggaactctaaacaatacaagaacagtatgctaattgtgaacccattggaactcatgcaagtactgttagtgccattagtgtgggatccagatgctgagatgggtcagattggtagctacgctctacaaccagaaaattgtcaattaactacctgcatgagagcacattgcattaagccaagtgattatgagatcatcactgccaaagaaaaccatgctgctgatgctcctagactgcttattgttgtaatggaggatgaaggcaatacagtttggactttagaattttcagtcagtggagtggtacagaagaagcgtgatctttggttgtgtgcatttgctgttaacaaggacatgaaggttgttatgttcctgcagcaatatggttatgcaaacttagtaattgtcaatttattgagtgttccatgggatccaggcggctctcatttggcattagctattaaacaaggaactaggctttcactgtgggctattacaagcattggctggttgtgtttcctatggtcatattggctacattacaagagaaatagtaacaggggagatcaagtgggtgaagcttgcacagcttcgagtcatcggcttggggacaagccgaatttcaagggaaggagaatgttaggagccatgtgggctgcaatatgggctggatcagctactttccaagaagtccaagcaagcccaagaggcaaccatatataagtagcagcagcacttccaggaggggacgaacagattgattggccaaggcggcgaacggcggcggcggcgacctggaggctggctggcctctttgtcgatctctcctctatctcccttcttctctactagtctagaagctactagaaccttctagcccttgtatccttccatcttccacctcaaaaccactccactattgtaacagacttggctgttccctgtgttggatttggcactgctatttctgaaattacattgttgagtgggtctctaacaccttctttggggttcgaagtggatccatctgcctttgtgtcaacacccggccatggcttgcaagtacaatgtttccccttctcgataccgtcgtaaacggatgcgacatgtttaccacatccattccaggtgaacttgccacatttgctgcattccaccttgaagcacatcctgtgctcttcttcaggtgctcctttggtgcgtggtgggcagtggcaaatgttgggatgttcttttggataggttcctctggtcttcatggatttcagcattttatagcatcatatgctgttcttcttctgaaggaacaatgtacaaataccctatatatgctgttcaatgtagtctttgactctttggtgatggatacaatgtatggataatgtgtaaaatcttgcagttagtgaaactgtagatatttcctatgctgatgcttggtatgttgccaatttgcttcatgtgtaaacaagtctgggatgttgtgttcttgttgccaagcaagatcaaaccacattttcttgtggttgtatagatggttcaacaacgaagagaccaaagctgtaaaaactatcaacttgaaatttttgtttctgtgctagtccaactttagctatacagcaaacgttttttcaattcggcatatgaaatactttgccatgtcttagaactaggctaagtagcacacatttcgacacatcaaaaaaatgttaaattcacatcaaattcagattcctctttgaattacaagtcaaatcgagagctaagcaaatcgcggcatggagccgttggtcgacggcgagctctggtcgctgacccacacgtcctgcaccgacaccggcgacccgaccttcttcaccgcggcgtcgacgccgtcgaagccgacgccgacgtcgatcaccatgggcgggcggctgccggctccggtccgggctcccggcacggacgccggcgcggcgtccctgatccgggcgagctcggcggcgacctcgctcatggccggcctgacgtccttctggaacgccaggcaccggaacgcgagctcgctgacatggcggacggagcgcatcacccactcgtcggcgcggtcgacgagcgccggtcgacaatgtcgtcgacgcgccccttcccgatgcggtcgagagcgagcgacgcgaggttgacctccgccgcggggcgggcgaagtcgacgacctt

SEQ ID NO: 91160 - DNA, 2648 bp, Oryza sativa
aaaggcccgctttgcatctttggatggccacaatggtggcaacatcacatcatttgatcttgtacaaattataacaatttacaaacgttgtaagatgaatcagtgtaaagttcattctgctgtatcttgtgtgtctacgtagtgtatagttggggagcttgtccctgttgatccttgcaactttttgcagacatagatatagtgagagtcagggtcctctggaacaaagccatccggtagtacaccactctctgtcattggaacaggatctaagacagaccttttcgtcttgcccttgaacccgggtctggctgcaaaacattaaaaatgctgatcataaagggaacctaaaagtacaggagaatagaagttatcaatcaggattcatcacaaatacttccactaaaatggagtgttcatgaaaaagaaagaattataaggcttccactaagcaatgcatcagaacacgtaaattgcaaacatggtctgaacatattgtcagataacatttccacgtgcaaaagaaaaaggataaaatattgtatttttacgtacgcagaatgtatagtacaattttccaattgcatcctgattggttcagatgaggtaccctcaccgatggatcaccataagttatctaacagtttaaatgcaaaacttgatcagataaatcaatattagggaagggcagattaaaaaccacattctgaacaaacttttcaaagtgcctaccagcataaagattcctcctggtttaagaagcctgcaatcaaatggttgagctggtgagtctgcagcagcactattgaaatctatggcgtatcttggtgcagatgagactgtgaatatagcttagtggggtaagcaagacattaaaaacctttctacttctagaaccatctgagctgcgctgagaggagcacccacaccacactatggaagtagcaagatcacaatgttgaagaagtaccagaataaggaaaaggaacaatgaataatgtagcctacttaccatcaatgagtccaaagtacctagaagaaatgcacaaaaatgaacaagtggcattacatgtatgcttcaataattgctagaacaccattttaagaactcatacctttatcaatggcacaatcaaatgattcatcagaaaatatactcatgtccctagcatccatttgcatgtctaagtgtcataaggagaccaatggatggtaaatttcagtggaggtggagaaagaaacaaaatggaaaagcaatttaggatacactgcagctgtggaatattgaagtgtttctttctcataatctcaattacaaccgaagaaatgtcaatgttcattatctccgtatagccatcatcaaccatatcctctgacataactgcgaatggcagaacatggagaaaacattttgaattaacacaggtggtattagaggggggaagtgggaagcaataattggtgttccgaaggttagctttactctaccctgaaaaacctaactcaacagcaacacccaaacaccaatgtgtgcccgcaaaaggaaaagacataattgtactaaaaatgtcacaataggacacactaaatttcctctgttcctctttatttcccctactgtccatattccaaaaagacattgaatttgtaaaaatagtgcaaataaacaaatgcgctgccatccagctatggtcccaagatgccttgtaccataacgcagcagcagtaagccaatagcaactttaagctatcgcaggataaaaagtccctagtaaagcagacttatttttgcatatgtagtctatcactctagcaagcgtctgaaaaacaataattttcaggacaacctcctgcccaattaggccatcataaattcacaagaactgcatgctcgtgtcagttgcgtgttatcaatagcaagaacttgtaccttcagaaacagcctaattatagtaatatatcagagcaaaagggcactaatgccactatgtatgagaatggcgccatctgattgccataatggcacagatagaatagactagtagaggcttttagacaagaaaagggtctcttaagacaaaatcaccattcttgacaaggagctttccacaaaactattgccgaaacagcgatttctatcctaataacagtaacagtcactgcctatgcaagtagtaactgcccaagaaaaatcactatccatcaatcgccccccccatttcacaatttgcttaattcacttgatactactatactacgcgcgtagttgaaaaacaaacgtgaaaaatcacaaacgaacaacacacacaagcaaaagataaatttaactttctttctttggaacaaggaaaggaattgaaaacacgagagcggagccgaaagccgcaatctctatggaaagggaggagatggaggaggagggaggtggcgtacgagcggagccgcagccgatcatgaggacgcgggattccggcggggcgaagcggcggacgaaggggcggagcgcggcgtagcgctggtaccagtcgtacggcgcgccgccctcctccacgtagcgggcgtcccagtactccgccttcccgtagctcagcgccctcccgcctccccctcccccgccttctcctcctccgccgccgccgacgccggcg

SEQ ID NO: 91161 - DNA, 1996 bp, Oryza sativa
cctgttcaggcctgtgaaggttgtgcaggatgtacagtgaagcggacgacaggaagatgcagaccgagtagctcagcaggtccaaccccgttgttatcttcaccattttgctcctctcgaacatcttcaccagaaggatcatgacgatgacatgccctactttggttttcagttcgtccagggaggtaatcttcatccactttggtctttcctgaaacaagaagaaaacgaacgatcagttttctgaacctgccacgattgcagaattgcagagatgataactactgttctcaaggcagatgtagggagtgtctatgtttgtgcaaactatggttatatttgattatctggtttgtctgaattttcagtagtgaagttttggttgttttgcaattaaacagttcaatggatagctcacaaaataaaattttcagtccacaaacaaaggagtgatatggttagcaagtacaggttcatcagtaaaaggctaaaacgtgaaggttgttttggcatgcgaagatgattggctagttcttattcagttcctgtacattgtttcccttctgctataatataaaaccagcagttgctgggttcttttttttttttttaaaaaaaaagatgattagctacctttaaagcaaacatcccaaataaggatgatccctgcagagctctgtcagactcagaaggaacatcagtagaagtattgctgatgaacagcccgtacaagcccatcccaaagatcagcatgactgttccagcgagataaacatctgcagagagcagtaaaacacagcagttaatgtaaggttcaatcattctacacaccaatttactgcaccttgcatgcttgcagcctctagagttgataaagactttatcgtatattatgaagcctagagagtaacctaccattctttttgtttttttaaacaaatgagtaacttaccattctactaccaaccacctaggaatatcagaaatttaaggtgtgatggttacagttggtcaccaaaagcttttataacgaacgaactttcattggttgagacgtcacgaagcatgatcgatgaagattaaggtttttaaaataacgaggtggtattgattgagttttaattattacaaacttgaaaaatagattaatatgatattttagagtaactttcatataaaaagttttcgcgcaaaacacaccgtttaatagtttgaaaagcgtgacatgaaaattttaatcttcatctaactcttcttggagaaaagaacggcaccatagagttaaattcgaatcattgtgagttgtgacagatactacctttctttgtgccagctgactgaataaacctttttcagtagctcttacaagacagaattctcaaagagtttaggtagtgacatatttatacttaaaccactttggatcaaacagcaagcagaatgggcatctcaccaatggcttcgacaactttgaggaccatctgccctgtatggacgcctttgagacagcccgaccaatacacgctgtaagcctcttttatgtaaacacaaccctaatcacgagtagacagaagctagatgatcagagccagaaaaatattgacatggatgttctctagtgttctaccctgcaagaaagatattcttgttcttgatacagataattcttgccctgattggaaagaatcaggtgttggagacgaaatggatatgatcacttacattgaggaagcagaggagggatccggccagtgatccggcaaccgcgagaagagccaggaatctgaaatcgaagatcacctgcgtgcgtcacgatggacagaaattttagcctgatttgcaataccaagcatggtaaatcgacgcagatcttggaaagaaccaagcagataccctctcgacggtggtctcgacggcggtggacttggtggtgggaggaggaggaggagccatggcgccgttggccccgccgacgagcccgtagcctcgcggcttg

SEQ ID NO: 91162 - DNA, 4431 bp, Oryza sativa
cctgcagccctttggtttatcagaaccatgggtacaacacttgtccaagaccaagttcatcagggcagacagagagaagttgagaaccttgtttacattcttgggagaatgcttgaagctaattgtggcagataatgagctgggaagcttgaaacttgccctcgagggaagctatgttgaacctggccctggtggtgatccaatccataacctgaaggttctcccaacagggaagagcatccatgctcttgaccctcagacaatgccaactatagctgccatgaagagcgccaaaattgttgtagaccgtctgctggagtggcaaaaggttgataatggtggcaagtatcctgagacaattgcacttgtcttgtggggcaccgataacatcaagaccaatggtgagtcattggcccaggtgctgtggatgattggtgtgcgctcggttgctgacacatttggccgtgtcaaccgtgtggaacctgtcagccttgaggagcttggacgtcccaggattgacgttgttgtcaattgctcaggtgtcttcagagatcttttcatcaaccaggtatgaattctgccccagccttacatatgtagaattttgtgcacatgcaaggaaaaatcatagctgaactaatgtacttctggaacacactgatgcagacgaatctactggaccgggcagtgaagatggttgccgaactggatgagccagaagagatgaactacgtgcgtaagcatgcacaggagcaggcacaggaacttggtgtttcattaagagaggcgacaacaagggtattctcaaatgcatcaggctcttactcatcgaatgtgaacttggcagtggagaatgcatcatggactgatgagaagcagctccaggacatgtacctgagtcgaaagtcttttgcatttgatagtgatgctccaggggcaggcatgcgagagcaacgcaagacatttgagcttgctctagcaacagcagatgccacattccagaacctagactcatcagagatttcactcacagatgtgagccactactttgactcagacccgacaaagctggtgcaaggactgcgcaaggatgagcgggcaccttcctcatacatagcagatacaaccacagcaaatgcacaggtgaggacattgtcagagacagtgcgccttgatgcaaggacaaagctactgaaccctaagtggtacaaggggatgatgaaaagtggctacgagggagttagagagattgagaagcggctgacaaaaactgttgtatggagtgcaaaatctggacaggttgtcaactgggtttatgaggaggcaaatgccacatttattgaagatgaggctatgaggaagaggctcatggacactaaccccaattcattcaggaagctagttcagacctgcctagaagccagtggtagaggctaatgggaaacatcagaggaaaacttggaaaagctcagggagctctactctgaggttgaagacaagattgaaggaattgaccggtaaatttgtttgatcaatcagatcctgcattcaaaaaaggaggagaaatccttctgtctcactgaattgagagttgagacttgtacaatttatgtaatttataaaaagttgtaacatgacatacacgaggatacagtgtttaacaaagagggtgcctgtgaatgaaaaatggagcatgggtagaagttctttctttggaatatgttacttattgtcacttaatcacttgttcatttgcagactagtatttgatacctactaggaatataaagcaggtggttgtgaacacagaatatcagtaactattttaagaaaactacactagagtattacgatccttcactccatactttacatatgtacgacaactgtacaaaaacaggaatttagccaacacgaaatagtgtgctaatgtggccaatgtgactacagtagcaagttaaaaatgagaacaccttagtaatttaattgtgaacattccaatcttgacaaagtaagtttctggcatctgattccacatgtaaatgacaccaagaaaaaacagcatatcttgctcaacaaaaagggtgttaaattgaacttacagctgaagtggatggcaaagaagaacaaaacaatatactgaataaactttgttttgttttcccttcccagtccgaagtatacagttttagtgaattcctacatcagatcaattccataagaaacggatcacctgaagccatgactctgattagctctacaaaatctatctcattctgaaccttcattgggtacactgcatgtgcttgagcagtgtatattgttgcaaaagtggcatttgattgcacatttgtcctataaataagtttggtcaaagcttttgattcaaaattgcttggcaaatccattgcaaggaacaacatggggatagcaatactgtgatgaatgtctaagcttccaatagcttgaactagataagaaaagtcaccaatgtgacttcgaggtatgtagaatatctcactgttgcaatgaattatcttatcttcgccaacacttcttttgtagttggcttgatattgaaatggaaagctagcaattgccttttttaccatatctccttggttaatgaaccattcaattttattgccatgtaaggggacatcggaccatgattccttcacctatggagaaaaagatgagttaatttgatgggacaaagaaattcacacatatattttggaaaccaggacatgagcatgcaccttgttggttatccagagcttagccttgtcaaaatcatagaggttccaataattgaggatcatatgatcctgaaggaacataaatcccccagcacctgcaaaccggtcaaacacctttggcaagaacctatagtggaaatgtatcagtaagtgctgcaagctttttacatattcaagtaaatgaaactttactggatgaagtggtcagtaagatttgtgagttatgacgacttgaagcgtaacattttactgttgattggttagaatcataaataccaagctgatttcactcacttgtaagcttgtgccaagttgctgacttcaacagcaagatctgaattgcttttctctgaaagaataacaactgccctgaatatacgaccataaagcaatctccactcaagtgcaacacggtccacaggtacggtgcagtgcactataagcacaacatcaccaaagtgcttcctccattttatgagatttccaatctcagtgctaacttccccaatctcctcaacaccaagatgtacggtaggcagtttcttggggacaaacacctgcttgtccccatgtccaatggtcgcccttggccgatcaatctccaatgacatcaaccttggctgccggtaaccaacagagaccagatcttgcagccacgcggacatgaactgcaaatccttctctccccagaacccctcctcagtcatcgcataactcaaatcaagaatacgttcaaagagtgtctgcttatgtgaccgccactccattaggaaatctatcagcctccctacactgacatggatatccttctcatcatcaaacgggtgagcatgcacattatccatgcggtgcacggtcggtgggtagaccactaagtaacccccaatctcccataatatgcgctgcgaccaatacccacgtataacatcagctgccattggactcactgatactggcaatgcaagcccccaaaatgccggtgaatggaacagtgtattaactgagttgattggagccatcatgccctgaggaagtgcgaccttaggcgcatctgcatcaaaccggagatcaaaagcttccatttccgatgatttccgagtgaagtagaacacagcgtcaacatccggtaggccattgcacagcccctgctgtatgaactgcccgccaccgaacacctgagtgtagaattcttccacacccacctccccggctttgtgcagcggcaacccccgcggccacaccgacggctgcccaaagtgcacgtagggattcaccaccgtgcggttgggatccgcatggctgtactgcaagagcacgccgcccccttggcgatggtccagatcgacatcgaagtgcttggtgaggttactgcccaggacggcgttgcgcgcgtccgcgtcgtagatgacgcgcgcgccgcgctgcacggcgaagaggtaggcggcggccttgcgggcgtggccgcgcgcggggaggaaggcaacggagcggaacccgaggcgcgcctggtcggcgagcgtgagcagcgcggcgcccgggtgcgaccagtccgggggcgtggtctcgtcggccacggcgaggagctgccacccggggaccgcgggcagcgggcggtggcgcgggtggtgggccgccgcggcgaagatgatccacctggaggcgcgcagcg

SEQ ID NO: 91163 - DNA, 8808 bp, Oryza sativa
atcttaaccattacaggcaagatgttgtgtgaagaagggcaaacatgcacgttgccaagattacacgcggtggacaagaatgaccgatttgtgaccggtctgacactgaccatatcgtcagcgcacagccatgttcccacgacgcgctcacccccggcggaagtggaggtaggtgtgggctgtcccatcggagcgtcattcggacagcaaccgtgctgatctccgcccattcaagagaaaaagaacagtccagtttggaaagagaagggtgcatgtggtatccccttgaagtataaaaggaggaccttgcccatagagaggggggggggttgattctttcccagattatgagcttagaacgggggagaagtcagctcacacttgtagctcattcatacgcagatccaccaaaacacaggagtagggtattacgcttctcagcggcccgaacctgtatagatcgtcggtgtctcgtgttttctggctggcatacgatatttccacatacagagagagtgagagcttgagatttcaccctaagcccccggccgaactggcaaaggggggcctgcgcggtctcccggtgaggagccacgagctccgtcatctggcgcgccaggtagggggctcagcgtgtggtttctgagctctcatactcttccgtgtgcgccaagtttcccttgttctgcctaatggccgagcaagcaaaggcgcacaacctctctccgagtgtgagcggcgacgacggggagccaaacccgcgccgtcgagctcgtactcccccacctcctccacgccaaagtcccaagcggggggaggcgctcgagagagtcgaaaaatccgcagcatcgccagtcgcgggtggtgcaggagaacggcgagatggggagcgtcgcctcctcgtctacggcgacggcagcacgccacagggcgcgcttcaggccgttggcgcgctcctacgccacccgcctgtcgtccctgacccggagtctccagcccagcgatggctggacaacgtggccaacttggtcatgacggcacagcagcgcctgggtgctggtggacggtccgccactaccaggacctccggcgccgccaccaccggctctgtgtcatcaaggcggagggcgcggcgagcggcggctgctgcacgccattcggctaccactccctcgtcggcgcctccgactcgggaggatcagcatgaagagccggatgcccgcctcgacatcgagcgccgacgtagtgatcggcgtgctccccgcgcaacggagggtgcctcttcgtccagggtgtcacctcgacatggacgtgaggatcaaccctccgtgcccccggttggtggtgttggctgtagagcctttgtggcgagtcttcggaatgtccgttggcccccaaggttccggcccaccatcaccgagaagtatgatgggagtgtcaaccccaccgagtttctccaggtctatacgaccgggatcgaggccgctgggggagacgacagggtcatggcgaatttctttcccatggccctgaagggacaggcgcggggttggctaatgaacctgccacccgcgtcggtccactcctgggaggatctgtgccagcagttcaccatgaactttcaaggcacctatccacgcccaggtgaagaagcggacttgcacgcagtacagcgaggggatgatgaatcccttcgctcgtacattcagcgtttctgccaagtccgcaatactataccttgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggtccattccggcgacgagggtcatgtcctcgccgtcgagggcgctccgcgggccacccgaaaggggaggcctgcgagcgacaaaaagaaggaagccgacgctccctgacctcggctacttggaagagcgaaggcggcgcgcggcccttcgagccgcgcgctacccgcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgattggcgtcccccggccgggctccgttcggctggccacgggcgacggcacagagctgcctaacccgtggaacatcgaacaccttcgtcgcttctacccccagtgggggtcgggtgtcaggtcttgggctcgggccaaccccgcacccccccgggcgtgcagggttggccggaggcttatcttttttctcttccatatttcaataaaagcagtttcaatttcctaaaggttgtgtctgtgccgttttttccttttgaagaatcttgacttgaaataaggtcactcgtactcaaccttgccctcgggggctcggttcggtcagctaaaatcgccaaacggggcccagaaccgagccgtgccccggggcgtggtgaactccgggggggaatcggcaaaaacccacaatcgggtcacccataaccctcggtcaccacgctcccggcctggccagtctcgatatgtggatctccccaggcactagccccgacccgagccatttgaggactaggacctgggcacgagcccttgatcaagccaagacacagaaggaccgcggcacagaccatcctcgtctcatacacacaacaaatagaattgacatagaaatttcctctttatttggttgcagattaaattagtctatacaagaagggggcccgaaggcctcggaagaagaaagaaaaagttattcaagattggcgggggcctgggggctcactccgacgcgcccgggtcaccagccttgtcgtcgctgtcgtccgcaccaccgtcaccgccctcctcgtcgaagtcgagggcgaacgcgagccgaagggccgtaccctcgaagctgtggacgatgtggtcggcggcgtcccggacctgcgcgcgtgcgccgtcctcggttccggaagggaactcttccagcgctgcccacggggagaagtcagggtccgagaggcccccaagccgaacggcggcccaaggcccccgacggccggagttggccctccgcctgcttgtccgacggtgtcaggcgcccccgaccctcaggatagcctcggggccactgcgggaaggccgcgcctgtcgccctcttaccccgaggatatcggtgcagaagccgagggcgccccgcgctgcctctcggatgaagagcgccctggagatgcggcccctagcgaagaggatcggccccgccgaaaggtgcagcggcccgtctactttgttagcgaggccctccgggacgccaaaacccgattccctcaggcccagaagatgctatacgctattctgatggctccgagaaaagcaccatcaccatatctccaagcgagacaaatctgctcacccagattcgcgcgctgctcaagtgatgtggcagtcttgaatagaccgcccattatggacaaccaaagttaccaataccaatatgcatggattaagaccgttgggtattttgcccaactatggagaccggtcccacttgtcaccaggctttaggggtggcgtcacacctgaccgcttcccttgggaagggaaattgctctggcataacgccgggggctactgtcggtgatatgggaccgggagtatcatgaccagaggcttgaggcagactcaatcgcccacgtggcctggcaccttcggggacgtcgggcccgagggtgaggtgtccgccctcctcctgatttcccccgagggggggtcgggttgcgtttgccccggccccgagggccgaggcaccccgaccccttaaagaagtctgcgccacgtatatgggataagtgagcacagctgtgctcacctaacagcatttattgcagtctggtcaagcgtgtcacgctgcatgcaacgcagtacagcacgctcttttatccggtctgtgaccggtcacagaccggtcagatcacgggttaggtggcgactggcggtctgacacacgccatgccccatcccgtcaagacgaaagcctctagtcactcgtctcaagccggcgttaagcgtgttatctcttagagatgacacgttagacccggtcgatatatgccaggcttcatcttaaccattacaggcaagatgttgtgtgaagaagggcaaacatgcacgttgccaagattacacgcggtggacaagaatgaccgatttgtgaccggtctgacactgaccatatcgtcagcgcacagccatgttcccacgacgcgctcacccccggcggaagtggaggtaggtgtgggctgtcccatcggagcgtcattcggacagcaaccgtgctgatctccgcccattcaagagaaaaagaacagtccagtttggaaagagaagggtgcatgtggtatccccttgaagtataaaaggaggaccttgcccatagagaggggggggggttgattctttcccagattatgagcttagaacgggggagaagtcagctcacacttgtagctcattcatacgcagatccaccaaaacacaggagtagggtattacgcttctcagcggcccgaacctgtatagatcgtcggtgtctcgtgttttctggctggcatacgatatttccacatacagagagagtgagagcttgagatttcaccctaagcccccggccgaactggcaaaggggggcctgcgcggtctcccggtgaggagccacgagctccgtcacccggtattcccagagaggtgattgagcactccttacatgtcaaagaagatgccaagcctatcaaacaacgactccgccgattcgcacaagacaggaaggacgcgatcaaggaggaattaaccaagctgttagcagcaggcttcatcaaagaagtccttcatcccgactggctggcaaacccggttctagttcggaagaaaacagggcaatggcgcatgtgtgtcgattataccgacctcaacaagtcttgtcccaaagatccttttgggttgcctcgcattgaccaggtagtcgactcgaccgccggctgtgagcttctcagttttttggattgctactcggggtatcatcagatccgactgaaggaatccgactgcttgaagacttcattcatcacgccctttggggcatactgctacgtcaccatgccgttcggattaaaaaacgcaggagcaacttatcaacgcatgatccagagatgcttttcaacacagatcggccgcaacgttgaagcctatgtggatgatgtagtcgtcaagaccaagcaaaaggatgatttaattttggatctagaagaaaccttcgcgagcatccgcgctttcaggatgaaattaaaccctgaaaagtgcaccttcggagtaccgtcagggaagctgcttggttttatggtgtctcgtaggggcatccaggccaacccggagaaagttactgctatcctcaacatgaaaccgccaagtacccagaaagatgttcagaagctgactggttgcatggcggcgctcagccgatttgtttcaagacttggcgagcgggggatgcccttctttaagctgctgaagaaaacagataacttccagtggggacccgaagcacagaaggccttcgaagatttcaaacaactcctcaccaagccaccggtcttagcttcaccacacccgcaggagccgttgttgttgtatgtatcagccaccccccaggttgtgagcacagtcttggtcgtcgagcgtgaggaagaaggccatgtccagaaagttcagcgaccaatctacttcgtcagcgaggtcctgaccgactccaaaacgaggtaccctcaggttcagaagctgttatatggtattttaattactaccaggaagctgtctcattactttcaaggtcactcggtaacggtggtcacatcatttccactcggcgatgttctgcacaatcgcgaagcaaatgggcggattgctaagtgggctttggagttgatgtctttggacatatcattcaagccccgcacttcaatcaagtctcaagcgttagctgattttgttgccgagtggaccgagtgccaagaggatacccccgtggagaaaatagagcactggaccatgcattttgacgggtcaaaaagactttcgggcactggagctggagtggttttaatttccccgactggagaaagactaagttatgtgctttggatacatttttcggcgtctcacaacgtcgccgagtatgaggcgctccttcatgggctacggattgcaatttccctagggataaagcgtctaatagttcgaggcgattcgcagctggttgtcaaccaagttatgaaagagtggtcctgccttgatgacaatatgatggcatatcgacaagaggtacgcatgttggaagacaagttcgatggactcgagctcagtcacgtccttcgacacaacaatgaagccgccgacagacttgccaactttggatccaagcgtgaggcggcgccctctgatgttttcgtcgaacacctttatacgccgacggtacctcacaaagataccactcaagttgcgggcactcatgatgtcgctacggttgaagccgactggcgagagcccttcatacgatttttaacttctcaagagctccctcaagataaagatgaagccgagcagatttcaaggcggagcaaactttatgttatgcatgaagctgaattatacaagaaaagcccttcaggaattctgcaacgctgcgtatctttagaggaagggagacaattgctgaaagacatacattctgggatatgcggaaaccatgctgctgcgcgcaccattgtcggcaaagcttaccggcagggttttttctggcctactgcagtgtccgacgccgacaaaattgtgcgcacatgtgaaggttgccaatttttcgccagacaaattcacttaccagctcaagagttgcaaactatcccgctgtcttggccgtttgcggtttgggggctcgacatggttggcccgtttaaaaaggcagtcggcggttacacgcacctcttcgtggccattgacaaattttccaagtggatcgaagctaagcctgttgtcacgattacagcagataatgctcgagacttcttcatcaacattgtgcatagatttggagtgcccaatcggataatcactgataatggcacacaattcaccggcggagttttcaaagacttttgtgaagattttggaatcaagatttgctatgcctcagtagcacacccaatgagcaatggacaggtggagagggccaacggcatgatacttcaagggattaaagctcgtgtttttgaccggcttaaaccctatgccggcaaatgggtgtcacagttaccatcagtactttggtctttgcgtactacgcccagtcgggccacaggccagtcaccttttttccttgtctatggggcagaagcaatgttgccgagtgaagtcgagttcgaatctttgcgcttccgtaatttccgtgaagaacgatatgaagaagaccgagtggacgacttgcaccgactggaagaggtccgcgaagcagctttgattcagtcagctcggtacttacaagggttgcgacgttatcataatcgcaatgttcgatctcgtgcctttctagtcggcgacctggttttacggaaaattcaaaccacacgagatcggcacaagttatctcctctatgggaagggccatttattatctctgaagttacccggccaggttcatatcgactcaagcgcgaagacggcactctcgtcgacaactcttggaacattgaacatcttcgtcgtttctacgcttaactttctcattgtatttccctattttgactgtcaaacatcaagttttctccttgaagttgtcagacgggggctatcatcataataatggagtgtgattttttatcaattcagtttgcttacttggtttatcattgccttgtttggtttttctacttagtttgcgaggactgaaagtttttaatagcttctttgggttttaggctcaacaaagcttagtaaaaacttttaagaaatcaaaaacttcgcaagaatcatcaagcacagcataaatacaccagtattgtacaaattgagcctccatgtattacattcaaactcagtcagaatcagtcctttcatcatcagagtcttcattactcggttggaggtcgttattgcgaaattgttctacaacatcactcgcaattttatcagccgcattttgcgcactgctgataagatcaagggcagcttcttcacttgtcccgtctgcaaatccatcaatggtgtcgacttcaattctcgggtacaaggattttgtcatcgccaaggccatgccagctcccatacttccagctttcttgatattcttgaaatatacttccggagcaacactcagcttgtcaaatatttcggttgcgtcgagtgcactcggaccaccattattgaagaacatagcttggataattggtgcagcggcattggcgacgttatcccttgctccttcaagcctcttgatcttaccaaccaggacgtcaaactgagcttgagatttgatcttgcgatctgcaaaacacatttatgatga

SEQ ID NO: 91164 - DNA, 1721 bp, Oryza sativa
gtactttcctataaaacctagattgcagaggttatttatgtgtaggaaaacggccgcatatgctaagtggcacaaagagtgtagggttgatgatggagttatgcgacatcctgctgattcaaaagcatggaaggagtttgataaaatccattcatcatttgcatctgaacctcggaatgtgaggctttgtcttgctagcgataggtttcagccgtttgctaacatgcgaacctcctattccatctggcctgtattccttgttcctcttaatttgcctccttggatgtgcatgaagcaacaaaatgtaatgttgtcaatgctactaccaggacctgatggtcctggggatgcaatcgatgtttatctgcaaccattgatagaggaactgatagaactttgggaagatggagttgacacatatgattcatcaaccaagacaaatttcaagctacgtgcacagctcttctttggacagtgcatgacttccctgcttatggaaatatatcaggccatagcacaaagggaaagttggcatgtccagtttgtcataaagaaacaaattcaatgtggcttaagaaaggtcggaagttttgctacatgggtcatcggcgctttcttcgcagaagccacagatggagaaatgacagaacttcttttgatggtacaaaagagagccgagaaccaccaaaggagttatccggagatgatgtgctcaagcaagtgcaggatttacagggaattatattgtcaaaggatatgagtaagaagacaaaagtatcacgcagtgataggggagataactggaagaaaaggagcattttttttgagttaccatattttaaaactctattgctacgtcataatcttgatgtgatgcatatagaaaaaaatatatgtgatagcattattggaacactaatgaatgtcaaagggaagaccaaggacaatattaatacccgtagtgacttaaaactcatgaacctgaggccagacttgcatccagtagatgatggaggaaaggtggttttgccacctacgccttacacgttatctccagaccaaaaaaaaaagcactgcttagtttttttaaagaattgaaagttcctgatggattttcttcaaatataagtcgttgcgttaatatgaaagagcggaaaatgtcaggattgaagagccatgactgtcatgttattttaaatcgtatactccctcttgctctgcgtggactgctccctgaaaatatttatgaaccacttgtggagctatcccagttctttaagaaattaaattcgaaggcattgtcagttgaacagcttgaagaaatggatgctcaaataccaataattctttgtaagcttgaaaaggaatttccaccatccttctttgatgtcatgatgcatttgcctgttcatttggctagagaagctctaattggtggaccaaccatctatcgatggatgtatttatttgagagacaaattcactgcctaaaatcactagttcagaatatggctcgcccagagggttcaattgctgagggatacattgcagatgagtttatgacattaagctctaggtacttggatgatgtcgagacaaaacacaatcgtccaggaagaatacatgacacatctattggtaacaaatctaatttatcaatcttctcctgtgctggaaggcccattggttctcgtaaaactcgagatcttgatatgcttgaa

SEQ ID NO: 91165 - DNA, 2520 bp, Oryza sativa
catgaccacaccagttataacaaagaaggtgggtgggttctgtatgttattcccatgagacattgttctgatttgtcacttctagtgattatggagtcagggtcttagcatgtatatgttgagaagttatgcatcccatttaatcgatgctgtcatttgcagtcagctaatgaaaacaagtggaagatgtcctttgtgatgccatcaaaatatggtccagacctgccactgccaaaagacccttctgtgaccatcaaggaggtgcccgccaaaatcgtagcagttgcagccttttcaggtcctaatttcatattctcagttttgtttgtgtacccatttcaacatgagcaatgctacacgtactaaatttttcttactaaacttttactaacaatcatctgaaccgtttgatttaagtagatggaagttacaaaaaatctagatgcactcatagcatgacacatcagtgttagtaagaatttagtaaaaaaaagttagtacgtatagccttttcctttcaacattgggatctcgatatgatttttgtcgcatttgcttatgaacctatttgtttttctaaaaatagcaatcttctgcttattggcactgccgttttcacatttgtaacctttccatttcctctgctactttaaaagcacaggtgtcgtccttcctttccctcccccaatcccacgtatgaaaaaccactccaaaaaaaatccagtgcaactaaaaaactagccaacagacaaaaaaaaaaacacattccccagatcccattgcaagggttgaaaagattgagccatgttcccatatcccgttgcaatgcacgggcacatgactagtaatgataaaagcttacctcttatccatcatgtgttctctggagaaatgcataattgaaactgatgagtttgcacagagcgacttgcatcattaattgtactatgtggttccatctgggaattattgtctgatgtaaattgtattgttgtttcccatattcgtactaatcatcaaaacaatctgtaatattagcttttccgttattataaaaaataaaaaaaataccttttctttttcaagtaatgagaccagaacaaggttcacccacttacattatcatcttatcagaaataatttagactttatgtttgattatgttttcaacatactacaaaatcacccaaaattcgatatacattacccctgttattttcaactttccttctcagtacagaaagtttgaaaatggcatgcatctctcatggtatttattatgttttgagctaaaggttaactctctttctttctgctaaagtaatataagttttatagatattgaaaacaccttgaaaacgttctttgttggttcgagaggatacgcaattatgtacattatgcactcctgccaaaatggcaatcatccactacactgacaagtcatcttttatactctatttgctgtaaaacaggtctggttacagatgatgacataagccagagggaatccagattgcgggaaactctccaaaaggactctcaatttcgggtgaaagatgattcagtggtagaaattgctcaggtaaatcttgctcaaaataattgatcaatattctaatgtcctacataaataagattgatcattgactgatcctgggttttactgaatctgcagtataatccccctttcacacttccattcacaaggcgtaatgaaatagcattggaggttaagaggcttgatgcaaacttctgatgacctagattaacaaataagttattagatttcagtgtatataaaaatgcacgcacctacaaatttagaatttcaatcttctctttgctcatattgtatatacatatgtatcgtgtatcagacacaaatttacatgattgtaaaattgaatgttgaagtatcatagttcattttgatattttaatttgtgtatggtattttttagcatagaaggccatcctgtcttaagatctctgtcacaaagctaaagtagacctttttttcctcgtacaacttttgtaccaaacctagaaagtcttttttacagaaataatgcgttcagcagagttttgagcctgccatatttgacactgatgggcatattttcaccaatttagcatgtagtacatgggagcatcagtaacagtaggatatatcattaattcattatggagttcttgaaggttcttagattggttctttaagctggattctgttttggactctgaacttgtaaagctgtgatctttatgcagaaattaagcaaaggggatatattctatcatagtatcatctaatgatttggcttgtcacttacatttacaggtgatatattccttatatgcgttcctatttccttgtttttatcgtgaactagcataaacaattcgcctaattgttgtcctagttggtttttcattttgtgtgcgtgtgcacgtttgtgtggggaaggtgtttgccgttcactggtcatgggcatatctgtacataggtgcttttct

SEQ ID NO: 91166 - DNA, 1025 bp, Oryza sativa
aggcttgagaacaataacctgctcacagctggaattgatgccattaaaatgtgtactatctatgaagcagatcaacactgtcgcctggcgttttttttttttgacatcattggattacctttctcatatactacacctcataatcagcatatgcatactttagctatttgctatgttggtgtcttggtgacatgcagataaaggataagttggctgcattatacttagagggctgtaaagcggagaaaggcgaacctcttcctgttggactcgtggatatgagggaattgaagaaaggcgcggataggtatttcagatacgttggatccctcacgacacctccatgcaccgaaaatgttatctggaacatttttggagaggtactattccccttgcagagtaatagaaacatcatgaaaacttcgtagtgagttatgtttttatactcactggcgcttctaattttgcagataagagaaatgaccaaagagcaggctgctgctttgagggcccctttgcacgggagttacaggcacaaccgcaggccgacacagccactcaatggtcgcaccgtgcagctcaattacatgtaaccccataacggtaatccaaaagatgctttatcctgcggcagctcatctatctgcagataataatgtgctttagtatgtacccaagttcaggaatgtcaatgtaatcggcgccatggactgcaataaaaccttgttcattgtcatggttcacatcattcatttttcttttgtgagaagtctccgaaagggagataacggcatggatgcagggaagacgaagaccctgaatgtatgaattctatgcataggaagacagcggcatcgagggaggacatgaccatgacctcataggaattgtttgatcttctttttaattgaaatgaagtgaggaatttagaatggaatagaagcaggttcgcttaactgttaatcacttgcaaatggaggaatttatcccttatggcttcttgttgctgcctgttctagacgagg

SEQ ID NO: 91167 - DNA, 1612 bp, Oryza sativa
cgtgagaagataaggaatgagtgttctactaggtaagaaaagatagggcttgtttagaagagattttggcagttgcagtttctatcagaattgaaagctcctcaaacagtccagtttatgagaagttgtagttatataatcgagaaaataaactagaagctaaaaattagggttcctagcttttttcagatttttagaagctgacttactaccaactaattattttttcagaatctttgaactttcccaaataggaccatagtccgacttggagctatctagaaccgcctgagataatatccaaaatgagccctcaagttctttgtgaacaaaggatagttctaaagtataaattgaccttcacaaaagggagagggaatccagtatcgcctatttaatattgagtacacaaagacacagcaagctaatatcctcgagtcgtacaaggagtttcttgaaggcaatccgccgaccgcatcaccaaggcatttcaccaagatgggaaaatggtagtggatgacgtaagataaagaggtcatggataccactacaatcactccctctgctatacactaagatgctatgctaggatgaggtagagcttagtgcgaaagatccaatggtaggtgagggtaaatccaacaacaaagcttgatgcaaatgatcctgtggttgctggtagagtaaaaagctcagagttgcataggcggtactcattgatactatgagtgttagtagccgtgaaatttgaaactcggcaaagatgaacaatgtgacatactggatcgatgatttgctagcttatagctcaactccgagtaacttggccattgttgataaaagaagggagataagaagcaatggctaacaaacgtggcccacaagttagtatgatagagttaacagagcggggtttatgtaacaagttaccttaaaatcttatgtttattgaaacaaaccccaaaatccaaggttttgtgacaggcataactcaaaacctaatactttgtgaaatttacttaaagtttatttgtcacacgttgtttcaaacaaaaatatagttagaaaaggagcgagcagtgtttgtacttttcttttttgaaagagaattattcatgatttttacatttggcactagtcactcgtatgtatgttctcttacataacatatatagtgtaggccaagtagaccatagaccactctagttacatacgagtagtttcgatgaaaatgaggggagacaaggatgcatgacgaagtactgaacggagctaataatgcatcgaataatgaatgattaaattatcatcactaaattagcgacgaattaaaacactgaaaacaaaaagagagaagacatcaacatctctgaatcaagctaatgatctcctggacgagcactgatgagaggctgcagagccttgacgacgatcgtcatgttgggcctgaaatcagcctcgtactggacgcacagcgccgccaccgccgcgagctgggacacatgaacattttgattcgttcagaaaatataccagattatacacagcaagtttgctaagccgatcctgacacaaacgacttgctgatctgaagaaaaaaaacagttcagaa

SEQ ID NO: 91168 - DNA, 758 bp, Oryza sativa
gagctccacatactcgcccccacaccccccccctcccccgcaatcggcgttgctgttgggatggaagggcgcgagggtggggagctcgggtcggcgtacaaggccgccatgctcaacggcgtcaccgtcgccgtgaagcggatgcgcgacatgaaccgcgtcgagttcgaggagcacatccagatgctcggtgacctccgccaccccaacgtcctctcccccgtcggctaccattatcgcagggaagaaaagctcatcgtctccgagttcatgccacgtggcagcctcctctacgtcctccacggtaataataatgacagcaaatactagtagttcttaatcaactactaatctcgattatagtttgctaattacgatgtgtttgtttgttggttaaggtgaccagcgcccggacagggtggtgctggattggccggcgaggatgaggatcgccgtcggcgtggtgcgaggcatggcgtacctccacgagaagctggggatcccgacgatgaggctggtgagcatggacggcgccgacttcgacgccatccactcctgccgccgtggacatctcacactactcgccgtctgaggtctgcaccgcctccacattgagctgcccaccggcgagctcggcatcgaggacggcgtgctcctcaagtggaaggctgacttcggcgtacaaggccgccatgcgcaacttccatcccaacaacaatgccgatcgaggggggggggggggggcgggagtaggtgga

SEQ ID NO: 91169 - DNA, 4488 bp, Oryza sativa
gctcccgacttgcaccgccgcggcgttctaatgcgcgcacgccgcacacacggagacacctcgcctgctcacaaccccccacaccgcgccaccacacgcgcactctcggtctcgctactcacacaacccaacccaccaccacggcgccaccgctcgcgtgcgccagcggcgcttcgctctcaaccggcggcgcgaaccgcgtaagagcgcagagcgctccgagttacccatggttccatcactcacacgcagagcgttcgcaacttcgcacacggtgcaagcgagagaggggaggaggaggaggagacgaaccttcttgcctcttggttgatctggaagcggaacggatcggagagacgaggccggggaggaggaggaggcgccacggcaggatccaagcggacgaaactgcggttcacggtagcgccggccacggcacacgctgcgcttctgccacaagagagagacggtaagacaacgagaagatggcacggccgagaagaagaagagaagcagaagatggagatcgaattcgaaccttcaccaagcgcagatggtgtggtggccgaggcgcaaacgcaaacgggcacggaacctcgttttattgacggaggtgaaggggagaaacgaaagttggaatggtttgttatgcttttcagagctgcagtggcagctttggcaggcccagtgattccttgtgttaattatactgtaattcaaaaaacttcttgtatttttttctctctttttcagtttgaccaaaaagttaatttctggttttacattttacctctaaaataattatgcctaaacaaatattccctttgtttttttaatagataacgctgttgaattttttagcaacgcttgaccatccatcttattaaaaatttatctaaatgttatttgttttcttgtgtcatgttttatcactaaagaaaatttaaatattacttatactttagtacatttacactaatttttttataggatggatgaatgatcaaaacactgcttaaaacaatcaacggtgccatctattttaaaaacggacgtagtagaaggtaagaattatatatgaactccaattctactctactacatggtggtctcattggcaatgacgggatggttaagctggtgatcgttggggtttgtgccgccgtcgacgccgacgaaactagcactagttgattttgtcggttctgagaataatggtggtggcctgggctcgcacggtcgcatggtcttgcgtcagggtgccaatgctcgctcgcttgcgagccggcctggtcgctcaagaacgccgcgccctgcgcccgacagacatattctgtggcgtcgtgctgctagtctgttagacccctgtgcttgtgcgttcgggccggcgcggcgagcacggtgttctctgcaccccgaccaccgtacgccgcgcgaggtgtgtatgcatgctctcgcgcgcgctagcgtagctacgagccgtgccgacgtgccgtcccccgcccccgtacggttcgccgcgcggtcgtggtgaaagctagcgtccgtctttgtaagacacaggaagagagcgcggtgagcgtcgagcgccacgatcttggcagccgcgcgctctgctcacgcggctttcttccacttccaccagcgcgatcgagtgtgcatcccggggtgatcggtgcccccgcgcgcgtggcgcgcatggagcagtttttcgctgtaagaaaggggaaattccttgtgcgcgcatgcaatcttgcaagctcacagggtaagtagctggcaaggaataacggatcccgcgcatgcgatcatgcaagctccaaaggtgcagtcgacgaccgcgggcgcggcacctgtcgcgcgcgcgcccgccacgccgtgcgtccaagtcggcgcaggcaaaattcccttcgctttctgcggcatcctgccgaggccttgcatgcatcggctccggtccggcgcgagatcctcggccaccgccggcgtcattggtcatccccacttccccagcacaccagttacaccacaggcgcacaagttccggctcgccgcggcgaccgccgtctactgaacggtctcttctacgccaagcgcgcgcccgatcgtctgcctcatgcacaacgtacctgtactcgcgcggtggcagctagccaaccagacaagctgcagattttctcgccgaggtcagttcgcggaacgacgtactcgcggaaacatgggcgccgcgcgcgcgctcggcgccatgcgagcatgcatgcatggcttttcctcgcgccgccgcgccaacgccatcgtcaacttccattgcacgcagagtccgctccaagtagtcttaacgggatcgagcacaaaacgtcgcacaccgcccgcccggccgctgtctcttgctgctgtcatctcgcgtcgtcctcgggtcttggcgtctcgttgccatttcgatgctcagcgtgttgcaacgtaccgttttacgaaaaaatttaaaaaataagtcataaaataatattcatgttttatcatctaataacaataaaaatactaatcataaaaaaaatcaaataagactgacggtcaaacgttggatataaaaacctacatctgcacttaaaacgtgatggagggagtggtttttagagtttattgtctagttgggtttcgtttttaaaataatatattcatgatttacagaagtcctgtcaaacgtcaccaatgcactcctctacgtcccgtccgctgcctcatctctttattatcattgggattttaaaaatcgaacataattattgtttatgttttttttattttctagaagtcccaccaaaccgtcagcggtttcgccactgtactcttctacggtccgcctgctgcctccactccttattatcgttgggattttaaaaatcgaacttgattatcattgtgatttatttttactttctattaagtcccatcaaccactgtaaccgtgctacttaatgatatgcctatcgttcctcctcttagtcgtcattaggattctatttggggttttgtttatagttttagttgttccatcaaccaccaccactcaactcctttacgtgtgttttgcttctcctatctttattgtcatttgtcatcgttgtactctggatggactattttttaaaaaaaatcaatatttttattccattttttttctaaattgtattcctaattgaactcctataattatttttctattttcagaatttattttatttgttattccaaaattttattaatttctctagatggtcacttctttcaatagtcattatttttatacgaattttagttatttataaaatttattcctagttttacattttttcttttctaattttagaatttatttttttttgaattttaattaatttatattgtgctcaatatgggctattcttttaatattccttattttttattttcaatttctacttgaaatctttttttattttcttattttggattgttttattttttattcaaaattttgataaatatcatatttggctcttgtatggactcttttatttcagttattttttttattcctacttgaactctttctttttttctaatttcggattttattttttttatttgtaattttaattaatctcatattgtgttcttatataaactcttcttttaatattgcttatttttaattctgaattttagttacaaacatagtactcctattacaatgtttaccctacccagaaatcccgaatatagaagcagctgcaagacctccaacaagacattattctcaggaagattccacaatacaaattgaaacaagtttagttgagtctaccttccaaaatataaaagtattatcgtgtcaaaaccatatggcacaaaggaaatatgtgtagtcttatatgcatatatgcatcataaaaaattgggcttgagcctgttattaatgtcacttcaaaatacatgatatttgttatatgaaacaattgtaatatcatgttccttggttctcgttgtcactcgaaaacagtctcctgacaaaacttctccgcggccttcttgatcttgcagctgaagcgattaacaaagctcagttagtaatctaaaagtacaagaaagtacggcatttagctatttatataggataatgtgacgccaaatgtgatatagactgattaaacaactggaagtaaagttaccttttagtctcccagacttcaacaaagcttcctcggcaataggcttccattgctgagcacatgagaatctgaggcccatcccaacagtcaacccacgtaaaagttgtatagttcgaagcactgaaaatagctcttcagggaagctcttcaaataaaagaatagaatagagacaccatttagtaagcaattctggaagtcaaatagtaccaacaaatataaaccatccatctccataagaggttgcaagtaaatggaagaaaatatgttctctaaattttg

SEQ ID NO: 91170 - DNA, 4672 bp, Oryza sativa
gcccccgcccgccaccgccaacggcgggagcgcgccctacaggggctacctcccgcacgccgtctcctccccgcgcgccgcggcgtccgcgcggcggaggctgcccatcgtcgtccagttccacggcggcgggttcgtgtccgggagcagcagctccgccgccaacgacgccttctgcaggagggtggccaagatgtgcgacgccatcgtcgtcgccgtgggatacaggcttgcgcccgagagccgctatcccgccgcgttcgatgacggggtcagggtgctcaggtggatcgccaagcaagcgaatctcgccatgatgagcaaggtcggtggcggggtggacacgttcggtgcttctaccgtcgagccgtggattgctgcccatggtgatccggcaaggtaagatttgttcaatccctcttgtttgtacttgtgttaatcggtagtagtactgtattgcagtaaatgggtaggaacttaacactgcattggcaaatgaggcaaacaaaagaattgagtgaagataattgggtttttctttcacaaccttctatctattgatctaatagttctaatttgtcatccactagcatttcttggtactgtacatcaaaattgctctagtttggtgaccatattagaagggatgagtaaatacttggtctgttggagattcaaatggtaataatattatgaatgtgttgagttccacaatagtttccatttctgagtggtaccagatttaaaatgtgcgagaatgttcgctgagacaggttcaatgtttagtgcccgttaattaggcttgttcgatatgtcatgtgtaatttatgttgtatcacgccatctgcatgcacttcagcttttcgtgtggattgtgatgatacacaggctcacaacagtgtgtagctccagaattaagaataagcattcaaaaaattccaaatgccagcccaccaggactgtactccagatggttgttggcatttataatacattgtgccattttaagattcgtttgacttgtggcatgtgtgttgactttttctttggaaaaaaaatgtaagtttttatcttgttgggaaagctctattcatctggaagctaaatgttgagtagatgtctgttaatggtctctccacaatgcaattgctttaaatgcaagcaaaattacatgttttcgtattgatgtaccatcttcacttcaacctctgtcgattgatgttgcaacttcctgggtgtagatgtctcaacgttcaaagtgttcacctaagttcaatttccaatataatatgttagtctttaccacgccaacaactattcttgtcttgctggtcaatatacctgatcatttatagttattccttttgttctagttattgagcattactattactgtaatctgaccatgcattctgtcttttgattgaacagatgtgtactacttggtgtaagctgtggtgccaatattgctaattttgtcactcggaaggcagtagaagatggaaagctatttgaccctatcaaggttgttgcacaggttctgatgtacccattcttcataggaagcgttccaacacactcggaaataaggcttgcgaactcatacttctatgacaagtccacatgtatacttgcttggagattatttttgtcagagaaggaattcagcctggatcatcctgctgcgaatcccctggctcctgatagaggagggccaccactgaaatgtatgcctccgaccttgacagtcatcgcggaacatgactggatgagggatcgagcaattgcatactcggaggagctccgcaaggtgaatgtcgatgcacctgttcttgattacaaggatacagttcatgagtttgcaaccctcgatgttttcctcaagacaccgcaggcccaggcctgtgccgaggacatcgccatatggatgaagaaatacatatccctccgaggacacgagttctcgtattagtagttgtagcaaatatatcagaactgtgaaatagacttacgggaaagcatcaacatgttctttttcacctggtaatgggagcaattgcaaagtggaggccaggaacctgttagcctaatgtgagtgagtactgggctttttccccccatttattatggtctttgtgagagagaatgtagtgtgcaaattgtagactgaactcaaagacgatgctcttccccctgtagagctcaattctttaatttcttttgtaccctttgtgtaatatgaaattgttggggcttgaatttaccatttttgagaaggcaagtgtcattgtccaatgatcaatttaaagaaaaagcgttgatataccatcgcgtctgccaatcaactcaattttcttttacttggttaacctttacttgttttggttgtaattttgataccactcaggttttctaacgcaaattccagaacaatattcaaatggaagttatctccaacttgttttggttgttaattttgataccactcaaaggtttactttgcatttcacccgtttacttcaacctcaccttcattttgcaaggtttaaggcgacacattgcttcgtgcttacaccaacagatttcaggcctaagtttcgtatgtcttccagcttcttgtttaatccacatgcatgttcttttgacacatgtatgctcgtatgatcttttcaagtttcagcatcgtcaatgaagtgaagttaacttcacccccttttcccagttgctaattgtacaataaacggacattgcactacatggctgaaacttgagggcagctccgatgtgagaaaaatgactgctcctagataccttgtcactgcaaaagcattctcgttgcagtaaaaggttgaacaaacgaacagatcataatcagatctcagcactaactattccctcagagaaaaaaaaataattcaacactaattaaaccttcaagggttacacgatctttcacagactgttcctcgttcggctctgaatgaaagcttgcaatgatggttctcgtccaaggtagtcagatatgatatcaaggggatttttcgagcctcctggagccaatacctgaataatgaaagcattttagaacaattgccatgagtcgatgatggaaatacataatgcctcaggagcactagtcagtaccttatttctaaaccgcaaccccgcatgctgatttagcaagtcgtctttaaattttgatgcaaacagatcagccgcaaacacctgcattgtaaaagtgaatgtgctttactaatggtttaaaatatatgatgagtgtaatatgcctttggagttatgcttagatcagacctcactccatatgtaactgtagcacacagcatcatagccaatagcaatacgtggaaaacatgaagctgggctattcccttccaacaaaggtatacctagcattacctgaaaaaaaaaggagcattacaccttcagttgtccatgcaagtaatataaataatgaatcagttatttacaatgtacctttggatgaagatccttgattaagtcatcaatgttcacattttcgcctgtatgtattatctgatcaacaaggcctggtaacagcaaaagaacacgtattagctagcactaatgaacatgtcaaaaagcatataccaggttgggattacacatataaaaacagtaatttattcagtgaataggcggaaaacaagggaagtaagactgtttttcttttgttcaaaatacaggtcttaagaacgacaaatgagtttatttatcagttattgtgttgcacaattagagaaaacgaagtgctggggacatcaatcgtcaatgtctcatagtatccgtatctcactatgttgtcagagtatcagagatagtactgttgagaaacaatcttcccagcaaaatgactcacacaaaaggatctcttgtttcagtttcaggccagcaaatatgtcacgccttcttttcagtgattggcaagcctcactagtgatagacttcgtaatgtcctacaatgataagaacagaaactatttcaagtgcaatttgaaacaagtttcatcaggtcaacactaacttgtctaagtctaaaaagcctgtatcaccaatacaattttttttatgtgtcatcagattcacttcatgtcataaacaaaagaggaaactattcccagttcatatactgctttcttaatctaaacaatgtttttccggtcatgcaaaaaacatccacttcttattcataagcttggttgttccattgcctaaaataacttggtagtataaaaatctaaatatctcctctgtagaggcagtgcacaatgtttcaaatattatttcggcacataaacatcatgctaacttgcatcacctgatggaagccagacatcatttttagagaaatgttctcatagcacctgaaatggcaaatttcatcttacacatcagaaatgacagcttccaaagtgttggtatgttactgaagaaacacagcaatacctaccaattctcaagtaacagacttggaatttcagcaaaatccccctccagttgaagacccgaaaatctagaaaaggtggctctgttggagatatgatggacctacagaatattggagaccaatcaacgcagttttatttgatgttcaacagcggaagagataatcagcaatctggcattggtcaaa

SEQ ID NO: 91171 - DNA, 2535 bp, Oryza sativa
cgggctccaatagaatccacatgtacatttcaccgattatagatatcacgactcgtgagaaactgagaaccgcagagtcgttttctagcttgtaaaattttgattgtcttaagtctccagtagctttgctttagcaagacaccctttttacactactttgaataaccagtcctttcaattgagccgattcgaacaattgatcatgctctaactgcactagaaatacatgaattctctacattacctttcttgtgccattagaacacaggcatctattctgaagtgccacgacgcaggtatgtgcatattttccttccctgggaataaagtcaagtagttcatcaaaattactttatttggtcgcaagtgcaagtggaagtgtgcatttttttcccttgtgatttgtgtttccatgttatgctgtttatccttaatgtttctttcatgtgttctgtgtctgcatttatcaagataagattttatcctaagagaattggctttcagaagtaatgtttcaatatgcatgctcaactagatttctaaatagtagcgtgaggctagcaaaattattaaaacttcaccagcatgcatccaaacaaacctggaaaagatatccagaaaaaagtaacccaaaagatcacttgaacttgcatcccagacagaaaagagacgaactgtatcgtgccaagtctcagcatccttcatttcctcaaatcgcagtgctgccaaaataagatgagagtaaaacacatccagtcatattttggaagaggtatatccagtcgaattttatgaataatggggggttatggtttattctctgatgggtacatcttaccaaacagatcttgaaacatcttcaatattcctgatatgaccaggtcaacagggaaaaattgtttaatttcaccaatatcaagatcaaccttgagctcctcagctcttttcatgtagtataacaggtcttccacgctaaattgagcatcaccctcctcctccatctgaaattagaagattgactatgagtttaaattgttaataaaaagagtgtaatcaataaaaagaaagagagagatcaataagagctttgtccaaaaccttcagatctttgagtacgctgagctccctattagctaggccatttaattgttctgacatctcctccaaaaactccaagacctgtaggtacaagtcctttagagcatgagtgggtcttggtatcatatgcaaatttaggtgagcatgtgaaaggggatgcaaatgaaatggctaaacatcatcttgttggaaaactgatgatctgagagtaattatatcagtatattgagacaaaattaagaatgcagatttagctaaaaaaaatctctagcagatctgcataatgggaaagtacaaaccttccttgacgtcctcggcattctaggttcaatagcataatcagcataattgggataccccagcaatctagcaagccggtgtcttagctggacctattattatgttaaaaggggggaaaacacaacttgtcagctgctggtttccattatgaactgagattatgcatctaaaataagcaattgctttaccagttaagaaattaaaacattgtaacgcttaagtcaaataatgctcataaatgtggattgcaccctagtgcacctctacagcacaggttggacgtaaaataataaaatcctatttcaatgagctataatgttacatatctttcctgggtaattgaccaactgcagcatagaacttagttgtgcgaaataaatgaaatcatgaatcgaaaggtataagttccttatgagtttacagatatgaatatttggagttaccaatttttccaggatggctatattctcttttccacctttctggccataagcaacagcaatcagtttcctggtagagccaaccttgaaaacaagaaataaattagaccagttagcgattatataaaagaattgtagtaaaaagattctaatcttaagtactccacagcatataatattaaatgccttatgcagatgtgcatgaaaagaagcacaaaatagagctgaccttgcaatgctcaagaattggagtaacatgataactggtcagcagaaccttccacttcccatttgtattttccagttcctgagttgaacagtcattgtaatgtaggatcagatagaaatagtatcatccttttttctcttatcacacttcagttcattcgtaaagtccgaaaatagctttcaataaaagctgagtactcccattttttaacagtccaatgttcgcacattgtagttcctaaaggtaaactcattaaagaatgatattggatggatcatggatgtgtgaacattcggaagtgtgtatactgcatcctcccagcttacctttaagaactctagtggcatcccagccaggtcttcctcgttcaatagaagaaattttgtggaatcatttaagctttgaatatacttcaaacttaactcatcaatgtgagatttcagtttctccatctccattttcttgctt

SEQ ID NO: 91172 - DNA, 1508 bp, Oryza sativa
atggtattttggtgccagcaggattggtttccgggtgggtgcagcactgatggtatccatttatcagaaatccctggtgatgaagaactcaagcacagccagggggaaaattgtgaaattcatagatgtagatgttgagaaggttagggaatttttgtggtaagtacatagaatttggtgctacccttgcaaatatccttggcacttgccattttctaccgtagccttggtgcaatggcctcgctgtctgcagtccttgcaacagttttggttatggtgagcaacacaccacttgcaaagtcacaggagaacctcaacatgaagatcatggaagcgaaggactcacggataaaggctatggctgaagcaatgaagagtatgaggatattgaagctgcatgcatgggagacagcttactttgacaagctactgaatctaagggatgtggagaggggatggctcaggaaatatctctacacatgttcagcaattgccttcctgttttgggcctcaccgaccttggtgtcggttgtcacatttggtgtatgtattcttgtggagatgccattatcagctggaacagtcttatccgccgttgccacgttcagaatcctccaagatccaatctacaacctcccagagctcgtttcaatggtcacacaaaccaaggtgtccctagatagaattgaagagttcatcaaagaagaacaccaggggaagccaagtcgttctgacaataacactaggactaaggacctgtctatgactggtgcaatggaaattgaaccaggggtatatggttgggaaattgacaatagcttgaagaagacaaaattcatgcttaagattgacagaaagctgagcatcagcaagggtcaaaaggttgcagtgtgcgggccagttggttctggtaaatcaagcctcctttacagcatcatgggggagatcccaaggattaatggtgcagaaacaacagtttttgggtcaagggcatatgttgcgcagagtgcatggattcagactgggacaattcaagacaatgtgctctttgggaaggatatggacagaagcttctatgaggaggtgctgcatggttgtgctttggatagagatttggagttatgggccaatggtgatatgactatggtaggggagaggggcatgaacctgagtggaggccagaagcagaggattcagcttgccagagcattgtatagtgattctgatgtttacctcttagatgatcccttcagtgccgtggatgcacacaccggagcacatctcttcaaggtacagtacatgagaaatctgcaacagtttagctgtaatgagcttcaaatgaaatgtacaataatgttacagcacaaaggcacaaagcaagaaccataatcaaaacaggaaaacacaaaagtattccacccattagacaatctgcaaattatctataagcaatcaagtaccaaatctaattagtaaccgcaaatggcttactcactgaatcgtgagat

SEQ ID NO: 91173 - DNA, 1333 bp, Oryza sativa
ggtcattactaaaaatctagttagactgcttatttgcgattaatttttcgttgtatgcttatttttcgttgtacagagcaatgttctccgaggtgacgcttcccttgcaaagctagctcagcttgaagaattctcccattactttatgcacatcactatgtcagcggatggcaatgaagagcaaggtttcagcactgccagtaatgaagaggacaactgctgcatatgctacaattccgattcggataccacattcgagccatgccatcacaggtcctgctacggctgcataaccaggcacctcctcaacagccaaaggtgcttcttctgcaatgcagtggtgacttcagttaccaggatagctgattcgcgcatcgaatctcggtcacctttggcaccgtaaacccgaagagaagaaagatggatcatgccggatgtcttatccatttttgctcgatttggaggcgcagacagctcggagcctcggagttcttcccttctgctttcctggaagactgcatcgccatggtggtgaagtcagaaaggttaatcttttcccttgtgtaaagatcaggtaatagttaaaacaaaaaaagattcaataacaggattgcagaaggaggcttctgcacaaggtgggaagccagtaccacccaaagaaggattcacagaatcgtgaaatttttgtaggttgtagggaaaaattccattgtaaatacgagatatgaaacagaaaggaggtgtcagatctacatcaaccttttgtaattatgtagttaaaataaagaaatactagatggtttatattggagggacctctagtttttttccctcgtatatgttgaataagagcctcactatttttcttatgcttacaaggcaaattttaaattataaaacttaattttatagttgattttgtgagttttttcatcttagtttatttacaatatttgcctttaaatcgctaaatacataataataaaaattttacttaaaaattacttttaaattgctaatgaacgggtttgcgtgaacattagcggaaacaaatgagacctcatgctttaaaatgggtgtattctaaaatgcgtaaacggctagcctcgtgcaggggcccacgtgccagaggagggccgcacacctacgtgcggaccccaccatcccacggcaccgtccacgtgtagccgtgcaagggacgagacgagacgggaggaggggtccttgtcccgtgatccgacgcctcgtttcccgggtcgcccgcccgacaggtgggccccacgtgtcagccccccacacgcgcggccaatatctctcctctcctccattcccc

SEQ ID NO: 91174 - DNA, 2083 bp, Oryza sativa
cgcgaccgctccgtgggatccccgcgcggctcctctcctgccgcgcagcgatggcggtggcgcccgacaaggaggaggcggcggcggttgctctggacaaggcggtgaaggtggcggtggcagctcccgacagggcggcggtgcccgcggtgggcgtcggggaggagctccccgaggggtacgaccagatgatgccggccgtggaggaggcgcggcggcggcgagccggggtgctgctgcacccgacctcgctccgcggcccgcacggcatcggcgacctcggcgacgaggcggtcgccttcctcgcctggctccgcgacgccggctgcacgctctggcaggtgagtggagcttcgcattatcgcgcccatggctaatcgaatctgctcgccgattaagccgcgattagcgtctgattagcgagcttaattgcgtttttgcgttccatttgcgggacccaccacggtcagggatggtgggccatggaatgcgctctgggccctggtgggccggggaacgagacaaaatacgggggcccggcaagtgggctgcgagtgcagccgggcctactggcccagtacgtggagcaagcattatcgtccattctcgctgaaacataccgattgttgtttggtactgagaatctgcgagaccgggactgtagttgtttgctgattgaaatgctcacatcttatctgctgctgtcatgggatgtgtccgtcctgattgtcatagcaacggatgggaatgtgcaccaaatcacaaggttgttaaatcagtgctgtagcaaacaggaagaagagttaggagtatacagtgttgaaacatgttattactatgtggtagcattcattgcttctggccatgcttacaggttcttccgcttgttccaccgggaaggaagtctggggaggatggctctccatattcaggacaggtgaaactatatccagctaatcttgcatattgtgtggcaatcatcgaatggaacttatacgggtacacgttgcaggatgcaaactgtggtaataccctattaatttcacttgaagagcttgtaaaagatgggttgttgatggagaatgaactacctgaccccttgtaagtttgaactctttaatgattaactggaaattcatttctaaggttggcgtcaagcatttacatttttaaattgatggtagggatatggagtatgttgaatttgacaccgttgccaatctgaaagaacctcttattgcaaaggttagtttttcatgactgttcacttcagcatacctttctgtttcctccgactggatttgattgttctacttctacacttctactgagttcaaacagttgaaatgtgtacagcaatgttactactactgaattgatggaagcgaatcatcgcataattaaaattatagataaatcttttcttctaggctgcagagaggctcctactgagccgtggagagctcagaacgcaatatgactgcttcaagaaaaatccaaatatttcaggcaagaaatcttgatttgctaatttcaaaccatattgtcttagtcttccatactcttaaatgagaatagcagatacaatattgtcagcaaaaaactgggtaacacatcaagtacaaaactgcaacctattaaacctttagtataggcatcaataaatagctagtgttccccgcaaaaaataaaaaataaatagctagtgttgctatgctagaaagaccatcagataggtaaactggctcaaatcaggggtcaggtggtctgcttttacaaatacatgccttttccaactaaaatgaaaatagcaatgatcctgaaatgtatgcctgaaataatatacacagtacagtgccttagtcgttctttcctgccaggttggcttgaagatgctgcactttttgctgctattgacagaagtattgatgcattatcctggtatgagtggcctgaacctctgaaaaaccgacatctcagggccttggaagacatatatcaaaaacagaaggatttcgtaagcatttcaaactataatattttcattgcgatgaattattacagaaacaaatgccagtggact

SEQ ID NO: 91175 - DNA, 1049 bp, Oryza sativa
tccctgtaactaactaaccaaccgcctctgggacccaccaccaccaccacccagctcaacccaagaatccaagaactcgtgcgctgcacgcgcgcgccacgccacggccatggcgacggaggcggcgccgctcccccacctgctcccctccttcggctcgccggcgacgacgcctacgacgccgcgccaccacctcgccgagctccgcatcgagcgcgcgcactccgcggtcgccttctccgcgccctgcgacgccggcaagaagcggcggtgcctcctcccgccctcgtccccgcgcaagaaggtgctgctcgagctccaccccttcggctccccgaccccgacgccctccccggccaccgctccgcctctgctttcctcgcgcgcggggacgcggggttcttgccccgacagcgacttctccttcccgttggcggtgggcgggacagggggcggcggcggcggcggcgggggtgggaacatgttcgcgttcttggaggacgcgccgagggcgccgacgacgccgacggggtccagcggcagcagcgccttgtcgttcttggtgtctccggccgcgccggagacgcccacgggctccaccgcgagcggcgggttcgcgttcgtggcctcgccgaaggagcccacggcgccccccggggccttctcgttcttcgcctcgccgaagcaagcggcggcgaccacaggccccacggccaatggcggtttcacgatcttgggtgcaccggagcaaccgctgacgccgacaggctccaatgccagcggaggctgcggttccttgtcgccgaaggagttgcacggcggcagcgccatcgcgcccttgccttccccgacgccggcgagcacggactccaccggcagcggcggcttctccttcttcccttcgcctgggccggcgttcggaaccgcggcttctccggggctcgcggcggccaatcagtcgtctcccacaggcggcacctccccctcgccgccgttcgtcttcacggcctggccagcgcacaagtccggcggccgaagcagcagcaaca

SEQ ID NO: 91176 - DNA, 1744 bp, Oryza sativa
tggaaccctcccaatccttcaagtattgattgtctcgaacaataatcttcatggtagcataccaaaggagatcttcagaattccaaccatagtgcaaattagcttatctttcaacaatctagatgcacccctccataatgacattggcaaggcaaaacaactcacatatcttcagctttcatcaaataatatatctggatatattcctagcactttgggtgactctgaaagtttggaagacatagagttggaccacaacgttttcagtggaagcatccctgcatctctagaaaacataaagactctaaaagttctcaacttgtcttacaacaacctgtctggatcaataccggcatcacttggtaacctacaacttgttgaacaactagacctatcattcaacaatcttaagggagaggtcccaacaaaaggtatattcaagaacacaactgctataagggttggtggaaatccaggactttgtgggggttccctggagctacacctactcacttgttctagcactcctttgaattcagttaagcataagcaatttatttttctgaaagtagctctcccaatagctatcatgacttcacttgtcatcgccatctctattatgtggttctggaatagaaaacaaaacagacagtctatttcttcaccttcatttggcaggaaatttcccaaagtttcttacagtgatcttgtgagagcaacagagggattctctgcatccaatttaattggcagaggaagatatggttctgtatatcaggggaaactatttccagagaggaatttggttgccgtgaaagtcttcaatcttgaaacaaggggtgcaggcaagagttttatcgcagaatgtaatgccctgaaaaatgtgcgacatcgtaatctaatcactatccttactgcatgctccagtattgattcatctggaaatgattttaaagccctagtgtatgaatttatgccacgaggggacttacataacttactatactcaactcgagatggcaatggatcttcaaatttgtcctatgtttcccttgctcaaagattaaacatcgcggtggacgtatcagatgcattggcatacctacaccataaccatcaaggaagcattgttcacagtgatctaaaacctagcaacattcttctcgatgataatatgacagctcatgttggagactttggactagcagcattcaaatctgattccgcagcatcatcttttggtgactcaagtttgacttcttcctttgcaataaagggaaccataggatatgttgctccaggtattgctcatttcacattgaattctctttgaagttgactggcacattccaaatttttgtatattcatgtgaacatgtgaaataatggggagtaaacccttcctatttgtgatttacagaatgtgctgggggtggtcgagtttcaaccgcctcggacatctacagctttggaattgttctcctcgaaatattcattcgaaggaagccgacagatgacatgttcaaggatggactgagcatctcaaagtatacagagatcaatttccctgataagatgttgcagattgttgacccacagctgctccgagaactagacatctgccaagaaacctcaattaatgttgagaaaaatgaagtgtgttgcctgctttctgtgctaaatattggacttcattgcaccaagttggtcccgggcgagcgcatgagcatgcaggaggtggcct

SEQ ID NO: 91177 - DNA, 1320 bp, Oryza sativa
ttgagagtagtttcttgctcttcatgtcgaagatgatcttccatattgtcctttcgcagtggaagcatgactcccagtgttccttgcaaaccatgaagcaaatgatgtgtgggttgtccatgctaacaatggggtatactggtctcaggcgtggtgggccggcgtaggcgtcgagggaccagagctcggcggcgttgaccatggcgtccatcgcccatgtcgtcgacgtcgtgtcgtcgtcgtcgttcatcatgagtgtccatgtcttgatgacgaacgcgccgctagagttgtggcagagggtggtggcgcctgggctgccgcagcagcagcgcggcgagacgtcgatgaacttcagcgcggcgccgccgccggtgacgcagacgctccggtttctctccgggtatcctcgtgggttgatcgcgtactctccgccgtcgtcgtcgtcgaatttcttggcgggagcctcgacggggagtgacgtgtactttagccggcggggacgactttcgtcgaacaggtcggaggcggagaggaggatgacgccacggcataagtcgacccagcagaggagcgtgtcgcccacggggacgaccatgtcggttcgccagcgggacacctcctcggccttaccgtcgtcgtggatgatcggcgcccgcgtgacggtccactcgccagagcggagcacgacgagctcggcatcctccggtgtgtcgtcggtgtcgcccttcttcacggtgagctccgccaccacgagttcgccgtcgcggcggcggcgacgcaggaggccggtggttttcacgtccagccagtgctgccgccgcgcgtgggtcgggagcagcgtcaacgtcggcgagtcggcggcgctgtagacgaagcgatcgagctgaccattgtatgtcatctggaggaggagggagtcgccggcggcggcgacgacgcacaagaatggcttgtcgcatctggctctctctctctcccggtgccggtgccgcacggcggggagcagcggaagcatacgcgcgacgccgccggcggagccacgaggcggcggaagtagacgcggacgagatggccgtcggaggagcggcaggctgcctcggtgttgatcttgacgtcggcggcggagcagcgggagtcgtcctcgccgtcgtcgtcctctttgtcgtcgtgaacggctcgctgctcgaggatcacccaccgtgggtaggcaccgccgcctccgcctccggtcgccgacgaagcaccaggagacggtgtcgccgtcgattgggtttccatgggcggcgagcagattgatcgatcggttagtcacgcaga

SEQ ID NO: 91178 - DNA, 2793 bp, Oryza sativa
ccagtctagagtcttaccgccagagaatgattttagtttagtttaatttaacacaacagacattcttagcatgcaaattgccaaaactgtatcacctcacaaatgcaatatctggagttctgaataacatgtcaaaaatatctgcaagtgtgtgtgatccatttggatgcagaaagtcagagagagcatcacgagcttggagcaatcacactgcaaacagattcggagcgacattagctagcttgcaactgttcaaaaggcaggcaggcaacactgccatatgcatatatgccactactgaattaaagtggcagagagttgcattatctgtaaacacacacatgatagatatagacatagatagatataccagcatatatatgtgtaaagcaacaagcaccgatcgatcacaatcccaagaatatattgtacaccttggaaaagaattagtcaatgatgcggttctagtcatgtttttggaatacacatgatgtattagagaatcttgtagcgtctttttatttataagaaaggaaaattttcaaggaaatatatatgaaaatcctataaaacttctgcgttccaaaggaacaatattgaaggtttactactataagattcccgcgctacgaatggatgctcacgtgaaaccacctaggaattaggatggtggaacaatcccaccgagcattgatatataaacgcatattactttttttaagaacatatgcacctattgcaacaacttaattagaaattatatggagcgcatggttggaggattttatgggttataagtcataacacttagaggttatttttctaaaaaatatttatagaattcccatgtttcaaatgggtgctcatataaaaccattatatatataatgacgtgaaacaacattatatagcattgacgcataagaggcatatatatgcaaaaacaacaattattatatcaaccacaattaattagtaacggcttatagaactcattttgagtactggtagttaggctcacatagatttcataaaaaaactaacggtttattccataatagtcctgttagtgcgtgactcccgtgatttgaacatgtgctcatgtcactaccagtctcacgtatagcattgttagtgcataagaagttaactagctatcatgctcaaccaagaagcacatattgcaagaaatccgagaaatgattgttagcaacaatctaggacatatttggagtcatggattgtatagtataggagttggattttaattttccgcgacttttatgggattctcatggttcagatagattacaggggatgtaaaaccacggacaatagcaaactgattaatgatcatacggaacctagacataaacatatgcaaatcatagcaagaatcaactattacaacaaactacgccaaggattatattagcatcggtttaggtcattaaatatcaaagaaaagcaaccgtttaggttcagctaggagcgtagggttgcatcccaaacaaccgggtgtttgtcattgttaatttcataagctttgtacatgtcgagcacagactgacaacaagaaacatattaaattaatcactcagctaggcttctcaagatcgatccaattggacccactactaatcatcatcatcatcacaaacaccttacattgattaattaattaatccaaaagagcaaactaaaataatcccaggtaaaaaataaggggggtaaactaaagaagcaaacaatccattgattgatgaattgagatgattaattaacgagagcagcagcaagcagttccaaacaccctaatctgtactctctctaatcaaatcatcatatgccatttgcatttgcatttgcacagctacctcccattaacccatcatcacagcttagctagcttagcttagcttagctcagctcactgcgagctcgccgcgccgccagcctcgccgccgccgccgttggcgcggcgctgatgatccatctccgccggcgactgcccctcatgctggtgctggtgctcgccggagcggccgccgccgccggcgttgagcgcggcgagcatgccgaggttgttgttgctgctgttgttgttgtccgccatggtgacgttcatcgccgtgggaaagctgctgcgcgacatgaactggagtggcgcctgcaccgtgttaccggcggcgccggcgccggcgccgtgggggaatgcccatgccggctgcatccagaaggcggcggtggctccggtggtgttcggccccacggcccacattgctgacggggcggttggcggcggcgccgccgctgctgcggccgcacgggccttctgctcggcctcgccggtggcgccatcgacggggtcttggcgtgaggtgtccttgaacaggtcgtcggcttccctgtagcgcttacgcatgaactcgccggcgccgggatcttggggcgtcggctccgggtgctggtgcggtggcggaggagggagcagctggtggtggtggtggtggaagccgagcatggcggcgacgtcgtgctgctgctgctgctggaggtggtggaacggcgcggcgcgcggggaggaggagtgggaggcggcggagcggagggagacggcgagggaggagaagttggccgggatggtgcccgtgccggtggcggcgacgatggccggctccgcctgctgcagcagccactcgatggtctcgccgtccgtcttgtggccgagctcccgcgtgagctggaacacccgcgccgcgcacagcgccgacatccgtatcggggtgcagg

SEQ ID NO: 91179 - DNA, 622 bp, Oryza sativa
cgcgcggattggggtagtggtggtggtactctccgcgattggtacacgtcgtccaatccaaccgacctgcaacctaatcttgctgcaagtttccggcacctttgacgaactttttgcatttaaaaaaaaaagaaatttgttagtcataagtcaagtaatgcaaagtgctaaatcaattttacctctaagacattgcggagtgtgttctccgtgtcctcaccacccctcgaagattggagggcatgccccatttcattcacactcctgaggagctctctcgactgaaagtgtgagaagatgtttgttagggtgtaaggtgcaaatggaaatcactttgacaaatgcaagaaaacttacgactctgtttctaagtggggcgtgctccatttgatatccaaccctagtccggacgtcatagggattccgcccctcatcggagtcgcggtcttcctctatatcgccttccgtccaagtagggcgtaggaacagtctatatgtcctatgcaaccaacgaaggtactctaagaaaagatgattttggtgtattgtctcgatgtacctgtcgttccttcccgctgtcctccattcatcaatgtatctgttatgctctagcccccagtcc

SEQ ID NO: 91180 - DNA, 3213 bp, Oryza sativa
agcttgacgacgaggagaagaggcgatcggccaagccgttggagaacacctgagcagctatgctcttccccctgcaacttgtttacgtgaaaaatgattgaaatcatcaaaatttcacggtttgcacgaacgttttttactggagaagatgcgaacctgagaagtttgttggctgctgcgttgagcatcatgaacggactcctgattaccgatgcttcacttccaggagttgagagatctcagcagacagtagtctgtactatagatggccatatggcccgcgggccgacggcctggcccaagcatggcacggtctgacaggtgtcaggcccgtgctggcccggcccgatagttgggtcgtgcgcatgaacttcagggaggctaaagtagacttatttcaaccatatgtatggcacggtcccaatacgaatgaggaaaaatatacttatttcagttatatataagacacggcccaaagaggagggacatatacatgtcacagcccaaagaggacggagacgaaatagacttgtatcaaagaaagcacgatgggctgtcgtgcttttgggtcagcacaacccgactcttattgggccatgcctaggccgtaggtggagcacgtgggctggcgttgctcgacccggccgttgagcaggccgtgccaggctgcgcggcccatttggccatctctagtctgtacaatgggtgcggctaaatagttaaaagataaaaaaagtaatactattagtatgctaaaggacaataattagtgagtttaatgtctggaagaattttccaatgtgttagagaatttggattataataatagcactccactattatagtgaggtgaaggtgcatatccaaggcctatatcgatatacagtgtgtgactagaggtgttttgtggtgtcaaggacaggtgatacctctaaggtatcatcccatctgaacgagataccgtcatgtagcattcccctaaacatttgtaaattccacatcgtattccattgaagttattatggtggcaccaatgatttgttatcttggctacgcacgttgtctaacattatgtgattttgtcaaacttccgtgtgtttttaaatcgccatttccattgataccaaattatcaatgttttaggctctatgtgcctatgaggaaaagagaagcacccatccaaatgatttgcgttggcacaaattttaatctatctattgataaaaataaagtaactgggtgtacgaggatgtccatatccaactactatgtctagccaagtgtggtgagtctaacatgcatgtccactccaggaatccccaacggctagtttttttttctgttggatagaagtccaatacaattgggcttagttggatgatttgactaagataagggtctatctgaccaacgtttaaaggccggtcgaactaccagatgaccccaagagtccccaatgaccttttgtaccgccggactaaagtacggtgtgcttagttgggcggtttgactgacaaacatgtcatgaaaagtgtaatagcctcaaataattagttatttgatgtaggctatataagaccatgaattcaagcggtttggctattgctccttatcctagtgccctagtggaggcattacttaagaggcaacctttatgagtctattgtgcatccttgaaattgagcgagccatctgccccttctcatctcctccagtgcataagtacccttagacgtgtgaaccatattgatgatatggaaagtggttattcccttattgatgtacacatcattgtaatatgatacacaatattatattgttgtactttgtgtgaactatatctgatgtacgacatgaattgagttagagctcaattgcacagatcatagaagacactatttttttctaacatggaaatttaaaagttattaaagataatacaatcaaaccgtagcgtttagcacgggcatattactagtctcctccagtgcataagttgcaaccaatgtgcttagtagaaaatagagagattgtttagtcattgtgcatgagattgagccatggtactttgtgagagagtcttggtttactactcttggttgccgacacctagacggtttggtaccagttgtgacctggtgatctctgcaagggagtaatggagaaggtccggtggtttaatgttcaccatcttgagaatggaggaagaacggccactaatgattaaggcttgggtagattacctcggtattggcctcacttgcccatctcttgagtctcgacgagagatttggagtcttgacggttcgagtggtgaagcatcatttgttgatttgatgtactcgacgtatccattttatccatcctttggatgctgaatactactctgtccaaaaaaaaaggcaaactctaactacatatctggacataggattgaactttttttttagacggaggggatatgcatgtaagtcatcaaccagacctccattcaattccaaggcaggtcggcaactcaagatatatgcatgcttactttgaatttgctgttcaactagccaccagaaaccacgggcgaatttcggagagataaacacaatcacaataatacagtgattcgatatttgaaatacttatgcaaacggaatagtccattgagtttactgagaaagaacgacagatttgaaatgacgagacaacaacctccaaatttggccagacttgacaccaactcaagcagagcccggaggatcccggacgagcaccttgcctgccgtgaacccgccgtcgacgacgaggttgtggccggtgatgaacttggcctcgtcggacgccaagaagacggccgccctcgccacgtcttccacctccagcgacgccccttccagctcctgcatctccctcgtcaccatcctcctcacctcctccgcggtcgccgccgggaacgtctcggagaagagacctatcgccatcggcgtcgggactgcgtgcggcgagatggcgttcacccgcacgccgtcgcgcgccagctgcctcgccaccgtccgcaccatgccgacgacggccgccttcgacatggagtacgccggcgccgccatgccgccgagcaccgccgccgtgctggccgtgcagaggatgcaaccggcgcggcggggcgccatgacgcgcgccgcgtgcttgacgcacgccaacatggacctggcgttgacggcc

SEQ ID NO: 91181 - DNA, 2449 bp, Oryza sativa
agactaaataggcatggatataaattactaatattttatatatctgcgcggctctatcttgcgatggctggagaaggaaggataatgccaacgtaacttgggcacaggccatctgttgttgaacaagtcgctgaattacttccgtgaaacaaagtgagtaaatatcattgaaccgcttcataattaaaaaacacacatacctgttttggttgtccataatctcaggagagatgtccctacaacaaagacacaaaacagttcagcatccggaaataattaacttatagctttataaaagacaaatgatcacacaagtcacaattgtaaaagaccaagtgatcacataggtctacatataagacatacccttctccatcaaaatagctcaataatttcagaattgtatcccttggtaaatacggagtctctttcctaccgtagaagttcataccaacgaaattaccatgacaatcaatcaggggccctccaatcccagcctagcacaaaaacaaagtagcacgtatgaaaagatattttaaatgccttacacaagaagttccgcagaagcaggggcatttcacactttacaaatctttgtcacactgtaagatagttggttgtttcatttcctagggaacatgtgtcatgcactcatttatttcccaaaccttgcctaaggtgtggccatcttgttagacacccctttggctaggtttggtaaggcatggcaatgtttggtagtgttatattgaattgttcatgttgtaatgcaacaaattgtttcactaagaaaattaaagcctttcttttacaaggaaaaaaacaaaacttcaatttggagattcagtgtaccttactgattctacaagtggagaccttaagttctttgcagtcaagtttgcttggtttgtcagtcaatatcccacttgtggccattaatttggctgacttgaagacgcgtcctacagataatacctccttacgctcaattagccctggatcatgaaattcttccgtacgaagacaacgaaaacctttgatgctgacaatagcaacattgtaatgcagatgataatgttgcaatgtccctacagtttgttgtttgtttggaaggtgtacaacaatctgcagaagtaatgtgaggatttaccggtatctcaaatgaataagctcaaggaggacaatacaataccaaccttcaagttatcattaatcctgttttcatcatcagaaatcctaaccaaacttgctgaagtcagaatccttgtgttggattcatcgcagcctataaatattcctgtgcaagcaaaaatccgttcttcgcctacaagatcataatgaatcatagttagtgatatgatataaaaaagaaatgaaaatgcaatgagattataacaatgcgattaccattgaatgaagcaagagagacaacaacacgagacatgtttgaagcaacttttttggtgagtttactccagatatcatcagcaaattcattttcaaaagtattaaccaaacgcatgcctcctggttaaaaaaaagtagtaccacatatgagagtgctgtaatacaactgtcaaaatgtgcaatacaagggagtaatcaacaacaaactcaccgtcaaggacagctggcaaaggataaccttgggacgttagttccttgattaaaaatttcccaaattctggtaaacaaactgaaatgattaatcatcatgtgttaacaatgacagcaaaattagaaacaatgactcaccatcaccatcagcaactggcaagaaaggggaggccgtctccataaaaaatggatcattctcaattgggttttctagagaaaaaaaggtgtaggcgattaatgaccatgtgttagtaatgatcaataattagtgttgaaacatgatgacaacttttgcatgatatgtcatattagtgacctagcctgattcaccttctgaatcactagaagaagacgactcctgctcattctcaggtttcctactggagttacctaaaatggaaaagatgagaggaatgagcagattggacaaactgaaatccttgggtaaaggacacaatactagattttcatgcagaacatccatgtatgttagtacagacaggtaaaagcataaaatcaatcttgcacaaatgctgacaaacctacaaatgatgaatagtttaaaataaatgataatgatctgcttgacaggcgacatcacagtttagtagtctttaggagtttttgcacacttacgtaactcaaaagagtccgaacatccttccaagccttccaaataggacttggaggttgcaggagattcttgtatctcatttgtgctccttccagttgtgctatcaagtttcttaagctcacccctgcagtataacacagtaaattcatcaagagtagttaccaaagaaaaggtggaatggataagaacaattggggg

SEQ ID NO: 91182 - DNA, 1295 bp, Oryza sativa
ggccattttaaaatttataaatgtactctgtgtggctgtgccaacatttaaaacatgaggcttatagttcagtctgaccattttaaaagttaacactaagtgcagtcctaatttaacttttcttttacaaaaaagtattccatgtgcgctgcataccaaatgtctaagtataaaatagcgatgtataggaaagtagaggctagcgaaacgagaaaccatatagctgacagtaaaaacttaccggtatgtcttgaaattagccatgcattcggtaatagtactccttggcaggaatggtgtccttttcttcgcataaaagttcatgccaacaaagttcccatccaaatcaataagaggccctccaaccccagcctagaaaaaatatatataaagactgctataagcctaccacaaaataaagcgatactagaaaataattatatacgagaaaaatgcaactttaaggcccaaaagataaagttaagtgcatataatgatatatttaaccactgataccacgccaatatgccataattattcatttccgcaacacatgaaagtaaagagagatcagcagggcaccatggtgatttcacacgtggagatcatgagttctttccgataaactccgcttggatcgtcagtcagcaccccactggtggccattaatttgcctgacttgaagcagcgccccacagcaactaccttactgtgagactcaaattgcagctgatgctcaagatttattgctcggagaccagggaagaacttggtttcaataacagcaatattgtattgcaagtcatacttgtataaccacccatgggcaacttgtttttttggaaggtgtacttcaatctgtaataataaatcaagaaaaaggtttacaaattaatagttatatcgcaacatatgcaagtgatagagatgagataaaatagaagaacttacagacacaaatggcatgatcttgctttcatcatcaaaagatctaatcaggctagctgaagtcaggtaacttgtgccaaataaatcagttttgataactacgcctgtgcatgcagaatgcataatatcccctgcaaaaaatcatgatttccatcattaagagtgatggcttgatacaaactttaaaagccaacgtgcataatcaccatcgaatgaagccagcgagacaacactttcagataagtttgacgctactactttactcagttcactccatgctccttgaccagagttcttcaagctgccaaactcctcttcaaaaatgttatcttcatgcaattttccta

SEQ ID NO: 91183 - DNA, 2345 bp, Oryza sativa
tatgttgattttcaggaggagcttcttagtgaaggcctatgggatttcgatagaatgagccgcccttatattcttcaggaaacactggaggtttgtctttcttgttcctaaaacaatgatctatcttttttttttaacaggaaggaaaacagggcaccagcatgacatttctattctgttataggagaagtttgggtccttttggacagtaattgcagctaactttctaaatgagtacaagaaacaacattacgaggtaatgcaatcagttatattctcttttcatgtttgttgaacgtatcacctacttaaaaccgcatggcatgagtagatttagcttaggctttagtacagaagtctccatttcaaaatcagctacgtgcactccttactgcatttttccattacatttcgtcctctaatttcccttgcaatttattgttttgcacgtgtatagttcaaagaggactgcaatacagagaaaaagataattgcaaagcttaagaacagttctgaaaaatcattatggctggagaaagaagacagcattcggcgtggtttgtttgatctactacaggtaattcatatcgagtgcatataatccatgctacaactttctcttaacctatcctgatccttttcaatccacataaaaatattatttgaaattctcaacaaaatatcattgaaatcattagaaataaaacatactgtttattctgcagaatatagtccttattagagatccagaggacagcacaaaattttatccccgcttcaaccaggaggatacttcaagttttaacgatctagatgaacataggtaatattgattttatttaactccaattgtttccttctctatgttcaggtcggacaagaccttgatctgcacttttgcgttttactctgtaaatttacttcaagctagttaatgctgatgaagtatttactttttagtccaacaggttaacagtgcaggatccttgtgatattgaactttgttacatactgctcctttctgtccaaaatttgcttagttctactgctatcgccttactacatactctaataatcgatatttttcactatgcatctctagtaggcatcaagaaaaatgaaactagtatattcagcagcagtttcttcccaagaaaattatgaagtacagtagcacccaacgttttaggtcttgctaatagcactcccttatttatgcaatgagcactaactaaattgttccttgtggagtacgaactatttcatcctctcatgaaaaacattgttttacagcaaaaatatcctcagaagattgtactatgactattattttgctcgccaagagaatctctggcgtcaaaatgcgctcaagactctgcctgtgcttttgaactcatcggatatgttggcatgtggggaagatcttggccttatccctgcctgtgttcaccctgtatgatgttttcctgcacatgctagtaaacagctattgcttgttctatgcacataaatgacagaaatatattatccaggttatgcaagaacttggattgattggattgcgtatccagagaatgcccagtgaaccaaacttggaatttggtattccatctcagtatagctacatgacggtgcgtttcccttctgtttacttgggttcaatatgttcattgctacagatgcacacatacttaggttgtatatggcaaactaaaaatggtttggagaagctattcagtttgatgttcaattttgtgtcatatttttttcaggtttgtgctccgtcatgtcatgattgctccacattacgtgcttggtgggaagaagatggaggaagaagaagccgtttctaccagactgtaattggtagtgatgacgagccgccatctcgctgcaccccagaagtagcgaactttattgttaagcagcattttgatgctccatcaatgtgggcaatcttcccactacaggtatataggttggcttgttaacttatataaaagatcaatacagaataaagtagattaatgtacttggggtgttctatttgtcaggacctgcttgcacttaaagacaagtacaccacaagaccagcaaaagaggaaacaatcaatgacccaactaacccgaagcattattggagattccgtaagtcaattttccaatattattattttccttgcttcatcaaaattaggtattaagagtaaacaaattcaaaaagagaattggctattcttgacataataataccttcatacgagaaaattcccatacaattaattggcataaagcaatatgttcaccatgaaaaagatatgaggcgatcagatgatgtcacattg

SEQ ID NO: 91184 - DNA, 588 bp, Oryza sativa
tggtttggaggagttctgcaatgcaattcaagcaaagttgaaagtacgacttgtttccagacttcagatataagcttttgttaggtcctattgcttattttattgttctaaaatgaattatgcctatctatcttctacaggactcattggtgccgatagaagcttttgttccatatgacaaaggagagctcctgagtgacatacacaaggttgggatggttgagaaaacggtgagtatcatgctcgatcattaaaacatgtttttgcctatcaatatgctctaacttttaaattgaatgtttggtaaaacctttatccttcttacttgaagataacaacgatgtttccacaaaatatttattgcaggagtacacggaaaatggtacctttgtaaaagcgcatgtgcctctgcctcttgcaaggcttctcacgccgctgcggcagcaggtggcggctgtttcatgatgtgaacgtcttgcatattgctatcggcaattcacataatttgctagcctttgtagtttgtacagagctaagccatagattttcatgccatcagtttgacctgtgtagagcatcattacaaaa

SEQ ID NO: 91185 - DNA, 1224 bp, Oryza sativa
aatcaatatgctttcggtcgttctggtaatagtgcacatggcggtgaggtggttcatcaaaggcttgaccttgatacgacctgcgatccaatggaatagatggatcccacatgggccatggtggttgtggctgatcagggtgagatacccatggttgtggataggtagggtaagatgggtagtaatatggtggatatagtggcaattggatattgctcataggagttcttgtgttgtaattccattgtataggactatggaaggttggctgctgaaggcgtcccatatgcatgggttggtaggttgggggtagtggtagtggtgttgagtgaaatggtggtggtattggtagagtatggaagtacactgaagcattccactctagtgtcgaagtggttggaaatgcaggtggtgatgtttgtttagacaaagtagaagttgataaagcacagttagcatgcctaagatcaaagacttcatgtttagttggtttagatggttgtttatcactcctcttagctggttgagtcactgattgtgtattacctgtaaacaagaaaattgtatcacctctcgcccttacaactggagaaagtccaatatgtcctatataaacctgtctcacctctcgcccttgataactagagaaaatcccaatatgtcctagataaactttagactatgtatcacttcatccttgttagcttgggcctgggtgtcacgcccagaaattcccaaatagaattccaagcagaatgtgcattataatccccgtccaggaccagccggggtacacaaacgacaatgttgacattcagatccacgtcttacaaacatcataaaagtcttacaaaaatgcagcggaaacaaaagataactggagctaagccttgactaaactgcagcgggaacaccactccacaggcatcctcgacggcacggacgaagcctactcctcggggaaaccttcatctgacacaaacccgtcctctggggttgggaaaagtagagcaagactgagtactacccactgtactcagcaagtcataccggaataggagtatgatgcagggaattaacaaagaagagctagagtggttcatttgcataaatactggcatttaaaaacaggaattgaatgcgaaaaggttgtaataattaattagtattaaacatccactgtccaacgctaacccacgttgcgacaggcccaaccgtccacct

SEQ ID NO: 91186 - DNA, 1811 bp, Oryza sativa
tcctgcagccccgctttcacttacatagttacatcaaagctcccattgagaaacagaggtctttctgataaaaatattaaatacaaatattgcactggaaaaatttcaggaaaaatgagtttgtgatatccgtatggaacggacactgtacgtctgtacgaaaatactacagcactgacaatcaaccacaattgcatctgagttctgagatgattcatcttttccattttactttccaagtacgtactccttaatcaatatatcgatataagaaatacaattctgaataaatctgaccagagtgagtagatattacaatcaaagtttcccatttacttgtatgatgcaaaacaacagaatattatctatcataatacaaaaagtgttgataatttagcatagttagaggttttgttgtgtcctcttttcaaggttgtttcaatgaaaacatctcattaactaattctgcttgaaggaactaatccatgttgtatggatctagggtatctgatggaaagaggccgcccttgtttccctttcagtaattgatcatagtttataaataagactacggcaattacatcctcatggacatgcctaggattatccctgtccatcttcaagagatctgagtaatgcaagttgtgctttttggctgctgcatgaagagctgcttttactagcattttggcacttccctgaacagaacagaactaggttagcagcagtaacagttatggccatagcagcaaacttgcagccttttaggtcatcaagaaccagagtaccaaacacaaatatgtattgtatgccttagaacacaggtaactaaatggaaaaagaatccattatacacctctcaagcctgaaatgagaaaagtcaactaacagaaacatgttttcatcctgaatcctgaatgaatgtggaggatgggcactaaaattatattacaaggcaagcatactaccagcactgttttcatgctaaacagaactctttttttttgcatgtaaataaatcttgatcatatactgcagcaggctataaatctcgagtacttgaacataaaaattggtgttctttccatgtaattataacatttagtattagtatggacctacagtacttagtaacatcacttggacctacattcttgataacatcacttggacctacattttagttaatttatggaactacaggagcgcaatgagtgatacagctacaatttgcatatagctaatacagtcataccacgtgaaccaaatgagtgaacatcattttttttttgtgtgtgtgtgggggggcacataggcgtatcagaatctcaaatattgctatatgcctaagcctttttactgtgcgtgaacttttttgcaaggcctggcacagcataaacattttgtaaattgactggttttagtcattattgacaacataagaaagctaaacaatttaaatgaagcactatataaacaagatgaaggtgagaaaatagatagttggaagcttacagaagcttgatggtttttaacaatctcaacagcttcctgattggacagatattcccatagaacagctgagccaaatatgatgaagcggtcacttggtcgaagaacgcgtgaaacaatagatggattggcacttagtattggtttgttgagtggttccctgctatactgtgggtatttcaagtatgcatcacctatcgctctcaacacctgcatcatgcatacaatgcataagtagaacatataagattcaaatattgtgacacaaatgaaatggtaacataaagctgacctgcacg

SEQ ID NO: 91187 - DNA, 535 bp, Oryza sativa
ccggcggcgtcgctcgagacggaagtacggaagaatccgacgccgcgccgcgtccacgaccaggagaagacggcgctcgagtcgagtccaatcgacacggaacggctccgggaagagacgatgccttttgggctgggcctcgactccgtatcagttatggttatggaccgtgttggattccgtcctcgtttctatttttttttctggaataagttcattttgactcccttaactagtgtaattcatatccctaaccctaaaccataataccagatatctcgacccccaactattaaaacctgtgtaatttgactctctcggtggttttgaagggcggtttcgctgacgtggtgcctatatgacaatattgacctagtcttcgttccacgtgacgttgatgtgatgcttatgttgaattagaattaaaaaaaatctgtggaccatttgtcattcaaaaaaaaatatgggacccacatgctatcctctctcctttttcctccctctctccttttttcttcaccttggccaaagtggt

SEQ ID NO: 91188 - DNA, 691 bp, Oryza sativa
cttggttgctgcctattgtttgaagtccctattctggtttatgaatttgttccgaacaagacgttacatgacttgttacatggtcaagacgggagatgttacatatcacttgcaactcgtttgaggatagctgctgaatcttctcaagcacttggacacttgcattcgttggcacgtcctatcctccatggggatgtgaaatctgccaacattctgctaggtgacaatttgattgccaaggtcgccgattttggttgctcaataatcgcacgaatggacgaagaagccctcgtggcaaaaggcacagtcgggtacctagatcctgagtacctgcaatcatgtaagctcactgacaagagtgatgtttatagttttggtgttgttcttgtggagcttttaacaggtaagaagccgcggtgccttgtgtcggtgtttcaagacgctatgaaggagggcacggttgacgagctcatagataaggagatcatcaaagaagacgacttggaggtcatccaccaagttgcggagctcacaagcaggtgtttagctatgccaggtgataagcggccgacgatgtcgcaagtcgcccaagagctccgacggttgacaggattggtgcgacaacgtctggatgcggcaggcgagctgattgccttgcgtgaggtggatagaagctttacgcggacaatag

SEQ ID NO: 91189 - DNA, 1338 bp, Oryza sativa
attaaatcctttttgacaaaagaatagagaagaaaagaaaagagggagggaaattagacttttcctcgggcggctagggcgcggcccgagagagatggggcggtccggccgagctaaatgggccggcctgcccaagacggcccaaggcggcccagggcgcgcgcgcgcgggagggaggagggagagaaccggtggaccgggctcaccacgcgtggtcccgggtgggacccgcttgtcggtgactcggtttaccatgcggagcgagcacgcggcgcacgcgcgcgagcgggggagggacgcggtgcacgcgcgcggttcgcggtggaacggatgcggcgggcccacgcgcagcctcacggctcgtggtggaacgcgcgcacgggtggggctgaccggggtcggcccaggccgatctcggccgagctggggccgacgtggcgcctacgtggctgccacgcgggctggcgggaggtagacgacgacgccggccgtaacggacggcggacgacagcggtgagcggcggagcgaaccatggcgttacaggcgaaagcgagtacaccgggtggttgctcaggatgaggggagacgagccaacggctcggattcgctggagggagtgcgtcgacggcggattgcggcggcggcaaccggcggggagggaagagggaaaaggcgacgaggtcacgaggggccaatccccggcggtgagagcatctacacggctacgggaatccgtccctagcgtcggattgggcggagctacgcctagcgaggctggcgacgagcgggtgctacggagcacgggcggcaacggcggcgagcacatggcgagcggcggcaacggtcggggtggcgccggctagctacggggaggctacacatgctactaccgaaaactaagggggagagatggagcgaggaggaagaacggagggaggcactaccgtgcggacggggcgcagtgacgagaggccgacagcgcgggagtaatctctccggcctcgggccggggaagaggaaggagagggcgcgcccggagtccccttccgcgtccacgaacgcaccggctctcccagtgctgggcgatgaacggcggaggcgagacagagcacggaaggcggcggcaatggcgcggtggcggcgagcgaaacgggagggggaaatcgatgggagggcgccttggcttataggacgacgatgtcggtttggaaaccgaccttgggcggtcaaggcgcgagctggcgctcggcgctcgcggccaaaacggtgacagaggcagatgacgccggcggggaggggaaaaggaaaagagggagagaaaagggggcttgccccct

SEQ ID NO: 91190 - DNA, 719 bp, Oryza sativa
cctgcacccctcgacggcggtttgcggcggcagcaaccggcggggagggaagagggaaaaggcgacgaggtcacgaggggccaatccccggcggtgagagcatctacgcggctacgggaatccgtccctagcgtcggattgggcggcgctacgccgagcgaggccggcgacgagcgggtgctatggagcacgggcggcgacggcggcgagcacatggcgagcggcggcaacggtcggggcggcgccgactagctacggggaggctacacatgctactaccgaaaactaagggggagagatggagcgaggaggaagaacggagggaggcactaccgtgcggacggggcgcagtgacgagaggccgacggcgcgggagtaatctctccggcctcgggccggggaagaggaaggagagggcgcgcccggagtccccttccgcgtccacgaacgcaccggttctcccggtgcttggtgatgaacggcggaggcgagacagagcacggaaggcggcggcaatggcgcggtggcggcgagcgaaacgggagggggaaatcgatgggagggcgccttggtttataggacgacgatgtcggtttggaaaccgaccttgggcggtcaaggcgcgagctggcgctcggcgctcgcggccaaaacggtgacagaggcggatgacgccggcggggaggggaaaaggaaaagacggagagaaaagggggctt

SEQ ID NO: 91191 - DNA, 706 bp, Oryza sativa
ttcgcccgccgaccgccggagctccgtcgccctcgtgatcccgaaccgcgccgccgtcttcctgcgcttcggtcgccgttgccgtcgccgccgtcgacccggggtgagccgaaggccgtcgcttcgcttccctcttctctcctctctctcgggcgccgctccgccgcgccgggtcgccggcggtgaccatcggggcgcgggtgcgccgcctcccgtcggccgtgccggcgaggccgccttcgggcgcgccccgcggctgccaggtggggcccggccgtcagccgcccgcgcccgcgggtgcggctgacgcgtgggacccacggcgccgaccgccgccaaccgcgtgctcccggtccaccgtggaccgagaggctgacgcgtgggccccgctcccgtggacccggtccgcgcgccctctctctcggctgacgcaataaatgagatttttaattaaaatttaaatgaagaaattcgcaaatatgcatttaaagagcatataaacttcaaatggccatatcttggccatttgaactcggaattggaccgttcaagtctctaatttttccttatgaagtcaagaacccatttttgtgctttatttctgctgttatatggagttatttagtgtttaagccttttactttccgttggtcgtgtagacgctgcagcttcggaagatccgctcttcgtggaagttgaagccgtc

SEQ ID NO: 91192 - DNA, 511 bp, Oryza sativa
cctgacaataggaaagactttgttatatattgtgatgcatcaaggcaaggattgggaggagtactaatgcaagaaggaaaggtcgtggcttatgcatcgcgacaactgcgaccacacgaggaaaactaccctacccatgacctggaactagcagctgtggttcatgcgctaaagatttggagacactatttgattggaaaccattgtgatatctacactgaccacaagagcctgaagtatatcttcacccagtcagatctcaacttaaggcaatggcggtggttagaattaatcaaggattatgatctagaggttcactatcacccaggcaaagcaaatgttgtggccgacgctttgagtcgaaagagctattgcaatcacctgagaatgaaagggatggcccctgagcttagggaggaaatagcctagctgaacctacatatagtacctcgtggacggataaacaccctggacattcaaccccttttgagaacccagatagaggaagccc

SEQ ID NO: 91193 - DNA, 1298 bp, Oryza sativa
ggggatgaccccgacaggtggggcccacctgtcggtggctcgggggaaaggagagaggaggagacggttggggggggacgatgacaggtggggcctcgggtcccacctgtcggagagagagggagggagaggccggctggggaggcaaagtagacttcggggaggagagaaccgagcggcgagctgggccgagggagagagagagcccgagagggggagggggaggaatttgggccgagcccgaaagcaaggaaggggaaaattattttcttttctttttattctaattggttaaatgaactttgtgctattaaatttacttcttgagctccgaaaattcacgggaaaatccggagagtattttagggcacaaagaatattgcaaaatattcccggccaatgatttttaagggaaaattttaattctcccattatttcacttgattaaattgattaactttttattcaatttctaggaaatgcatcattaaatgatttttattcccgaacgaaaatcggggcgttacaacctttaagctgatcaaacaaatcatcaattctgggcagcggatacttattcttgatagtcacatcatttagtgcacgatagtccacacacatcctctgggtatgatctttcttttccacaaaaataaccggagctccccatggagatgaactcggtctgatgtatcctttctgaagcaaatcgtctacttgcctcttgacttctgccaactcattggctgccattctataaggtctcttatggatcggagttgttcctggtaccaaatctattctgaactctatatcccttttaggcggcataccaggtaaatcgtctgggaacacatcaggatactcccgaactataggaatctcttccaaagttatttggttcagtcttgaccttaaagactcagaagacaatgcatgaacagttacaactcgaccaccattactggtgagagttacttttctgttagcacagtctatcacacctttatgtctggctaaccagtccatccctaggatgacatcaaggtctttggattctaacaggataagattggccagaaacggtactcctttaatttctattctgacagaggggctacgttgcaaagagagtgcttgattacttggggtactaaccatcataggacgtctaagatcttctacttccatcccatgatttcccgcaaaactcatagataagaatgaatgtgtagcaccagaatcgaaaagcactgttgcaggaactgagttaacaagaaacgtacccataatcacat

SEQ ID NO: 91194 - DNA, 554 bp, Oryza sativa
tttaatacacaaaatagtctggaaatttgggctaaatttctgggcgtgacaaaggtgccaccgttttctccaggatagatcttcgatcagggtatcaccagttgagaatcaaagaggaagatatacctaagacagcttttaccactaggtatggattgttcgaatgtactgttatgtcttttggacttaccaatgcctccgctttcttcatgaacttgatgaataaggtgtttatggaatacctagacaagttcgtggtggtctttattgatgacattcttatctactcccgaaccaaagaagagcatgaagaacatcttcgccttgcactagagaagctacgagagcatcaattttatgccaagtttagcaagtgtgaattttggttgtctgaagtaaagttccttggtcacatcatctcagcaggaggagttgccgttgatcctagtaatgtggaatccgtaaccaattggaaacaaccaaagacagtttcagagattctcagtttcctaggcttcacaggatattatccgacggttatagataattttttc

SEQ ID NO: 91195 - DNA, 4666 bp, Oryza sativa
tgtcctaacaaattaattaacaaatagtgtatatgttttgtaggtgctcgagcatgcattgctggaggattcttttgaggcaaatgtccgtgactacaccaaattgatccacatatatggcaaacaaaagctattgcagaaagctgaggatgcattccatgccatgaaaagcagaggtttgccttgcgatcaagttatgttgactgcactgatggacatgtacagtaaagccggagatctcactcgtgcaaaagaaattttcaacgagatcggattgcttggcctaccgatggataagcgtgtatacggttcaatgatcatggcttacatcagggctgacatgttagacaaagcagaagacatgatcagtgaaatgggggatcagcagattgttgcaggaaaggaagtttacaaggcattgctgagagcctattcatacaaaggcgattcagaaggggcacagcgagttttcgatgccatacaattcgcagggatagtacctgacacaaagctttgcgcacttctggtgaatgcttactgcctcgcggatcgaatcaacgaagcgatgatagtaacacggaatatgagaagcgcgagaatcacaccgtgcaacaaatgcattgctttgatattgggggcttatgagaaggtgaacaggctagaaggagcactggcatttttgacagagctcgaggagaacggcgttattattggccaagaaccttctcagctgcttgcaggatggctcagaagacttggtgttgttcaagaagtcgaacaggtactgaaggacctcgctgtagacaggaagaacacccttgaagtagacaggaagaagaacctcgcatcagacaggaagatcaagaggaggaggagcaagagcaaacgcagttttgcatcatctctgcaacgcaagtgattagctagctgcaacacaaacctgcaacattcttgactggcaacaaggacatgtgctgccccatgagtcagattacaatgcaaacttgtatacatgtttgggatttcacaggcgatactacgataagatggtaattaagctatctgaaaagaaaaggctccatccaaggtgatatgcatcacatgtaactcttagaggaacccctaggccctaactagaattttgatacccagaacagcagcaatgttacaaggaagctctaaccagagcagcaatgttatccttgacacttaagttgatcatgactcattatcaacaatgttttggactttttcttctttctcttctttccttcagtggctgtcctaggctcaacatcttctgaagcctccggcttcttctttttcttcttcttgggagtttcatcttgttcgagattgccattgactgccatctcctgatcctgtggctcctctagcttgtgcttctttttcttcttattctcattttctggatcagtctcttctgcagcaaccttggcaggcttatcaaggtccatttcttcaccatcagcttcagctttagacttctttttcttatttttcttagcagatgtgtcgttcttctctttttctgaaagaatttttttggccagcgtgtaaattaaaaattaatatgcttacatgaaatacaagttgtaccaatctgacagatatgaatgaacaaagagcccttaccaccaccatcctctgagacggcatttgtcatatcattaatagcagctttcatcacatcaaggttcttacgcggtgcaatacccttgtcatagaagtctagtctctcctcaacttgttcgcgcagcttctgaccgaaaactgaggtattcaactctggaatccacaatcaaatgagaaaaacatagatcagataataaccatgtgtaaagcatgctaacaaagttctcaactaacctgaataacagtcgatgcgtgaggcaatggaacatttatttgccaggtatcgagctattctgcccttgttcctagttgacgcacggccaataaaagatgagtggaatatgaggccatacttgggtgtgttaccacgagttttcagagctctgcagttaaatggagagagcaatcgtaagatttcacagatcataaaggtaaaaagatttgaaatatttcactttaaaagactttgaaaggaactgacaataaccaatgagggattgaaagaagataagaagatcataagtattaagtacctgaaaagtgccttttcagcgccaagaatttgaagagtggaagcagcgcacttcgcaagatttgaaagactgccagcatgagagattaaccgagctccaagcctccaacaatttcaccaatcaatgatgtcagatttggtgcaatgtcattcatctttgttactagatactcataaagattttttctgtattcagatagattcatgaccctttgagcgaactgttggacattgatcaaatcaactggtgaaagatcctggcctgaaaacaccatggagaacataagtgaactgcaaagaagccactactgcgactattagggacatactcaattatggagcaaattgtattatagttacccatggatgcctttgctgcttcaacaatttcttttgccttgtcctcatctccaattatatctgctaaagctgggatgtctttttctgctaaatcagatttgttcaccacaaactttgcaatcttagaataaacgtagttatcattcacgattttgaccagctcaggaaaatgccaagaataccattccctgcattgtggttaagcaccaatttattacatcgataccaatatcgcacagagtattttaaacgtattgcgtcaacagaattggtaaaaataagtttgttaccacgcccatcacaagcataacaaaacatgagataatgccatgtggacggtttgatatctcgatggcatatagctttacattttttttttttgactaactcaccggggggggagagattccccacctgaatttatcattgcataaaagagaggaaagaagaggcttgacaaagaaccaaattgtaatcacaactaatacagatatacatgagagtgttccagtcataaacgtcgcatgcacttgcagcatgttataggaatcctccacatggtataccactacaccagaagtacccatacttgagaatttaacatttagatacatggaaaaatattaaattgcattagaactcactcgaacattcagcagagatacaaagaggatgaatgtgatcagaggaatcgagcaaattcaatttaaccataaaggataaatagagaggccatgctggtggtccagtctttctcagctggaccatgtgaatgtaaagatggtataactgcatgcccacggcatagcatttctaggagtaagataccaaaatataaccaaagacaatctgggataccatggagcaaatgaaatcaagaacaaacaactagaatattttcaggacacatcagcatcaaaacataattgaggtgattaaattccagtcacaacatctaaaaatctaaataaaaatcactaaacaatgaacatgtaaattaagcaaaagatggcaacaaacctcactctcatggagaaggaattgatatccttatcaagtgtatccaacaaaaaaatcgcttgaattaccatgttatccacacggttcacattgaacttaacctttgccctgctatagctatgccccaggcctagctgagccttttccaagtcagttggctgcaatcgaaaacaaaggagcaagtaaacaaacaataacaggaaaaaaaccattttatgcaaggaacatatgaaagcatcaaagcattgcagtccaacaaacatggtagcaataacagagggttataatgcagaacctctctgtatggagttccaggcaaatcacttcatagtctagtaaagttgcattggataacaaagatgctatgtcaagcagcaagtagtaaaatcctatagtcagtaactctacagaccaaattcacgcaaaataaaatttaagctaggagcattagaatttgtaatttgatcaggacttcaagttttccgagtgcagtataagcatcaaaacatcgatcagcgacacaatactattgcagtaactgagattgcaccagtgcagaactgcagaaggcatagtgctaccatccacccccacatggccacatgcccctattcagatcagttacaatacgatgtcatcaaacatacagtagaaacaagcgcaaatgtgaaatcaacaaccttgagttgatcaatgaaatgatcgaagtgtagccgcactccgcggagcagttcctggacgaactcattgcactggcaggggatcccggtggcctcggagatatgggacccgaccttgggctccatgaccccgacgctgtacttagccttcttcccctccttcaccttgggcaaattgagctccaggaagctcctcagctcatcagtcataatccctgcacacgaccactcaaccatcgcatcacctatcaatcattcaggagagcgagcaggggatcggcggaggcgagaaggcgccgtaccttcggagatggcgttgcactggttgagcgcgtcgacggcggaggagaaggggagaagccggcgagcttgacggccttgctgacccgctggagctcgagcacggaggcgcgggcgg

SEQ ID NO: 91196 - DNA, 1389 bp, Oryza sativa
tagttctcaataatcctaacatgaactatctgcaaatatggcacctttctaactcttactacctccgtcccataaaaattgaatttctatggaattaagaacatattaggaggatagacaaatgactataataaccctatttaatgaacgtagtacatgcataaattccatatataaatgtgattaaaaggaatgttgagataataggttagagatgggatggaaggaaagaagattacaaggaaatgtaatcagtttaattggtcccacatcagtagaaatacaatttttatgagataaaggttcaaaggtaaaaattcaatttttatggtacggaggaagtatactttatcatgtattcttcattgcaggagatcaagatcccagtcttgtccattctgccgcgatagtctcaagagagtgaactcggccgacctatggatatatacagataacagggacatagtggacatagcgacggtccgaaaggaaaatcttaggcggctcttcatgtacatagacaagttgcccacggtcatccctgaaactgtttttgacgtttacgattcccacgtaaaatgaccttgcactcatgcacaaattctttactggtgtgttactactagtgctgtagaaattgtggagcccttggtgttcatgctgccccgcttgtagaagctgtaagcagctaagctcgccgaggaggctcgctatacaaaggtatatatgtaaattgtcttggctgtatggtgtgtacctttgtgaggagttaggagaatctgatgccagtcagtctgtaagtaaggaagaaccagcaaccattgactttgtttcttttaattgtaagcatttcactttcacccatgaaacagtgaagaatgccatcctgacagcttgattgctcctgtacgatgctgttgctcgttgtgaatggggagttttcagttcctggaagaagaatcaagaaatggagggccactgatttgatcgtgcacagaagtgagacaagagtctgaactggtacagtatccccaataataatttcctgatctgctgcacgtgcatcctctatctctgtaatgtcttgcacgttctgaaaatggagaaactccactgcatttggagctctgcagttggatacttctgagcctgtttggcacaactttaccttttttgtaactggagtccagccaaacagtgtaaatagtttcagccccatctggagttaggtgaagcattctcacaaaatgaactagagaggtggagctgggtttatgctgctacacaactcaactctagatttaacccctggagcttaatttaaaagttggagcatgtcctctgtcaggatgaaaactcatcaagtttatcttcgttcttgtccaaata

SEQ ID NO: 91197 - DNA, 1519 bp, Oryza sativa
catcttctgaaaattcagattgtgattttacctgttaatgtaacaggaagcatatgagtatgcaaaatagcatatgatagtatacacaaaatcatataaccaactagaattcaataaactggaacaacattgatatactataaagcaactcactttattcctacgaagattgctgacagataaagtcccgtcgccactgcaaacaacccaagtagttagttctgattaccaaacatcaaggcaacgaagacttctgcttagaattgaacgagcaaaagtaacacaaaggaaaaataaattcagtgagacaacaaaacattagcatcattaatacaacaccattgcactaagaaacaaatgagtagtttctgaaccagtatgaagtaaattatataaggttcaaatcctggtatccacaaatatggctttgagcatccttagttggtgcagaagccagaaattatagttcctttgttaaaaaaaggaacgtggaaattttactgaattcgtgctggaatgtaaaagtttcctttcaaatccatgtgttccaagtagggcctaaatggctggagctgcttcatgaataattacataaaatggtgtataagccaagcaatgctgatctctttccaacaaaaaagcagatttcgcatgcatactgaatgacatgcatattgatcagggcttgaaggcgaataaaattatttaccttgttgccagtatttgagttgagtcagatacatatgtcatatctgatatgtaatcttcgtggcagtgaaaggtgttacagcaggaacgttcccgagtatcccatacctaaaattgcacagctattttacttcaaattgactttaccaaagaggcaaactatagtcaataacacacaatacaatgcaggtgtcagtccaaaaacaaatgtacatggaattttggccaggatggtcttttctgcttattacccaatcatgtgctgatgtgcatatatgtatactcacgaacaagacatccttgggtaaataagcttatcaataatatatatttgcacaccttttaaatatacaggttttaagagtcaatgataaagctggcctacactcaacaaccatgcacggttaaaccagattgactacttataataccttaatgcaaccttcatcatcacctgaagcaacagtagtttcagtaagacacacaaggcgatttatgccattcctataatattttaagaagaagatatttagttccacaagcaaaattcaaagaaagaactgcaagtctgcaaactgacaaaacttactcatgtgcatcctccaagcgagcaatgggtttgccagtttccacatcagaggcaagaattgagcaatcagcagatcctgtcaaaatcactgaaacatggcacaaagtcaagatagcccgcacaacatggttagaggagctaacagatgaatgtatgtgtcttccttcccatccaagttagttttacaattccattgtgaacacgaatctgctaatgttgcag

SEQ ID NO: 91198 - DNA, 1259 bp, Oryza sativa
tgaaatacagccgataatccaaacatttagcatttactttctaccataagctgctgaaacaggcacctagtagtacacaaaatcctgaagtatacataaattccagggaaatctcaaaataagcattagcagcacgaacatctgtagctcaaaaggtggtaattgtaaagttgttgaatccaaggagcgagagactaaaactaacacctaaaaactaaaccctaaacacctgatacaatgataggatcatcaatgcaaaccacaaactaacagagcgcgatgaacagcagcgttggtcgtgagtacctctcaggctgcgactccgcggcgtaccggaacctgcgaaaccagctcgataagaagagaagattaccaaggtcgcgataagaacaaactaaaatcagaggagggggatgaagaagtagtggggcgcgcccgtggatcgtacaggtagagctcgccggtgatgagggaggttgcgacgaggggggaggacgggtggaaggcgaggtcgaagggcatctcctcgtggagggcctccatggcggcggcggcggcggtggcggcagacagaggtggcggcggcggcggcggtggcggcagacagaggaggcggcggcgcgacggggaagaagcctaggagacgggagcaatgcgcttgtagcctcacgtaaagcttccttggctgggctgtgtacgagcaaatgggcctcaaacaaggcccaaaaacttttttttccacatttttatttgcaaaaagtacaccaaaggttcctcaacttgtcattgaccccaaccacaaaaccagatatatgacatccctcaacttatgaaatctgtggttttaatcccagttttatccgacgtgacatcagcgtgggactccatgtgggtcccacatgtcaggatgccacgtcagcactctttcttccccctcctctcccagtctcccttcctcctctctctctctctctctctctcattttctcctctcagggcaagccggccggcgggtgggaagaaggtcgccgggacgaggcgggagaggaggtccggcggtcggcgacgcggcggcggtggcgaagcagggtgggggagtcgcgcagcatggagagtgtggcagccaccgtctgtacatggccctcacggatgtcgagctggacgcggttcccgccgtccgtggtggacatggcaccaacgtcggcgtcctccggcgacggctgccgcggcgccattccctgccttcacctccccctgcc

SEQ ID NO: 91199 - DNA, 2221 bp, Oryza sativa
ctggaaattgaggctatacgttctgaagttgtttcaaggatgtctgagttggatgggaatgatgagctttgtaaaagcactcgtacaagaagaaaaaggagggcttctgctgtcaagaacctactgaattcttctcgggctcctgaagattccagtgacactgaagatggtaacagcgatgagtgttatctttgtggcatggatggtaatttgttatgttgtgatggctgtcctgctgcatttcactctaaatgtgtgggggtagtggaagatttattgcctgaaggtaattggttttgcccggagtgtttgatacagaagaatgatggattcaaaaatatggtaaagcctggaagaggagctgaggttctgggaatggatccacatgaccgactatactttggcacctgtggctatattttggtgtaagtcaatatattttgtggtatgcgcaaatttgggtcttttggctatgtagtgaatgggaataatcctctgccatattgtctattggttattagtagcttgcgtgattccaaacctcagtataatgcaaaaattaaattcacaattttactgttctgatcattgagttgccttaggatttaagaaaaatgatgtagcactttctcctgtctatgtactgcaccaaggacgtggtgccacctgtccatagaacaacacgtaagcttcagtcaagatttgtatgtgtgtactagctacgtgtgtcatacgagtctagatatacgcaatggacctatatacctagaaatgcatttaatttcatcatgcaatgcagctcgtgaaatatttcttattttctaagctagaggttttggaagagtaaatttaccaacttagcttatcctgttaaaactaaaacctatatatactttctcattttataacattctactgtgttttgtttggttataacaaccggaagatgatgttataagtgactagtcgaaatatttttcaaactgtattgctttttaatgactatctgccaattgttacacttattaaatatcccaatgcagtatttatgccattttttcatttatgcattcaggtgcatgcttgttcatgagtatttcctcacggcaaaatctagttcttattccttgcaattcatatgttatatttatatacatatttatatttatatatattgcagtgcagtacgagatgtttaccttgggaaattgaacctctctgtatgtactatagtataattgttacgttttgctacatcaaaagcataacatcattttgaatttgcagggttgagtcaactgctgaggattctctggactcgacatgtcattactatggcatttttgatcaccattcgcttttcaatgtgctaagaacatgccatccctcgtacagttcaatcactaacatgatatctttgttttggggcactgcaattgattcttttgattccaatggtcgatgtgaaaataacaaggaattcagtatctttgatgccaagatagactgtagtcatttattgccatcgaagcaacacacagaacatgagcagcttaagtcagataagaatggctcctgtgaacaattggcctgtgggaaagctcatgcctcggatccagatcggctggatcatgacacctctcaccacaagttctccttgagatctgcggttatttctgaaaatggaaatgcaactagtgccaagactcagcaagatgtttgttcttatgctaatggattgcctgctgagaataagatagaccaatcacctcacaaaaagataagtgattgttatatccattcgaaccctgctatgtacgtaaactactacagttttggtcaaatagcagcatcagctgctgaagagttgaaggacaagctatcggaaaacaaagaaggaaagaaagttggtcaggatgcagcttcattccagctaaaaacaatatgtaagaaatatgccaatatttttgctctgacagatcaaaagttgtctgtagagctgcgaaaggaaaaatgtggttggtgtaattcctgccaaatcagtggcggtgttgattgcattttcagagtcaccgatggcaaatgcatggagggtcttcagtcagaaaagaatatgaacagccatattattcttgccatacatatcatcttgtccattgaagaacggctaaatggtctactgattggtccatggaaaaatccccaatttagcagttattgg

SEQ ID NO: 91200 - DNA, 2461 bp, Oryza sativa
tgcagttcaattcaaagtgcgcataattgttcgatttcttttatgcagggatttgggggatgcagacatctcagggcctctgattcctcaattgggtggactgaaaaatctccagtacctgtaagaacttcataactcgctctgcttcgaacatgacagtttgcattcagatgatgaattactggaaaaatattgataactcatgtctgcagtgagttgtacgggaatcgcctgaatggatcaattccagcagcactgggcaagatggaacatctagtcagccttgatctttatagcaacctgctcactggcacgataccaacttcgcttggtgccatgagccgtttgcgatatctgtatgataatttcacaataattttataataccgaatagtgaaagattacggtgaaacttctggatattgtttgaactgccaaaatgaattatggttatatgcaggaggttatctcaaaacaaactgagaggggcaatacccccatcactgggcaatctgatgagccttgaggatttggagcttcacaagaatgcattgagtggctctattccggcttctctgggcaatgtcaaaacattgaattacttgtatatgctcattcctaaatttgccaacagagaaattacgagatattttttcaccaaattgggaacctccaagatacttttaacttataatagtagtttttgtttacataaactacatcctccaccccaaaagtaataagaaaagattataaattttccttttttaaaaaaaagattttactagaggaaatagtcatatactaggttttgcacaaatctgtgatataaaaattcaggggatgaaagcttacaaaccagtattaaagaccttcaactagaagcatacaactttgatatgttattcttctcaaatcaacagaactatatatatacctttttaaatttgtttgcaggcggttgaatggtaatatgctgactggcactgtgccgttggaaatcctctctcttcttgtctccaacctagttgaattgtgagttttacatgcttgtttttcatgtattgattagttaaattccagagaaacagtcctgattaactcatactgacaagactaaatatttcgtacagaaatgttgcgaataataatctggatggcacagacagagaatctggaacgagaggtatgtatcatttgaagctcttttggctgcgtacatccatgttgaatatagaggccgggttttaatccattttttataaaaaaaacattttgaagcttttgactttttctttatatacgtgtaaaaaaatcagttgtgttgattacatgaactaccgatcgacaatattcttgcagttactaccattatccaggacatgccgaaaactgcaagttgaatccaggaatccaagttcaagattttgtatttcaggcacattttggaaaatgggataaataaaaaaaataatgatccctcctgtgctcactgaagtactattactgaacatatatctcctagcattttaatgttgactaggagtgcaatggaaattatggtgctaatatgtactttctctgtttcacattataaattattttgggctttaatagattcatgcatcgatacatgtatgtacttcatttatgtgttcaaattcatatgaatgttagtgaatcttgactagagatagagagaccaaaacatcttgtaatatgtaatggagggagtagttgtgtgttttactgatcatgtgcctctattccaaaacttactaatcatgtatttcctaaaaattcatctatgcggtgaaactgagaattattatggtttcaaattaaatagtagatttcacttcagactagctttgttacccatatttagtctgaatgagagttttacaaaatttaatcactttggacccgtttttgttacaaaacagctgcagctcgaatctgtggcccacctgtccaagaaagggagaaacatatccatgtagaggaaaacatggatatacggtgtaaaccccaacttaggtgaaaaatcgtgcaaaccatgaaaaaaatgtcaattttttggaagattttatttcatggtttatacaggttttcaagtagggtggggtttccaccacggtcaataaaaagttgggatttccggcgtatattttggtcacatgctgttgtttttgttcccctgtttctagtcctctgtttttcgcatggagagagccccaatcctcatgtaaagtagccaaggagaggaacggcagattttgcagcccaagggctctctctgtgtcattgttcctgttctgatctggatctgaatttaccatttaccgtagcaaaaaattattatttttacatatcttgtatcagcagatgtcgaccatcggatcaaaataccgatgattcacatgtcaattttaggggagaagatagaaatttggggatt

SEQ ID NO: 91201 - DNA, 1648 bp, Oryza sativa
gtttagttccaacaatacgcacatagtaatccaaaaacaaaaaaaggtcaatacactgaaatatctaatgtcagatgaaaagaaaacttttgttaactgccaatatgactagcataagatagttgtactcttgatagagtaatcattaaattctgggtatacttccatgaatgttgacaacctagctttacaacactttttaaggatctaatatattatacgttagactctaaactctaaagttcccacttgaggaaagtaaaaatctggtttgagcatttccatgtgtaagtttttgtttcttcaattttccttgcagtctgtatcttcaagagaatatcgcaaaatggtgagctgggattaaacaatgttccattaaaagtctgtccacactactccctccgtcccaaaaaaaggcaaaccctaggtttctgtgtccaacgtttgaccgtccgtcttatttgaaaaaattatgaaaaaaatttaaaagacaagtcacgcataaagtattaatcatgttttatcatctaacaacaatgaaaatagtaattataaaaaaatttcatataagacggacaatcaaacgttggacacggaaacccagggtttgtctttttttgggacggagggagtaatagattaacaaatttctgaataaggtccagacagcatgaaacaaatttgtatcttatggctcattacagatgagcaagtatgcctcgccgcaagctcagctctcaatgaaagccacgatcatgatacctttgcttggacacttcttttgcattagtccctagccaaaacatcaagctcgccataaccgtgactgcttagcctccttgcactgcaatgcgctacactaatcccagaaactagttactaatagaaaataaacagataacaattggtataaaaggaatagaaactagtagtagctagtagtcaatagaaaataaacagatatatagcaattagtagaaaaacttcagtggaaagatcccaacaaaagaaatgaaactaaggactaatagccttacaacacagctgaaatttaagcccatcaactttacaaacaagaaatttatcagtcaacttgataagaaactctaaaaaaatgtgttagaggaataaaaaaaccagtattcagacacaaaaaaatcttattgcaaaagttatttttcattctcattgtaatatatttatatatgcacaagagttctcttatatacagcaatgctagaaaaacatttagagatgaattaagctgacctctcaatattcaatatccagttcaagaacaaaattttgagcttggagaaaaatcttttccaaatttaaacgaagctgacattccagatctggatcccgaccaactaattggattttcgattgggattgtttaacctgtgattaaaatataaataataattatacctaattgaaagttacggttgtggtatttataaacacgtaccttttctggaatatactcgttttcatgctcaaataggtctcttagtccatcaatgaaagataaaccagtttctgtggttggtgcttgataattagaactttgagttatccagtgaggcatagccttcgcccattgtaaactagcattcatgaatttcaccagttcgctaatgat

SEQ ID NO: 91202 - DNA, 684 bp, Oryza sativa
aatggatgcaaaggtgaagttgtagaaacttgggtaaggcaagtacggaggttggcgcatgatatggaagatgttgtggatgagtttatgtatgttattggcaaaaacaaagagagagagtcacgagcttatgtgaagaaaattatcaagaaacctaaacctttattttcacttgatgaaattgctactaaagcagataggataaacagacagcttatggagctttctaaaagactaggacgttggacccaaccgatattgagtgggggtagtattcctgcaacaaaatatgacactgaacaacaacagttgtatctacctggacatgattattcaattactgatgctgagcttgtaggaattgataaaaatagacaaaccttgattgaatcattgtgtttggaagattgttctcttcggatcattgctgtatggggcatgggtggccttgggaaaagcactcttgtcaacaatgtctacaaaaaagaagcaacagtatccaatttcaattaccgtgcatggctttctatctctcagtcatgtagagtacttgatatttggcgaaacatgctgaaagagctctgtggaaaagaaagcagagagtttgatgctgaaaatatgagcagtacagaactaaacctggaattaactaaaattctggatcaaaagcggtacttgatcata

SEQ ID NO: 91203 - DNA, 846 bp, Oryza sativa
tggttacttcctgggaggggattggctaatgggctaagaagggtgaaaattgacgtgcacacaaatagtatggctactttggcacctcgattcaggaccctgaggttgtatgttcataataatgttatcaccgaatttgctgagatggattcactcggaaaacatgagttaaatgcaaatatcaactttaaaaaggctcacatttcagaggactaccaagttgacaatataagtgataatgatgatgagggtgctgagtttactaacagtgattatgaaatagataaaggtgatgatgatttgtttgagaagtgggtggacaaggatgtcgttgataagctagtttcaccaaagggcaaacaattgtcaagtgctggtgaggaagatgaaaaatgccatctatctagtgaggaaggtttggatccttgtgatacttctagtcatgatgaagaggcgcaactaaaattcaagagtttcatgcctaaggacatgacaaatccacagttctttgttggcatggtattcccaacagtggaagcactaagggatgctataaatgatataaatgaacacagtgtcaagaacagagtggctatcaagatgccttataatgacaaagatagaataagggctcattgtgatgaaacctgcccatcgaagttaaatgcttcacatgatacccgatcaaaatgtttcatgatcaagacttatatcggcgaacacagatgcaacaagaagtgggagctaaagacattcactgccaactatattgctaacaagtatgtggaaacttttagggcagatgataagatgactataaggaattttgcaagaacagtgcaaaaa

SEQ ID NO: 91204 - DNA, 1465 bp, Oryza sativa
taagcctatccgtgacaatgtggatcacatgatctgctggtttctgcatttaaataaagtggtatgcatctcgttaaatataacaaaaaatgggtagaagaactattagttcatagagattaatgtcaaaggtcaaatgatgtaccttagcatgaataatagtggagtttacaaccactgcagcagccaacacattatctgagaacaacgcatagtgatagagttttggatcttccaacttttctatatgtgggaattttttattgttggagttggtgtagtagtactcatttgtaagccgcagcggaaggcaatgaagtccttttggtaaagattttgctgctacttgtgctagatagttggtttcctttttatgagattggagtcgctcctctgttgagtgaagggttgcacggagcctgttcagagcacccgagcaactatcaagaattctctttccctttcccaatgtttgctccattgctcttattttgctaagtacactgcataataataaaaaagggtgagatgtccaatttcaacaaaaggtacggcaaaagcaataatgcaccatgatgacacacacacacacagagagagagagagagagagagtacttctgaggaagctggccaccactggttgcatcacctaggactctttggatatccctcatccgtgcacgaagctcccttgcaaaaccatgattgcctctagaagctacaaggctcagatatgtcgttgctctcgtcaactggtccttgattgtgcggatggtagcgtctggggaagtagtggaatgaccagcactaacacttgttgggagagcagaattactgttagttgttggtgtgtaagactctttgggaatagcttttgtaacttgttcagacaatctaccagtgctcctttcctggacaattgaacaattaacagttagttcatagcataacctgaaagacaatcactgacggttgagtggttgacggaacacatatactatgactgtggataactgagtacacaagttacagtatgttaacaccactaaacaatatgtttattccaaataagcagtccagctttcagaaaagggtgacaaaatggaaaatcacaaaaagaatgggcatctaaatgcatttttactcaagtgtatagagttgtaatatacatgcaactatgcaagaaaggtgaacaacagaatattaaattcattaaagaaaataaaaaccattgaaaaatctgcaccacctcggcagcactcacttacttgattcctaaaatgagcatgattttaggtgctagtaaatatgtatagctgcgaggtgttgatggtacaaggtgtctaaagtcttactttctagttagtagtccctacccatgattcttaaaaggaaactttatcacccttgccaagtatgcaatcggtcatctgtaatcaattttaccttttctagggatgaat

SEQ ID NO: 91205 - DNA, 566 bp, Oryza sativa
tcaaatgctatgaaggtgtgaagcctggatggatctatgcttgatctaatatcattgttgcatcgaagcaccgagacacgacgagagtctaatcccacttgtgccactccatgagtgtcatcataaattgtacagaaactttctttcttcaattggaaaatggctaattcacgcacaatgtcatgcattcgaagacactgaaccctatcaaaactgttacatgctacaacttgaagcatgcttcgttggacaagctctgctaggtaaccttcagcgacatcttctaagctgcatgctcctttttgttctataaatccttcactgatccacagtctaattaatctctttctgtgaatcagataatcttctgggaacatagcacaatataagaaacaatacttcagatggtttggcaggtgcttgtagcttagatttagaattttctccacccggtttaagttctcattattgtgtacctctgaaataagttgattgtagaaaagcctccaatctttattattctttgatttgaggacaataaactccctattgccacaagagctaaa

SEQ ID NO: 91206 - DNA, 1462 bp, Oryza sativa
cttgtcaatgctcaatcatctgaggttttatctccctgaaatcttcccgaagcttagcaaggtgttattcctggatgatgacactgtagtacagcaggacttaagtgcgatttggtccattgatctaaaaggcaaggttaatggtgctgttgagacctgtggagagacctttcataggtttgataagtacctcaacttctcaaatcctcttattgccagcaattttgacccgcgtgcctgcggttgggcgtatggcatgaatgtgttcgatctatctgagtggagaagacaaaagattactgacgtctaccacaattggcaaagactggtgagtacttatgagcttacaatcatatttatttgtaaaaatatttggagatggtctctctgccatcctactgctcctcctgcacttgaacaccagtagatgtaaaatattaagcctcaaccagcagagaccatcttgtcaatctcgttgtttgaagaaaagctgtagtgggtccgttcagctagtgtaatgaaaacttgcacttctaaccctggctggaattgaattgaaagcacctgatctaatgttccatacttccaactaggaattgagcatgttatattgttatgcttagaaaagctgctacagttaaaccgatgaacaacctcaaattctcaaccgaaaatatgatttaccattctgtagtgctggtttttttttctcgaacgtgcaggagagatgtagtgttggtttgtcctattgttctgctgtttatttcacttattgatatctgatttctgcagaacgaaaataggatattgtggaagctaggtactcttcctgctggtctcgtaacattttggaaccgtaccttccctcttcatcactcctggcatcagttgggacttgggtacaacccaaacatcaatgagaaggatatccggagggcatctgtcatacactacaatggtaatctgaaaccctggcttgagattggattgtccagatatcgcaaatactggtcaaaatacgtcgatttcgatcaagtcttcctacgggactgcaatataaatccctgaatgacagagtgttgtattatccaattattttcttttcacctggtagattaattctttacgctctaggttttatttaagctgtctagagcgatattcttttatctgggctcttctctcttgtaaaggttccagcaagttagtggtaggctttagatcagagacatgttcaatcacagatcacgaaagctgcatcacattttgtagtcactaatgttaatatagtaaattatttgattgtattattcctatggaagagtatttaggagtacctttattaatcttatgtggctccagtatttcaggtatactacttggtcatttgttcacttgaaagccatttattaatctgaacaaaaccaatatttgctgactcgaacacgaatgcatatacatg

SEQ ID NO: 91207 - DNA, 2837 bp, Oryza sativa
ccggaagcgcggcgggcggcggcggcgccgccgcgtcgacttccggtacccggccgccatgtccatcgaggacgtccgcgacgccgaggaggagctcgccgtcgccgcgttccgcgaccgcctcgccgtgcacgccctcctccccgacaagcacgacgactaccacatgatgctcaggtggagaaatgccaagaaaaaagaaacagaaaatctatcattttttcccccaaaaagttgctaatgataactcccgttgtgattcaggtttctgaaggcaagaaagtttgattcggagaaggcgatgcaaatgtgggcggagatgctgcgatggaggaaggagttcggagccgacacgatcttggaggtgatcagagattcagatagtaacattttcacctgataacttacagtgtctgaataatttttggattgttcatttgttcttcatttcttgggtttcttgtggtttaggagttcgagttcgatgagctcgacgacgtgctccggtactaccctcagggctaccatggcgtcgatcgggaaggccggccggtgtacatcgagaggctcggcaaggtgtatcccaacaagctgatgcagatcacctcggtggacaggtacatcaagtaccatgtgcaggagttcgagagggctttcagggagaggttccctgcctgcacattggcggccaagaggcacattgattccacaaccaccatactggatgtccatggcgtggtatgtatgccaatgacaaagctccaacattgggtttggatatatgtgtgttgtgttgtctttagtgttggatttttgtcaatccttcagttttaatgttgctgttgttgtgttgttttgttttgtttgttgttgcaggggctgaagaatttctcaaagactgcaagggagcttgttcaccggatgcagaagatagatagtgattactatcctgaggtaattttggatttccatgggtgtgatgtgtgtagtgttggttagtgaagtgcacattttaattgcacatgaatttgcagacattacatcagatgtatgtagtgaatgctggcagtggcttcaagctgatatggaacagtgtgaaagggtttcttgacccaaaaacttcttcaaagattcatgtaagtgacatgtttgtgatcaatgaggattagcatcttactggtgtgttaaaattgggtctaaaattgttgttttgcttaggttcttggtacaaactaccagagtagacttcttgaagtaattgacaaaaggttagtatcaactagctgcaactagcaaccatcgttgaaactcagcttgtatatatttatacagctatagctcttcagcttaccaagatttggaaaatgctttgtgatttcacagtgaattgccagagtttcttggcggttcatgtacatgcagtgaaggtggttgccttggttctaacaaagggccgtggaatgatcatgtcattttgaaggtacctctcaatttgtgatcctgaccatacttttgtacaacagccccaacattagaaatgctgtccatggaagattacttgtgagttgtgacagcgttctagaaatgaatatccctctgaaaagtaaactaatgtggaagtttcttttgtagctgatacacagtatgaggagcagtagtagtatgagggaaatcaagcaagtttctgatagcgaagacaggagcggatcttccctaagggcagaaaaattgaaggcaaggttctgaatgtctcttttccttcaaccattccaaactccaatgaagtattgcttcgtagttcctgatgaaccttttgctattgtttcttctggaagcaggggatgatgagtgatatatcaaatgctgaatcagagtcagatgttgatgagttcagtttatcagctgtcctgaggagtactgactacagtttccttactccagttagcgaagaagtatgtgctgtgcttatttgttgaactatcctttactttaactaagatacattatctccagttattttgatgccttgagctatgttcttgatacattatatgaactgactcgatatcaaaatgcctgcactaggttaagggatcagattcttcaactttctgtagttgtgagtcttgtgacaggaagggtctcccagatgtaactcctgaatcttctcagtctgtacaacaatcttctgaaatggtgccaaaccaactggtctctcatgaacattcatccacaaccagatggatgaataatttaggtacctcttctttttcatagcaagttagttgcatttcagtacagtttccactttagaacaacaaaaagtgtatcttctgttcaaataattcaccacaccaaatatctctttcagattttgtcttttcagccacagtcttattttactgtataattatttataaccacttcttttgaatacccatttttgctcttgcagggaacatggcaattagttttcatggcactctgactggaaggactttgagcaatttcgttagagtagtaggcacactcatgatcaagatactagccgttttcagcctttttgtcagtagaagaggaaacatgctagagaatgttcatccttctaatgtagaagatgaacctcagcctcgaagtgcaacggaagataacatgagtgcttgtttacaacgtcttgaaaaacttgaatcattatgcaatcatctcatgagcaaacctccagatatgccaaaggagaaagagtgtctactgctacaatcgtttgatcggataaaaaccatcgaatcggatctagaaaggactaaaagagtaagttagtttgcaaactaatttgtcat

SEQ ID NO: 91208 - DNA, 5397 bp, Oryza sativa
aaatttgaataaaataaatggtcaaacgttggttaaaaagtcaacggcgtcatacattaaaatacggagggagtacgtcacagtggactttacattagaccctttattaatttactgaagttcaattcatgtcagaacctttttgatagatattttcgctttgggcaccattttaatttctttatcttcgatttgcatgatttcttttccacaacactgtatcatctccgtctagacagagaacatcgtcgtatattggtagaaacatgatgtagatactctaaattaacttacctgacatgtacagttactaatagggacaattacaaatttaccactagtttgaatcattattacaaaattgccattagaaaattacaaaaatgccactgaaactatcattcgagtggcatccttgtaatattaaaaaatcagtggcaaatttacaaatgccccctactaatatgttggcctgtgggtagtggggctcacgtatcagtgaccacatccctccgtctgtatgtcaaagcctcgaaggatctcaatctagtggagagacaagaggagcatggctagtgcatagatcatagtggcatatcgagactagatttgtatataccaataaaattaaaaggtggttcaggcgaaacaacaaaaataagagaaggggcctggaataaatatatacgcttagaatacaaaataaaacttcgctaacaagcgtcctaagctgtaaatgtaatatactcatctcaagatatatatgttgaataggaggtcatgaataaacctgtgtaactattaaaattcttttaaaagcatagcttgcataattatatatgagtacaaaatatatggaataattacatgtgccccaccgatggttctacaaaagtatttttgtttatgtttcttcctttttcgtttgacgtgtgttcacagatccaaacaagcacttggattccttatgattaaaggctagctgatgcaaccacaaccacttagtaaccctttttatagtgattacagaggtgcgatcgatcgatcgatcgatttggtatgcctcttacgagaaaaagtttatgcttggtaatgtaacaaaaagtatattaaggctttgtaggacgatcagtaagcgaaggataagttaaaagatactgtgagctagttgacatcaatctcgatctatatataatctttaatttgctcttctttttaggtcggtactcgcggtacatacacgttacacataatgtttaacctgtttttattggagcaagatattaatcagttttgctaatttttatactacctctatctttttaaatatttgttgctctatgtttattctaagtaaaacttgcttatatatctttgaccattatccgtgtagatttacaacatgtgatcaattatatattttaaaagcatttctaatgtcaaatctagaaatataaatcttacgatgttaaactagatgaatgtatagaaatagaatggttgaagattaaaatatttgacttggaataagctactaatttgaaatagaaagtaaaaaatgcatctggctagggcaatttggtatacattatagatttctcatttgtttcactttgaatcttctctccacatgcattgcatgatgattttagattgctctagaaggttaggtatatacatacgtttggttcatatccatcgactcaaaacaacatgtgttgccaagtcttttatggcgatcgagtacgccgataagattaggcaaaaaaacaaagtttaattaggcaaaagctagcctacctttcttgccgttatgaagtagttatggaaatgacaaaaaatagatcacaagctagcttgattggacgcttaaccggtacaacgtccacgctacgcacgtataatctatcgtcgtatgtgacgggttgatcacttctgaagttgaatgtacaacgaccgtacgtatcattgcacgtccacgcatacactctcttcgtccaaaaatatatacttcttctgtttcacaatgtaagttattctagcatttttcacattcattttctacattcatattgatattaatgaatctagatagatatatatttctagattcattaacatcactatgaatatggaaaatgctaaaaagacttacattgtgaaacggagggagtaacacacatttactgtttatatagcatttaactattcgtcttattatttagaaatttagtatgaatatgttaaactataaggtaagaacataaaaaacggtaagagaaatcacaataaaataaataatatttattatttttttctgaataagatgtaattgaatgctatgagaaagtcaatggtgttttagaatgaaggaaatatatcctagtatcagtactactgctcaagaggtaggtagcatagtcatatactcacatgtatagtggtggatatactacacgtatgtagtggtgaccgatgggatggatgatgtgtgtagtggctaccttttgagggattgagtgcgaaacatccttattattatcttctcatcctgatgaggatcatcagtcatagctcgtgatactatgtgcaaatgatccatataacgtgtgtgtgatgattgaaaattgtcattgttgtaggcacaaaataatcgaaaccagaaaatatcttgaaattgacgatgttactagttaaggacactcatttaatgtctagttttattcttcgtacctatcaaaaggaggaaaagaagttattattcttgggaattttggtatgtttaacgttgtgttcgtcggtgtgaaaaaactaaatgggcaatataaacctcaagatgggccagttcatgtcaagcccatttctcatgggccgccacaaccattccacccatgatccatgtcactccctctctccattctccggtgccacacgcacgcaagcaggcgcccggccggcgacggcgcgacgccgccgagatgagggtcgccggtgatgcgagcaacctaccggggcggcggctgtccggcagccggggagggagtggaacctctcgaggtaatcttccgaatccgaatttgctcggtttttgttttattttgttttcctgggaataatcatcgataatattagaaagtgaatatacccaaccaatataatcgatataaaaacgatcaactgatataacattttcagcaatctgctaacctgaactaaactaggctaaacagtattctgaatttctgacagagttcttgcattcccccaaaaaagggataaactggcgtaacaaagtaacaatgcaccaatacaactcccttcaaagttcagacgctggacaaaatcccccaaagacgccatccatgtttcatctgaatcatacatatggttttatacagccaatctaaatagttctaataattctgattaatacaatactagtaatgtctgaaataaaattgactgaaataccctaaatcaatgcctttgcatgccagaatgcaaagttcaattacacaggaagctcccaatattaattgtcatatctgaatatatcatacaaacaacaaggtatgcaaatattgaacacaaaacatttgataaataaaacaatacatgcatgcttttggtcttatagatactatctaattgaacgaaacggcttaccgtgcattaccgcgtggaggtcaaaattttgaattcaaaatttggaataagaatttatcgtggttcacactctattgggtaagtaaatagaatactgacagcaagttaaaccctacggaggaagagtgagtccatattgtctcatctacaaaataaaatccagagaattttaaagtcattgcagtccagcagattactaagtttggtaaagataatctcaaagacctcaacgataaaggccataaaccaagataattccatagtagaaactggaaacagagttcttacttgagtagagtaaccatggatactaatgagtcgagactcaaaggcctttttcaaacagtggagtttcacatgaaacaaatcaaattatggtagataaaaaaaagcatttcattatagaggtagactcattttgaacacaaattatcacacaaacagaaatattacacagtcatttcaagcgatacagactacaaatcccgaacaagcgatacaatgatacagagaagcaaaacagtttcctccagggacaacagtagttgcaaaagcaaatggacacctctattacagattgcagatggcaacacatttagccatttatgtggacaacatacagaaataatatggtttatcatacagcatcacttttttttagccttacttcttcaatgatcccagtttatcccctaaggcagtgctgccttatgtgttttaaagcattgagatcttgacgtgacgaaggtgcatcagactagaaagtctgtcaggtaaatggcacatcttgaacagagaacattctaacagacgcaaggattttgagttcttcacgacctctgccattgcgtataccacgtcctcctcgacattgccacaatcttcaatgatgactgtgcgcagcttcgtcaaacggagcaattccttcacatcaacaacagtgaaattgttaatacctgcaatactaatgtgtcgaaccgaactcttcacgtttctcaagtctgcggcttcagttaacctcttacattcgccctgtgagatatatgttgcaaaatcatgcattgtgtcattcataacatagtatgcaggttcttcgttttctccaccaaagcgatcaaggaacaaatttgcagtcaattgagccaagtataactctccgtcctttttcccgaattgaggaaatatcaatcctgaccaaatccaagccctcaccaactcctcctttctgaatggatgattttttggaaataagctgcaatagcgaaagcaactctgcaactctgccgagagcctgtagtagcttattttcaagacatccataatatttggtactgctgctccaaaattatccataccgtgaagaaaccttcgccaggactctaatgatcttactcgtaacagataagcagcactttttattgccgcgggagtccctccaagtttctttacaatcttagcgccgattgattggagttccgcataatcttctgatctttcattcagatcagccaaagcaagttggcagaagatctgtagatttccattttcttcaagttcatgcaacctaaggtgctgatcttcacatcctgtgacactctcaactagagttgccactgattgcgttctggttgtcaataaaattttgattctagtgttgatgcccctcagaactgaaaatagtttctcccattcatgtagattttcttcccagacatcatccaaaacgagtag

SEQ ID NO: 91209 - DNA, 786 bp, Oryza sativa
cgttgtggggatcagatagatagccagcatcagtatacctaattaaagtcgaatcatggttctttttaaagaaaagtccaagatctcttgtgcctttaagatatcgaaagacattcttaactccagtccaatggcgtttggtaggagcagcgctgtatcttgctaatagatttaccgagaaagcaatatctggcctcgtactatttgcaaggtacataagtgcaccaatagcactaagatatggaaaatcaggtccaagtacatcctcaccatcttcctttggtctgaatggatctttctccacgtctagagatcgaaccaccataggggttttggaaggatatgactcgtccatattaaatttctccaaaattttctaggtatatgcactttggtgcacaaggattccagaaggtaaatgctcaagttgtagacctaagcaaaatttgggttgacccaaatccttcatctcaaattccgtctttaaatgatgacgtgcttcattaatatcttgtgtattgccaatgatgttgagatcatcgacatataccgagacaatacaaaatcctatgggggactttttgataaagacgcacgggcaatcatcatttttagtgtatccctttagtgaaaggaattcacttaatcggttgtaccacatcctgcccgattgttttaagccataaagtgacttttgcaacttaacacaatacatgttacgatttacctttgattcgggatgtcgattctgtcaggaaccttcatgtaaatattacaatcaagtga

SEQ ID NO: 91210 - DNA, 676 bp, Oryza sativa
cccatcagtttctccacagaacctaaggcaagatgggggattatgtaaaaacaccagcaaacgcaatgcaaatgctcaatggcgagtcaaaaccattgccttaccttatggattttgtgctaaatgtatgcacaaacgattgtggttgaaagggtatcaaaaggattcaccagaaaggaaaccaatggtcgcaagtgactccagtgatcggatcaaccagtggggaggccgagaccatcgattccgctgacccccaaaccggatctgtagctcaccgatgactccagtgatcggatccaccagtggggaggccgagaccatcgattccaatgaccccaaaccggatctgtagctcaccgaggatagggagaggaagaggaaggcggtagtggtctggagatgagaggggagaagagggcagcgatggcttgatggcctcgtgacccttccttcctccggatggctagatccactggcaaggagggcggcgccagcgcaacgacaataggaggagggtgaggcgacgatggcacaaagcgaggggaggaatagccgaggagggcgaggcggcgcgcgtgagagaggagtgcgaggccgggctgggctgaatgcggctagggttttcttctcttgatctgctcaaaaaaaaatctggaccatccaatatgctttcgcc

SEQ ID NO: 91211 - DNA, 914 bp, Oryza sativa
ccatggagtgctgaaaattgccgactttggactggcaatatcttatgatcccaagaatccacaaccgctgacaagccgtgttgtgacattgtggtacacaccaccagaacttttgctcggtgcaacagaatatgggtggctgttgatatgtggagcacagggtgcattgtggcagaactctttgctggaaaaccaatcatgccaggaagaactgaggtatttcttgttttgccttgtggaattccaggaaaaacatttgatttttgaaagatatgatttatgtgtactagtcaaaacctcatgtgcctttttgcaacaatgtcatactaggtggagcaaattcacaagatttttaagctctgtgggtcacccatggatgattattgcaagaaatcaaaagtgccagagacagcaatgttcaagcctcagcatcagtataggcggtgtgttgctgagactttcaaagtttttcctacttcagctgttgttctcatagactccttgctttcattagacccagaagctcgaggaacagctgcctcagctcttcaaagtgatgtgagtttcaggcttcagtgcatatcttctgtttagtgtgggacatagctttgcagagcctacccaaaacctaacatgctgttctcctaaaaaaaaaaaaagcctaacatgctgcaaatgtagttgaaacatgaaactaaaattctcttagcagtttgtgaaatcaacgaatgaccaaatctgtgttccatcttgtgtgaacattatgcatttataatactttgcttgtaggaatgccttcagatttgtagcactaataccatatctcaaaccaatttcagtttttcacaaaagagccatttgcatgcgacccatcaagcctgccaaaacttccaccaagcaaggagtatgatgtt

SEQ ID NO: 91212 - DNA, 664 bp, Oryza sativa
tgcaagcatggaaacaaccgttctcccgttcacgtactcgcacagtttgtgctcgcacaccagcctcagcctctccatcttgtacctgctcgccgccgcgaccaggtccgggagcatcgccgccgcgtcccctcctcctttcgtcgtctctggctccggcgcgagtcggtgtacatgtagcggagcagagcctcgaagtcccgcgcctccatgtcgtcgatgcgtatggcggtgtgatccaccgcgccgccggtcgtggcacccagctccttgcttggcccaaaaagctctgcacggaacaccggagaccgggccgcgagcaccagcctgtgtgccgcgaacgtcttcccgctgacctcgaacgtcacgtcggcgccctccccggtggcgaggaggcctccgaggtgccggtgcaggtccgacggtgggacaccaccgtaggcggcggcggcggcggcggcgttgcggtgtctacgtcgatgtcctccgtctgcagctccatgaagacggtgaggtcgcacacgatcgtgaggcagtcgtcccggagatactccgatttctccagcacgtccctccggatgaaactcacaaacccccacccgctgcttttgaaggcgtgcgggttgcctcccggcacggtcgagcaagctaaacttgaactgag

SEQ ID NO: 91213 - DNA, 791 bp, Oryza sativa
aagtccaggcctcgggacccgaggggagcgctcccagctcccttagattgattgcttggatcactgagatccaggcgtacctcacagataagactctacccgaggaccgcgaagggagtgaacgcgtccagcgcatctccaagcgctacgtgctggtggaagagaccctctatcggcgcgcggctaacggagtcctcctgaagtgcattcctcgggaacaaggtgtcgagcttcttgccgatatccatgaaggcgagtgcagagcccactccgcctcacgcaccttggttggcaaggcctttcgccagggtttctattggccgacggctctcaacgatgcggttgacctggtccggcggtgcagggcgtgccagttccacgcaaagcaaacccatcagccggcccaggccctgcagaccatacctctttcatggccgtttgctgtctgggggctcgatatcctaggtccgtttaggcgggccccgggcgggttcgaatatctgtatgtcgctgtcgacaagttcactaagtggcccgaggcttacccggtcatcaagatcgataagcactccgcgcttaaattcatcaggggcattactgctcggtttagggtgcctaatcatatcattacggataacggcacccagttcactagtgaactcttcggtgactactgcaaagatatgggcatcaagctctgcttcgcctctcccacccaccccagaagcaatggccaagtggagcgcgccaacgcagaaatcctcaagggcctcaaaaccaaaccttcaaca

SEQ ID NO: 91214 - DNA, 1612 bp, Oryza sativa
  unsure (1)..(1612): unsure at all n locations
ccgccgcccttagccactgctgccgctctgtgtccccgcttgccgctgacccgtgagagagagagagaggaagaggagtatgataggtgggtctcatagttttttaatatagaatgctgggagagagggagagagagaggaagaggagtatgataggtgggtctcatgttttttttaatatagaatgctgactggactgccacgcgtacgctatatagaccaaaaccaccgtggattgggtcgagggtggtaattcgtccggtttacatagttgagggtgaagaatatccggttttgtggtttatgggggtaattcggttgaccgcgatagttcgggggggtgtaattcgtaaaaaaattggtaatgccaaaatatatcaaaatttgtctaaattttagtagagttcaaaatagctacaaagtgaaccagccccgagtgctaatgcggaaaagaaatctcaataaaaaagttgttactttttgctaagcgtatgtgtcatacgctcgcactgtcaccctgcagcgactccaattacttaactttggtttaggtattgctaaatgcgcataccgcgcatggttgcgccgggtgtgccttcatacccagcgctgctatacgtacgaattatttcgtacgatggttgtacaatcaaacggatcccctcaggcctcagttgatcctatatccaagcccaagctcttgagtcctggcctgctatctggttggcttgcttggagagccaatgagccaaccaaagcaattttcttttcaatcatatcttaagcaatcctcttcttaatatcttactgtatatagtaattgtacttagcactcaacattgaatttatcatgtggcatggttaagcaaattacgcatacaaatatgttccttgaaaaaaaagaaagagagaataatgtaaaaaaaaagatgattgtgaagctaaagaaaatcaagtaaataagatgccataccttcgtcttcgatgcgtatgctattggattagtttcacacttgcagattagatcagaacatgaaagtcagatttagggtttggagtagtgaacgtaaagttaggtttagaggtgaactgggctttagggctcataagtacgcttagactgcgccgtgcgtgacgttttgctgttgccgtccgtgccgttgcgtcttatcgtaacaagatcgtatgcgtagcattttcaattgctaaatgcgcataccgcgcatggttgcgccgggtgtgccttcatttgggcacgccaccagctcgccctggagatgttattaccccgcgcccgtgcgctaggctccccgaggtgggactaaaaaaacgctagtgaaagtttcgcttccatgggccttgtagccatacatctgcactacacatatatgggcccttcaggtcgacgatgatgagtccgacacggcactgcagatacaccactactgtcatatacggtgatgctattttctcctaaagataaaaataaagagaaaaattaagttttttacgtaaaataaaatggtattaacgtatgatngattgagttttaattattatatacttgaaaaatggattaatatgatattttagagaaactttcatatagaaa

SEQ ID NO: 91215 - DNA, 695 bp, Oryza sativa
atcattcctgctctgcagagtgacagtgagtacatgtcagggcagctgtcagcgtttggatatgcgatcactgaagagcccgaaggagcggatttgtggctaattaacacgtatggttttagtttctttcttctcttatttgtttctttccatctattacctctgacgttcattaaaagtacacatgagttgaatttaacctgtgatggtttcaaactggtgctgctctggatttgtgttgtggaaaactagctacgctattttttgcactagaatatgccatgagctgtgtaaacttgggataataagcataaatccaacttgcagtgccgaagagtgagatatatattgacacgtaggggcaaaccttcaaattaacttcagaggtgaagaatatattgtgaccgacacctattttgccatttcagatgcactgtgaaaaacccaagtcagtctgccatgacaactctcatatcgaagtgcaagagtgcaaacaagcctttggttgtggctggatgtgtaccacaaggaagccgggatctgaaagagcttgaaggtattagcgttattggagtgcaacagattgaccgcgttgttgaagttgttgaagaaaccttaaaaggccatgaggttcggttgttgagtcggaaaacactgccctcacttgatttacctaaggtacaactcatatttct

SEQ ID NO: 91216 - DNA, 724 bp, Oryza sativa
caaattttcgatggctacggccgctatcggggatctctgcgtttcatccagaaggccgtactggagagatcggagtacctccgggacaaccgcttcacgatcaggtgtgacatcacggtcatgaagaatcccgaggcaaaggacactggcggcaggcgggtaaccctgccaccgtcggacctggcccggcacctcggcggcctcctcgccaccggagtgggcgccgacgtgacgttcgaggtcgacggcaagacgttcttggcgcatcggaatgtgctcgcggcccgatccccagtgttccaccaagagcttttctccctaacggagaaggggaatgccgcgactggcggtgccggtgtcatcatacgcgtcgacgacatggaggcgcaggacttcgaggctctgctccacttcatatacaccgactcgttgccggagatgaaaggtggagacgcagtggcgatgctcccaacctggtcgcggcggctaacaggtataagatggagagactaaggttggtctgtgaagataagctatgtgagtatgtaactgtgagaaccgtggcagccatgttggcgtttgctggggaacaccaatgccccgagcttgagaagaagtgcttgcagctactcgaagatccagcaaatttgaggaacatcgtggagactgaaggtcttgagcatctgacgaaaagctacccctttgttttgaaggatctaattgc

SEQ ID NO: 91217 - DNA, 1175 bp, Oryza sativa
acacgattggtgtatccactagaaatctcttgtatgagctttctgaaactttcttctccttgtgcacttttgtctgatatctttgatataaagcaaactcctcaggatcaaaatgtgaccttctcattttaatttcaagctttcttcttttctggggaactcttacagtatttttgttcacagagctttgctttgagctactagatttatctggagcatgtgtagacacaatgatactggttttgttctgctttgtctgattggtgactgaatagaagttcagatggccattgcaggcttttactgctaaaccagcaatatctccatggcactccattgtcatggccagcttttctgcaatagagtttggagaaatatctgctactactttattgtgattagcatccttctccttaggcaatgcacgtctgatttctgccactatttgaaagcttatattacatgtgtacaataaatcttgtactgcttctcctactttcttgtcttgtgatgctcctcctactttcttttttagttgtggtttaacagtctttacaacagctttagggagttgaacatcagaacctaatgtaccaacttggaaggacatacccactgcctcattaattttgctagacaggcaactgatgaactcatcttcttcaaataaatttggacatttggctgcttgaaaatcatttgttaatgtcttggatatttttgagaccggcatattcataggttcagcgagtgaatgttttgtagggctagttttattctgtggacttccaacctgtggatcaagctcaccatcaaggaacctgtgaaatgaagcgtgaagacatgacacaggacaatttagtgactaaagctaaacgacatatgttaacaatttcacaggtgcatatgcaaaatataaaacaaaaggtgtgtacctttgcatctttttaagtacacgaccttgctccttcgaacaaatgaaatcatttgccttcaagcgtattgtatattgaggacagcaagtacgttccatctcaagtttgtaaagaaaacaaccagatctcctccacccacggtcaagaagagctgtaaacagtagccataattttcaatcatgataaattatgccagcagaagaactactttttaaaaaactatgaatatccaatatctca

SEQ ID NO: 91218 - DNA, 675 bp, Oryza sativa
tcatcagattggaaatccttattgctttcttttatgcagttttccaagttttgagcaaaagcttccatgttaagttttattgttgggatttcatcagtatcttcatcaaaatcttcaatatcattctctaaaagttctcggcattcttcctctcttggacttgctggctcctcaattattggatttgtgttgttagcatgaacatcccttgcatggatactcccctcgagctgaagcagaggagttgaatgtggtgtgggcattgtaccattctggaaatcaaattgattgctcatattcaccaaccttttgtcctgaggagaaggaagtgcaagtcttgcacttcatttaaaaaagtcaaacaaaatataagaattaataaggaacaaaataacaaataaagaaatatgcaaaatgaaggctcccagataaggtcaactggaagcgcaagatatatcaggcatgcgcgcacacacaaacaaaacaagaaagatagtggaaagaggaaatacgtgaacacaaaattcccaggtaagataagtgaaagcagcaaaaatattttgttgcagacagaaacgtacataaagtgccatgggggtgtactagaatcatgtactgatttttctcctagaatattttcccttttattcttcaaaagcactattttgcactctt

SEQ ID NO: 91219 - DNA, 9471 bp, Oryza sativa
gaagaatcggaaacggcagtcagtcgatcgtgacgtgaattcatccataacaccatctaacaaccttaaaagaagaaacatcaagaaatgctcaccctctgaaacaccggacagtgcaggagccggcataaagctccgacgcctggatcccctccccgtcagcctcctgtggaacaccaggatacttatcggcacctgcgtgcatcctgcaggaaggttgtaggatggccgtacggggggcccaccatgctgctcatcggcgctgctcccggaacccgccaccagggctgcctgtggaaaggagccctcgtgcatggcgttcagcaacgccgtcgacgacagggaggatcccgggaacaatgtcaatggcgggcagctccggcctgccacggccgtcccaacacccaaatttggggtgcccctcccaactgacacgccggaggtccagctctcctggttctcagcaggattcccctgcaggttgagccctgagggatccatggctgcttcttccacaacctacacgaagactaagatgaaattgcacacaaagcgaaatacaaacgacagcaaccaatgaaaatggaacgagaaaaacctccccaaaacccagaaaaagaaggggaaaaatatagccaaggcgcgaacctaacgtggattgccggggttcaactgaacccctaaattttttttcgattcgaaccgaaacggaggcagatggaaggaggttggccgcgtcgatcgatcccccaccaaacctcctcgccggctgtgcgcacgccggcgccaggccacactggccacggaggaggaggctacgggcggaatcgggaaggggaggacgccgtacacaccgccgcctgcgccttctcgccgaggcgacgcctacctgcagctcgcactgaccattggaaagggaaagagagtgtggaggatcaaggatgaagacacggatgcgtgaagagagaaatatcagatggaggtaagacgggttctcgtctttcgccattttctaggtagaagatgttacatgcgaaccgcgccatgcagtcgttaagtggggatgaaaatggatcggatatatatatatatatatcaataaaaccgttataatttttaaaactttagcagcacgaaaccaatcaacaatacaaatataatattttaaaaatatattggattcggattatccgaattaaaaactattatgggcgtttgtctcaaacgtgaagataaagataggcacttaatctcggtagggaaaactctattggaggcctacaaatagggttaatttatctttctaagagatgcggctaccctaatcaagtgaaacgggtctgaggacgttcgttggcacctcatccttagagattaaaagcccacttaggaagacttaaatatcaaatacggataaaaaagatcctagcatcgctcgtagagttgtttggttgttaaccatactttatcatagtttgtcatgcctagagggatggtaaatagatgtttctagcaacaaaacttacagtggcaagtagaattgatccgataaatcatgtgccactgcggatagtccgataacacatggtgttggacaatctaatcaaacatagagaaaacaggaaggaactcacctattacatgtatagatctgaacagttcgacaataccaagcgtcacacaatctgaccataagggacaatccggttttatacagagaatatgaaacctatatgaggtatgacactttgcacactgttggtatttcttacgatcacagataaatccgcaagtacacggaatatactgatgtagcacttcactcgggattattctcatgcatcgatttccacagggaacgtgtgtgctaactccagtttaggttcatccaaggacacgaagctatagataggcaaaggatagagaggtttcaccggtgaataacaatgtctacgaaaagcttaactttaatcctaataaggtacttcggacactggccagctcgctgctcccagatatcgctctactgcgcacccggacagggaggacttcagtgatattgaggactgtcaccacctctacacccacctcacacctactgtgggatgcggagcaaacaccggaaatcaactacctagacaccacgtctacgcagttaataactattttagtgtttataactcactaaagcaatcactatagtttagttgattatagtgaacgatgatcccatctgaataggaactaactaagaaataattctcaccgagtaaaactaaactactcaaaagatatttcaattataataagagtaataaacagagcagaatgaaataggaagaggattaccaacaactccagaattcctcccacttcttctactctactctttccctaatctagtatacaataaagtacaatagagcctcttgtaattcaactcatgcttcaagtatgtgtttacaagtgaggatgagaggggtatttatagggggagaagtgtcttgggagtgtggagatgctccaagcaaccaaagagcatcttctctcttctcatgccaagtgtcccttctgatgacggtttctaccggtattaacgccataaccgtcatagggagagcgttatccaccgaatgcaacctggttctgggccagcggcctccacagtggttcggccgaactcagggttcagccgaacctgggacggcaccgtttgctccgaatttcggcctggacactcattttggccccctcattctattggtatggatagaaggcccatttggaggtgtttaattgggtttctgggtccaaaactccatatgttcggatacacgtttgattctcctcctccttcatgtatatttcttctcaacttaggtagtttgtcacctgcaaacgaatatacaccaacactcgtgaaaattgttagaaataaaccttaccactatgttggatgttttacttttatgatttatgcaggttttgacggcgttaatttggtacttcataaccgtcaacacacactaattttaaactataactaagtggtgatcaaaagatttaagcatgcatagtatgatcgccaaaaatctcaatcatgaaaccataagtgcaaagtagagaaacacaccgatttgtttacagaattcgaatccaaccaatcatgaaaccataaggaggtctgaagagccgggtttcgattaagccttttcctcttcaagctactacctctgatagtgtcttggtctcttcaagcaaccaccaaggacaagtttgtattccaagcgacccacttgattccaagctcggatgccccgcaactcccctctgatgaagcttgctctaccaagcgtccaccaagatgcagcttggtttccattattaccttttcccttccgagacgacttatcaacctgccgcgacgagaaaatgatgagaatgagtagcgactgacagctccgttcaccttgacttgctcaactccgttgaggtctctgcaaccgtcgctaggtatcctcgatcgccgtatatcttggctttctccactagatcctcggagttcacctcgatatacaccagcaaagtcaccttctcgaggtcgcggagcgcacacttccactccatcctcggggttgtcgtcaccaagaaccaccaccttcaagtgtcgtcggccccaagctaccttcgagtagagaaagtggaaggggagagtggcgccagtggtggatggtgagagagtagcgactgtggtgccgaccggcggggggcggagggagagtagtgtcatccgtgcagtaagggagtgggtaaggataattttatattatgctctgatttttgaagcgttcggtgcaaaatattggagtttcctataaattatcaaaacacaaggactaaaataaaaaaataatagggactgacatgccaaatcaaagacaccacttgaactatttgcactgtaaaaaaggagggtggtctcaggctatgtggcatgttctctctcctgtagagaaatggttagccatgtcttgcacaaatggccttaggccaatagtagtgggtcactcgtttgttttgcctcacgtgccatctcagcccaattcataagatactccaccatcagtgcaaagagtccagaaaagcctaatgtctaagaaaaacaatgcaagcgtcaacggggaaaaatgaaaaatggagctccacaatgcaaagaaaattgagcgatgtagcgggtgtcagcggggcatgttgttagggatacgagagacataatgggggcgcgcatgctacggacgagaaggagaatatcatatgtggcacctcaaagctgaataccatgtaggagcactatgactgctcttacaagcacattttctcagaggtgactagggatcggtcgcccaatccaaatctccaaaaatcgggcgctgacgtagtgccacccatatatgcaaaaccactttaaaataattttttttaaattatttatccaaatcataattcgattgcaccattaaattcattgcaattaaatcttcaaaataagaccacacatggatatattccgacgaaaataagcttattattgaatttttttaaatgttacatgatgttccaccaggtatatcggaattgctttactaagtagatcgaaaatgtttcaatcgtttaaattgagcgttgtttcacattatataaaaacaatgtttcagcaaatagcgaaaaaatgtttcagttaactgcaacatttgatccatacatagtgaaacattataagtacactaggtgaaacatttttagtggaacaaaaaaatgaaatgaattcccttaatagatagtttccaaaatatgtgggtgatttgttgcaatggaatatttcagttcactgcaacattagatctatatatagtgaaacattgtgagtgcactagatgaaacatttttggtggaacaaaaaaaccaaattccctaaatagagtatttctaaaatatgtgggtgatttgttgcaatggagtatatggtggagacacgtggtgggaacaggaggagtcacgtgcgagtcaggaggggggggagcgcccgatccagctccccccacgccggtcacccgacacgcaacattttcgcattttctctgtgcacctcaatcttatcttcaaccacgattgccactgaactcgtcaaatctatcataaatggacgagagttttctgacatattagaacactagatatttaggtcttgtttagattccaacttttttcttcaaacttttaatttttccgtcacatcgaactttcctacacacacaaacttctaacttttccgtcacgtcgttccaatttcttcaaacttccaattttaacgtgaaactaaacacaaacttatatggtcttaccgttgtttttttatacaaagttcagtcgtgtcgccgccgccgccgctgcaccatatcttctcgtacgattggtctttccacccaacattggcagaacccaccccctagacaaatagcaatccactatgctcacaaccagcgatgggacgcaactcacagttgaggcagggaaaacctacaagaaggttagtgaaagaaatgaattgggcatctaatgtgataaaagagggtcaagcctagaaatcgggaagaagttagcgctctgcagggttgtctattcctctttggcgcaacaaagctttattgctccacagtagtgtcgaactgtcgattgaattcattcgctgccgaaatcatccagaaataccagtgacaagacaatgaaaaacactagtgacaagacaatgaatgcaacataatttctgaacttatcacggcaacacggtgggacacacgatgagaagccccaagtgcatccccaaggacctcgggggccccatgtgtgttggcagttgccgtcccgcgcgatcaaataaaaactgccttccgattccgacggggtctcgcttacccactgcagcagagcgtgggaccaatccccgtgaccgagcgtggatggatcccacgcgtctgtcacaccgtctcgctggcctctccgtcgccggcacgcgggtcgccgctcccaaagcgggtcacgccaaaggcgaccaccgtctccatctccccttcccgagcatcccccgggtccatcatgactcggaatgtgtgctgcattttttgtcccggcacttttttcccctaggatgtgtttaggccgagttcagggtatttttaattcacgacaaaattagaagtttggttaaaattgaaacaatgtaatgaaaaagttagaaaattttaaactttttctttaaactttcaacttttccatcacatcaaaactttcctacacacaaatttctaacttttctatcacatcgtttcaatttcaaccaaactttcaattttagcgtgaactaaacacacctttagttcacattaaaattgaaagtttggttgaaattggaacgatgtgatgaaaaagttagaagtttatgtgtgtataaaagttttgatatgatagaaatattgaaagtttgaaaaaaaaattggaactaaaatcggccctactcggaatagaacggtatcgtcttttttcagctctgtgaatctgtctattgatggccacagcagccagtagcaccgctctgcagtcctggctcttacgtgtcagtgtgttcgtccgtctggttgtcatgccaggcacagtagtggcaaggtgtggcatatggcagctgcggtgaggttgataggtttcgtggccttcgtgtgcctcgggcgcggagccgagcgaacaccggtggtgaatgtggaggaaatggcagaggaaagcgggaatctccccgcatgagacgagccgggccgacggagccaagcgaacaccggtggtgaatgtggaggaaatggcagaggaaagcggggagggaatctccccgcatgagacgagccgggccgacggagccaagcgaacaccggtggttaatgtggaggaaatcacggaggaaagcgggaatctccccgcatgagacgagccgggccgtgccgtgccgctggcatggtgacggaggtgtcgtgacggcatctggtggcgagtcgtggtgtcagcacggccaacgcatgccgtttggcttttgcaacgcgccggtggtgctccccacctaccgtctagtttggagctgtgcaacgagaggcttccagcttcctgctcccagtacgatgtacctgaaactttgtgcttgtgagttgacacagtacaagcaaattttggaacaagcggtgttgctgcttcccgtaaccaggaacagcatgcgggatgaagccacagtgaaatgctgtttaacagttggacactctgtaaatcacatattcttctcatttcaacgcctgcggtcctcgagttttttcatcaagaaacagatgtgctatttttatgtagaatcatgtgcagaaaccaaacgacttgtgctatacccttcggccaacagtttatggaatacggacttcaatgacagataacgaatcggccggaaaaatgtgtcattccagcctccaacctgaacccaccagaattcgactgcgaagcgattagcataaacatgttattgtacctctaaatggtcgcattgctcccttgggacagaattgcaggccaactacagggaataaaccatgcgatcagatagctccttccctacaactttcacgtatttgctcaattgcctttctagctgttcgaggtgcctcctctcgattcgtccaacgactcccagaagatcctgaaagcgaaagtaaaaaaaccaatgttgcagtacatgagcaaactaaatagcagtattaaaaagcatcaattaatgcattctgcataaatcaacagccttgaacatattgtcggatagataaggtaacacaatgagagcaaagaaatataattcctacacaattattatgcagtttcaatatatgcagcatatatagttgttagcatgttctgtacaaaggacttgcaaaaggatgggcaatttaataacagcatgacaagattaaaaaggaaaattgcagactgcctgattacacgcctccgttgcaattcttttgggttgtaggtcaaattttatgtatatgcagtttgtagtaccttatatttaactcgagaaccattcagatccatcatgacattttcaaaatcaattatgctggaacaatcctccattacatcagtgttggattctgatcgaaccatctcttcatcaaccatcatgtctgagtcatcataggacaaatcttcatcatcctcatcgatgggagactcacaattgtcattttttgataactcagtatcaagatgagaattctgtggctgaggcatctcatcttgtatttgggcaaaatcagataggacagaatacaggctcttatctagtaaacgtttggcactgtcatagcacacccacctgcacaaaggacatgaatatcagagatgtatggatagtttagcagccaaagaaagacaaaatagtcatccttccaaaactttatcataaacgctttgtttcaataagcaaaacaaactatcgcctagaatttgaaagcctgcggtttgaatatttgggttggaaacataaaattagctatgttcgtgataatctttttgagcaggagaaattactgtattttttcatagcatgtagttgaattgtaaaccgtgatttacagaaaactcgtgcaaattaattatacccttaagactgcctgttaggatgagatggactctttttgggaacctcagttcagacttgaacaaaatccttcgaatttgaatcagaatcctcaaagatgcagttaggagatacatcctagctactccttccgtcctaaaatataacaacttctagccttcaaaactagtcccaaaatataataacttctccacctacattctcttctcaatcaataacaaccttccaccattcaaattcactacccacctcctcaaacattacaacctccccctatttaattccaccaattttcttaacacctgtgtccaatcctaaaactccttatattttgggtcagaggtagtattatttttcaactaagactaatacacagaacacaaccgtgttgcttctctatagagcctgtgctgttgcatttgcatcataaaataatacatggatgtgtcaaaaattaagagaagcgtcttactcgaaacggactggacagagaagttctgatggtcgatacgcagctttgtatctcatcttattgcaggaatgtatgtaataaccaagataataatattgaaggttggggcagtgctcctgtgttgtcttgacccaatctatctccttcagagctgtatactttccaagagataggaaagcaaagtcaggatcccagaacaaatacttgcttgacaggcacttaggaaggatatcaactacaccaactgccacaagttttccat

SEQ ID NO: 91220 - DNA, 2880 bp, Oryza sativa
aactccagatgttgatagcgtatgtaagttagtcaggaataccttagtttgcgaagtgtggaaaacacatcgcgaattgagaggggacgaggaggagcaagtaacatttgattctggcggcattcttgggcaacatcacctacaaattacactacatccactgttaacactacacaggatcatttcagcataattaaccagtacatgaagctaaacaaggcagttggacctggccgtaagcctgccaaatgttgcatgcatgcatcaaactcctattttgcaaagacacagcctacaccatacagtaattttttccccacaccatggacatcaacaatgctggtacttctaacctccaaacttaccaagatcgccgaacgttttgtacatctcatgtattttagatctgctggatcctaatgcctcctccagagcagatacaaccaaactcccaccaatgtttagttcctagcttcattaacaaatatgggttattgtattgattgtgccacacgacaaggcataacagaagggtaaaccaaaatatttataataggacatgacacagttactcattagaaaataatgaaagaaagaaagccttccaaaggaaagggccagctaattaagaaaatttcaacttaagaaaaagaatcaacttatcctaattgaaatgctgctagaaaatttcagcctgttggaacatagtatcctcacagggattttgtaggacacctacatccatgttcctccaggaagtcccatatttcaaataaagctttagaaagaagcaaagagcagtaaatagggggaagggaaaagtgaatgaaataaaacacttacaatattttcatggtcaggagaaattttattagtacataaataaacagcaggtagcacatcatcaggtgataaggcaagcaaactgcacttgagaatataagatgttaagtatattccccaatcataaacatatagatgataatcaaaaactgcacgcaatgtaacttagagggttataggaaaaaccttcggaacatgttgcaaagcatggcagtagttttgatctttcccttttctctttcaaccagatcaaaagtgcgagccaaatgtaagtatggtgcaggctgtcctgctgtccagcaagctgtagaagatcacatacatggtattactcactgtcaagcaagatgctaagaaccataaggagggtaggcactaaccatgctcgatcggtagatacttttcaattggcaatgatatacagactgaatctgcttgtgccacataagattgtacacataagttcggcatctttggagtggcctcagaagagttgcgaagcaagcccgtactactagatttgtctgtcatttcattttctgtgttttgtgtgacaatattcatatcattttcaagtacattactgttgtcggttttactgtaaaatatatcaactgctacattcacatccccttttgccttctcaagcaatgaaattgcagactctctggacattccaccatcgacaatctgaagaagctggcttacactctgcttctctgactctacaacttcagtaaactggtcgtcattcctcacattgttttgatttgcgtctacagttactttatcggatgtatcgcttttagaagcagctagcatggttctagcaaaatagttcgtaattgtggactgtttgcgcccactggattctgtcaagggtttaaaggcagttgaccgccctttcttttttggtttgtccgcagaattagagcccctcttcctttcccttttagaaagatttgacttcattctcatagcgttcaaattcagcaacttactagaatgatccatgggcttctgtgaaaataaaggaacttcttgctgactacttgcatcagcagaagatccatgatcagaagagagatctatctctgacttaggcgtttcactattataaacatttgcttcctcaaagaaatctctttctttctcaaaaaaatcagttgctgcttgaacaacatcaccgcctgacttaattagcaagtccaggatcaggtcctggctgacccatgagggtaggaaatctgataattctttcttcatttccactgtaatcttctcttgaaaactatctgatcgttcaaaagccaaacttgcaggtaacaaagtagcctcctccagttcttgcacctccccttcttgctggctcaatccagtaactgcatcctcagggccaagagtagcatttcttgagcttcggtggaatgccatcaggaactcctgtttgtttgctgtctcatccaccaaaccagcaaaatgcttctgcagagcaaatgcctctttactatcgagctttccaccatcaagccccacggttggaattacccgttttgggtgcaagaacttcacgtagtcccgcaactcattatagctcgagtgctcgctataaggcacaagatggatctcaagtgaatcctttgttctaactgcaaagccttccttcttggtctcgtacatccaaccggtcggtacaaatccaacagccttgttatatcctctctccaccatgatctccttcatcttcacaaaatttggccgaaaatagggccatgtttcacctaaaatattccacccagtgacatgcacatctgttgctgcagcatcctcagtaaaaactccatcctccccaccaatccccaatagagtcaggatttccatcttcctactgtccacatggatcttacagccacagcgtcgtgcaacttccagcaaaatcctctccttgcccaccacgtaggtcgcgatcaaacacagcacgcgctctccagatgctctgctctcctccttcacccgcttgattgagttcacgacata

SEQ ID NO: 91221 - DNA, 1297 bp, Oryza sativa
acacaccgctgcaagaattcaaagattctactcgtagtagctgatatttggttaattacattctggggtacactgagtaatttgcaattttgccgtgggtgcaggcaaactcggcacaatggcaggacatgaagcacatctggggggccacctggagcctcaccccgggcccactggtggggcccttctcggtgaggctgacaaccctgaccaccaggcagaccctctcggcccaggatgtcatccccaagaactggacccccaaggccacctacacctctcgcctcaacttcgcctagaggaggcccctccggcccatgtttgatgtttcgttggctgggctccccaaggaggcccatacggcgtgtttactttcggatgaattgtgtcgttcttgcgttgcagattggagtaacttgttttgtgtagctatagctattgatgatacctgcctaatagtgcgtgggactggcatgtgggcccaggtagccctctccgaagcggagagagagcgtgatttggttggtgttttgcttgccttcctgggaggtttgggatcccatgtggttagaggccccggtgaaaacatcctcagggtctatatagttaagtgcatatatacttgtatgtgtgtcaagtagatgaactgtattatgttccctagctacttccctgtgcgccctgaagtttgatctttgtgtttgattatttttctcgttaccaactaatgtattaatgttggtcttaaactgatgtttgcagttatttgttctgaaactacgcatacaatcaataattggtttgccttcactttttttttttgcattatcaatcatccataacctggctctcgtgctgattttgttaagttgtgttggttgttgctatgctggtaatcttttcgcttatgcttatgcttatcagccaaaatttaaatttccaaccttaaatttagagctgattttgagattttttcatcgaagtttatttttcagcctttacttttagatcgctaagaacacgtatataaaagttttattcacaaattactttttatttgcaaatataccgtttcgcttatcgcgcgaaaaaagcgaaaggatggctccgtccaattgagtccgaggctccgagccaaggcggatgttggagcaagatagattagggaaaacttttgaatatgttctaaagatactcttaacacaaattgtaagatggtttgaacttaaactaagatatataacttttcttcaaaaattttgccagacccgcaactagcacaaaactcacattatgt

SEQ ID NO: 91222 - DNA, 3380 bp, Oryza sativa
ttgctcagacgcactgctatttatttctggatccgccactggtcctagaggtcgacctcggcggtgagcagtcgtacgttgggtaggtctggcttattcggcttcagctcctccgtgccacgcgatcggcatgcactcgtcggctgccacagctcgtgcccgcggcgagggttgatcgacgacatgagacaggctagggagggagacaaacatgaggcctacgattgcaagtgcaaaggaggcaattcaaacacacgctacccctccctctcccctatagatggctatatggcctgagtcccgatgacccggcccaaggcacggcaatttggcccgccccaatcacggtcgtgccttaggctactccctcggcacggtgagcctgcacaaccaaagaaaaaaaagttgagggatccatcaaagacttgattcggccatttgaggtacaacccaaagactggaggtatacaaaatagacttattccagtcatataagacacatcccaaagatagagggaataaaaatagacttatttaatagagaagcacaatgggctatcgtgccttcgtgcaggcccggcacaacccgagtcttgttgggccgtgtctgggctgggggcacagcctagcccggcgtgttggtcgggccgtgttagtctgactagcttcggcccacgcccgaacatgccaggccgggcggtccatttggccatctatactcccccccaccccccggcctgcacacacccgcatgcgcgactggacacgtggcatgcgtggaaaggggggctggacggtgcacttttcccttatttctttttttctttccccgtttcttttcgggtttttttctttcccatttattttgtggttttttaatacgtatgaataactttgtatagtaagtttatattcttgatcccgttctctctccttcacataatttaatttatagttagcttatactttatggattagccaactataaattcacgtgaaaagtgccaaatctttttcaaagtgtaacaacaataaccataaagttagctagtctgatgtgaaaagattgcattagtgacgatccaaatgaacaaacggctggtttgagaaggccttaggcccaacagctcgagcaagatatcataagctggatttatttaccttttggtcccttacaaaacttattttataaaataaactcctagaaaaaacttatttagaaatgaatctttttatgacgtcaatgtcatcgatgccgtggtccagcataatggtgtcattccctacccgcggaagccaagtaactaatatgaaggaatatatttatatttttttgaaaaatgacatatttgtaataaaaatatttataggcaggtacttagggtgtgtttggttgagctgtggcttttgaaaaagtagctgttggctgtagctttttgaaaagtagttatggaatatggactgtggcttttgaaaaagctagtttgctttaacacctgtggcttttaaaataactagtcccgctgacaagtgggccccgcatgtcatacatagaaaataaggggatggagatggcaacggcggcgtcgtcggcctcggcggcggcagcggctcggtgaggaggagcggcggcggtttggcgaggaggagcggcgacaacggcggttcggcgaggaggaggacacgcggcggtgacgccgccgctgtcaaccacctcaccaccttcgtctcccgcctccacggccggcgaacgaaggggtggcggcgggcggtgtctggcggcgccggtcggggatgggcaagagcggcgccgttgggttgggtggcggagtcggcctcgagcggcggcggggagcggcagtgcgcgcagcggcggaggagtcctcggcggcagcggctgcggttcggcgaggaggaggacgcgcggcggtgacgccgccgccgtcggccacctcaccaccttcgtctcccacctccacggccggcgaacgaaggggcggcaacaggcagcgtctggcggcgctggctcaggttgggcagcggagtcggcctcggcagcggtggattcggcctcgagcggcggcgaggagcggtagtgaggaaaccaactcaacttactgaatgaatatgtcttaaaatgatagtgagacttgactatagaatctaatggtgcatagcactccccttcttgaatattgtcatcgatcttcaaaacaaggttaggtaaatttatcccaatagcatcaacgttgtacgatccatttggttctcatatttttccatatttaaaggaggattcatatctaaacatatataaacacgatgcaccatataacatcctctattattatatttaccaatgacatgataattgttccaagaataacatggaaaatcataaattttcttctctaaggcatttagatcacaaagaacatcaaattcgatataacccaaagtacataaagaagacaataatttcagctcttcttggtcatcagcaataacaaagacacgtttattttgagtggtaaccaaatattcaaaaatataagtaacgtgttttttcactagttgtggcatgtgtataagtgaagcagtgcgcaactcttcttcattacaagcattatcaatatcaacacaatctgaatttttagcttgtgataaaagcaaattagaaatctgttccactagaggttgctctaatatagcataattagtggacaattgtagcatagcacaatctttcttaccttggtccagttgaccatcacttaaattacctgaaacgctctcttgacataatttaggtgcttcattgttcttctcttcaaaattgtttttaccttcctgcatgatattagataaaatagaaggagcaagaaaattctcatgtatcataggcatttttgtttctttctcaatctgactttcaatatcgcaagcatgcaaaagtaattgaaaaagatggctatgtgttttattctcaagcctatgctgaatttttaaattaagcccatgtaaaaatcttttaattgtatctcctctagactactctataacaccgtacaacatacaaattttaaactcccggtggtactctctcacggttctattcccttgtttcaaattttgcattttcttttgtaaatcacgaatataataatcaagtacaaatctagctctcatcattgtttttaagtcattccaagaataaggtttattaccgacaagacaaatatcactccaccaaagagatgcaaaagaagtaaaagaacttattgctgccttaactttttgttcctcagacaattcataatattcaagttcatcttccacttctaactcccaatcaatatagtccctaggattaaacttac

SEQ ID NO: 91223 - DNA, 2142 bp, Oryza sativa
gcgagagagccggcgagacgaccatcacgcctgggctaccgacggtgtccgccgccgcagcgtcgtgggtgtggccgtcaccgacgaagcccgggcagagcatctccagctcttccaagcacaccggccgcgacagcagcttcaccacctgccgcatcgtcggccggctgcacggcttcgcctgcgtgcaggccagcgccaccttgatgaacttgagcgcctcctcctccgggtaacctcccttcatgctcggatccaccatgtccagcaggctgccctgttcgtgcagcatccacgcctgcaacaacaaaacatgatcgatgctgttcttcatcagcagcgtagacatggtggcagaaattatcagggttcaggacctgacctgccgcacgagaaacatgcctgatcgaatggtctgcgacatcctccttccactgatgatctcaagaatgagcactccgaagctgtagacatctgccttcttcgtcagctgtccgtgcacgacgtattcaggtgccatgtagccactgcatgcagagaataaggtttatttcgattatgttgcatgcagctcgatcattgctgaagcctgaaagaacagcttacgttgtcccaatcacacgtgtgctaacatgactaacattgtccgggaacagcttggcaattccaaagtctccgatttttgggatgtagtttctgtcaaggagaacgttgctagccttgatgtctctgtgcacaatgcttggctcgtgctcttcgtgaagatagctcagtcccttggccactcccatacagatgtccgatcttgtgctccagctgaggtcagttactccagcagctgaacctaaatgttgcaggagatttgtaagtacgtcgttgctctagatagagcataattgtggaaatttaatggagatctcttaccctgcaatgcattgtcaaggctgttgttctcgacgtactcgtaaatcaggatcctgttttgcctctgaacacagcagcccagcaacctgacaaggtttgcgtgcttagcttcagtaatgctctcgatttcggtcaggaattcgttgatcccttgttcagattcagcagacagaacctttgcagcaaatgcagtaccatcttcaaaagttccctgtgtcatgggacagagattagtttctgtttccatcctggcttttcggctgctgatttactccatttcttcctactcttcgtgcagcagttcagatttttcagttaaaacgaacaaaatatcaagtgtaaaatacgtagtagtatcttggctaccttgtacacagttccaaatccacctcggcctatcttgttgccatcgtcgaagttgtttgttgctgctctgatctctctataggagaatagctggacatttttcaagttcagaagctctgttcagaaaacaatacaaagaaacaacgtcaccatttggagttttggacaaaccgcatgagttcaaacaagctctccagaactcatgcatcacgaaaacgtccgcaaacaattagataatcatctaaaaatcgccagcgatgcatgactagaaaagaatttatactacaaactcccaagtcctaactgctaggaacttgacatggctagcatgaaagaaacaaattgtcaaattgttactacctttgatatcttcttgggatccacagaagcatctcttcatcagagccatctttcaagctggagctgtgacctggattcctggagcaatcctctctttctcagccaaacgggagctccaaaagaaaggccaagaatttgttgaagtgagaggaacagggtttccaagcgagcattaaatcttcagaggtgttggcccaagaagagagctctattacagcaagcaacaaggtgaagcaatgaagcagggaggtgcttggaaagtgccaaacaaactcttcactaaggtttaattagggttcattgatggtgtactgtacaaaaatacagttcatcagtccatgcgtcccgatggatctttgacccctccctgtcaacgagccacaacggccacttgttttagcttaaggggtcaggtcaaattccaagctgttgcctctagatgacgtgacagtaacactcctaaaaggcctaaagataacgttaccaatctat

SEQ ID NO: 91224 - DNA, 817 bp, Oryza sativa
accatggaccatggtcctctctgtacttcagatctgacagtgtcttcctcctcattaatttatgcctcgacatttttaaccttcgtgcctactctaattaattaagcatgctgtacaattgccgggcagggaaaaaatacagcggtagtaccagctgcagcctgcaggatacgtactttttggcagagttccaactggctttcttttcagttccaagtggctgcgttctctcagtaaacgtcaggcatgccaacaacaacatacggaccaccacgacgtacgccgtgcacgatctgcctctgccccccaggctatgcaatactgtagtataataagctgagtaaatgtactgttaggtgctcacctgcggtacaccaccgagatctcgcctcggttctgcagctggccgccgtggccggcgacggcgagcctggcgaaggcggcgccgctgaggtcgaagtgcgtgcggccgaaggcgcagacgccgccggggcactcgtcggtgacgatgaccgtgacggcgcggcgcgagcagatgctggcgtcgaggcaacgcaccttgtagcaggcgcagcacccctcgccgcccttgaacagcacggggctcaccgcgcccacccgcgtcttcatcggcaccacgtccaccagcgtcccgtatccacacgcgccgcctgcaaaaaaaaaaaacgtacatacatacagccaaacaggttacaactctgaaattagaaatgctcacgtgataacccgtcatctaaaaatgagattcgtaatttaaaattggtctaatctaagttactacatttttggacgatgg

SEQ ID NO: 91225 - DNA, 1149 bp, Oryza sativa
agaagatagatcttggcctatacatggaacatcaatacaaaattgcagtcattacaaactaattttacagcaagataaatagcatgaataattcttgagataggtacacaaagttagacagcatcaaaacttccaaggtggaaacatagaatgatgtgataatctgatttgctgatgaaaacttcacgactgagataaagcgaaaaaattgtagagatacgataacacttagttgtccaaccctgtcactgaggcatgtgaatcacacatcgcaaacacttgttttctagcatcagttcaagtgccttgttgatgtaatcgaatgacaaatcatgtgtaacaaggtcatcgacttggatttcctgagaagaagtaacatgatatcagtcaacattctacccaaacaatatttgatatcagaaaaggtgaaagacctatatattggaaaaacaaacaaggtattttttgtatgtatcacattaactaaatatattgctatgtgatcattgaccaaacatcaaatatgacatcttgtacataaatgctattatgttcgattgtgataaccacttcgcaccacagtaaaggataatccattcacacaattacatatgatgaagttcagcttcttaatttaatatttttaactgaaaatagaattcagttttattaggatgtttgcttctacaacacattgtctccgtaccttgtttgcatacttgtccactaacaaaggtagatcagatttaggtctccatcctccaaacaaagaccccttcaatgttcttccagacagaagtagtgcataatgagcagaaacctctggctttgcttttggcacaccaagagttacagtcagcccccaaccctaagaagaccaaaacatgagaagataatatatctgggcagaataggtggaattgtagtgcaatggaaaggaataaaaattacatcagaacatgattgcagtgcagtcgacactactcctgtatcacccacgcactcaaaagagtaatctgcacctccattggtcagccgcttcaccacctgaaagtatgaaaacaatgtctttatgctgtgtatatcagggatatgatcaagattttagaaactaccaattggacaccagtgcaacaggagctgttgact

SEQ ID NO: 91226 - DNA, 736 bp, Oryza sativa
tcctgcagccctgcttttcaggattagtatcaacaccgataattatagaagccccgcgcagcttagcaccttgagcacctaagtcaggaagatatgagtataaatattacatttcctaatatgctttcattaactaatagcatagcctctgtagaaacttacagaaagccctacagttccaaggccaaatataaccacactcgaccccttcgagatatcagcaaccttccaggctgcaccaagccctagtgaaatacagaaatgaacgaagacatgaatgatcagagacacggttaaaatgcgcagaagtgcagaacaacatagcacacctaattcttagcatcagtaaaccaagtataagctacagaaaggcgtggaagataaagtaaaaacactgatgccatctgagcccttaaaattcacctgcagatacaccacagctcagcaggcatatcctgtccatcggcacggttgggccgaccttcaccgcgcaaccggagtgcacaaccgtgtactcgctgaagcttgacactgcacagtaatggtacacaggtttccccctgagcgagaagcgggtcttctgatcgctgtgcatgacacccctcctctccaggccgagcttctggcacatgttgctcttccctgaaacgcagtgcttgcagctcatgcactctccgatgaagacggtgagcacatggtctcccacttcgaactcggtcacaccttcaccaacact

SEQ ID NO: 91227 - DNA, 3024 bp, Oryza sativa
tttaataaaactaatttggtaatgtaagagtaaaatccatcaccggtccctaaacttgtaccgttatgtcatcccggtccctaaactcgcaaatcgactgttcagtcctcaaacttgttcgaccgtgtcatcctggtccctaaacttgcagatcactcgtttagttcctccaacttattcagttaagtcgctctggtctctaaacttggatttgaatattatctgggtcaaataggacggtctaaagactttatattcaaaaataattcataactttttcatgtgaactctaatgaagacaaactttatatcaaacttatagccctcgatgcgatttacaactttgtagttgaattgtttttattctaagtcatttttttgtcccaaaatgtaatttaaaattaaaatttcaaaatctataaacatgcaacaatattttaggaccctaaacagttttaattcgaaaactttacaactataaagttgtaggtcgtgtcgagggctacaattttgatgtaaagagtgccttcattagagttcacatgaaaaagttatgaattattttttgatataaagtctttagaccgtcctgtttagggaccggggtgacgcaactgaacaagttggaggacctaaacgagtgatctgcaagtttagggatcgggatgacacaatcaaataagtttgaggacctgaatggtcgatttgcgagtttagggaccgggatgacacaacggtacaagtttagagaccggttatggattttactcgtaatgtaaatattattatattttttataaatttagttaaatttaaagcaatttgactttgatcaatgtcaaaacatcttgtagcctaaaacgagggagtactagtttacctcaaacaagagcagagagagtatgtacacaataagctttttttcccccattttctgcatctgctgcagcagagttctttaaccggcgtctcaaccatatgaagacaatccttttgtattcgcggtgtggttgggaaagaaaaccactgcgtgtgaattttatgattatatttttcggcttcaaaaaaatgttgcaaatggagatttcgcgaacgagcctgcaacggcaaaaggttgcacgattcgtcgggaagcttggttctgtcctcgagtatatggctgcatgcacatggctgttactatctcataatactgattattcggaaactgccaaatgggaaggttctgctcatcgtacgttgcttatgtaactcaacagttatgagtgatttatcgagcactcattgttgtcagtttgatgggtaggaaagaaaaatcagtgcattatgcattcagaataaaatgataactgaataaaataagagggatataccatgccgagcagcacacttgagatcatgacaaaaatagggaaaatagggtttaattgattgcttgagggtacgaaacaaacataaggcctgatccagcaggggaaagaaaaggcagaagcacttcagaactggatgactatataatactcctccattggtaagattgatatgcttccggtacagatagagatcaccattcacccataaacatgtcactaaaagaaatggtcagcgcaatagttttatatgcttactccgtacgagttgttgcattgattgttccggcaggaatgcgcgccgtgacctcatctcttgctaatccttcatggtgcacggagaagagggaatttttttatttgccaaactaaacaatatttgtgcagatcatagttatccttgatgcattgtgttaatctactagcttctgtggctactattgttatcagcaaaagaccaaattatgtaatcagttctgtcttctgtggctagagctccatcttccactaaacaattaagacgataagctcagttaattagtttgttcaccccctttcggcatgcagctctttcacaaccctaatcatgcacactgtggccaataacacgttgatatgtgtttcgcaaagtaggagtatatgctcatcttgcttgcattggttgcacaaatcgtccaaaaccgtcaaattatttcgagttaagatcggatcgttggaagttgaaacgctcgctgatattgtctctttgctggagttagagaagaggagcaacgcgatttttttgaagcggagagaaacttgagactagaagaagaatactggattgcaaggaaagcaacagatggatcagtctaaggcttctttctcgatcagtaccgtccatgtctagccgtgacagcggccgaaagctacgtggtgcccccagcttacgcctcgagatccgtgcggcgccccatccgccgcggcacgaatcgtgacgtccgccgtgtcgcgaggcgagaggggcagacgggtcaatgcgcgtgggtcccgggcaccgaccacgatccgttcccgccacacaaacgacgcatgctttttttctcctcctcccctgtggaaccctccacgggatcgaaaaaaaaatcccacctcgcctttcgattgcgcgatcacccacctttataagcccgtttcgccccgaggcgctcgtccccgaatcagaaccacgcgccccattggctcggcgcctccaccgcgcacacgcgcacaccggtcgcccgcccaaagcctttcccgccccgccgtctcgctcgttttaccgcagcattttgttgttgctctagcgggcggccgggtttactgcactcggtggaatcgcgaccggtggtgtgtgaggaagagagcgcgcggcgttgttgggtgtgttcgtgaatcgggcgggatggacgcggtggacagaggcggaggcggaggcggtggaggagcgcgcgggcacgggcggagatggaaggggaagggagtgagcgcggcgatctcctcctccgcggccgagacgcagcagccggtgccagttttagaagacgcgccggcggccgcagcattgctccgtccccagaagaagatccgcagccccgatcgtcgcctccagcgctccatctcctcgctgtcgtcg

SEQ ID NO: 91228 - DNA, 4136 bp, Oryza sativa
tgcaccccctactaaacggtgcgttttttgcaaaaaatttctatatgaaagttgctttaaaaaatcatattaatacatttttgaagtttaaaatagttaatactcaattaatcatgcgctaatggctcacctcgttttacgtatcttcctaatcttctcaatcccctctccctcaaacacagccttaggaaagccaaagtttacagatgtgctatttactgtttccatcaggttattggagcagcgaagttagcaccctaacttgcgttatctatagactgcacagtattcattttttgtatgtttcatgtccaaaagcatctacatcagaaaatacctaacgttgtgcgtttttctctaagcaggctgccttgtattatgaagaagcttatgcttcactggttatccctccactacaaaaccactttgagagatcttgggtagcacacatcctgttaaaggctgctctattcaatgcagaagctagctatcactatgctattgaactgcatgagaaaacagaaatcggtgaagagatagctcgattacagtttggaattaatgcaattgtcgatgcaaagaaagctgtccgtggagccccaggatccctttatgatgctgcctccagactcgaacaagatatgaaccagaacttggagagagcactgaatgagaacaaccgcatctatcttctgcgagtcccagcagccaaactactagctcctctgccagcagcttcacttgtccggtctgcttccctgagtgagatcttagatgtgaagacagaaaccggtaatcaatcatcgtaaggaaacccttcacgttgcaaaaggaaggaatcacatgtgtcagtgccactgcatttgcatgttaaagatcgtctgctgcagtgaattgcagggtcgattacgatttgtttgtttacttgctgggggtgtaaatagccacaggaacctgcactggcgattacatgggttgttactatgatttaccataccatctttgtgggctcgttattgtagacaacatggatggttcatctacatgccacttaacattttgcaagaatattatgaggtagtgccttattttgttagccattttggcaactatgggtctccctcttcaagtgtttgtctgaagaaggcaatgtactgaacgatcgtgctggtgaatgcaccgacgccatctctacaactgtcaactgggatctgtgctaatactcgggcatatcggccgggaacagaaggctttcagaacgttctttatccacagaacgtaccggcttggcggctcctccacggcgggggaacgcaacgcaagcaagcgtcgtctccagcgacagtcgcaagcgcggcgactcgaaccgaggaaaccaacgagaagccgagctgtccggtccctctcgtgctcgctagtcgctactactcgctaggtgctccttttggtttggcacgggcgcacggccaaccacagccaagtgtgtgctcccggccttatccattaactcaggtgagcatttgcattattattgccaaattctgctacgttcgttccatctcacctcctgtcgtggcaatggaatctgtcttttcagcacaaagtttaaattttgattgaaattagagatgatgtgactgaaaagttatgtgtgtatgacaggttaatgtgatgaaaaataactgaaggttggatctaaactttggatctaaacacagccgaagcatcttcaaagtgcaccttggcgtatatgacatgacttggtcctataagactcgcattcttaaaaaaatcacaagaatttgggccatgtttagttttaaggtaaaaagttttaacgtgtcacatcggatatacggatatacatttaaagtattaagcatacactaataacaaaacaaattacagattccgcctataaactgcaatacgaatttatcaagcataattaatccgttattatcaaatgtttagtgtagcaccacattatcagatcatggagcaattagtcttaaaagattcgtctcgtaattttacacgtaatctgtgtaattagtttttttatatttaatactccatgcatgtattcaaatattcgatgtgacataatgaaaagtttttcatgggaacaaaacatggccttagtgataaaacgaggaaaccagagttgcaggaagatttctggagacaaggtgagagagacagggttcttggtcctcttggattttatccctgaaaatccttgaaattctcgacatttccagggcccaaaaccagcaaatccaaggcatcggagaattttttacgcaactcggagaatcgcacacctctcctgtccccccgcacctccacctttcgttccccacgcctatcctctttactcggttctcccgcgcccaccacctgttcgacaccgaactcaaccgtctctccacaccgcgcgcgcgccgcagcttagcctctcgcaatggcgacgaccaccgcagccttggcgccgccgtccacctcgacgtcctccgtcctcctcccctcagccgccgccgccgccgccgcccgatgcctcgggccgctgccccgccgcgcgcgcctccggaccgcgcgccacgtcgccctcaccccccgcgacttgtccgcggaggacgtggccgcggaggaggccgccgtcgcgcccaagatcgggaagcgcgtgcgagtcacggcgcccgtgcgcgtgtaccacgtcatgaaggcgcccgacctggacatcaagggaatggagggcgtcgtcaagcagtacgtggccgtctggaaggggaagcgcatcacggccaatttccccttcaaggtggagttccatctcagcgtggagggccaggacaagccggtcaggttcttcgtccacctccgcgaggacgagttcgagttcatcgacgaatgagatcgatcagtaaccgtgaccaagtaagcctagcgccttttgttatacaataatgaccgcagctgtggcatgtgtatattgtttcggttgtgtggtgagagagatgagagagactgaagagagtagggaacatggcaaggaagttgtttgcttactgtcatgctcttcctcctccagttcgacatctaatttttcagatgtgggaaatgtttggatgatgatgatgatcgatagctataaatagtgatcattctgttgtcttgctggctatgtttttttttcttttgctgattctcttatcattatagttctagtgcggcaactaggaaaatgcactattgtgctattgaatgcaagcaagagtgcaagactgatgtttgttgtgtgggaatcagctaggcaagtagagctatacattactagcaacatttgaatcatcatgcccaatccatgaaaccgtcaaattatctgatcacggagcatacatcctaacgaagtaagttctcttaaaacactccttataggcttacagaagaacaaactatgaagaaggtgtttggatgatgtggacaaggatttcaatccaaattcctcctatccaaagtggcattaagactgagaattcactatctatcttttgctttcaatgaaaagctgggtccggggacctttattctaaaaagaatcattctccaggttatcctgaagaaaatttgttaattttacaagatttgaaagataacctaaacatatgaacagaactagagattgcattaaatgttttagtttgtgacattctctatgtcctcagttgggtagtacgacatggtatcagatagcacaaagtggcataacatgcagctacatgtaaactagtccgagtactcttcagtatatagtgtgcaagatgtactattttgttttatgtagttgtttttctgatccagaatgcgatatatctgggacttcttggggccgttagttgcatacagatgtctcagaacaacctgcccgttagactctaatgcattgtattatgaaagtagaaacttccactttggtccaagcctttgcatattgtttccggagaattttaatccaaccatttggaaccatctatcacctacccacaaattataagccatcaaacagccaactgggtcaattcataaccgtaaaagagacatattctgaccaaatttagtcataaccataaatt

SEQ ID NO: 91229 - DNA, 827 bp, Oryza sativa
tctcgcgctcgtgccaccggacttgccgatggaagtcacatgccgcgccgctgtccgctcaggaggcgcccaaagggccaaagaggatgaccaagcaggagaggagggttaaaatagagaaatttgttgaggagtaggtggctttgtcctgttggcatttgtgaatcttgcgttgatttgagttaggagatttatggatggtttattggttttgcatttaaggctgtgtttagttcacgccaaaattggaagtttggttgaaattggaacgatgtgacggaaaagttagaagtttatgtgtgtagggaagttttgatgtgatggaaaagttggaagtttgaagaaatattttggaactaaacacggcgcaagtagtgtgctgtttagaccatctcactacttgaacttcaaacctagaaaccgatgttgtgaaatgtagcgcgactttatctattatgtgttgtgattgcacataactgatacggaataggtggctcaaatgcagcgacaacatgactaatagttcatgcttcttcgtggttttgcttagtgcaggtataaggcatcgaatgatggtaaattccccacgatgacgactgttcgtcaacatgttggagggggtcactacacggtgagggagatagttcaggaacttgagtacaaccagagaatgttacaactggaccagtctaaggcagctgagctgcccgaaacagctgaacattctgagcatttaaagcccaaggatgtccatggaaagctcaatttaattctgaaagcttcagtggaaaccaaaatacagatgaccttcacctctcccagaaggg

SEQ ID NO: 91230 - DNA, 2084 bp, Oryza sativa
cgtcgcggatgcacgcgcggtggtggtaggcagccaaagaagtttcttgggtcggggaggaggaggagggagggagggagggagggagggaggagaggtggcatgaaggacttggtgtcgtgcttcagcgagcacgccgtccggatctctgacgtcgcgtgctccggcagcgcgaatgcggcgacggtgtcggcagcgggtgttgctgcggcgggggtcggtgatggtggcggcgcggggagggcggcggtgagcgcggtgacgagcgtgtaccggtcgcggctctcggcgtccgggaaggatttggtcatcgacgtgacatggtcgcgggcgcccgacgggccggcgctgtcggtcgccgtgcacgacgccgcggccgcgtcgaggctccgcggcggcggcggcggggccgcgggcgcggcgccgaggcacctgcacaggaggaaagggagcgggacgttcaccgccggcagctgcgtggtgggcgtgttctgggacttcgcggcggcgcggtacgcggcggggcccgagccggtgtccgggtactacgtcgccgtcgtggccgacgccgagttcgtgctcctgctcggggacatgagccgcgggtacgtggagcggctgcacggcgggataccgatcgccgggtcacggatggcgcggcggcgggagcggttcgtcgggtgcgggtgctggtccacgagggcgcggttcctggagtccggcgccgagcacgacatcgtcgtcgcgctggacggcgacgcggaggcgtgggtgaccgtcgacggccggaaggtggtgcagctccggcggctgcggtggaacttccgcggcagccacacccttttcctcgacggcggcgcgccggtggacatgacgtgggacctccacggctggctcttccacgcggccgacccctcgccggcctcctcctgcgccgccgtcttcacgttccagacgcgcggcgcgtcggagacgaagttctggatagaggacgacggcgacggcgacgacgatctggaacaatctcagccaccggctgcgccgcgcggcccgaaacagaagctgggcggcggcggcggcggcggcgctccgtcggggcagggattctgcttactgatccaaggtttcaggggcgcatccaagatcgcttgatctgtataaatgccatgagagattcgccattctttttcacttcttcttcttgcttgcgttgcttgggattgtagtatcaaaattcgacaatgggtttggtgctaattctcgttgattaatccgatgcatgacacgagtgtgaaatgtaggagtagaaggggaggcttgacatgtacaattggggtggtgtgtttcgttttggtttgcttcgtcgccgtgcagatttgatatacatgactgtaactgtgtcctaatttgcagaaaatacaccaaagattgcaacttcttacatgaaagaaatgatttgattatattcactctgtatgtgttggtgttgcatctgtctgtgattcagatcaggtgcagtcatatctctctggacacgaggaaactgaatcacatagatgaactagcaaaaattgtgaaaaactaatcatggatttgacaagttgagtagagataaggatcaaagcactttctccataatgctgcacgattgttgtcattttcgttcttgaggaaactacacacatgcatagtcatattttttcttaaatccatagctatcattttcacagatgttgatagctcatttggtaagagtacagcttatgctatctcgaaattaaaaaaaaaacaacacctacgttggactcttcaaatagtatattgtagtaaaatcaccacctgttcataacacgcaacaaattcgcattacaaaagcaggctgctgttcttaaaatttgccacgcacttctatcattgccgcttgcaaaagcttaaaaattagacaagtccttgtactaaaataggccggcacaactgaagattgttcaaacatcatcctacctgacgttttctagatcagtggagaaggcttcaaatatattggaatttacaaatgttctttgcatacgtaagcacattttttt

SEQ ID NO: 91231 - DNA, 688 bp, Oryza sativa
attcctgcagcccgtccagaacaatagattgtatccatgttgaaatgaaaactgtgtaaatgccccaccagccagtggtggatctagaaaaaatttagagcccaggcaaacttaactatagctagtatttgctatacaaattaatatttccttcattttttagttgcatagaattgtaatggattatccgccgacgagccctagtgacttcctggggtcaccaggcggtagatctgccactgccaccagtgatgatagggtacataataattgaaccatgcaaaaggaagtgcataccttgtactttccaggctttaaacaaccgacgcgatagtcaaaatagctattactccagtggaagttgaacacgaataccaaatctcctctctcgaagatgatcaccttatcctcctcgtgtttgcgcgatatatactggtgctcagatgtcatgaactgcagcaacgttctccgtttaatcagttaaatatctccagtacaaaaaggatggctagagctgggacaggtaacaacatgcaataacccaaaacaacaattttggatggtgaaacacaatttcagatcatacttcccagattcctccaattatatgaaatttgaaatctctactccctaagttagtgaagtgatggtgtgatctatgcagacaagtgggtgtcatttgctggga

SEQ ID NO: 91232 - DNA, 658 bp, Oryza sativa
attcctgcagcccacgacggggagcagaacccgcgccgtcgagctcgtactccactgtccccctctcgccgaagtcttgggcgggaggaggcgctcgaggaggtcgaaagatccgcgacttcgccgcacgcgggcgatggagaaggacggcgagacggggagcgtcgtctcctcgtctacggtgatggcagcacgccccagggcgcgctccaggctgcgggcgcgctcctgcgtcacccgcccgtcatccctgatccagagactccaacccgacgttggctagatgacgtggccaatttggtcatgacggcgcagcagcgcctacgcgccggctggcggtcctccgccactaaggccactggcgttgctactgctggctccgtgtcgtcgaggcggagggcgccgcgagcggcggccgttacccgccgttcgtccgccattccctcgtcaacgcctctaacccaagaagatgtgcgtagggggccagatgcccgcttcaatctcaagcgccggcgcaatgatcgccgtgctgcccacgcatcggagggcgcttcctcgtccggagcgccacttcggtccgggcacgggggccagccccccgtgtccccggttggcggtgccggctgtcgagcctttgtggcgagccttcggaacgtcc

SEQ ID NO: 91233 - DNA, 2368 bp, Oryza sativa
taaatatttgcttgagaaaacacatacggtcgattgtgaacctacaaatgattacctaaggaatgaacaaatgggtaaatacagagaactcattaaattggtcaaacctaaggtttcaagctctaatgtaagttagcaaattaccacacattaaatttttttcagcaatatttcgtgtcaaatagacgttgggtgctagtgaagcaataaatcattgtaccaacagaagacaaccaatatgatgaaacaaagtcaattattcaattctttttaggtacgaaattaacagatagtaccttatccatcaaccagaatgcaatagtcttgtcaccaactagtgcttggtcatgactttctgcataagtaacacacttctctgaccaccttctattcgttagggtgtgcacgatatcacccattttccaatattcgtcactttgcctgcattaaagaaagttggaatttcatgacaacatatttggaagttggaacctacccagaacatacattaatactagctctcagtaactcataaaaaatatgattaaaaagtgtaaaagcagctcttcaaagggcatagcagcagtaccaagatggagcactagaccagtaacatggcactataaaaaggagagcataactcaatgatatccagtaagttagttgaatgtctcaattttcagatgtacaatcaccgaagttccagcacttacttgaggagttcgatccatttgtccggtacagccatatgcaaacgatagtcaaaaccaacaccaccatcttgaacaggaatacaaaatgtgggcatcccgctgacctgaacagaaagcagggatgtaagttcaaccatgttgctctcacaaatagtttatagcataattaaatatatatttggtatcatatgctagccccattttgcattgtgcaacttaaataaatcaaattacattttctcatttaatgaagaatagaaaagaatgctgttgagaaactataaccatcaaggaacatgcctgttagttcttccaatgcccttaaactttatcaattggggacaaatatattatattttatatctggttgggaatagatactaaccgctttcacccaactaaaactaattaattggtttgtgtgaagtatcaatatgacagaaaagcagataccataagcacttacatcttcaccaatggctacagcctcaggataaagcccatgaattagatcgttcaccagcatcaagtaaactactgcatcaacatcagtagcaaatccaaaatattcgccatagttgccagtaaatgccacctataacaaaacttgacaattttagaaaaaacagtagcaattcccatcaggggcaaacaatactagaatgaaatccaagtatcagcagcaggagtcataataaatccattcaaacatagcaatggtttctgcaaaaggacattaaggcatgcccaaaacagaaatggcagcactctgaaatgcaatttaccagaaacacttgataacttacctgtaaaccatgatgagtatacatcatggaggtcaccccatcaaatcgaaacccatcaaacttgtattcttcaagccaccaccttgcattcgacagtaaatatcttaaaacctgcaagaggacataatgtatgcattggtaaggacagagtaacggcaatagtgaaccaatctatggtgacaatagtcaactgttacatacttcccaactcccatagttgaacaggcgagaatcccacatccagtgatgaccccgtggtccaccatggaagtaatgtgtatcagtaccatcaaaaccattcaaaccatccagggtattgtttgatgcatgactgcaggatacaaccaaaaagaaagaaagaaatggtaaaactatccaactaaaaaggatcaactaaatcaagtggatggaaaagaagtaaaaaaaattatctggtctataaacacatgaataaaggggttaagtccaagtacaataggttccgaactcttcagtcaagatattgacatgtatatacatggaactctttatggaataaacagtgtcatgggtggacgccagtaatctaaaatactagatttacacagacaaacaaatcaacatttcactaattacctgtgaacaatatccataagtacaagcaaaccaagctcgtgagctttatcaatcagagatttcaagtcttctggggttccgaaacggctacttggcgcaaagaagttagtaacatgatacctgtaaaaagaatataacaaagatcaaaccaggtcagaaacagaaagaatagttgcactattggtgtccacacaaagaaatttgttcagaaatttctgcatgttcagaacacta

SEQ ID NO: 91234 - DNA, 2912 bp, Oryza sativa
taaacctgctacataaatagaaagaactagattgcattctacaaagcgaaaaaggtttcaagacaaaaaagaaaagtcaaaatattaataacttattggcataccgggctactcattccaatatgtgattcatatatccgcagcgaatttggtcgtttaggttgaggatgttggaatacatatttttcctgcagttgcgtataaacaacattaggagatggaaaataaaggttaaaatggaatatcctgatcaacaaagaaaaaaagtagtattacacagttctataaggttttagtgacacgagcatagatttttttaaaaaaaatgcaatggaaaaatatttcgtttaaagactgtaaggtagaaacatacttcttcaggtggatcataatatataccgttgtacggtatttcacctggagcctgcacagcaaacttaatccaggcaggaattgaatcctttacgccagatggtgtatccatccgaatctggaaattaagaaggtgaaagaagatctctcagtaagctcattttgaaaatgattaaaccctcaactaagtaaatagccaatcagaaaacttacctttacacgtgagccatgaggaatagcaggggatccatcagcattgttaggcagggaaatctcccaaacaccatactcattctgaaagtgatcatgccatatatcaacactaataagagaaaaaacgttgctggcacatgtaaataggctcgtatgctgcgaaatacacccttctcatgtcatataataaaccagtgtggatggaagtgtacaaaattcaaggcgatgtttggaaaatgggtttgggatatgatttcccacccccaaagggtaagttttgatcttagccatccattcatttcacccatttcatcctatccctccattcatttccatttcccaatcccacctctcctaacccattttccaaacacaccccaaaaggctatattaaccattaggatgcaaaattgcatgcatgtgtttactgtttaccctaaacatgaattctgctattttggactcaaagaagatgatagttagtaaagtaaggaacagtgctctgttttcactgactttgagacaatatagagtagcagcattttagaatgacacacgtgaggttcaactttaaggaatataaacagaaataatgaacccagataattgaaaatatattaatgatacaatacaaagatggaaaataaaaaggttgaagacgtactctggtcatagtatctgcatttgggttccaattgttgaagtcacctactaatgctgcagactgcaataggatgaaaatgtcatttttaattcttaatgtgatgactgtttgaaaagaagttcatcaatatatcatttgtgctactggtataattccagtacactggatagggagtagtgaccactgccaaatcacgtacctgtgctccaggtgcccattctcggtaggtaatgccttcagcgctggaaaggacggaataatgatattgagtttgatcatttgatatccaagtagaatattgtaggcatttctgtagtaatgcgactttaattttacctgcgggtgaatccaagcttttcgtaaccacgagaaaatgcatccaagccaccttcatgttggtcaatagctgcacgcattctcttgtattcactgtatctgttcataccaccatgcataccaaaaaagatatactgaagttaacagagtaggtttcccaacaaaagcgccagatatcagaaattaatttgctgagttgacagagaagtgaggggattaaactatgcagactacttgccacatcctttttggtatctctagtgatcagtgccaatgatttgtattgcatttgtgagatatcacctctattttcaaatattataccaaccttaatcaaaatgaaaaaaagtaaataactaaccggtagtcaagatggttccgaaatccttccagcattgggtcaatttggtatatcttctgcccatctcctggtggtgggataactcgtggtttatcctccacagttggttcatcagcatctttgatcacaccctcagtcacattttcctcaatgtcttgaatcacttctgaagattcaagtttgtcttcagccacaacctttatgcttgcttctgccactgctggaatctcttcctcctcctcaaaaggttttactttattatcatcaggtatctacacagaacatagatggatagactctgcatgagacacccaaaaagaaaaaaaggtacattcttttgtggcaaagttgctagttggaagacccaacttggttttcagtagcccaacagccagcacaaggtcacaatgcacaaaacacatgaaacctggcattgccactacatcatttcatcacacatttggtcagtgaatgacaacagctcgaattttattcccggcattacctgagattcttcaggttgctcttgagtttccacgtctggttccgcagaggacagcaagtcgtcgctcccaccgccaggcaccagcaccttcccaggagcacccgcgcagctcacaacgccacctgcaaatgcaaagccgactctactagtcaggcaacgccataccacccccacttgcaagttgcaacaataaataagagatcatctgcatcagcctcaaaacgaaacataaaaaggaattagagaatgatcacagcgatttgtaacactaactcatcttatccggcaagaaaaaaataaactctggttctcagaattcagaaacagtgatcgcttcggtgcacccaagtacccaacaaagtgcacacacacatcacatacggatcgagagataacagtaaaatgggaggaataacgcatgcccgcgaggctgtgagctgcaatcgatcaggagaccttct

SEQ ID NO: 91235 - DNA, 1071 bp, Oryza sativa
ctggcgccgtcctcctgccaccgtggcgcacgcgaaccgacgtggcaggaggagggcgctagccatgctggcgccgccccagggaggagggcgccagcatggctggcgccgccgcctccattcctgtttctctgtatggagttacaacggtgtcatttttattttattttttcggatgttttttcacactcaggatcacgatacaaccaaccacaaaaaaaatttaaactcgaactaccacttagctaagtctgaaaatatctagcataccacttagtctactttgcaccttcactaaaattagaccataactcttttagtaaaaccctttgatcagcatgttaaacataatgcactctaccactatatgaaattacttaatctaattcaaaatataaccacatgaaatgacatatataagttaaacagtacatagagatgcaatttttttatttttattttatttttttgatatttttttcacacttaggagaacataggaaccaaccgtataaaaaataaactcaaacggacaaaatatatgacatgtagaattttccaaaactctaccgaaatggacaaaatatgtcatctattaaaataggcataactttctcatacggactcggaatcaggcaaataatatatgcacggacatctacagaaaaagttacatccgattctccctcgcttcgccgggttcggcgatattaaaacctccaaattctgcttgcaagattgtgttttcgaggagagaaatttttcggtagagctttggaaaattccacatgccacatatttcatccgtttgagtttactttttacatggttggttcctgtgagttcctaagtgtgaaaaaaatatcaaaaaataaaataaaaataaaaaagttgcacatctctctcccctgcactagttcggagagagaggagaggagagtaaaaattctacatgtcacatattacgtctatttgagttcaatttttctatggttggttcttgtgtgtccttaagcgtgaaaaaaatatcaaacaaataaaacaaaaataaaaaatttcgggggggggggg

SEQ ID NO: 91236 - DNA, 1875 bp, Oryza sativa
cttgtaacttcctaagaagacatctaactcttaaacagactggctataaagcaaaataatatgttctttgggaaatattccatactttttccaaaataaattttaacgggcttattttgcgtgatggcaacataataaggcatcttatgctgttatgctgttaagctttaaacatgaagggtaacaagagctatctgattttttttttttttggcaagactgatactgaagtagcagaaaataaaattaaagagcatatagtcatataataacatttttcatttaccatcggtggaaactcttttcatcttggtccatatgctgttctccactggtcaattcaacatggaaattgcatgtcaagcatgacaccatgcaatggtggtaatttgcatcgcatctccaagagaagacaaaaatatatacattcagattggagatcgagagttgccaagaagctggcctagaagattttaggttcctgtaaaggcaaagaaaatgcatcattttttgcatggcttgactctgataagaaagcatttgatatggtaccaatgcacatcacacaatgttttatgatggttgtcatctcaatttgagtctaagagatctgtgactctgcactctttttagcgtgctttttttgggtatgatcaggatcataactaaatctaattctactgattccagtaactaaatacaaataattgcttgcatatgtcctctcaattgtaaaaattcaccaattatttattcaaatctaaagcacaactaaaaaccattattaagagtgaagacgcatggtataaagggaaatacatctatataatcaggttcaatcttatattctacaatttaatcctgttaaaacatctacaattcaattctagatcctaagcctgatgatgtatcttctaccaataacatgagaagcaagtggcataaagcaatattgcgttcatttcaaaaggttggcatgacagtttgacttctgcttacattaatttgggttaggaagtgttacaatcagtgaatgattctgactatgcttcaggagtaattttgaagaaaacaataaacgtcagtaacccaatatcattacaaaccttgcacttctgatgccaaatacctttaatataatctacacaacgtttaatataatttagattaacataccttttgtccagaaatctggcaaagattgatcattcatggtatcatctattgtgatatcctcattgatgtttatagcatccctttgtaatcctctgccaggatttctttcataggcaatgatttcttcatatgccttctgtaagatgtcttttgctgctttatacacagcctttgatgcagatcctttgtcagcacatctgatggcatcagcacacaggacattgtaacggcttgtaatggattgacaagtagcatctttgtggttattgctgttgtcttccaacaattcatcatgtctggcattcctcgtccaacgtttcaaaaagtaatcaggtggaagtgtgcgtggatcaactattatgaatactccaagaatatgacggcataaaatacctgagaacttaaagtacttgcaactacactttgccatcttactggaagcattataagtcacacagaatgtgtctgatggatcatcttcatcttttgtgatgctgaatttgtttactctgccttcttcagttttctgaatgatataacccaaggattctgtgaattcttcttgaaacctactgaagactgcttttgtgtaagtgcttgctgcctgtttctctattggcgatgcagtccttgtagttgcctcatttaaccgagtgtctatatctgcttgtgcttcattttcatatcgacttgtcatgg

SEQ ID NO: 91237 - DNA, 1574 bp, Oryza sativa
tatggctgagaacagtaggtaaatatcccatacagtatcattataaaacaatgcataatttaaaggaaacatagggcatttgcaatatgggatcaatatgttcaagtgacaagcatgacttgccttgctctgcagctagagggacctcagcgactatttcaaagtacaccggagcgtcgggagagccgaattctatgcgacatacaaggcaaacaatgcaaacaggctataaggctactgaaacagagaacaaaaccatttttaatgaattctgcatttttgttgatttactgagacttgaatgggcttaaatggagcaaggataaattttctatggaattttagaagattcactgtgttttattactataacagaaaaaccctaaatgaattattgcgcattaaatagccctgaatgatgtcattggagagaaaggaggcggcacccacaggcgggccccacatgtcattggctcagggtgcgccggtccacggtagacaaagtccacgggaccagggaagggtggcgcaccacgtggtgcacacgtggcgctgacatggtggccacatgggctgccacgcgggcggcagatgggcggccgcagctcgcgcccaggcgctcacgggcacagctcaagccggcccggcggccatggcgatgcggcggcgcggcatgaagcagcggcagcgcggggtcggccaccggcggagagcggcggcgatgcggcgacgtggagtggtgctaagagagggagacatcggtcctcatcgaggggttcgccagtgcggaagaaggcgatgacaggcgacgggatgtcgactagggatggcaatttcccctgcggggccgggtcccatgcggggacccgaccctaagggggcggggacgggttcagtttttgacccgcgggagaggcgggactggggccccgcatttttgcggggaggggacggggaggcatttcacccgcggggccctgggggtgtatattaaacctcaaaatgtagcccatagaagatccaaaagagcccaacccaacaaaattcttagatataaaattaaaatcctagcattatctctccatctcccctctcgtcaccctctcggctcaccacataggtagaggcggcggcggcgccatcgcgccaggggcaagggcgcggttgagctggcaaggacgagggcgcggttgagtaggcaagggcagcggcgtcgacggccagggcgtgggcgtgggcggcggcatcgatgaccaggcacgggcggcggcggctgccagggcgcgggcggcggctgcggccagagcgcgggcagcagcatcgacgaccaggcacgggtggcagcggcggccagggcgcgggcggcggtgtcgacggccaagcacggcgacggcggcagtagccatctgcgggccgtggcggcttgcctcgtcgtcttccagctcgccttcctcgtcgccgtacagctcgccgtcctcgtcgccgtcgtccagctcgtccaccggcatagccgggtagtgcggggccccgctcacccgccgggtcccctacagaaacgggggtcggggggagaa

SEQ ID NO: 91238 - DNA, 2523 bp, Oryza sativa
tcgattgttccaagttagttaattaccaagtgaaaagaatagaaggaaactggttgcgattcttcagagaagaatagatgttcgggaacacaccatgtcctgagtagcaataaccatacagtccaattgcgatgggaattcctgggagattcagtgcagtccctttgttctcaaaaccaacatggtcaacaaccccaacccagcataggcagacaactacaaggattgatgcaatgacacccccagctacaaacacaacaacatcatgagacgatgtgcagtacatacataaggcacaacaaataacgtgcatgttatttaaacaactctagacccagtaagatgaacagaagaagcaaggaaatgcaaacctgaaagataactcagacagctaaggtcgcggagccaagtggttggcatgactatgagggtggtcaagattgcgaagaacacatgagagtttagtgtcatgctcccaatggttagatgtgcattggggaataactttgacaaattgtcgctctccaatatcaaatactcaatgcaacaggcctgaaacagtacatcagggtcaattaacatgttgtgaaaatgctttaaatagtattactattcagaaggaaataaaaaaatatattatgtttccgtggcaactcttcacaacctaaactgagctaactcatacgtattgcatggttaagttaggtaaatgtattgcattataatctcaagatctaagtaactaaaggtaggtattattttggttctgttttaaagcatagaaatttcaactgaaataaattattattgaagcatgtgacactattatcaatgagcttgaatacatgagaggtcatatcagagttgcaaataatctaatagtgtggtgggctggtggccttgtacttatcagaggcacgtgtgtgactatgtgttttgtcccggatatgaagttgatgtgtgttaattgtatgaattcattccctggggactagcacgtagcaatttcgattgaaaatggcttattagtaataagtacttacatacagttcgatgtacaggattatctgtagatagtggagccacatacaaggaaaaagggttagcacaagagcagtcatttttgcataacctgaagcatacagttgaaatatcatcatctacaagagattttaccgagattgctatacgtccagtggtgccaaaggcggcatgaccaatatcagggtatgtctcaagaccctccttgctgtccagacaacgtcgaaggagcactccggtgtaccaagcgagcacagcaaataagcaaagtatcaccagtccaagccagcctccctgtttaatggcatatggagtcgataggatccccacaccacacagaacatttattcctgcataataggaaaaaatcccctagactaagtaataatacgtaggtatttggaaaaaaaaaagttaagttatttgtcctgagtaaagcaaacagatcaatttcttgggttaagaagaattagataaaaatagagagattggtacttgtacattttattttggatgaagtatttctgcatataatttgataataattatatgggtttgtcttgaagcaaaagtacagcctgcagatctatctacttgctgtttgtgacaactgtcacatggtggggtgactcaaccatgtgatgtccctattgatgccaagaacaagaagaaaagttgaactggtggacctgtgatgcggcgtatcaacaaagagaatagaccattttcaggacaacatgattgaccatttgatgtacttgatgtttgcacttaaactgataaccgctgggctaatctgggctccagatgtttgctgaactaactaatgttttgcatttcgctaaaaaaaaactaaaggtttgggtcttctatcaatgctggtatatcaaataaaatgaaacagcatgtaaagctagtataactactagttcaaaacagtgtgatctcaaattctcaatccagatccttagaaattcatgctctgattgtttggactggtctgagcatcaatacactgaacttggacatgctggtctgtgggagcgtgtccaggttcaccaaatctgattgtgtattcatcaatgctacgtactccatatgacaaggatattctgtggtgccaataagtgagggggtcctatttctcatgttctacttcacagtagaagcaaaacgacttccagaaagtcatatgcaagcaaattatggttggatctataaattggtttacgagaagcaacatatatatctagtatcaatcattgcaggataaataacattctagtatttcccttccataaaggaaaaaaaagaaatgatatcatcattaattaaaattggtagacatgcgtaccattcatcactgcctgggtgtaggagcattgttgataagccggcacctcatgagccggcaccaatggtttttgatcctccgggatctgttgcaaagacggttttcttgagggaagcaagtactgggaa

SEQ ID NO: 91239 - DNA, 1334 bp, Oryza sativa
agattagagagaatttcaggggttttgccacgaaaagagttggtgaggaatgagttggagagcctgcttagagttggagttcccaaaaagctcaggttgggagactgcacgctactataaatgtcgattgattgcctgttaacatagaagtaagagagaagagttactccatttttatttttagtttagtttagtttgaataagatgagatgagcaagggaggttggcatctagtagtcctatagtatgtggactgtttctcttttagatgaacttatttaaattggaagaatgaggatacagagacagatacagattaattgatgggaggataaaaagagaagaaacaaatctgaattttggcaggaagggaggggaagggacctgtagctttgcggccattggtgggtggcgtaggagcttgggcgcggggtagcgcaggaggagtcgtcggagtcggagtcggagtcggcatccttgaggaggatggaggagtgggggtgggcttcctcgtcctcctcctcctcctcgctctcgatgaggaagctgttgctgccgcgctcctcctctgacgcataacgagaagaagagttgttcatctcgtgggatctcatctcttctcttggaatctcctctcctctcttgggctctgcaagtctgcaactgcagtcctcctcctatacaagattagtagcagtacaagaacaagagctgtgtgtactgatcaatgttagagataatgccaagacctgattaggattaaattagttctcctctctctctctctctctctctcactgtcgcacacacacttttagccccagctgatgcaagggagaaggaaccattggatgactccacacatgcatactatacgattggagtagacaacaagtgcatgattaaggctgtgttcgcacataggtgttcccaacttgcacagtaaacacagaaaacggagcggttcattagcacgtgattaattaagtatttactatttatttttcaaaaatagattaatttgatttttttaagcaacttccgtatagaaactttttttaaaaaacacaccgtttagcagtttgaaaagcgtacgcgcggaaaatgagagagataggttgggaaaaaggggttgcaaacacaccctaaataaattgatgccgtccgtcatcaacgtcatgattccctcacacattactctccttcgcctctatgacgatgattccctttctattattcataaccatattccccttcattctccaattcaactttaaataaacacaagacattactactagtcctagcagcttacatgtcaaattttgctgcat

SEQ ID NO: 91240 - DNA, 3870 bp, Oryza sativa
  unsure (1)..(3870): unsure at all n locations
cagctcaaattgtgcctccacatcatgtgagatgtcaaaatgagtggcacttaacgcttttgatttccctttggcttttgtcacgacattctcacttgcagaatttaactttgcacagagtgttctcagtttaagaagatcgtcagtaactccaagatctcttgattcatggtcagaagggaagtatttatctttgaacgactttgcacgatcactaactgcaaatcgaagactggtgttttgaacttctgtagagcatggtgttgagctggcaatcccaggattggaagtgtttgattcatctaatgagctgttttctgttggtgcagcagcaccacgccggcgctggcgtctagaatgcgagggcatcacagattcattgtctttatcatgtggcaatacctgagaaggcaccatatcggaggattctggacatataagcgactccacagcatgaacgacaccttccctcacaaacaacttagagaatgtctcaggaagtttttccatcataatttctgctatttaagagcaggaatcaacacttgcggatctttccacgcaanngaatgcccntgctaaggaagctgcaaaaatggaaattatgtagcttagcaaggatcagaaatgaaggtgtgtctacttgcacaatacaagaaataaaagcttccaatatacatatgccagtaaatcattaggttgtgccaaggagtgactggatcatttcagcagggctgtagcacattattttccagttttccagtgattgataagcattagttttcagcagtcttattcttccaacataaatatgcttatcaataaaaacttccaacataaatacaagaaaagaataagactgagcagaatcttgtattagcacctggatatgtttgttgtgccaaggagggactggatcatttcagcagagctgtagtacattagttttccaatgattgataagcatttgtggcgtatcggtgcatttacacttgagccatacacctgtccaagaacagatgccattaagtacagaaaccctgacatattcccaaaagtagtagtactccatctgccccaaaatatagcaacatctggctatgcacctggacaaagttgctctattttggaaggtagtagttatgttcactgacaagaaagaggatctgggcacaaacctgcgtcattatgggtaataagtccataccgaactgctttagaagctcanggtgctcacgtaatagtctctcatgtcctgacctttcattttctgttgaacttgtgccatcttgtttggtggaagctgatttctttgaagaagagcctttaacaagcacatggaagtatgctggtaaagaaatgattcccgaaggcaaatgtggaagcaaatcatcagcaaggctcactatctcaaacatctgcagaggtaagagtaaatatgtaaacatcacacataaagaaattaacaagcatgtatcaccccctcaatcaaacataggtgccaacaatcaacataagggtgcgtaagtgagataacaagcagcagctgctgataacatcatgcgttaacaatgctcacaaatgtcagatattttgaatctcagcaaatatgtttattggcatatgtatgatataagaaataagaccaaaaaaatgtaactcagcaattagttactactggtaagcgttggtagctttggatcaatcacacttcaaattagatactgagtattgtgttcctttatgtctccttaaaacactatcccaaagaaattaacttaatgcaggacgcgttatttgagaatagtgtctcaaggactgttgtacagcatttgaaacaatggcactgaacatgaacagagatccaccgataacatgttccctttctgcgtggttcattaaaacgtcaacagactagtttttgtttactaaataacagtcctaccttcaatcctcaagaatattaccatagggaactgcccactggtatggaaaattgtacatgtggcataggcgcatagccttaacttttaggaagttgtggtaagccatggagataggcgcagaagacacaagtttagaaaacatggtctgctaaagcaagtttcagaaatacataagaactgagtctcagctacccgcatgtcacttcatctgagatagatgataaaaatgccataaagcttcagattaagtaaattcagtgacacaggcaatcacctgttcagcaggccttgacaaagctggggagactgatgctccagcaaccaaaccagaacctgaaagaatatctttaagagtaccactgattccaagaagaagaagtgttttggctgctaaaagcgacccactcgcacatgttgagagaagacgaattaatccctgaaaaaagttccagtctatccttagcaagagtacagaaaagataggaaacaactcgaaagaatgacagaacatatttgcgtgtaccgtatatgttgatgtactcaacgaggcctggcctgcggagttgctgattgataccaggctagcagactgagcaaccaacccatgattgcacaaatcatccaatttctctggataagaagcaaaagcctgtgcaacgcgtgtcaaacaaacagaagcatgttcgagcacctggaatgagcataaacagaaagttaaaaccgcatgttataaaggtgaagccggatcaccaatgcgatgtttggaaatgaaaaataccttagaatcatggtggttcaagagattcgtgagcaacggaacagcttccatgacaaactcggacgcatcagatggcagcttcctgcatatattagcagcagtagacaacgcaactctctagaagcatgtccaagaggaaacagatagtaagttaatagagcatgcagaaccagaggaaattaaatttaagtgggtttgaagatttgagatatccggagtggtgaattaattaatagcatacctgaacaccagtagagaagaagtccagatatgacaggacagccattagcgcaccagctcgtaaacaggcagttggatgctcctgggagatcttcttgagggcttgtagcgactaagaacatcaagaagtggatgttagcatctcggtaaacacatgcttgaaggggcaaagaacaggtgttccgagtgaatctagctagcctacctcatgacggcaaatggttagattcatcatttatttatgacaccacagcttatagttatgcactttaaactaatcatatgaataattttatttattcatcagtggtgtagttattcagttgggtatggaatataacgagacgacctaataaccacatgagtagagttcatgcatcaatggtactagagcgtatagctatactggacctatcaaagacaatggctactgagtcgtcgttgtggtggcataacaacagcagagcaagatgagagtattcaggtaaaaatattcaactaggtcatatgaacaattttattaattcagtggtgtacatacacgagtagatgaatgaatcgatggtagcagaaaagcataacaaagcaataataataatatgaagaatgagatgagagtaatgagtaatgagacaaggggcggggtgagtatacctgctcggcgaggtccatgtactcgatggtgagcaggcgagcacagaaacagggtatagccccatagtgcacgacggcagagcaagaggaggggaggacgtcgacgagattggcgagggcacgggcggcgagcagcatgacatcggggctggcgccgcctgcaccatcctccccggggccgagaaggccaacgaggatgggcacgaaggcatcgacggggaaggcagcgagcgactcctcggtgccgatgga

SEQ ID NO: 91241 - DNA, 562 bp, Oryza sativa
tattggtttttgcagtgaaatcaagttccatatatgtggcgtgggcagcctcgcgagcaccgagaagaggagctctatcctttgccgtacatgtaaataaagaaaaaaaaagaaggggcaatagtagtttacatatttgtcgaaagaaggattgattcgttggtgaaaccctttgctgtgtatctggaatgttattactttgctattattatgttgttaaccatcatgtgtacatgtgtgatcgataatatcgtactgtttttgtactaataaatgtggtgtagtgctagtacatagacggtattgtcttgccccccccccccccccccccaaggagcgaaaagcaaagattttgcttaaagacgacatcagctagctccgaatcatttatatagctccgaatcatttagctccaaatcatttatatagctccgaatcatttatagtaaagctaatacgaattcatatgtataatagttaacttatgtactacatcattaataattagttctattaaacacatataatgggcttgataggtttaataccaccttattgcctt

SEQ ID NO: 91242 - DNA, 937 bp, Oryza sativa
ggtccaaaaactgcaaagtgctttgtgttcattggagcgcttccctgttgtgctcagccagtccagcagaataggtattggaggctcccgtttgacttcaggtttgagtgctctagctcagcccttcaagttgcgcctttgtcgaggtcagggtgaaaaatcacttcgggattattcgtcaaatattgtgcttattgatccctttgcgagtctagcagctgttgaagagtttctttggcccagagttcagcgtagtgaggctgcttcgaagcctacagttccatcaggaaataattctgaatctggcatacctggcaccgcagctggtgcgtcatccacagctgcaccagctccatctggcaggcgtccaacaacaagatcaaaatcatctgctgcaagtagtggtgcatctaagaaggattctcaggaggaaagcacaaacactgccaagggaaaggggaaggctgttgcaaaaccaaactcagaagaaccaaaaggacctaatacacggaatgctactcgcagaaaagctgcttcagagaaagatctggaaatgaagcgagcacatggtgacagcagctctgaggtatttctttcatttctctgaatgaacatgaaaaattctaatagagattacgaatgcagttgtcagttttatttagctctatacaagattctagtgcatgttaattctatgttgagaggcatatagacataataattgtccaacaagtattaaattaaagataatgtacaatctcctttttgtataccaagatttgacctcagcgccttataaactacttcctccgtttcacaatgtaagactttctagcattgcccacattcatatagatgttaataaatctagacatatctatatgaatgtgaacaatgctagaaagtcttacaatatgaaacggagggagtacatttt

SEQ ID NO: 91243 - DNA, 1950 bp, Oryza sativa
ttctctccttgatagcatcttacaggcagaactcccatgtgatctagagagaacaaactcaacttacaacattttagcactattgcgtgtattagaggggctcaatcagttgtcccctcgtttaagagtacatgctgcttctgatgattttgctgagggaaaaatcaccacactggatgagctatatagaactggagccaaggtaccgtcagaagagtttgttaatagtaagttgacaccaaagcttgctcggcaaatgcaggatgttcttgccctctgtagtggcagtttaccttcttggtgttaccagatgaccaaagcctgccctttcttgtttccctttgaaacaaggagacagtacttttactccacagcatttgggttgtcccgtgctttgaatcgacttcagcaacaacggggtgacaaccaaaatgctggtggcgaaagggagatccgatttggaaggctacaacgtcaaaaagttcgtgtttcccgtaaccgtattctggattctgctgctaaagttatggagatgttctccagtcagagagctgttcttgaggtagaatactttggtgaagttggaacagggcttgggcccactttggagttctatactctcttaagccatgaactccagagtgttcgccttggattatggagatctagttctccatctgatacgggaatgcaaattgataggagcgcaagtcccgacgatgacttggcagccaaagaactcagctcagatttacctgacaatggcagccacttgatacaagctccctttggattgtttcctcggccttggccacttaccgttgatgcttcagaaggcagtagattttctaaggtcatcgaacatttccgcttggttgggcgagtgatggcaaaagttttgcaagatggaagacttttagatttgcctctatcaacagcactttataagcttatacttggacaagtaagtgatatactcttactggattaatatcagtttttccttttgttacatttgttttattgaagttagtctgaacaaatgaactgtatgtgccaggagctggacttatttgacataatctcatttgatgctgaattcggaaagacattgcaagaactgcaaattcttgttgaacggaagaggttccttgaatccacttatggcatgaatcagctagaagtcacggacttgcgtttccgtggcactcctatcgaagatttgtgtttagattttactcttccaggttatcctgattatattcttaaagaaggcgaggaaaacacaattgtaagtgatgaaacccatcttagttttgtgtttgtcccagtgactagtgtctgcatttgctcctttttgtggtaataaatagtattactctgttttgcaggtaaatatttacaacttggaagagtatgttactttggtagtggatgctacagttaaatcagggataatgaggcaagtcgaagcatttagatcaggatttaaccaggtgcaacgtcattttctctctcttgtaatcattttattagctgtttttttttgtttactgtaattgttcatgtttacctttctgttttaggtctttgacatctcatccctgaaaatattttcacctgaagagcttgactatctaatatgtggtcgccgagaaatttgggaggtaatgctctctctctctctctcacacacacacacacacacacgcacacagttttagtttgttacatttcactgaataaacctgtgctgcagcctgattcattggtggataatataaaatttgatcatgggtatactgctaaaagtcctgcaattgtaaatgtaagtgcgctatatgcatttcaatatctgaattggccttctgtaagtttagttacttaattgctctacatgtttgtagctactcgagatcatggctgaattcaccccagagcaacaacatg

SEQ ID NO: 91244 - DNA, 1431 bp, Oryza sativa
ttcggttgcaaagaaacctggaaatgcaagtgatgtgtcaaccaagcgcaaccacacggatccttctgcaagagcaggcaaggcagcactcactgattcctcgtttgcattgaaacagatgtacaggtcgcctctgaccgaatctgccgccatttcatctacctctgcatttatgtgcatgcaaagaaagttgctggtaggatcatcccaacctggctcacatagatcgctcccataccaatgtatattctcaagttttaggaattcccttctctgaaagatatcgcctcgccgactcctgagtgcagttagaaatgaaatgaatccggtcacttccttaacaaatgttgtcttcatgcctctccagttcagaggccctctatccttgtatgatactgaaccagcagcagagtgcccacattcatctcccatgttcagaacaggaacaccaagtgatacaaatagaataaataagaagttgcgtatctgccttagccttgtctgaaggacagcactgttctctgatggaccttcttcaccacaattccagctcgactcagaaagaagatcatcattgctgaaactcaccagatcaacaagagaaagccctgaattcctggatacatgattgaatgaaaatgcaggccctctggttgagaacaggtccccactgccgcacaggcgtgtagcaagatcactaataagtgcttctctcttcaaaaatttgcgcacatcaatagagaatcttgtgttcacctcagcccatcttttccaatgagggaatgggaattgcacgttagatatgtcaagtggagaccaaggatctgcaatgatctttgtcatggaaagaaccgggtcaaaagttatcgcctcaagaaggggaggtcgagataaatattcaccaccaggacctctcacaaggaaaggggcattgatgaagcaaaacccatcaacatggaagtcaagcacccaatggcggaggctgtccaaaatcagcttctgagtcaccggatggttgcaattcagtatgctcgctttgcatcctgcgatcccattggcaatgtaatacgaggaattatcaatgccacgcattgatatcgtctgacactctgattctccctcagcagtatgtgtaaaaaccacctccaagaggacctctattccatttctatgcattaccctgaccatatccttcatggacttgatggctgaaacactcaaacctttgctgctatacaagttcatcggtgaaaagaaatggtacgggaaataaggtcctttcacctgatgaaatgggaacactggttccagcaaaattgcattgacaccaaggctcctgaagtgctctaccttagcagaaagcccggtgaaagtgccggcagcgtcatccgggagcccgctcgacctgtcctttgtggacaaagccacatt

SEQ ID NO: 91245 - DNA, 9674 bp, Oryza sativa
gctcggcggcggaggtcctcgagcggtggcccgtggtcgtccctgcttcgagcggcggagggcgacgatggcgcctcggatccagaccgacgccggcgcccccgcccaggatccagactaacgatggcggcgagcggcgtagcccctccctcctccttctcccgcggcgtgtggcgaggacagagtggcgcaggtaagtggagtcggcggcgagcggtggagcccctccctcctccctctctctctctcgcggccggtggggttgctgctgctactgcaaggccgcgccgcgccgtttctccctcctcccatccgcgacgatgccgagcgggttgctgctgcatggccacgacgcgccgtttctcctctgcacggcgcgtcctcgtcctcgcatctctcatcagtgggccccgcactcgactttttgagcaaggttctcgttccttcgctgggaaccgaagaagctagtggagctatgggccccaccaacttttttcaccacgtaggacaaagtaacgcttcacatagacaaagtaacgcccccactgtgaagggcctaatagatgtcacatcactgccttatcaatggattttactcccaatactctctgggtgtgtttagttcgtgccaaaattgaaagtttgattgaaattggaacgatttgacgaaaaagttgaaagtttatgtgtgtaggaaagttttgatgtgatggaaaagttggaagtttaaataaaaaaattaggaactaaaccagtccctagtctctataaagtactacctcctaaaatataataatctagaatcgaataaaatatatctagcgctaagaatccgaacaaatcatctctctagattcgaagtactactaccttcgtcctaaaatatagcaactttttgctatgaatctgaacacacaattgttgagattcatagctaaaaatgtttacatttgagatggagggagtaacatatatcaaatcttatcatagattcttactacctccgccccaaaataagcgcagatttgatatatgtgtctaatgtttgaccatccgtcttattaaaaaaaattaaaaaattagtcacatgaagtactaatcataaaaaaatttcaaataagacaaacggtcaaatgttggacatgaacagtgtaaaactgtacttatttttgggacggagggagtataatatagtaatctaatatcagattagatatatttaaaagtataaatctgaacagatcttttgttcagattagtatcactaaaatatatcaaatctgaccatagagtcttatattttgggatgaatatagtacctctttcatatatagagggtgccaacattcgattaaaaatctatccggtatcgatctcacctactccatccttgaaccagctcacacctttgttctgtcgttgttttaccgacactcacaatgcaaagtttatattcgagaaggtaatcgcttggagtacttctaacagcctctctaaatttgactagaacagcctctctaaatttgactatttaaatatctatttagctagtttgttaaaaatattaaagagtgaaatttgactttcactctaatattcttattattacactttccaatatgatagtgggttacacatatcaatctttatattcttcgtcttccttccttcctctagatattttccccctcaccattttttctctccacccatttctttccatgccgcttggtggtaggtggtggacaaggctagcacaagatgcacaggaggtgacggcatggacgaggcgagcatagaggctgtgcgggagggcagggaaagggagggaagggcagagacacctccgtcagggaagccatatccacacaggggggctagcagggtgatgagctctccgaccgctgatgccaccgcctatgccttcttcgctagattcggtatcgagctcaccttccctccctacctcatgcagatcgacatagaggacgagcttgacagtgctggagaggggacgatgaagggagaatttgttggcggtgacacatgaggatgatggaagaggtgtggatcttgacgattgtgacatgacagtagaggggtttgactctgtgacatgcaagctttgatggcggcctcaccattataattgtcgagctgctcctcgtcgttgccattgtacaccaccgcttaaggtcgtatcctatgggatctacaggcaatggcccctccattcggttccagcgggtggcagcggcggaagggaggcaaggagggttgatcgtgtaagcccacggatggccaacgattttggctggccaaattttagtagtgcggagaggataatttggccagccatttgagaagactattggagggccattttttctcaaacttaccaaattttgacttgagaagccatctaacaaggttattaaagatgctcttagaccttcctctaactcaacccgggtttgacaatgtcattgtaactaggacaaaagacattaaaagtgatttactttcatataaatgctacacactctgtataaaataatataacaatgtaatactgaattagacacatcctagtactaacatgtactcctatctaattcagtgctatgtgcttgtagatagattgatcagtccggttctttgtcctcggatcgtgttatgcccttggacaacatctatgatcaaatatagtggggtttcagaggtgttaccgttgacgccggtggggttattcgttgagccccgcggttttctccagatcaagtggcagcgacaagccccatgggccatggcggcttgatctctagatccatagtgacatcctagttcttgactttgggctttcttcgatggtggtggccgtacactagtctgtcaatgctcaagcagacgacaaggggaccttgggcctgcaaccctccccgtaacaccaactgttattaaatttatttctctttaagaatggtttggtaaatcagttttgtttgttgttaataactgatactatcattttactcctaactcgattgttagaaaaaacatactaaagatcatatagtaattctcgtagtaaaacgtgggaagcacacttaggagaaatcgagctgtgtttggttggagggagtggaaacgtgtttgtgggtcgtgtgtccttgatgtacccgcaacaatgagcgctcacacattttcatgctctcctccgtacaatataaataaaatacaagcatggttgatgacgaaagattttctatgaaaacgttcacatcgtgctagattttgaatgtgcttgtttggctttatcatttgaaacatattatttattcgattattgtcatgaattatctacttactattaaagagagcaatctaacatcttaaaaacggtttagcttaaattatggcgacacatgttacactatgaattttttagcaacttgatcctctctgcaattcgtgtaggagcagcgttaaactggctagctaactaaagctactcaaaaagactcaattcttgggttccagtgtccaacgtttgactgtccgtcttatatgaaatttttttatgattagtatttttcattattgttagataataaaacatgaataatactttatgcatgacttatctttttaaatttttttataattttttaaataagatagacggtcaattgttagacacggaaacccacaaattgagtttttttttgggacggggggagtagctaggtaggcagttatttatatatttatataattttacacggtagttacaacacacttacacatcagttacgtatgtaaactcgacttacacatcacttacatatgtaattagtatgtaattttgggatttacatatgtaattttaggacttacatatgtaattttgggagttacattgtaaatataataaaattacatatgtaattttgggacttacaatggaaatatatgccaactattttttggtgaaaaatatagcgccataaatatagctactccctcttaaaaaaataagcttaggaaatagcttaaaataagtggtttaaacaatagtataatagaagaaagttttcttaaaaaaagttttttaaaagcacagaacaaataatatgtggcaataatctttaaataagctgaaaagaacgggtaacacaaactttagatgtgcaacaaattttttcaagtatctgtctggtttactgcaactacggtggttagccatacgttttagtcatgtgacattatggattagagattttctttttttactttgtttaaggtgtgcctactttttctatcaataaccaaaataaatatagtctttatcatgtctttttcattctttatcacattctccttcctactagtagtatcttccaatggttattgctaacttctaattctctcatgaagccatcatagagccccaaagacaagctagctgccttgaaaaaaaattgacttgcacatcatgtttaatatttcgtcttgaaaatttcttaggttagcacggaagcaactgcaactaggggcttgtttagttgtggaaaatttttagatttggttgtcacatcggatatacggacatacatttgaagtattaaacgtagtctaataacaaaataaattacagattccgccagaaaactgcgaaacgaatttattaagcctaattaatccgtcattagcaaatatttactgtagcaccacattgtcaaattatggcgcaattaggcttaaaagattcatctcgcaatttacccgcaatctatgtaattggtttttttcctacatttaatactccattcatatgtccaaatatttaatgtgatagagtgaaaattttcgttttaggaactaaacagggcctagttgcatggatgttgttatgttgcatagatggtacggagttagcagtaatcttcagcaaaaatgtttcggagaaaaagccagaggccagttcgaatttgcagttcggctcggaaacatgatggattattagcacataattaattttgtattaactattataaattatatatatatatatatatatatatatttaaaataactctacatagaaagttgttatacaaaacgcactgcttaccggttccagaaatgtgctaacctaaaacgagtttaagaaagaaattgctgttttgaattattggaaagaggtagacacgtatccttgcaattattgttgatggatcttatttcatagtaggtttgttattgatggatcttatttcatgataggtttgtttattttgatggtttattattgatggatcttattacataatactccatctattcctaaatataacggattttggtgggatgtgacacatcttaatataatgaatctggacatgcttcagtctagattcgttgtattaggatatgtcacctcccaccaaaattctttatatttagggacggagatagtaggtttgtttattttgatacggatgaagtaatacacaccttgcctagtatcccatttcgctcaagattcctttattttcatgacaacaacagtgtgcccacgttttggtatggactgcaaacaaataaaaatggatttttttttacacatagaatatacaaagaacaaatattctcaattgtaaaaattgaacagaaagattacatggaatcaatcaattgctacttattcccacgtgcatcatttcttttcttttacaaaaaatccttcaattaccactcatgtccaacaagtgtttgccacaaataccaccactcctgcaactgcaagaagtgtaaacaccatctttcattttttttttggtgcacatacaatgccttcggctgctgagttctggcagaactctagtactctacactagacatctgacattacaagataaatttattgcaactgattcatttccagcaaagaaagaaggaatatgaacagaactgatatgtttacacgctacatactatacgtagtcactacaactaattcgatctgtggaacacctatttcatttcaatagctgtagacattcaggggtaaaagaagaaacaaacgaatttattcagaaacattccctgacgctattaaaaagaccccacatgtatgacgtgatgttttgcttttctgtatctgttccttattcctgagacttattctttggtacaggatctcaaaataccgcaataccacatggattacattttctttacgaagggataatgataaaagttatgcactcttgattctcttctgagaaacaaagagatatcgccgcagggcaagcagtgaaatccaagtaaatcttgaaatcttctcctttatcatcagcagcaatgcagaactcaggacagtcttgagtatctgagcatgtaatcctttgaagaagcctgggatgccttccttgctccacatggcatgcaaagcgcccaacattgttttgggagattttgattttcctggcctttcagattcatcgtcatcatcctcatcagggtctgcagcctgaatcatgaccttgcacctgtttgataatgatgtcatataatttatatggtgataataatttatatgtagcattggcaagcaaaatcaggtggaaaggtccagatgtacatcttctgagaaaaaagaaggttcacctgattagtgggtaggttaatattgtagcaacactttttgagatggcaccaaggagaaatgctgagaaagcagaaagagcaactggtgaagaaccaccccctgcttctgcatttttacgtctctgtctctgaattagcttctgcttgagctgatcaaatacagtatactgcaacagacaggtaatggcaaccataaaataattgtcaattggtgcgtgcaaagaataaaagtgaagctaataagtccgaaatccagttctaggtgtttcttagagcttatttgttacaaattccacacagacatcagccatgtcattgaagtgatcttatattagaaatgttttttttataacacgttatcttgtctgcaatttttaggcagataatatatacatgatacttgaactaaatgaagtttcttcaattacagaactagaataacatttacaactgaatcagataggaagaaagtttagtgcaggcccacacatcatttttgtagtagtagttagctatactcaattctactagtaaacaaacttgaagcagctcacacatgaagttctgcagttcctccattgttgagctcaggatattcttaattattaagtcaaaaggcacgagagttgcatttcatttatatgcaaatacagtatagttcacaaccagtcaacagtacaatagttttgccccttcctgtgtttttcaaacaaatgaatttgtgactttcactaaagcttgcagataaatgactgtataactgccatttttaaaagcatctcagtacatatgtttctatacatacaaaaaaaagagagaatttgaacaatgcagaacctttgtacctgaatagaaggattacacgttagtataagagaaattcccaagccatcaaatgcctcaagccaagtgccttcggcaagagttgcccgcagccctttggactttccaaaggcacttgtttgcattctagaagatgctgtatctagtggctgaaaacacaggagagatgaacacataaaggtcagcaggtaaaaacgattttcagtgaatggtagctaattacttatggcgttagttacctgagtaacaacaactgtgcaagcaccagcagcagctgcaactaacaagttcgcttttgtgccgatagactttgctccactcttctccaagtagagtcttttaaagtagctatagccataaaagtaaacgaattgtgaaatgaaagattggatgttctttgtcttaaggccctgatatagggatagaatttgtcttttctgaacagcttcccaaaagacatctgaaagattcctggaaaaaataaacacgtgaggtcacttattgtatgaaacagagtaactcagaacttcagaagagatggaacaccatgaaggcctggatgccaggacatacatcaaacgctggcaaaaatgcatgacacccaaatcaatttaacttttttaagagtataaaggtgcaatcaagtgaggtaccaatatgtgaaaatgtcaaggtcaatgcacatcccaaatgctacaaagagttagctggcaaaacctaatgaataaggaattaactggaccatatcatccaggtggatgttatggaagagaaaaataacatgtacatgccaaagtccctctacaatcttatatcttgtggtggagcgatcggtaaacaaaatatggaaaggcaaaatacctctcaagattaagatctttgcatgaaaattatttcttagtgagcttcctactgatgtggagggtagtgaccttgaataaaaatatatagcttttgtggtatacttgaggttcaagatcatttgaatttttcagcgctctatgacctgctctgtatgcctaactaacctgcatgaactaaatgctggctgctgttgtcttttggtaatttctctttgaatctggtggtgtctcctaatatgtactatatgttgcttttagtgccagagatgctcccaactctattctctttcatattatctcctgaaaaactctggctttcaatacaagcaggtattggacccctttggttcaggaaaaaattacaaggtatttccacccactgattatttttttctttttcatgactagtccattgattggccacagaaaaaaaatctctatatgcataacccttctctctcttttttttttctctttgtggggtgcataatccttcctatttggttaaaccattctataaccaacacctattggtgggcaactgggagctgaaccaaacaatctccaaccaatcaacatagtgccaacatactatacgattccagattaagtgaactccttgtgaagtgtgagcctaattcagagatataatgcaaacactaggtctaaagttcctttccccccttctaacaacaaagctggcgaaaggagacatggctggggtttttctgcatcctttggccaccaaataagaaatcaacgacagttctatcccagggaaattatcaactggcctatgcgaagatcacgacatccgccgctaacgccaggttatccacgtcaatcggaccagtgcatcacgatcagcccaaacactgaatcagtagcagccagatcccaattccgacgggtcgcctgcctctcgatcgagaacccggcgatctccccagcaagctcctgacaaggggatcagcaatccaccacatggcgaagagagggagagagagagagagagagagaggagccgctggctgagctgcttacctgtacttgtgcgcgcccggctgcgtctggagctcggcctggaacttggtcttgcaggtgtcgagcgggtagagcacggtggtgctgacgagcgcgcccaccgccccggacgtggcctccgccacgctctcccagtccacaccatcccccgccatctctcctccctctccctctcccgcccgcccccgacgagatcgatccctaactcgcgagcggcgtgcggcgtggagaaatcccccggggagcgagcga

SEQ ID NO: 91246 - DNA, 1478 bp, Oryza sativa
ccattccgcggctactactacctgctcgactgcggcgccgcggcgtccaccaccgacagccgcggcctcgagtggctccccgatggcggctacgtcaccggcggcgagccccacagctccccgaccagggcctcctcgacccggcgctcgccacccgccgtgacttcccgcacgagcccgggaagaagttctgctacgagctccccgtcgaccgcaaccgccgctacctgctccgccccaccttcttctacggggcctcctcgccgccgccgcccgtcttcgacctcatcgtggacggcaccttctggaccgccgtcaacaccaccgacgacgtcctcgccggcagcgcctcctactacgaggccgtcttcggcgcgagcggcaggaacatgagtttctgcctcggcgtgaacccggactacaccagcgctggccctttcatcaacgcgctgcaggtgatccagcttcacgattcggtgtacaacgccacgaacttcactaccagcgccatggggctcattgcgcgtaccaagtttggctccaccgacggtgttgagaggtgagtgctcgatcactcttgccttcactattatgaacttctgcagtccccattaggtcctctattacgattagcttagtgatgaaatgttgaatggggattacatgattcactagaagtgagtatgtttattgactgcaaagctgagccaatcttgatatgatggacaatgatgtgtattcataggttatagggataaatgaaaattttgaaacaaataagtaatactctttggatcattttctttgatggactgaataactcaagtttttaggttatcttctcacgggttaatgtggagtgatatgctgtgttatattcatgtattaatttcttatgtatgtaaatttcacaagatctgtacaagtttttgacctgttttcctatattcaaacttaggtaccctaatgacaccttcaatcggtattggcagccattcccagacagtaaacatgcagtcagtagtacccacaatgtcacatcggctgatttttggaatcttccacctcctggggtgtttaatacagctttggtggcagaacaagatgcacccttggtgctgcaatggcctccaatacctctccagaatgatagctattatgttgctctttattttgctgatacagtctctgagagttcaaggacctttaatgtatatataaatgattacagcttctatgaaggcctaacagtaacatcagctggtctttctgtctttgcaacacaatggattctctcaggcttgaccagagttattttggctcctatttctggccttcctccacttatcaatgctggtgaagtctttggacttttcccactaggaggatacacatttcctcgggatggtatgtcagtcgctacatatattttttcttccatttgtatcttttttcgtaataggttaaactaaatgact

SEQ ID NO: 91247 - DNA, 3183 bp, Oryza sativa
gtcaagattgcctcaccccaaccattccttggaaagtcccgcagtgtctaacatggcattcaccatctcagttagagtgcagttctttctttcggctaccccgtttgattggggtgaatagggaggtgtcctctcatgaataattccagactcttcgcaaaacgacgtaaactcattagaaaaatactctccactcctatcggacctcaaccgtttgattttcctttcaagttaattttctacctcagctttatagatcttaaagtaatgtaatgcttcatcctttgttttcaatagatacacatagcaaaatctagtgcaatcatctatcagtgtcatgaaatatttatttccccctttagtcaacatgctgttcatttcgcacatatcggaatgaacaagttctagaggtaccaaagtcctcgcctcagatgccttgtgaggctagcgaggttgttttgattgaacacaagtatggcacttggaacttttgactaaagtgaattttggaattaaactcatgttagccaagcgcgtcatacaaccgaaattcacatgacaaagtcgcaaatgccacacattggactcatcattctcgctaatatggttcacaacattattattacacatgtcatccaaagaaaagcggaacaagcctccgctatcatagccttttccaataaaagttccatatttagatacgacacatttattggattcaaacacaagtctaaaaccatctctacacagtagagagccgctaactagattcttctttattgaagagacatgctgcacgttcttcagctgcacggtctttcccgaagtaaacttcagatcaaccataccaacaccatgaacagccgcaagctatccgtttcccatcaacaaagaggaacctctcccgacctgataagaagaaaatagggaaatattagcacacacatgaatattagcaccagtatcaacccaccaatcaagtgaatgaaaaacagagagaactgtaggtaaaaaattaccgtaccccaatgttcctccacccttgctaataaccatgttggcggacttcttgtccctacgatcaggacaattcttagcccaatgcctaggtttaccgcacacaaagcagttgcccttggcctttcccttgcctttcttcttaaaattggtagtagcctttgaaaaacagagagaactgtaggtaaaaaattaccgtaccccaatgttcatccaccctcgctaataaccatgttggcggacttcttgtccctgcgatcaggacaattcttagcccaatgcccaggtttaccacacacaaagcagttgcccttggcctttcccttgcctttcttcttaaaattggtagtagcctttggtttgacatcaggcttgactttcttgttgttgttgtgagatgcgtgagggttcttcttctacaccaaattggtgctggaacctccctcgatcttattgccccggttgtcctttgccctctccttctcctcaacacccaaagagccaatgagatcagtaacactgaacttttgccttttgtgttttagagaagtagcaaagtccaaccaagaaggtggcaatttggcaataatgccacccgccacaaacttgcccggcaactcgcagttgttgttctcaagttcctttgccagcatctgaatctcatgagcctgttgcactacagaatggtcatcgaccatcttgtagtcatagaactgctccatgacatacagctcgttgccggcgtcggaaactctgaacttggcctcaagtgcatcatacatgtccttccgtgaaggcatgtgaatgtacacgtccactatattatcagcgagtacactgatcaatgctccacggaacaggcaatccgaagcctcgaacttagcctccttctcagaagagagaggcggttcactctgtttgccccgtgaaacatagaagcattgcatcgctgtcaaccatagtagtgcacgtgctttccatctcttatagttcgaaccatcaaaagcatgatgtttcagtgttgcggcaaagccaactaccgaaaaggacctatcaggactttggagtgttggaaattaggtcataattcggtatattttaacccaaaataacaagataataaacatgatatttacaatgggatttgatccagtgatagtggtgaatgtaatcaacatgagcatgcttaacgtagaataagcatcaacaatcacataataacgcaatgttgacattgtgatgaacattaacagaaaaacttctaattgaaataatgtaagaaggttataccccaagaatggtcctctgttggagtttgaggcagtattgactccgttgatgttgacaggaacctccttctccttgtctccagtgttgccgttgtgtccagtgttcgacatgttggtgaagacgaagtagacattgacgaacagtgagtagtcgcgccttgcgctccccaaaaacctgatcgcccgcccatccgtgcaaacgtcgcagtagtgaagcatctaggcccccggtgttaattttggtaattaatgacaagcactaattgtggactaaccgttgtctttgagctatacattttaagttaggtccacgtcatatgcgcgcatggatgattatcgatggattaaaattgacggcgcaaagcaaagggaaagaagacggtaaaactagcgctttaatttagaattgatcgaggtgtagggcgatcaaatttgctagtttaattttagtttcgtcgtactattaagaggggtaatgacctagcaaagagatgattttaattgccacattaggtcattgcattttcatttgtgctctctttttcattacacaaattcactgggttcagcctgaccaggggcggtcagaccggccacatagtggcggtctgaccggcgtgccctagccggtcagatcggctacatagtggcggtctgaccggcggcactttcccggtcagaccggcctcctggaggccgagatgatgctgctcgggatggccgatacagagccgacggagccgtagtcggtcaaaccgagccaatggcggtctgactgagccgaggccggtctgaccggccaccccatgtcgatctgaccggccaggccgatggggccctctgacaggactacaacggctagttttctagccgttgc

SEQ ID NO: 91248 - DNA, 3779 bp, Oryza sativa
tggggtgtgacacatcctagaacaacaaatttagacaggctaggatgtgtcgcatcccaccaaaatcccttatatttagggatggagagaataaatataatggatttctcttctcgcaagacaagcaaggattgttagtcattcaaaaacaagtacccctccgtccaaaaataattcaatagctaagagttatctttttttttttttttgacagagtagtaatcaacagatacaaccatgactaaaaagatacagaaaacataccagtactactccacaccgtcagtatcagaaacgataaaaattatagagaacgccctagtacaatttggaactgattatgcacaaggtttgatcgtccgtcttatttaaaatttttttatgattagtatttttattattattagatgataaaacataaatagtaatttatgcgtgactaattttttaatgttttttcataaatttttaaataagacggacgatcaacattgttggatacggaaacccacaactacacttaaaacgggatggatatagtactaatttgtttattgtgcccaggatatcttttgaagctaaagatgtactactttctcttacttaatacatctccgtcctaaattagttgtctttctaccattcaaaatgtatttcataatacttgtcactctctcaagtactatttatcccatcaatcacatccagttcaaatttctgcgtattatactcctcaaccaaccttctatcctcaaccataaattatttttataagctcaaaaaggtgtagctcttgcaaagtagttactcctggtaatttctccattttacattcgccaaaggaatgctagctgaactcttatgccagtagcagtgcaagcccctcatttgagttatcttagatgccatgtaggataaatacacagaatccacttctctcacagtgcaaactactttcacgggatccccgagccaaccaccccaacatccccgagccaaccaccccaacccaaccaccgctactttcgcattctctctcccactttcctcggctgctcctcaccaagtgggccttgcaccaggcttgtgcaaagaaagcactcattactctagcgagaagcgaacaacaaaccaaagctatggccccacctactttttcctccacgtagacgaatccacacgccatgtccttgcactgtgcaaggccttaagccattcacactgtgcccaatccccatgccgtgacccaaggaaaaaggcaaaaatacacatgtgcaggctgtgcagtggaggaaccgggccatgacctccagagtgcgctcacgatgctctcgccccatgcactcattcaggattagactgaagaacaagtgaccaaagttggatacacgaacttcagatatgtgtgccagaagcaaacgtggcacataatatttgttgggggaacaatgaggccaaaatgctgaatgccacctcgacacaatgtaaacgcccttaatgaatgtagtgttgtctgttgtcaagtgacacaccggccttttgcattggcacatacttttaccaaaaacatctcataattcaacagaatatctatactattttaaaagagacctgcgaaaagtgagagaagattttacagatttactttccatacaaacaagacccagacaaaagaaaaatatcgaaatattcttattgtggaatttctcatcgctctatgatatattggacaataggaataacatattttagaggctttaaaataatatataataaatagttttttaaaaaacaaatccgttgcagtgtcacgggcattatgctggtatgcttaagaatttgaagtggtcactacacaaaccatccatttactggttatcttgcattaggtaagcctgaaagattagctgctgcagccagcagggtatccatatgcatttttgtataagggaggtggaaaaattcttaaaagatgcgatggaaaaagatacaacaatctactccctctgcttgaaaatgtaaggtatttaactattttagttttgtgctaagtcaaagttctcttactttgagtaggctcatagaagaacagtacaccaaataaatacacgagtaaattgcaccagcgattcttaaacttataagcatgttttttttacctagatccacaaacttgcaaagcatgcatcgagttacctaaacttggtttattgcatcatcccaatccaaagctttgtttgaccgtggtctaacttacgtggcaacgatcacatgacacagttttattatttttccttttccttttttttcttctatctcctttggcctctctccgacaagcggtgcaccagcacctatcttctccggatcacaaatcagataaaaaaatttcgaggaaaaatcatttaacgcttacaacaaaaacctcgtgctacatggagcctaatagatgctagttgcatgcaaggagatgcggaaagagaaaatgactctttttctcggacacgcaaaaagattgtacgctaatatattaggagagagaaaaggactcgtgcacatgcagagctagagccatcagttgaacgtctgactttgtgttgtgcgtcgaaccgtcgatcaaaggcattctcggaaatcttgtgcagattaaccagaatatattatttaaacccataaacagaatacgatctcagccgcacacacagtatctgtccagctctcgccgccgggggtaggggaggctcctctaactttacatgtgctctctacccatttggcatttcagatttattttgacactactctgcaatctgcatgtgcctatgtaacaatttaagcatggatcgatcaagtctatctaccactagttgtaaagaaacaggtttaatcgattcctctgcactttcccatcttattgacattcacaacaagcataaataacaagtgacaaccacggcaaattttcatgtttgttcctaaatcgaaaaatactaacttagttctttattcctgaatcgaccgttttgtagttaaagggagtagttgtattgcgcccccgcgttgtcctcccccacgggcgacatgggaggtggaaaccaccggcgtcgcccgctcctcccccctcctccctccgccgtctcgccgccgcccgagcggccgccggcaaagccgcgcggccgcaaggacggcggcggcggggcttcaccctcgtcttcgtctccctctcccgtcgcggtggggggccacgcacgggacggcgaagaccgcccaaatccgggctgccgcggccggatctggcgggcaggccgccggcagcgggtcggtgtgaggtggcggcagcagttggtggtggtggcggcggggattgaaggtgggggggtggtggcggcagttggtggcggctggcgccgggaaaggcgacaacggtggcaggggaggcggcgacggcgacagggatggcgtgcgtgctggtggtgtgctgcttctcttgctgggggcgtcggcgacggagttggagatggcggcggggatggaggtggcggcgaggctggcgacggaggtcggatctagcagtgatgctggcatcggcgaccggatccaggcgctggagatggttttgccccagtggcggtcacgacggcacgagagctcgacgacggcgttggggcggttgcgttgcggtgtcggcggtttgcgacgacgactgctggcgtcggtggctggtgacagcggcatcggcgacggccgccgacttgcagtggccgtgactgagcagacgg

SEQ ID NO: 91249 - DNA, 4808 bp, Oryza sativa
ccggcttggcgcgagaggcgcagccgatggagggaggccggattggcgcgagaggcgcgtccggtggacgaggccggcttggcgcgagaggcgcggccggcggtggaagaggcgacctcggtgcgtggtggagctgccggtgggtgtggcgcggtcttcggcgcacgaaggttggccggcgggggcattcgtgcagggccccacatgtcggcagagtttgagtggtggtggagcatcggtgcatcagccgtagattcgtaggtggtgagcggcgggtgaaaacccagcccagccttggccggaccgacaacgatgaattccccctcctgagggcgttgtcgtgctatctcaccccttaagggtgattaccgggcgaaagcccagtcttggctcctttgagccctgatggacggcggcggcggtcttccgtcgcttctcttcttgaagacgtcgttttggcacccccccccccttgctgtagggcgatctcgtctgtgttcctttgttggtctagcggcagccggtcacgcttagcggcggctggtccggtgctaaccttctcctggtcgtgtgtgttggcgctgccggtgtgtgggtggtggtatatttttttctttctcctggttatgaccctccagggttataatattgtaattttttcctgctctatcaatagaacttcgcatcgtctcatgcgagtcgttcaaaaaaaatcctgaatcgaccgatatatgtttctatggttattgattacaatttttttcatactggtaagtctattacaatatttaaaagttagattgctcgttgtttcactccaagaaaaaattgatatagagtcatcagacgctaaatcaagtgactgatatataagggtaaaaaacaatagctcaggtagtccattttcttttatatcgcttcgaccatccgatggcaccatatatttgatcatagcatccaggtgcacttcctttgaaaaggcattgtttgcaatccatctcttacaagaccaaaaatgaaaaccgtgctatgcccgtgcaacattcacgcgttgcattgcaccatcgggtgcagaggtagatggtaacatacgaatgtttgatgccttggtatgtgaccaaattttgctactgttgaaaccatggattgttccagatattttcacatgctccatacaaaaaaaaacttttacaagttattgtactaatgttacattcaatgttttcttttccttcaaacgaaaatctttacacagtatttgacttgggaacttcagaactcaagtactcaaccatctctgcatctcgattatgcacactagagacacagcttgttggcttgaaactcatctgcctcatgctagagcttgagcgtgtgagataccctcacaccattctcatgatgatacattaatccagagcaaagcctcactgcttgagttacagttgaactctgaatgactagagcagtacaaatctaataggagttggacacccaggtgcagaaaatattctacgaaaatgcattgacgcccaagcagatatcagctaacctttgtattcaaatgctaggagtttctaactagcagaaacctgagaatcagctcaaaaggctgcaccctaattgcagctatcaagtactcagccggtaacttctagtcctatgtgcgcagaatttcatggtcctctgcaaactcaatcctcaccatttcagggaggatgccagttccaggagagattccacttgacgtatggtccgcagcttctcttgatacttcaacttggtcgcaacagcttccgggtcattaccagttgggaccttattgttttcatgtgcagcttgaacttccttcaagagctcatcaacttccctgatgaaatcaactcttagaagaacatcatcatcctgaggtggcagcttgatctgtccttgatgctgacaaaagaaagaattcagaatttttttgtagcatgagagaaccaaagagagaaggagcaggaaatccagaattcaactatgaactgacaacgatattccatattatctttggactaactaaattaactatgagggatgtggcagtgtccatgcttgcttgaaggaaaatttcattgctgtcaatgttaacaactatgaagtatatggctaagattaggaggttatgtataataaaagacttggtaacacttatgttaagtggcacaactaattttgaatacaactaggggatgatatttttgtgtgaaatctgtaaagtcagcatctctgttttggaattgtgtcatgtaaattaaaattttgtaaatgtctcatgcataaattttcattctcaagtctcgaataactctaaatttctagcatggtcaatttatcccatgaggaaaaggcatgcatttaactaacatacttcctccatgttgaaaccagcaggaaagaccatggtgaacgggtcttctctgggaaaaacttcaagcatatgttttttacatttctttaaccacttgtcatcatcagatccatcatgaagattcagaaggtcattgagcaatctcatagcaggagttgcttcactccttaaaatttccgtctgcattcaggttatggtttctgattagcccatcagagaccaatgaagcggtcaaatgaacaggattgatataaatataagagcttaatggactcctccaacaatgataagataatggaggctgtgtgcggtgcacctgtgtgacttacctctacccttctgtataagagatcaaggcttctgatggcatccctctcatcctgcgggtgtataagtcaatatctaaacaataaatatggtatcccattctttcaaaaaaaataaatatggtatccctctagtcaaatatcttgattgtagatattagaacttataggcaaaggaacttctcccttctcaaatatacttttgctatgctgcctctagtcaaatatcttgattgtagatattagaacttataggcaaaggaatttctcccttctcaaatatacttttgctatgctgaaaatttatggaaagactagatatcaacaattgagcaacagaagtgataaaagtttaaatatcaatcaatgtttacaggttgtaatattgagtggcagtgtggaataagaaaaataaatgcatgggatctaggagttcttacaactcacaaggtgttttagttgtccaaatctgcaaggtgagtaaatggtatgttgtagtgttatacagcctaaattatttcctccttttttgggggcagggaatccaaaattcaattgttgttccatcaatacttcaacattcgtacttaatgagtttctttaccatgagtcgtacttacatgtttctcgaaagcattttctgcacattcaactatgattatcttacgcccaaaatgaaaaaaaaaaaaagcaaccacacttttgataacaaaagggtgaatactgactagtaccaccgtaaaacaagatgaaaactgcaagggcttgaaataaataaaaaaataaacaatacataagtcatcagataattcaaagagaagattagcatacatcgcggcgagcaacatcaagtcgattccatatgaccataagaacaagttcagtaagctctcctctttcagcagccttctcaatttcctgcttatgaaagtagagcagcaatgtattaagaaatgaaatatttcataagtggcttaataaaaaaaaaaaactgctgtttataggaaaactcaactctgatgaccctacctaataaaaaactctttcaagctattatgttaacagaactttgatgtgtgagcctggagttaaccttttagtagtcacatacaaatatttttgccaacaaagaaggtgccacagagagaaactacagacacagtacagtgtgggtgttcaactgtacacagatcattacatataataaagtttcaattaaagttccttaataggttttttatgtacctcacactatcagctgattagtctacagcatatgccgtcccaattcaaatgtttcagattgaaccttaactgacctggttggccgttggcctaggttgtgtacctttcttttcttccttcaatataaccagttaacagttctcccgcgataacctttaaaatatatctgtatgtcacttgtgtttttagccagcaagtttgggccctgattctacaaaggcttggcttctcttccaagttccaacttgccaaatcaagacacacataagtcctctagttggtgtcgaaggctgtgaaaggtatgcagaaggatgaggagaaagtatttaactcagctcattatcttggttgcttgagagatttggaaacataggaatgattgtgttttcaatggtgcaacacctagtatggtggcagttatccaaacagtggctaatgaaggagcactttgatgcttggctggagcctcaaagctccaagagttgttggctaggtcgatagtccttgtctcctagaatgcttggttgcgtccgtcctttttttttctgttttattgtaagacttgctgttggggtgggagagtttattctaattccccacctgttgttttttttttctcttgcttaatgaaatgatgcacagatctcctgtgtgctcgaaaaaagtatctgtatgtttaaagtacctccataaaagtttcaagatagtggtctatactatttaatttagtagttcatttagtgttggcccccttatattgtctcaagctctgcccccttgttgatatgacagcacatgctggtagcttaaggcatacacatgggaaaata

SEQ ID NO: 91250 - DNA, 1710 bp, Oryza sativa
  unsure (1)..(1710): unsure at all n locations
attaataacattaatttaatgaaaggttctgtattgcagaaggccattaaagggcaagcggcggctgatttcttagcatcacaccacacatatatatctagtaaatagaataattcccagtgtagttctaataattcccagtgtagttcactggatgagcaatggcagagctctttttaaacactccctcctttgcattgagtgtcaacttcactgttttcttcaaacgcacaagaaataacattatgttgaatacagtataattttaagacaattataaacatgctatgcagaagctgtatatcgttctttctctagactgtggtagatcctttttcatttctattaatggaaatggagggctcttgccctttgttaaaaaaaattgcagaagctgtatatactgtattcaaatgaaaaaaaatattgacacaatcaacatagtatgaaattataatgtcaaaccataaacgaaaagctatacaagtcaacttacagttcacgcaaagatgtgatttccccagtgtctgcggtactgttccatttaatttgttgtcctgcaggtgcctacagaaaagagttttttttcctaagtagtggataagtaagcattattcaaatagtttgggaattgactagctaaggaatagcttacagtcttgtgagattcctcaggttgctgagatttggaataggtccagacaagctattgtttgcaaaagatctgttcatggaaatagtgttaattttggcattcactcagtttgatatatatgcagcagaacttacatatcagtcagagcggtgagccttgcaatatcagatgaaagatatccagagaggcccatacttgaaaagttcctggtgtaaaccaatacagaaaattgttaccacaaaggggaaaagaataaaatcaaataatataagcaccatgaggataactcacagtgagatgacacgtggtatttggcctttatcacatgtaactccagtccaagcatatccatgaggcatacatggatctccattccaatcatcaggtatattttgaaggcttctcttaatagcttccagggcatgtgctgcagaaattgtggagtaattaatacgttaatctaataaaaatatgcatatgcagactattcaaaggtggtaatcaagtaaaagcaacttggtgcattaccaaaaaaatcagtcaatagttcaatacagatacttaaggaagcaccattgttgtggtggtggagtcatgggtgcatgaatccacccaccaaggttcaaattctggtgtccacaaatatggatgtatggatcctagttggtgcaaaggctggaaataatacttccattatctaaatataggtgatgctacaacattaacacctcacagagttacaaagtgaaatgtactgtggcccttttttttgcgagtcccatgacctgatatgcagcaacaaatttccataaaacatattttgatgacctgctgctacatatataatgatgatttgttggccacataagtgccaccaaaggcataatacataagttgattatttggttagcaacagcttgtattgnnnnnnnnnnnnnnnnnnnnnagtcatttagtttaacctattacgaaaaaagatacaaatggaagaaaaaatatatgtagcgactgacataccatcccgaggaaatgtgtatcctcctagtgggaaaagt

SEQ ID NO: 91251 - DNA, 715 bp, Oryza sativa
ttcctgcagccctgcgcgcatggatgattatcgatggattaaaattgacggcgcaaagcaaagggaaagaagacggtaaaactagcgctttaatttagaattgatcgaggtgtagggcgatcaaatttgctagtttaattttagtttcgtcgtactattaagaggggtaatgacctagcaaagagatgattttaattgccacattaggtcattgcattttcatttgtgctctctttttcattacacaaattcactgggttcagcctgaccaggggcggtcagaccggccacatagtggcggtctgaccggcggcactttcccggtcagaccggcctcctggaggccgagatgatgctgctcgggatggccgatacagagccgacggagccgtagtcggtcaaaccgagccaatggcggtctgactgagccgaggccggtctgaccggccaccccatgtcgatctgaccggccaggccgatggggccctctgacaggactacaacggctagttttctagccgttgcagagtagcacggtctgaccggccgcatacctccggtcagaccggcagagcacagagttgggggatttcgcccccaacggctagttttggtgggtgggagtataaatactcccccaccagcagcaagggggctctcttggcacccattcaattgcatacactccttgcacctctctcacactcacttgagc

SEQ ID NO: 91252 - DNA, 1469 bp, Oryza sativa
taagtgcttccagctttgcagcttcaatcctagttaatctttttcctccctgtttaccttttgcaccagacggtggtaattgatgtgaaaataaaattttattctctttgtcttgtgaacaatctcggccgtgcttgcttttttcatatgattccctggaattacaactccccacggaaccactgttacagaaggattctgactgagcattgtaaaattcagattctttgctggcatctttctccacatgcgcttctactttcttgcagctttcttccaagagttgaatgcgtgtgttattattcttcttcgcttctagaatctccttctcaagcttcgacacgtgcttcacaagaatgctgctcagatctgaagcagaatctgttgcctttggattcctgcctgtaatctgtctttgagcaccttgtgcacaagaatttactgaagaggcttttctacctgcttctcttgcttcgtgaacttctttttcaagctttgaaagatgcttgaccaagaacttgtccagacttggtaactcagatgtgacttctttctttggttgtaggacatcaacaaagctagctgcagtggaatatcttcttgagtgtgccctttgtgatgtaaagctgttcacagactcagtttcctgatatttgcccctgtcactttgaagtacagcatttaagccagaagtggcaacaataactgccagagaagcaagttcatcttcatgaagagcttttagcctttccagcataatgttcacaagatcattggattgctgaacgttagtattgtcaaagtcagatggaaagatgcctgttcccaaggtttctttattgaatttcaaattccttttgtcttcactgttacagtccccctgatgctgctcatcttcagaatttgcatcaatctcagttacatcaggattttggctaattttccataaaagctccttaaactcttctttgtttgatgaaatagaagaattcgcaagttgaataaatgccttcttaactgcagcggcaacctccatatcaacctcaaaaccagtctgaaaggaagcagtgaccttatgagttgatcgtcccccagtctgtgacgatgattccacctcatactgctgacttgaacaatctggtctgtcgtacatcattacgcctattactctagcttcttcaaatgcttcagttgcccgaaacttggccttttccataacttcttcagcgtccttcttttggatcctgttgaaaagtagaataaaaatcagaacaaatgagtgtatcaaggaaaatacacacaaggctggacatgatggaataagataaccatgattttcaccttgctgcatgaagaattctgcaccacgatgcttcaaccatggcagctttgcgagcttccattgcctttctggctgcttctctagctgcaattttctcccttgccattcgcgtgtagtgaggattggc

SEQ ID NO: 91253 - DNA, 6940 bp, Oryza sativa
ggcgtcggcggccgacctggcggcgcgcgcggcggggcggctggacggcgtcgagcgggccgtggccgggcccgaggtgctgtggcgcgtccgcgacgcgcagacgtgactgagcgccgcgatgacgtacgagggcacgtgcgccgacgctctccggccagccgcgtccgccccgacgccggtgagggccgagctgcgccccggggtgcgccgcgccatgcagcacaccagcatcgcgctcgcgctcgtccacatgcttatccgtactagcgcctgaaaatgaagcccagctgtttgttcagctacgggttccgtttcttcattgcttttgcttgggcagtttgaggacaacacccacctgtgtacgtatgatctgaagcactgtcaaatttcgtaaaacagaaattttacttctcagacccacagaaacgcgtggatggtacttctagcgtgtgtttggttctgggactaggtgggatgggatgaaaccatccctgattttaggattgggatgattccattcgggtgtttggtttgtaaaataggacgatcccagttttttgtttggttgaaggaacaagggagggatgggatgagcgccgtttgcaaccaccgacaacgccgtttgcaacaacgatggctgacgccgcacctgccctcacctccggacgtggtcgccgccggcctccttgatggcatcgatgagcttggtctggtcggggacctgggtcgcgagcaccgcggagatgacggcgtcggcatcgcagacgagcgggcggaggagcgcgacgacaacagacgggatgacccaaccgagcactggcggcgatggtgtcggccttcgcgcagagcagccgcggctcggcgacgacgacggcggcgaggtccgcgcgggagagggagagggagaggccggtggagaggagggcgagcatggccaccatcgtggtcgggcgggcggagaagcgcgacgacgcacggtcggcccgccaccgagttccccgcctccggatccgtcgccgcaaccctccccatcactggatccgccgccgctgccttccccaccactggatccgccgccaccgagccccccaccgccgccgtcgccgagcccaccgccgccgctgtcgcccaagccgtctactgccgccgtcgcccgagcccaccaccgtcgccgtcgcccgagccatctaccgccaccgtcgccgagcctcccgccgccgccgtcgccgagcccaccgccgccgccgtcgccgaggtccgccgctgtctctcgaggacgagcgcgtgagcagggcagcgagcgtgctcgctcattcacgccgttcgctcgtcccacttgggacgagttcgtccgccagttttggccggatcggttggtcccaaatctgagaggaatattcctctctagggaccaacccatcccactcacccctgaaccaaacactcctaaaaatgggttcatcccatcccatcccatcccatcctatcctagtgtaacgttaagtagtcagcagtaatggaaactttaatcttttggtgtgatggttacactataactacaggaaaaaaatgcagtaacagccaacataattttttttttcttatattgatgttttagctaggtttggttgctttggtgataaaattgaacaggatctctgtatgctcataattcttagggcatcaccaatgtttactacctactttaagaataagggtgggccatgtgtcagtggatattagttgttgttgtagctacaatggtgaaataacaaaagtgggtagtaagctggaccccacaaccattatccatgagagagggatgagagaaatcatttgtttattgcttatggctaggtagtaagcatattacctagtatttgttacttactacttccacaatgtatacaacctggtagtagtagtattttatttcttactacccactttatatgcatattgtggatgcccttactgcatgtcatctctactcaatcctccgatctatcactgttcaagtattcaacaattaatgaggatttcttatttacgttttgatttgtatattaatttatcgttttatgtactctgacttgattcctaaacagggatttatacacaaaatagtctaaaaattaactaaagttttgggcgtaacaacggagatggcgacatggcggtagagcttgaattgttccagaaggacagcaaaggcagattcccttgggggtaaatggaggcggcgaccaagggcacagcacgagctcgctcgaggttggtgcgatagatctcgaggttccttagcaaggaggacggtaaccagcaaaatgcacgagctcacaaagggagtgggcaggaagagggccaccaccattgcgagcttctctttcaagttatggatccgaaggttggtctccatggcgatggatctcgaggttggtcgctgcattcgcctccttgacctccaaccatcgcatgcttggtcgagctcggctagcacgaagagggagacactgctaggagagagccatatgcaaagatgagagaaaaagaacattgttgatggttcttaagtaccaaattcaattatcaaataatacataaaagcaaatgaaaggatacaaaatggtataccaaacttagagttagtggttattactaaccattttcacgagatgtcagaaacaaaccttttcatttaagatcgttttcatgtccaaatattcgttgtaaaatctaaaacctattttaacaacactacattttaagcgatatcagataaaaataaactttacatatcatcgagatcaacaacattatggtttattacttttctatttaaaatcagttggagtgtcgaacaagcattactagtttattaaacaattaaaactagcgaaaagggtttgaatacaaataaaaaagtttacatttagatccttaatgtcctgtggaagggcgatttagaaagaacgtctcaggttcaaattctagattagacatgggtgctcgtatttaagactaattattcttttaatagtatgcgacgtatccgttgatagcgaggtgcccgtgctgactttatcaatctaaagatataccatcccagccattcagaggtgcttacaggggcaggtgtgtatgtgtacgttcataggtgtgagtgtgcatacgttgtgaatacttgcatttatattgtgtttctataaaaatgaagcaattttttttaaatatttcaataaaaaaagggatttgctagacaactgcctaaaaaaatgtaaaaataatttttttaaaaaaatccgattttcacatgacacgtggacaggtcggctggtttgaaaagcccgtgaacactggagttagttgacccggcccatgtgaactactccaggcccactaaaatctggcccacgtggaggagaggcgaggcccatctccatgcggcggcgcccctgcctaaccctaaacgcgatgcgataaccaccaccaccatccgcttcttcccccttcggatcgagaaaaaagcgaaaggacctcttgaccccccaaccacaccgaggccgccgcggaggaggaggaagaggaggagatcgaggatgtttttcagccgcttcgatccgtggccggtgttcttccggagggagtggaagcgctgctggcccttcctcaccggcttcgccgtcaccggcgccatcatcaccaagatgaccgccggcttcaccgaggaggacctcaagaactccaagttcgtccaggcgcacaagaagcactgatctgatccgtgcctccatggtaaatccccccgcgcgcctccttcctcgatctcgtctcccctccggctgagatctggttctttccgctgtcctgcggtagatctggtttgtagaaactatttgggggttattattgtttgttcctgctttaagctgggcatggtatggtgtgatttggtttcgatttgaatcgaatcgctaggattgcagcaacatcacttcccgcgaaacgggagagtaatttggggggaatcaggagataggattaggggggaaaatgtaggaatcttctggcggcacattctctatgatgtgattattaattagtccatgaaggtgaggattaggcaactttgctcatcgatattgctccgtgatcaagatagcctaagttttctgaaaaatgcattaagggcatagcaagtggctaattcttaaagcatggttgagagtacaattcaacttcttttttgtagacagatgtgcttttgtagcctgtttccttttgaagggtagcagaaagtcccgattgttcttagtgtgctaattttaccttctaaacttggaagaatggaacatacgcaaatgataaatgtgcttctttacatccaggcattcgtaatcagtatgaaaaggatgcagaatacattgacgctacattttataaataaggttttcttttctaagagaaagaagggtgcgaaggaaaataatgctgcgttccaatcctattcataatattaggggaatgctacaggacggtatcccgttcggacaggatgatacctcagaggtatcgtctgatacccaggtatgccaatacctagtaggtattggcgataccttgaggtatcatcatgtccaaacggggtatcagccgataccttagatgatcatcccgtctgaacgggaaaccgtcccgtagcatttccctaatattattgtgatacgtcttggaacataatgtttgggcagtacatagggattactatttaataatatacgaatgttgaaaaatagtttcatgcaaaagttggaaagggtgtatgaaatgctgtaatacggaaggaaaggtggttcttactccacgaacgcattttctagatatttatatcaataaaatttcctcaatcaaggtgctcatgtacctgtagatccgtttattgttgcttcccttttatttttcaaacaaaagctgatcacatatcaatttctaaaccagctaactgtgatttaaatttttgttgagtattgcacaagggattccaatcactaatgtaaatgtcttgtatccttgtaattcaaacctatctgatgcttcagagcccaactaattatgatcaaaccactgtttggagttactgtatatggttccttccacatcaatggtatttttgccactcatgggtgttgtatactttctggggctgggagtattatctcagaaactgttattgtattgacctggctggctggctatatgccctactctgtttgattttatcagcagctcatattaccttcagcacgctcaaattgttaacatctgtgaatgtgtatttgtttattgaggtacttaaggattcattgagcaaatttgttgtccattggacacaagcttatcttagtgtgcttccagaaaaaaaaatgttttgtcaatgtgaactttttttgtgaatgttttgaattgtgcatttctgctatgcactgcaatgatcaaatcaagctgtacagctgctgcttttgtttgtaattgttttgaagccctaagggaattgctgttgttattttttctagaaccataggtagcaagtaaaaacatgaaggcaacatcattcatactctttgcttgatagtcatttggcgtattttgtaaaatttggaaacctttctttgcatgcatgacatgtcaaattggagttcctaatttcaggtatcctgtttatggaagtacttactttgcttaaccttaccatatctgcaggtgaaggaacagctggtattgcctaagtcttcagtttggcctatttttctgttccaaatgaacctacctgttttttgtttatccatttgggtggacaaccgctccagttgtatctaataagaggcgtttgaatctttggaccaaaaaatttgagcttctggtataaacctgtaatactcttcaagtgccatcctgcttcctgatttattttttgtaaaagcttgtatcgatggtaagtatacatcgaaagggctttcctggctggttgccaaacgttgggcttaggcacgacatagtttcttgggcaagacatttggttcattgctgtaacttccgcacacttgtcttaggcacgtttcttttgccaaactttgtctaaggtgaggcgagtaaattgctagacacaccgtagacaagatttggccgagaagtgtcgtgtcgaaatgaaccaaatctgcccgtaaaacttgcagcgtttgttccattcccatttaaaacacagctttgggtttatttgtttgtgtgaagcccaatagaaaaatttcagtcttccggcctagctacgtaccggtttcagccctacttgtaaaagttcttgttatgcatcggtttgcacagcaacagcaagactacaaatgcaaatagaacaaggctgcagagttaagatcccattatttctgcgtggtcttgatcgaacaaaccagctcatagctcagattactctcgaaagacaaatccagcgtccgtcgaacgttgacttgaaaaaactggctctgcagtgcacttgtatattagaaaatgcacatgctccagttcccataggaagaacaagttaaaaaagaaagagcgacaaaagacgtcgacggaacggacactaaaacaactccaaaaccctaacgaaggcctacaatggtagacaggataactgttgccaagctccagaatatacaacagtttgaccttgcaggatgggtgtgtgtgagttccaagttcccaataggtgaggaaggactaagacagtggacttgagaatattagtattcctcaatcttagacagtggtttcttctccccacgaagaacacacacccctaagaataaaactattgctcacatcaagaaataagaagggagtgcaattccattaatgccaggggcaagaaggtatcaaggttttg

SEQ ID NO: 91254 - DNA, 804 bp, Oryza sativa
acccagggcagttctcgcttaggtacctggcaggctgaccggcacgatcaggtcctcggcgccgtgccacaggtgcaccttccctttgccgccggcgaacgggtcctcgagctccagcgggctccagctccacttcccgaatccgaccgtcatgtcgcggtgcaggcagctgtactccccctgctgccttatctgcggctgcgacgacgacgacaacgacaacgacaacgacacgcaaaccgatgagcaaacgctagttacaactaaatatgcaacgcaagtgatgaagcgatccggtgatccttaccatgtaggttcggaaggcgaatttgggcatgatgagcttgtcttcctcagagaggagggccgggttgtaggcgatgacgctggaggcagggaagagcttctgggagttccaccagtaggtgagccacggcaggtggtgggagacccagaccgcccacttgtcctgcgggagctgctggttccaggcgtgccacgacacgttcgacggcaagccggaccaccagtagttgcccacggggccaagaatggccaccccggcgagcctgcatgaataaacacattggtcagaattcagaaacaagcagtcctgcactcctgccatagattttccggagatgaaaatggtgatcgactctacctgtgtgagatgtgcttgaggcagctccacatgatctctccgcccatggagaagcccatgaggtagaacttggggcccagctgcaggttgtccgcgagctcctcgacgtccagggctatgctcttctctgtacttgccgg

SEQ ID NO: 91255 - DNA, 672 bp, Oryza sativa
cgtgacaagcaaattaagagcgctatcaattaatttgttgaattaatatcaagcaatgtgcaatgctacaactcgtcgttctgagagtccgcggcggcggcggcgctgctactctgctggcacgcgccgttggcagccaggcttccagccagatctcgtcgcgcacggtggagtcggcgtcgtcgttgcggtgccacgtccagcgcgcggcggtcgcgttcaccacgctcagccgcccgtgcccgaagctcgcctccctcatcaacgagagcggcgccagcttgtggttcttccgaaagctgatatccaaccagatttagccgtgagctatggttagctatcaagatttgtaagttattttgccggtgttaatgtttagtgcttactcaaatgcgaggccttccctgttgccgccgtcgcctatggtgatgtgcaccggtccacacgggttcgcctcgttgttatatacccttgtctgcagcgacaaagtcaagacgtgcactgcttagttgagaattgtacgtgtgatcaaccgttcgagcaatggcgctgatcaaaatcgaactcacgaagcgttcgtaggcgtggacatggccggcgaagacgatgtcgacgcgggcctcgtagaggaggcgctccatggctttcctcatggcctcgccctccccctcg

SEQ ID NO: 91256 - DNA, 634 bp, Oryza sativa
cacatttttcacttatatactgtgacacatttctacataaccttttagtctgaatatgtttgactgatgctgatgtcattttcatgcagtgatgtcttcgaatgactcaatgggtacagtctttaagtgtttgtcaaaaggagcagttgactttctagtgaagcctatacgtaagaatgaacttaagaacctttggcagcatgtttggagacgatgccacagtgtaagtttgtttttttttgttggcctacctttaatgtgggatcaagtccccaactctccgtgtaactcatagtattttgattctaacttctttgtctgaatattttttatgtgactaatctgaatataatttgtctatttgtaattcagtccagtggcagtggaagcgaaagtggcatccgaacacaaaagtgtaccaaaccaaaggttgatgatgaatatgagaataacagcggtagcaataatgacaacgaggatgatgatgacaatgatgaagatgatgacgacttaagtgttggacacaacgctagggatggcagtgataatggcagtggcactcaagtaagagaccgtttactacttttcgaaacagtgttactcttatgtgttatgtctatcgctagatatatat

SEQ ID NO: 91257 - DNA, 5043 bp, Oryza sativa
ccgcaaggaggacacggtggccgccgtccgcgagcagctggagggctgctacctcctcgccgggatccgctacgagggcctcacggtgaagcagctgcagggcatccgcgacaccctcccggagacctgccggctgctggtggcgaagaacacgctggtggggaaggccatcgagggcacgccgtgggaggcgctcaagccgtgcatgaaggggatgaacgcgtggctgttcgtccacaccgaggaggtccccgccgcgctcaagccctaccgcgccttccagaaggaggagcgcctcgaggagaccaacgacttcgtcggcgcggtgttcgagggcaagttctacgcccccggggacttcaaggcgctcgagacaatgcccagccgcgccgaggtgtacgccaagctgctcggctcgctgcaggggcccgcgacctccgtcgtcaccacgctgcaggcgccggccagggacgtcgtctccgtgctctcggcgtacgtgcgcaagctcgagcaggaggtcggcgccgcctgatggctgttgagagatggttttgtggcttcgtttctctcatctcactcatttcttgtagaattcctgtacttttactgcctcacgtttgaattgaatcacaaaagttttacctcttacaacgcatgcctactggtctgatttcataagattaccgagttctgatgttattaggattacgttgcgtacttagagggaatgcttgttccacaactagtgttttgataatttaattttacctgtagagactacagagatcaaagtttagtaggttgaggggcaatggcaatgcacaattagaatggtcaataactactagtgcttgtgtagttgtaccatcaatcagtgtatccaggtttacaacaaagttgttcaaagcagtatgatgagatgttttaaaatcatgaacttaactgtgctctttttgttaagagcaaacctccttgaagtgaacaaaattaaatgattaattcatcttttagtaacagaataacactaattagagttggaaattcttctgaattagcttctgaaacttactgttggtcaccagctcaccacatacctaatttgtatcatttctgtctgaacgcgcagtggatcaagaatagaattggcaaaattgatgatcacatggtcacttatttgtttgatactgatttcttctgacagtcatggtattgtcctaggttattgtacttgagtgatagttgtagttttgcaggagtgactaccaggcatgtcaatatgccaatatcattcgcccaatggataaggatgtgagaggctcttgagaatatagaggaaagcttgttaggaccaagttgcagtcttacggatgtgaaattgctttggtatgggaaaccatttctttggtccattcctgaagatcgtgttgtttggttataaaagatacataaaagatacatatgtctctagcaacatattgtgatttggctgcttaggatctattgcaagctaaagtggaatacgtgcactgccaccaagcggttgtgaaataaagtatcatctggataagtgctttcctcaatctctgaattcttcaatggaactcagcaacatgatcttgtttgtctttaagcttttacattaatttgaaatttgtttgcaatggcatgcttagacacaatttgaaatcatagttattccatgatgtataataacaaaccttcttgtacagtaaatttagtcctgattgatgtgtaaaagtaaatacactgctacagcctcattatataactggaggggatttccatggtgcaaatgtgcatttgcttgaggtctaaaaaaatggtgcaattcttttgacatctaactaacatcagagttgtattcaacacatcattgcatctcagtgacactgatgaatattttctttactttgtgggtccaaacatattaatgccttgcatgcactactttattcctgcagtgctgtatctccaaacagataaacctaaacaagttttcccttcatgagcgaactgttgctgtgttggtccttttgaatttggtgatgcattttacgttccttaattaggtctaaatttactttatgtgaatattactattatatgtaagataatgtaagcctgattctgttcttgtgttgataaagctgggcaccaccatgtgagcgcctgattggcttcgaaagctcacacctgttttttcacctaacttcgatgcggggtttaccacttgactgatgaaggaatgttagcaagttgccaaacactcttgaaaaggagcagattcttgcacagctgctttgtgtgatggcaccggcgacctagcatgagcacatgacacttcctggtccaggttcttcctactcgttggtgtttcacgaactcaatagtcctactttttttcccttttcttaaacgtgttcgatatctctgctccttcaatatgcccgtttggccgctggcaaggtgagcagacggcttcgatcacagctgctcgcttgatcggacggtccgtttgtctcgttggacaatctccaagcgcgtaccagtgtaccaccggattgagactctgtaacttacttttctttgacatgtgaaccctctatccagcgggtctatatgtcagtgtctcaaaaacaaaggaaagtaagccaaagatcatcttccgtgtaccactaatgtatcagcagtaacaacataggcgccgctctcagaaaaggaccaaaggggatcgctaattagcgcacgtacattttcagtgtacatatttttctccttcttagtagcattctcatataaaactttcaacttcaactcaaaatcatacgacttttagctcaaattatatggaacttccaaatgtagatttttgtttgcaaactttttatatgaaagtgtgccttaatagcacacgtgcactaattagtactaatcctaaatacacagaaagctaagggtgcatcttttttattatggttttaccggattagtggcacgcgaaacgagaaatataattagcatatgattaattggtattaattattaaaaacataaaaatattttttggtttttcaaaaaaaaaattttatataaagttttcacggtaaatacattatttaaccgtttaaaaagtgtgctaacgaaaaataagaactaagagcagcttcagtgtagggagaaatcgaacaatgagacagaaaaatcgaatagaggacactgagacagtcgactggtgcatatcagacgaaaaaatggactccaaagaccgaaccatactgaaatagatagatacggatgtcaggccaagcatagcttcatctgtccagagaagaagcagcctagatttattattattattatttccttgaggccaacgatcggatgcagcactatagctctagatcaaattccacgtcaaaacgaccttataatcctctaaaatcgagttagcaatttaaaacgcgccctaagtcccctttaggcaaaggtgtgatacacaattcgtcttcctctccagcgctctccctcccgccgcaacgaggaaaccaccgcctcaggatggccccgcggccacgtgaagcgccgggccggtgcgaatcagctagggctacagctcatcatctcgccgaagcgatcaaccaaattattacgcgcgattggagacgttgttcagccgggagcaggagcagcagatcatctgattgatgccttccatgctgaactttttgccagtgctgtggctatcaaaacggcaaaggagaagggtatggcgcgagttgaactggaaacagattccctgatgctgtgcaatgcactccagagcaactctttcaacttatcagtgatgggtggagtaatccttgagatcaagcatgtgattgctagctgttttcattctttctctgttagttactgcccacgaaactgtaataaggtagcgcatgaattagctgctttgggttgtaacctttcaggacgcttcctcctggacaggctgcccgcctgggatggaacgactggtgaccagcgatttagctggatcagttatataaagtttcggtttccctaaaaaaaaattattacgcgcgatcgagcaagcgagcgcgcgcgacgcgacacgacgccctcgctaatacgattacactaatacgcgtggcacggcgagcgcgcacggcggcaaaaggctcggaccgcggccacacaaggaaagcgcgcggagggtgggggtgaaagatgcaaaggcggttcagacgcgggagtcgcccaaaaaaaaagcaggccgtctcggccacagccagccgtccgggggggataagcgaaagctggagcccgtcgccagcagccttgtggtttgatcctgataccatctcgctctccacaaaagcacgagtagcattcgatcggtcactccgttccctgcatctgcatgtgccctacttacatttcatttcattcacctgctttaattttgtctctcgatcgcttgattcagtggctaattatagctccaaaaattaccgggtaatcctagtgctcataacgaattagtaatactctaattactccaattatcaagatcgcagatttcagcgtgtatcttggttaatggatgggcagttcgtgttgctggcttgctgctactttacaaggaacatgcgcactaagggcgtgtttggttgctgccctggcgagtatttgcctggcctagagctagctggattggttgctttcctgaatggtgtccatgctcaggcaagggtgccggactcaggccaccaaaaatgaacacctgagtcaggcgtgggtatgtgtctgatcctcccccattgattcttcattgatgtgactgctattaacacttgtcaatatcttactcaagtaaacaaaatgtttatatataatatattcactcaggcgtaggttttcaaccaaacaacaaaacatcacacatgcctggtcaggcacaataaaacacagcttttctaccacacaggcatagatttttctcaggcaagtcactca

SEQ ID NO: 91258 - DNA, 623 bp, Oryza sativa
aagtcaaaaatcgtatgaggggctctcgccagtcggcttcaaccatagctacatcatgggtgcgcgcaacttgagtagcatctttgtgaggtactgtcggcgagtagaggtgttcgacgaaaacatcagagggcgccacctcgcgcttggatccaaaattggcaagtctgtcggcggcttcattattgtgtcgaagaacgtgactgagctcgagtccatcgaacttatcttccaatttgcgtacctcttgtcgatatgccatcatgttgtcgtcaaggcaggaccactctttcatgacttggttgacgaccagctgtgaatcgcctcgaactattagacgctttatccctagggaaattgcaatccgcagcccatgaaggagggcctcatactcggcgacgttgtgggacgccgaaaagtgtatccaaagcacatagcttaatctttctccagttggggaaatcaaaaccactcctgctccagtgcccgaaagtcgttttgatccgtcaaaatgcatggtccagtgctccatcttctccgcaggggtatcctcctggcactcggtccactcggcgacaaaatcagctaacgcttgggacttgattgaaattcggggcttgaat

SEQ ID NO: 91259 - DNA, 2521 bp, Oryza sativa
ggggctatattctactcagttagcaaaaacgagtggtagtatattctaatgattgggtgaacaaaatgacaattgatacaatttcttcgtacggatgtgaacactactttagaaaagagtataaaaaagtgttgtttcttccaagggtgggccatactttaataagtaccaggatcgaaccagtgaattactacattccacaaagtaattcataatgtctaatgaggggagtatgatctttaggcaataatcggttttgacactgttgtttcacttttgaggaaaaagacacttttttcttgctgttgtgcctgactaaggttagcattgaaccggtatctttctgatggctttgtccgcctattttcaggtgcgctatcagagcagaaagaggttggctgagcagcgccctcggatccgcgggcaattcgtgcgacaatctggacaggaagatcaggcaggccaagacgaagacagataactaagaaccacctacatatccaacatggcatctgctttgacagctggagagctacgcaattcattccatagctgaaagcagctcatcgatccccacattggagtgctcaataaataaaacccatatgattattttctgtgcctgactccagatgaaatttgtgctatggagtggaccacgcatttaattttaatatggcaatcggtaacaacttagatgcgatggttatttgtgacctccagttcccttgcagagatccacttggacactttgtcgagtctaaggaggagcaaaccatctgacgtttctatcggatcatgaatgctaaatctttactctactactacatcgagctgacatcagtgagggttcaactattcattgcgagacattattttcaagtcaaatagtacatacttttctgctggctgcatttctttttcatgttaatttccgctggctccaattttgtggttgactactgttatggagtaatggcaaccccagtgcagtaatgacggtttctttttaagttttgctttagctttgtcttgtaatgaacctctgtgatgtttgggatttcttacaaagccggatgctgacgatctttcctctaaaaaaattgccatggtaggctggttcagataactttctggacaaaatgctttcgtcgttttgaacctgaaaccagttacgctatgaaatgatgcaactaacgtagtgtaacgatgcctatctagcacggttgagtaaagacaatgctacatgcgggagaacctcagcttactggttcttcccaataaactgaacctactggtttagtcctcaattgatacattctgtgaaaacatttcatgaacatttgcctaaaatacaggagcgacacgcattacaacttccattgcttctgtgattcccgtgtctaccgaagtgatacatcaatatgcaagctaatgtctgctcccagggtagaaaaagtcagcgccgttttccttcactctaaaatggaagttccaaattctctgtgcttttagcctttgctccctgaatgtacacttgtttaccactgaaagctgttgaaaatgtttgagcaacttcaatagttattataaatgaaatatccaaccctggtaataagattctcatgcaagtttatcaacaattgctacattttctacagcgtggactaataagggcaagaacctacctgtccatgaacatcagcagctaaaccagtgctcaaaggtgcagctctgatcacaagatctgcaatgtagcgcagatgcaaaaggacccccacaccttcctcactcgaatatatatcctcatgaataaggaagaccaacgagcaattctgccaagtcataaacaaaaggcaaaaaaaacatgagtgcaaggcaaaaattacagagatctcagcaacttttaatagatctaacatttaccatctcagaggtaagtgtaacacaataatgcaagaagtccaacacatcatctacagaaccacctgctgcaacttctaacagtgaaacatcatcgatcatgagagtaaagcggcctgtattatctcctgtcctgctagcgtcgatggctctttgaatgtcaccatacagtctaacaaaactatcagaaatggcacctccctttgctccacctgcgtacagaagcaaagcaaacctgtaactcagtaattatgcctttatgcaatatcatttggaacgaatacaaggcattgatgtgattgcttgcctgggaaggcctgcaagtcaaaaaaatgaagcctctcactcttcctatgcaaggataggttacagccctggtaaatttgagaagaaatcatattacatgctatatttcaactaggaaaggcatccattatgcatagcactgtatagcagcttgtccaaatcaaggttcataataacggtagtggaaaggaattcatgatttgtaataaaacggttatcccattcccaccctccagtgtaccagtagaaactttactaggaaatttatcccatctcataaggcgcaagaact

SEQ ID NO: 91260 - DNA, 3110 bp, Oryza sativa
ctaatgtatctgggtgaacattacgggtctcaggtagaattgaagctgttagacacaaaaggattgctgtagtatttcctttcatgtatattattcctctcgaattcatgctattgttaaattgataagaacagttagggtttgcttaaggaaaatgtgaaagtgtttgatgcatgtatcatctacgggtgttcggcatgcatttcggcgtagtaacaaggaagatgtccaagtcaatcattatcctctttattatcctttctgttatttggttttgtccttcttagtcagtttggtgctcttgttagaacttggttgctgttctttcttctgttgcagctcttttgtggcaacttgatctctttgtggttgtttgtactttgctcttgtagcagactactctctttatctccaattgaagtggcctcctgtagcatttcaatttttttgtctgtgaaaattgatagccgtgactcgtgagaagatcttgtagggtctaattcacttgtgtgccactctaattctcgaaccatgcaattggacaggaggtggctataaagattcttaatctacaaggcaatcaaggagacagggagttcatcaccgaagcttcagtgttgagtaaactacatcacacaaatcttgtcaagcttattggctgttgtcaggatggtgatcagaggcttttagtttatgaatacatgcctttgggttccctgaaaagtcatctccatggtatgttagtatgttacaaactagtaacatatatagttccctccttcattacactgcttctaaataattagaagtttgtctaatcagaactgggtcttaatttttccagatctttcccctgataagaagcctcttgactggaacacaaggatcaagatacttgtcggggcagctaaaggcctgcagcacttgcatgtcaatgttgaccctcccgtcataaaccgcgacgtgaaatctgaaaacattttgcttggagatggatatcatccaaagctttctgactttggcttggcaaagatgggtccaactggtgatgacactcatatttcgactagagtgatgggcacacttggatattgtgctcctgattatcttgagagtggtaaactgaccgtccagtcagatatttacagctttggtgtggtcatgttggaggtcatcacaggacaaaaggttatagatgacagtcgagctaagcctgagcgaaatattgttgaatgggtaagccatttcttcctgttttaacttaattgtgttatttgcttctcctgcatgcacaagtctgctcatgaaagagcacataacactatctttatataattacttcaactatttgatcatcttagacttgtgtgcttctgttatttttatttcgtctcatcattgcagtcgcgattttttttagtcttacatattatgtcatgagagaagtagccagtaaagatcgattttagattctagcttcatccagggtttattttactcccccacattcaacttatatcctttggccgaaatctattttctttgtgtaccttgaattttaagcaaaattggaagataccaactgttaacaaaggagacaaaacagctgatatgttaactgcttccattatggctcttacatgctttgttacgagttattctttcgccattaatttgttgcataatttcaggccatccccaagatcaacaaaaaggattttcccaaattagcagacccggtgcttaacggtcagtaccacatgaggtccttgttccgggcccttactgttgctgctctgtgtgttgacagaacagccaaccggaggccagatatcacagcagtagttgatgctcttactcagatctcagagtcacaatccagcagaaagcggtggtcatctcgtctgcaatcatctgtaggttccagtgcatcgactgaaccgaggatagaagattggaaccaagccaaggatcagggagaaggcagctaggaagcccaattgcagaacagcaacatggtttccctgtcactattagtctcaagccttgctctttgtgtcgtgagccgtgatggttactgcctgagagtagtagaaactgaagaacagcgctgttccatttcggaacatatggttgaatttctggagggaacttctgttccttttcttctgtacatggatgaggcttgtcattttgttgtctttcgacatagagctccatactccgaaagcatctccagatggtttcatggcattgctcctatgttgaaatcaggatgagatgggtctcacgtttgcttccctttgttgtatggatgtacttaaaagggattaaagttttttttgtgtttggatacaactttgttttaaggttacaccgaagtgtcagttcaacctctgtccatttgttgtatggatggacttaaaaggggttaaagcttctctctttggatacaactttggttcaaggttatacccaagtgtcagatcaaactcagtccatttgagtatggatgcacttaaatggcgttgaagtctctctttgcattcaactttgctctaaggttatattttgttttcagtattcctcttctttcttgttttggccaattggccgcgtaactcttgaccagccatcaataagatggttataaggtagagtctctctacctttcagcgtcaaaaaaatatctaagtgcttgttcaacctgcccattccgggcagtgcagatgcttcgacttgtctagtttgccaagtcatatgcaatcactacaatgttaagagtgatttactgtcgttaacgaggtaccggttttatactttgtagataccttgaaccataaaatttctgtgttatggcagtgacagcttgcgcataaatggatatgtctggtatagaggttcaaggaagaaataggcataatctcaccaaaattctgaatgaccattcctgatttattatatgatccagtggttgattattattatttatttatttattttaaaaaagagcattctcagtggagactcggtgtttacacaacatatgaaattaatatgcttaaggcactcgtgtgaaagcaagtcacatgaataaaaaaacatcattt

SEQ ID NO: 91261 - DNA, 2848 bp, Oryza sativa
aatgaacaattgtacctcaagtttgtatcatcttcctagagccatttggctcatcatgatgttaatattttttttcttttccaaatatgaaataaagaggatatcccctttttttttactcaaattaagtcgtatcttgaagcattaaacaaatcaaggtaccttgcttttctctagccaaccaaggcccctagaaagcaagcccaatctcctgttaggtgcatcctggttaggatcttgatttggcttcccagactgaggggcagcacgaggtgaactacaaaagaatcccgagtaaacgaagtgtcaccatgcaaagacagtgttagaaagttgaatgttaaaaaccaacaagaaacatcagtaatatgtcatttgtagctaaggatgatttatgttaataaatgaatggagtactgagaaaacgaaaaggaactatctgaagcatcaccactagcaagtatgatacgatgcaacaaaagcaaattagtcatgcccactgctccctaaatgcttaatgtgtggttttgtaaaactttaggaccataaatacctgggattatgtgccacattccgaaattcctgtggttttgtgcaacttataccataataagtgtgttttatgaaatttacttaattaataattatcatttgatcagaactcatccatgatactggacatatagcataggagtttaaacataccttggattgaaggactggttggccttaaactgccctgcctggtactgctttgtagcttccaacatagtttcggccattacagctctcttctccatttgtcgaagtgctgccatcgctgcgtcatacttctcctgaatgtacgaggaacaaaaaggttatgcaactccctttttacagatattacaaattgtacgtgtaaaactagcagtttgagagaacatcttgaagcaacctggagcaactgagcagcatatttcttatcagcagcatctctctcagcagctatgcgggcatcttctgccactttctgttcctgctccattcttatcaaaacctgcaggcatatgtaaatatgtatatattttagccaaccagatggcataaagcacaggcatactaagctgtaagatagaacctgaagcattgcctgctcttgctcttgcttgtctgcaaaggactttcgcaactcagatacctctgcctccaatttctcaacctgagaatcttttctaagtcaagaatgaatgtgcccaaatttaagcccgaaggacaaaacagatttaaggactataactacactactactaggtaatcttcaagcaattggttcaattataaagaagtcttggattgcattaagttgtgcagtcctggaggggaaagagaagcagttgtagataacatcttaccttagcactcaacatatgtctgttgtcctgcttgaccatttccatcaaagcagtttccaactcctcgcttctgagagcatgacatgtgttaatagatcatgataggagttggacacagtacaaaactaagttaatggcccaaaacattacagcgacaacttagatgaaagtatgcatgaatttgacgaagactttaccaattattttagatgcaaaaattatttaaaatttactgtgaaactgagaaaagggggaattattcttaaagaactaattactcttgaatgctgggagctggcctatctggttggaaagaaccagacacatctttgatggaatgctccaaataagtttagatggagaaattccctccttaacgatttatatttaagagttccgagttttgcaggttgttatatctagcagtggctgggatagcttccgtactattgctattcttctttgtaactatacctgtacaatttaactatgtggataaatagatccagaatagaagcacaacaaacctgagttcagctgatcttttctcctcgagcagtttgcacagctcaactttcaaccatgttacctgtgagcattgcttgagtagttgagtatagaaattcatcatgtttaacataagaaaaggtaactaaaaattccatattggcaaaaaaacatctgaatattaagctcagaaaggaacgtaaatattgataggaaccattcaattatacagaaggaccgtgacacaaattcctgaatgtcaattatcagaatgaccaataaatttgaatgcatattataagcacattgtttttttgtttctgttagagaaaacatcagctcattcagtacaaataaatcagtacagagaagttcttacctgatcttgaagatcaatgccctcttccaactcattatctagagctgaactagtaaggtaggtttctagatttgctgacccagaatctaaaaattgcatttccccattcacttgcaaatcatcttccccttccttggaattaacttgtgggcatagaggatcatgtttaaagctgtaaagtttagttgctaaacccttcttatctttccaagaatggcggtcttttgatctttcctccatagcagatataatatcaggcctgtgttttttccttaactcctgcagccctatttccctgactgcttgaaaacccatacaagctgtcaacacaagttgactgctgtcaaaagtagagccagcaagagattgcaataatgtaattgcatctccagcatcctttgtggtcaccagggcaggccctacaaatcaacatacaaagacaacagtgtagattacacttacacatcaatgcttattagaaaagaacaaataataggaaacaatagctttttcagggattaagttataccatataagtcgagcaaagcaagcgttgtccggaacaaca

SEQ ID NO: 91262 - DNA, 2495 bp, Oryza sativa
gcctgcgaagatgtaaaccctactcggcataataatcttcgcaggcagaccggccgcctgcgaagatatttgcaggactgactctttctatttcagaattattttaaaatcatttttgtgatttgaaaatgtctacagtggttgtaataacaatggtaattgtacgtacaaatagataaaccttagtattactacttttcaaatttaaatattacttaaatgtttcaaacattaatattacttatatgtgcacttaccatttttttaagactttttaaaataagttttcaaacaatcgtaagtgaacataacaaaatgctactaaatttttaaacctcttttagaaaaaacttttaaaaaataaaaaactgtaaatgtcaccctacaagtggtaattgcacataaaattagtacaaactcatatgaaaaatgttgcgtgcaattgttcgtcaatttgtgatatgatcacacatcaccttacataccaccattacataactactaacttcttagatgcttacatgcactcaacaatcattaccctttaacattttttcccacaccgtccgtgcgcatgtaaggcttcacgatcttctgagtagatgtctcgacattcttaatcttctgtacaaactgattataaagtggcatactatcgtattgattgtaatcttcgacatcttcaaccccatccactcccaatatcttttgtttcccgggtagcactatatctttcttcaaatttgatgggtcttttacgtaaaacacttgtgccacgcgattggcgagtacccaagggtcatccttgtaacccacactcaccaggtcaaacgaaagtaagaccgaacttatcaacattgaccccgttcaggtattttacccactggcacttaaatatggggaattgcattgtgtgcccatagtcgatttcccatatttcttcaataaacccgaagtatgattgtttttccccggcttcataaattgcctccacacggacaccactgttttgcgtacaggtcttattatctcgggctcttgtactaaacaagtatccattaatgtcatatccctgccaagaatttactgtagttgatggaccacaagccaaccgcttcatagttatttcatcggtagtttgttcctcaggtaagtctaggtctcgcaaccaatctacgaagagacgcttgtgttctttcattatccactcggtggtgcgacccttattgttagctcgtattagttcgatatgttgatcgatgtacggctcaacgatagcaaactgatgaagcacgctgaagtgagcttcttggaatgatttgtgatcatgggtgacgaatctcttctttcctatcgttcccctgccactcaatctgccctcgtgtcagggcacaggtactccaattgcatatccatctttgaggtaatcgatacaacactcgacaatctcttcagtactataaccctcaaccatcgatccctctggatgtgcacgatttcggacataacccttcaaaactgccatgtaacgctcgtatgaccacatttgatggaggtacaatgggccaagcgcaaccatctacggcactatgtgaacaatgaggtgctccatcatatcaaaaaatgacggaggtaaacacatctcaagttggcactgtgtctcatgtgcgaatgtacggagatttcctaactcttcgagactaatgaccttctgtgacactgtgttgaaaaaatagcacaaccttgtgatagcaacctttaaatgctccggttttatggcccttattgcaattgcaagaaacactgtaagcaagacatgacagtcgtgtgaattataaccagataccgacaaatctttcattgaaactagtcgactgatgtttgatgagaaacctatgggcactctgacatcacggagtgagttgcaaaatgacttcttctcctcaagtgtcagtgtgaaataggctgatggaagatatactttgccatttttttctccttcttgagggtgtaactcttccctgattctcatctcgactaggtctatccttgattgcagaccatctttagtcttgttcggcatgtccaacaatgttccaactatgttgtcaaacacattcttctctagatgcatgacgtctatggcatgccgaacctccagatgtttccagtatgggaggtacttaaaaaatatggaatgcttcttgactgggggagggagtttatcatctggcttcgaactatcatcttccttcttactatccccttgtttcgtattcttctcgggtttcttgcgctttgtcccctttgatggtttcttagtcacttttccaaactcgcaaacaattttctctatcattgcacacaccttttctcccgaggttggtttgggtgcaggatctgtctcttcagtgccatcgaactccgccttcatcttgcggtacttgtgatttgtgcgtaggaaccgccggtgccgcatgtacacaagggtgcag

SEQ ID NO: 91263 - DNA, 2297 bp, Oryza sativa
agttttgggaagaaaaactgttggaagttttctagcaatcccctccaacaacattgaggcccatcaactcacaatgattgcccatcaacagtctggttttcactacacatcctccaatttcctgtcccatctccatttcgtgggcctttttatttcttgtttctggattgcaaaaagtccatttggactccctcaaacataggtcaaatatgattcataccctctgccgtaatatcctatatattgaccttccaaatattaacaacagtgtaaaataaactctctcgatggctggaaggaggcaagcaaatgaagagaagcatggagagccaactacaagaagcaaagctttgtaaactcgacaagtctcttatagaatgcggactactttttttcaaaagaggggaaacaaaacttaacgagctttaattggctgactactacataagccgttggcggagaaagctcgaaccttcattcgtagctaagccaaggtttcaggtctccaagtcagcccatgctttttcgaagaatcctacacccatgagcatggcaggccttccctttgccggagcttcatgggcgttgccccggggatgactgattttgtggtttaggtgtgtaattcgtacatctttataatttagtggtatttcagatattttcctaatttgattgtgaaatgtggttcaacattattgaaaaagtggtttaatacaaactgataacttacagacggctttggaacttggaagttaattacacatagatagataagcataagccaactagtgttgaattaatggatagtgggcctaaactccaggccctcaacgatgaggccaattttcttgacatggtcgttcacctcgcggaaatccaccatcaccgctgcctccgtgagcatcctctcatcgttactgaattctgccagcttcacctccatccagccgtcgtccctctcggtagggtaggacacatcggaggctccgctgcgggctgcaggatcaacactaacacggctggtggcgacgaccctctcaccacagagccgcagagacgacgtctaaacaccttgcaggccactggtgccactggttagattgtacactaggtaggctgcatagggtgtgtcgatgactgccaaccaatgcacgtctagcagctccgcgcactcggcgaatcttgtcacccagggtgaaacgatagtgagcaatctaagtttagattttgaagactggcaagtaaaattatgaattttggaaggtcatgttggtaagcaaacctagaattagggagggagatccatctccagtgtccgggcgtatctccccacgttatccttaatgatcttgatacccaaaaaatctgttcacattgatcaaatccatgttgcaacatttctaattaattaattagtagtaagtaacttcttcaaaattccggcacacaccttgttggttggtggtttggacaatgatggaactggtgagaacacttcgtatcgctcgactcgagttgatggttgacgggaaaaagttacagccatcaacttcaagtcattcatcaacttggagataggagtagaacttatctgcaacaaaatagaaatattaaaatacattatatgaaatcaacgaggctctgatcctgccgtacgtacgccatcaacaaagaatgactttattatataacgtaacaacgaaaactataaatatatgttctattaatttttttgttgaaaattaattagtttaacgccaacacaaacatatggtagttaaaatgtctgtaaaactagtaatttattgttaaaccaaaagctaacatgtattgagtcacatcaccataaaaattttaaccattggagtgctagctatagtgctaggaaaaactgggtgatgatacgatatacttgcatgttgaattttaggagtcagtgggtatctaactttatagtaacataggatatatgcttaaatttgttatacattattttgtaaaccctgaatacccttgctgaaaatcgtgactctgccatatgcgtgcatacctgcgctagcacaaccgaacaagttgcatggacagtttcagtctcctcaagcttatggaggatttcgagggtagcaggcctgttgtccagattagtatcaggaaaaaattttgaaattatactatttatcgattgattgtgcaaaaatataccggatagcgaacgatttgcggaaataaaccatcggtatcgccgatgttcgctcctggaaagtgcgatagcatggcgaaatcgctatctgaaa

SEQ ID NO: 91264 - DNA, 672 bp, Oryza sativa
cccaacaacggcggcataataagtcagccgtgcagccggaaacaccagtcggcggcagtcgaggcggccggtcggtgaagacgtagacgcccaacaacggcggcataataagtcagccgtgcaggcggaagcaccagtcggcggcggacgaggcagccggttggtgaagacgtagacgcccaacaacggcggcataaaggccagccgtgcaggcggaaacaccagtcggcggcggtcgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaaacaccagtcggcggcggcgaaggcaagccggtcggtaaagacgtagacgcccaacaacggcggcataataggccagccgtgcaggcggaaacaccagtcggcggcggtcgaggcggccggtcggtgaagacgtagacgcccaacaacggcggcataaaggccagccgtgcaggcggaaacaccagccggcggcggcgaaggcaagccggtcggtgaagaggtagacgcccaacaacggcggcataataggccagccgtgcaggcggaaacaccagt

SEQ ID NO: 91265 - DNA, 1946 bp, Oryza sativa
  unsure (1)..(1946): unsure at all n locations
ttacagaagtaattaagttgcatgggctatatgttctcaatatcaatcctttgttttcttttttgcagcttgaatatgtatatgctctcctaagacttgaagaatataccaattgaataacttgaatttggaaaaaaaatgcaagagaatgattgcccactaactaaacatacctggcctatagatgttacgttctgggtgactgtgcagcatcagagccatctgctgatgaactatctgtgtctgtatctgcatatgcttctcacggtaaatttcatatgttatgcagatgtatatgaaaatatcctttatagagttaattgcaaacagaaatgctgctaatataaatttctgcaaaggatgagagcatttaccactagacgaagagcctgaatcgctactagaacttccagaactacttgatctacccgcattctcccccttctgatcttccaaatgaacaggtgatgatgagcctacatacctctcattatcatctgtaattgaacaaacttagctgttatccttaaactggtaatagagctaggtcacaaacacaattttacatttagattaataataacaattataaaacatgctccaaaaacacagtcgcctacctgctgtgttttctttaggtggttcgatatcaattgattctggctcaggattatgtaactgcagggaaataataagtaccatattgttaatatcacagtataattaattcacaacaattacatcatccctaagaagcataccgtctcttgtactggaggcatctgatcctgctctacttcatccaaccttgcatgctctgtcttctctagctctatatcatgattcatctcatcctgccctgccacgggattctcagccttccgcttgttcttgcttatactttttttgtagtttgtaacaaacctatcgagctcccataatgtctcaacatcaaagctatctatatcaacctcaatctcatcatcatgctggctgagtgacaagtttctcttctttataatctgcacaacattgtcaagtttctctggtggcaactcctggagattattactaagccgctgcttctcccagaaggtcatctccctcttattaggctcccttgccttgggcttctttaaaactgggggccgaccagtgttctgctttggagtggcctccatccccgcagcatgtactgttgagtccgacctctctaacaccttagaattatctatctccttcggcttcctgggtgcagccgatgatggcgttggcggctgtggtgacagctgtgctacctcggcctcaatttctggccacttctcctcaaacatgttcaacagctgctccgccatgaagtgcacatcctgccctttggggttgtacctcatggcattctgaaaggtaaggcgcacgtcaccggcgaactcccgcggcgacttgtagtgcccagcggccagccgcgatttgacagtgccgaggtccatgggcttggtgatgatggtgtggtagtcgtggaggccaagcgcgctggcgtcgacgggcgtgttgaacacccagctgtgcttgtgcttcatcagcctagcgagcagcgcgccgcagctcttgaacacgggcgcgtagagcttccgccgcgcctccgcggagaggcccgggttggaggaggggttccccttcttcgacttgtgcttggagaccggcgggtgcgggggcagcggggtggaagggtcggtggcggagagcgcggaggaaggcgcgggggccgggagggagctgaggcgcttgcaagtggcgcgcacctgcgcgagctcggcggtgagccggcggcggagctccctgcgggcggccggcgaggacgacagcgagaaggtgacggtgcggacgtgcgtcccgttgtgagcatcgaaggccgccgngacacccccgccgccccgcccgccgccgcc

SEQ ID NO: 91266 - DNA, 2486 bp, Oryza sativa
gctccatgtgatgaagcgtcaacgacggtatatggacccatcaatttgctttgaagttttccatgtccgaaaagcttcacccgtgagttgaacagcaacaccttctcccttgctttgaactccttgtgcttgattcgtttatcatgccatcttttggttttgtccttatatatcttggcattgtggtaggccttgtccctccattcctccagctcagagagctgcatcttcctgtgctgtccgaatccctttatgtccatgttccaagtccggatagcctagtgcgccctgtgttccaactctactgaaaggtggacaagtcttcccgtagacaagttggtacggtgacatgccgatgggcgtcttataagcagtcctatatgcccaaagtgcatcaggtagtttgttcttccatgccttccccatctcattgacagttttctgcagaatattcttgatttgtttattgcttgtttctgcctgtccacttgtctgaggatgatacggagtggcaatgttgtgctgatccccaagttcttgcaaaaagtttcggaaggtcttatcgatgaaatgagaccctccgtcacttatcaccattcgcggagttccaaaacgagggaagataatctcggggaacatccggtgggcttgcttggcattgcctcaacccacttggacacatagtcaacggccaccaggatatacttgcagtcataggactctgggaaaggtcccatgaagtcgatgccccatacatcaaatagctcgacttgaaggttgtatgtcagtggcatcgcatctcgagcagtgatccctccatgcttctggcaacttgtgcatctccgaacaaattcctttgtgtcatcatacattgatggccaaaagaatccactctactagatctttgcgtgtgtcctgaatgctccatagtgacctccatatggggcaggatgacacttctcaatgatcttcatgccttcatctaccggaacacatcttcgtagtagaccgtctgaacagactctgtataggtaaggtgcatcccacaagtgcctgcggctctcgtagatcaacctcttcttattttctcccattggcacatgccccgcaaccatgaagttgacaatggttgcatgctacgggtcagagctatgactttcagcagcatgtcgtcacgcagataatcatttattggtagctccttcatgttagtgatttgcatatacgacaaatgatctgcaatagaattctctactcccttttatctttaatttctatgtcaaattcttggagtagaagaatccacctaattagtcgaggttttgcatcttttttagtgagcaggtattttagtgcagcatgatcagtataaactattaccttagctcccactaaataagacttgaatttatcaatggcaaacaccacggccaggagctctttttcagttgtggcataattaagctgagctccagtcaaagttttactagcatatgcgatagcttggtgttttctatccttagtttgcccaaggacagctcccatagcaaaatcactagcatcgcacatgatttcaattggcagcgatcaatcagggggttgaataattggtgctgagatgagcgattccttaaggattttaaaggactttaaacactcatcatcaaagtcaaatggaacatccttatctagcaaggcaattagggatctagcgatttttgagaaatcctttacgaagcgcctgtagaaccccgcatgacccacgaagctttggactcccttgatatattgacaggaggtggaagctgtcgaattacttcgatttttgctctgtccacctcaactccccgttcggagatttgatgtcccagacatttttcttcactattccttcacgaaccatgaatgtggcatttttcccaattaagtatcagtccttttcttgacatctttctaagaccctatcaaagttctccaaacaatgatcgaaagatttaccatagactgaaaaatcgtccatgaagacttccatgatatcctcgatcgtgtcagagaaaatagatgtaatgcatctttgaaatgacgcgggtgcattacacagcccaaacgacattcttcggtatgcatacgttccgcatgggcacgtgaacgtggtcttactttgatttggtgataaccagaatacccatcaaggaaacaaaagaaggaatggtttgctagccgctcaagcatttcatcaatgaaaggcagcggaaagtgatccttcattgtagccttgttgagtttcctatagtcaatgcacattctccatcccgtgacggttcattatgggatcaactcgttgttcgagttttcaacaaccgtcatgcctcccttcttaggcactacttgaacagggctaacccactcactatatggcatgggatagataatcccgacatgtaggagtttcaagacttcctttttgacgacctccttcatcacat

SEQ ID NO: 91267 - DNA, 2900 bp, Oryza sativa
aaaagcaaaaaaaaaaaaagcatccatgacctgccatatttgtgccattgcattgttctttttagtttttgcgttgttgaattttgtgttgcatcgtcacgtcgtgttgttggtcttagcgtctagttcgtttagagtttcgagttctggtctcgtttgtacaacagtcgtcgccacccccgtgtctcagttgtcgtcgagacctacgaaaacagaatcagctcgctgccacggttctattttcgtactttgaagaagtttctatcggttagtttttgagttcttgagttgtatagcttctgtttggtggctgtgccgtgatggagtgtgccatgatggtgggcctgtgatgttgcgcgtgaggaagaagagtgaaaggggatagtagatcggtttttggatgaagtgctacaatttgtagattggtttctatttggagggccacgcagaactactaaaaagttactgccgagtctgtttcagtttattacgtggtgcctttccaaaccgaggccgagtgggatctcttcccttccaatctcgtgaccgggacttgtgagtccgactccctcccttccctcacgactccgtttctgtctaggtgtgtcaaacactggtaaaattttcttttggtgtcggattcaatgtccatttgcaaaaaaagggaacctgtaggacgagagcattccatttttgtacaattttaattttgagtttgcacttttgcatttgtgtccctgtaatttttatatttacatttgagtccctgtaaccttacattgaggtccttgagtctgtttttgctaaaaaaatataaaaaaaagaaaagaaaaaaagccgcaccaaaaaataaagaaaagaaaaggagggaaaaaaaagagaagaaagaagaaggaaagaaaagagaaatactgttgtgtttgagctgaacttcatatatcagagttgtgcatgagttgttcctagtgctatcttgtggtatcgtttgtgtctaggctcatgtctctagtactttctagcctaggaccagcacggtactggactttgaacgatcattcaactttgcattatctgatttgagcatttgctatccctttgctacatatttaagcctgccaagagctccacagatctgattgcaaccgtacagcaagcgtttggccaaggcatcgatacatccaacctccattggggtgcttgattgagtcagtgtatgtcaccattccgcttgctttggtaagaacttgtaagagcttggttaaaagcttgagtgtgtgtgatatttgagctgccactacctagtagttgataggagcgtgcatattcctgtgtgtgtttcttgtttgctactatccatggcaggattgtgcaagggaatacgagaacattggcttcttcaccgtctacaagatatgacaacgtctccatgtgatgcatatgaggtacatgactataattttgcgcgagttgaacctaagttaccattttaggatggtaagtatgattctgttgcatatattgattgggaactagcagtagataatgaatttgacaaatatgatttttctgaagctcaaatgattaaggctgctagtaataagtttacctcttttgcattattttggtggagttatgttagtaatcaacctgaaacttgggatgaattcaaaaccatgatgagaaaacgctttgtgacatcttattacaaatgtactcttcgggagaaattagaacatctgaaacaaggtgatagaactgttagagagtacattcatgaatttaaggtctgtatcatctagggtctcaaagagtgcaatgaaaatacaacgcgtagatttttcaatgggcttaattctgaaattcaggttttgcttgataatgtgacatataatcatattgcgtacctattcatgcttgctcgtagcattgagagtcagatcatatcaaatgcgaggaagcatgaacaatgtgatttatctcccatttctgaatctcctatatccttatgcaatgatgatgtgcaaaaattggaggagcaatattttgtctctcctgttactaacgttttgcagggagttcagaacattcaacaaaaggaggagaatggtgtacttgagaagaaaggggatgaagcacctgcggtttcagaagaaagtttgcaaggtaaattaaatggtactgagataaatgaatgtgagtattctcaagctgagctacacatgtccacttttcatgctatagtagagcaaccattagtggaaccaattgctgagatgcctttgtcacaagttgattaacttgctgttccttgtgataaagaagagttgtgtgataatgcttcacttatatccatgccacaactagtgaatgaacatgctatttctagtgtttatttgtgtgctgattttaagcatgttgttcacattgcaaatgaagtagaggaacatgaattgctatcttcattaaatactttgggctatgtttggtttgatgatttttgtgagctcgaaaatttgaaggagaaattatttgctaaatctgatttgccatgtccaactaatgctatttctcatatctttggcgaatataatgatagaggaatatatttggggcatagagtttacatatgttcgtatttagaaccttctgtacatgtggataaaacaagcaaactagagagaaatgttactgctaacaaaattatctcgagtttggcttgttttgattggaagaaacaggttgttttaaatggactacgtgaaaagcaccatatggaaaaaccggggacggttttccataaagatggggaggatgatgtgaccatggctactacggatacaaccattactcacatcatggatgaacaagcagatatgaagatcaagtcctccaagtgctgg

SEQ ID NO: 91268 - DNA, 1251 bp, Oryza sativa
ccaaaactaaccgacataaacttctggaaactagaaaaatggaaccctggcagaaagacgattctgttttcgtaagttccgatgacgacaaagacacggcggcgacgatgacatggtagtagacgtcacaagaactcaaaactctaaacggactaaacgctaagaccagcaacacgactcaacaatgcaacagaatactcaacaacaaaaattgaaaagaacaatacaatggcacaaatatggctaggtgatgggtgcaacttttttatgcctttttttgtggatataggtagataaaaactcaccgagcaacgaaacctctgataccacttgaaaaacgctgagttccactcgacactcaaggctgttattggcccgatgtttcggtgagttgaaatagctacgattcgggagaaacgttgacgatcagactacaatcacacaagatgttgcgttgcgccttagcgatcgacacacctctcagtaggttgttgatcttgccgatgcaaatcaaccttattcctacaagcaaatcaaagaaacaagcaagaacaagataaaagcaatcagaattgcaaataggaattgaatataattgataagtttgggttccgaagaacaagcagactggcggtctagccgacatgcgcgctgtaaggaagtagcaatagctaaactttaatctaacaaaactcaagaaaccctgaaggggtacctagctatttataggagtgcaaggatgaccaagggtgctctagggtcgttctccaccaggttggggcgcaccccacatgggccccacttgggccggggtgccaaacgaagttctaagcccaaaggcccacgataggtgacgctgcaccttgtttcttcatctgcggatgactgggatggaatttggcgatgaggctagatccattggaaagaggactccgagagctttcatcagtactcatgggtcaataacggaggttgtatgcagattcggcggccgttagaagtcaactgtgtagagatggccgaataggattccagcacttggaggacttgatcttgaatcttgttcatccatgatgtgattaacggttgtatccgtagtagccgtggtcacatcagtctctcctccaatggttcataacaaatgacacatgagcttaaaaaagattgagaaaaatgaaaacaatgctcaaaagggaatgagataaagcattcttgagcatgaaaaaaatgagaaaaatatatagaaaaaag

SEQ ID NO: 91269 - DNA, 3560 bp, Oryza sativa
catacggagtcagatcaagacaaactttgtatcaaaattatagagctcgatgagatctacaactttcttgttgactattttttatatgagatcatttaagggtctaaatattcattataaaaaaccatatctatttttacaaaatcttatatctacaattcaaacgacatctgatggagatgtgttccatatcaaagttgtagagctcaatgagatctaccattttgtagtttataacagttgtatttgaaaatgtttaaagtataaaacagacactacgagttttgaagatgtgaaataaaataaataacatgtccaatttatacagcaagaacttgataagtgacatggtaagtaagctctacatgtagtaaaaggtcttaggattagaaaatgaataatcatatttacatgtgggtcccttaggggaacggccatgaaaatcgattttcacatacggttgtgggaccgcctataaaattgacgatataaatgttggagacgttgacctaaattaacaagcgatatctcttccttgattaaggaaactcaatttgaggggatttttatataccagcaaatcttcattgccatattcgttcagtttcgtattccttctgtatctgtattcgataatattcgatttcatttccgtatccgggttttcgattccaattctgattccgaaaaaaacaatgaaaacgaatatgataaagctcatttccgccgttttcatccctatgtgggggtgttgttggtggtcgttaagtacaaattttaactgttaactcctgcataagaaatacaaaatatggtatcaaaccttagtggtaggagtttacaactaaccatttccactagttttggtaaatctatgtattcaggtcaattaaggagaaaatacacctgccatgcgacgaaaacacaactccggataatcggacacatttacacgtattagagggcccacgtgtcaatcaaaaccacctagaatttgtcaggaaaccccttatcaatcagcttgtgaacactggatgaactcacacgaaagtggaagaacacaagaacacgtagaacacaatactgtagacgaacagacaacagaaacagagtttttggtgctgcctgaattgcttgcagctttttggggtttttctctccttttattgtgcagaactgaaacatgcaaagcgacgccaaaaactcggatcgctacccacgactcacggcttgatcgcgtccatccccgcgtccgctcatcgcgcgcatacgcccgaaggcttaggcacaccgcgagctattctcgcttgactcctacacgcacggcttccacacgttggggctcatgcgctgacaatacacaaaacagaatccaaagcttaactaactagctaaaaacaagcatgcaagatttatcctctaacaattctccccctaaaccttgcatggctgtaaaacctcaacaaggccgatcttggaccgaagttccatgaatcgatctcgcccaagggcctttgttaaaatgtctgcaagctgctcctcagtattgatgtattcgatcttcgccctaccttcctcgacacactcccgaatgaaatgatacctagtgtcaatatgtttgctacgattgtgaaacacaagttcttgctaagcaaaattgcagactggttgtcaaccttcagtgtgatggcgctcccttcttctcccctgagctcagcaaggagaagcgccagccacacaccttggcacgcaacagtcgtcgccgcaatgtactccgcttcataggacgatagagcgacgaccttttgcttctgagactgccaggtgatcaaattatccccgagaaagaagagaactcctgttgtgctcttacggctatcaacatcgcctgcaagatcactgtcgctgtagccaacgaggcacacggcatccttcttccttcggtattgacagccatagttggtagtgccagcaatgtacctcaacacacgcttcacagctgccatgtgctcggtggtgggcttctccataaaccggctgacatatcccaccaagaacgccaaatctgaccgcgaatttaccaagtatcgcagtgatcccacgatccgcctataatcagttgcatcaacagctggtgcggcactcgacttactgagcttgaggcgtgattccatgggggtgaggctgggattggtgctgctcatcccagccatctccaatatcttctcagcgtatgcccgttggcacacagtgatgccatcttcagtctgattcacctccaatccgaggtaatatttcaacaacccgagatcgctcatctggaacgtgcccttcatctcgtccttgaactgctcgagctcggcggagtcaccaccggtgatgacgagatcatcgacgtacacgccgacgaccagccggcgtgcgcccgtggctcggaagtacacggcgtgctctgacgagctttgatggaagcctagagccagcagggacgcgtcgagcttagcataccacgcgcgcggggcctgacgaagaccgtacaacactttgttgagtcgcaacaccatgtgctccttgccggcgaccacgaacccggccggctatgtgacatagacttcctcctggagctggccgttgaggaaggcggacttgacgtccatatgatgaacggcccagctctcactcaccgcgtgtgccaacagcagtcgaacagactcgagccgcgccaccagcgcgaacacctcgtcgaagtcaatcccctgccgctgcacgtagcctttcgccacgagatacgccttgtacctggtgatgttgccagcaacgtctttcttcgtcttgaagacccatttgagtccaatcgggcactgacgcgacggcccgtcggcgagacgccaagtgttgttggcttcaatggacttgatctcctcgatcattgcatgtcgccagcactgatgttgctctgcttcatcgaatgacgccggctcttccgcagagaccatcaggagatcctcatcgaactcccgtaccgcctgtccttgtggtgttgctgggccaagcacgttgtcgatggtgcggaacctgagtggcgcatcgtcgtggtcgacgtcgaggttgtcctctagacctgatggtagagacacgaactccaccgccggtgttccagcgtgcagaggagtgcttggcgacgcctagcttggtgacgacacgaacggcgagcctggcgatggtggtgccgcagctggggaaggtggcgccgcatctgactgctgcacggtggtgtactcgatgacgaagtcggtgtcgacgcccgtttcagcctggccgtcccacctccactgagcctcctcgtcgaacacgatattgcgggagatgtgcacctgtcgcgtcacggggttgtaggcgcagtacgcctttgatcctggctcgtagcccacgaaaatcatgggtttactcctgtcatcgagttcttcacatggcccacacacccaaatgtacgaagatgatgaaccgccggcgaaccgccgttccatagctcgtatggagtttttcgccgattctcttcg

SEQ ID NO: 91270 - DNA, 4562 bp, Oryza sativa
gatttgtgaaaggaaaataaagcgaaaacaactgttttcgactggggcggacggatgatttgggtggtatctggaaaaggctagtaccgtccccagtcaattaaggactgagccatgaagttaagcatgaaacgacccccgtacaaccgtacttctcgaatgggtatagacctagcggattagatagccgagcggaggcagtatccctgcatagatggttcacccctgagtgaggcaggtgcgctacgatgggacagccgttgaggtagggccgagaagcgtgccctacatcggtgtcgccattggtaggactgccatgagtgtgtgagagagagaacttaacttgaaccataatttaatatgtgtgtgagacttctctttccctggagcgccagaactcctctcactgctagaaacatggacgcctagagtgcatgaggatttaagttcatggagcgggtattgccaatgcgaggttatcgaaaagctttgccgtgacgcgtctcatgtgttgggacgaggctcatgtgttgggcagtcgcggagtgcgggtaaagtgtacatccactatagtgtgagtaaaccaaatctattcgaatagccgtgctcgcggttattgagtaccgggacatgtattacacttggctagtctctaaattcttaacttgtgtgggatgggttgttgcatgactaatttttatgctgttggagccacttcctgaggagggggaaggtgggcgtcctcagaaaactataacgactcaatggcgggaagctatccttaggatcacaatggatggtggacagaaccgtcgttgtttaaatacaaacactggtactaaaatttgatcagtcaatgctaggtcttaggtttgtgaaaagaattacaaaactggcttagcgcaaaagagccatagccatcctttgaaatacccctttcatatgcattgttgctgtggtgacttgctgagtacggttggtactcacccttgcaaatataaaattaatcagaagcgggagatgaagcttcggaggatccctatgcctactaccaggagggagatgaagacgatggcgctcagtaggtcttagtacggtcgttgcctgtggcaatggcgtgccgctgccttaactccgctgccttacctacttctgtttttggaatgtattccggaccgctcggtccgatgatttaagactgtgcctgcgggcttatgatgtaataattcatactagactctcgtgtatgtgcacttgatattttagctatgagttcgtgtgtaccagactccttgatccagggaaatggtactgtttacacgattgattcctgttataaaaacgggggtccacatttttagggtggtagatgccttagctaatctagtctaataaaacaatttagccgatactggcagaaaccgtaaagcgagagacaaccgatagagctaaattgagatactaagactagattaactaagacatatgataaataggcaggcaaaaatatcatccaaaccagagcaatccaagaggtcgaatgtactgatgcagccttgaacgacgctgacgtagacgaaacaattgcctgggccagcggaacataggacttaccccttcgccggagatcgaactaaaccgatgcaaccccgcgtcaggtgccaaattccgccggttgataagtaaaaacctctggaaagagggtggcgatgcgccgagagtagttgtattgattgagatattgtacaatgaccccgggtgtacatatttatacctggagagatactagtccttctaggacaagaaagaaactttcctaaagataaaaggaaaacataaagtccttataggacactaaacacactttcctaaagataaaaagaaaataagaaactattcctaatgaatagataacttgccatgctgcatcctccttaaactcggtcacttctggataagctttctttaatagatcaatttccttaaccgaatatagaaggaatctgactactggcgacgtgataattctcttagaggcttaccaaatttcactattaacagagggatctatacttgtgtcactggatcgactcatcgctggcaagcgaaaggggatcgattctgaattttgacttagggtttagggcttccaaactgtcaccaccactggggctcccttgcggcgggatcccatcccatattgcttggattggattgctgcctccctaatctccatcccatcccattccatctaccaggtaagacggccttcttgaacacaaggcgagtgctagggggagcggtggggctagtgtggcagacgacaagggcttagtgttggaggaggaagccggagcggatggcatggaggcatccttgcagacggaaggatggaggcgactgaggcaggatttgtgcggcagtgggaagcgccagcgacagcgtgaggacggaggcgatgaggacaaggtcttactatgattggtgcgatgtgaggacatggatttgcgtggtagtggggagcgtgcgacggcagcatgaggatgtggtgggtggagatagggacgggtgtaatgcgaatatgcgatggacgaatgaacggatgagattagtgcgatgtggatggacgtggatgggttcgtggatgatgatttgacctaaaggatcaaatcggtaagtctctactattataaaaattgtagatgattttgctagaattttgatacgtcatccatgtttgaaacggttttaattttatgttttggttttaatctatatctctactaaaaacaagaaattcctgtcctctgcaaaaacgaaagaaaaaaatccgactcaaaaaagtaaaaaaagaaagaaagaaaagtctgacttaacgagcgataaaaaaaagcttccgtcgtcagtaaaaaaaagaaaaaaaaacatctcttgtccgattcccatagaaaaaggaaaaaaaatcttccagtaaaaaaacaaaaaagtccgtttggttttcttagcatcagtattttttttccgttttttctttgcacgcaaaagagttttttattcgcacacgctaagacttttggtttttttgtcccctttttttaatccgacctgttcactgcgctcctgggtgtttttagttttttttgttcaatctttttgtcgccggttttttctctcgtgcgctttttgtttttctcatagtttttttggtcaatcttttttgtcgccggttttttctctcgtgcgctttttgtttttctcatctagttttataatcccatctgttcaccgcacgcctcccgaggtgaaccctagcgccgcgccgccgccatatcgatcgtgtatttttgtcctccaatttgattgcaaaaatcgattccccaatcctctcttatcattttctccatgattttcccttcgattcggctttaattgccggatttaatctctggtttacaattaccgatgatgacagcgatcttccccggtcatttttatcccgatcgtgtgttttctcctcctatttgattgcaaaaatcatttccccaatcctctctcatcattttctccatgatttttccttcgattcggctttaattgcgggatttaatctctgttttacagttgccgatgatgatagcgatctttcccggtcatttttatcccgagttttacgctctgattttagggaaaacggaaagagtagatcgagtggataaaaaacccttgaccaattttggctgatctagaaagattcggccggatttgatggggagatttgctccgataaacgtacgggtacgggcacaggattatctttgggaggttgaagatggtagtcatatttggaaagttgaagatggtaggtttgaagagagcagaccaaatggaggaaggtagcctctctctctttctccctctatattcgtttagatcagagaaatacattacctctatcctccctcctgtttttacacaaatgaaaagcacatcacaatgtctgacctccatgttccctcctttatctacagaaatcaaagcacacatcatgctcgccaacggaaaactacccaataaaagcagtaatccaaaattctaaactgtatgatgcttacatcagagactaacaaaaagaaatgcacacccagcggaactttgctcagacacctccttgctaaccagtggtctacatgcttccaggcttcaggcgctgctgcaatataatccacacccagccgcctagcctactgagggctccgcttgggtacaaaacacagtcccgactcacagcaaaacaaatccacaataaatcccgccggtgaggaggcggggagctgccagatctgggggcctctgagctcgggacagccgatctagcgactccccacctcctcacctgggggcctctgagctgtcccgccgtcgatcccagcctcgccgtggcctcaggcaccctccacatggcagcaccttacgccgtcgtcccctccctccctctctcttctcagcgcgtagaggagaagattgggagtggccagtggcttagtgccttcagacttcagtgg

SEQ ID NO: 91271 - DNA, 2118 bp, Oryza sativa
tccccttcggacgccgccgccttcttcaccgccgcgacggtgggccccgggcccgaaggcgacatcgactcggcggcggcggcgtcgcgtccaaggcgcttaggcccctcgcccaacctggtcgtggcggccgcgaacgtgctcgaggtgtacgccgtgagggctgagacggcggccgaggatggaggcggtggcacccaaccgtcctcttcgtccggtgccgtgttggacggtatctccggggcgcgcctggagctggtgtgctattacaggtgcggtgggcggtctcttgcttcttacaatttaccactggttttagatttcagaaacgaaaggatttggtcctagtttattgtgtactaatttgttgatgaatggcatgtaggctccatgggaacattgagtccatgaccgtgttgtcagatggagcggagaataggcgagccactattgcacttgcatttaaggatgcaaaaataacttgtttggagtttgatgatgctatccatggcctgcgtactaggtatgcatactgtttcctcattctccttttataatcgttaaattattgattcttgattactgtgaatatagtccccatttgcaaaattgtagattttgtaacaaatgtatgtgtgtaccaatgcaattaatgtatgtcaatcttcaccattggaccattggaatcacttttgattcccacaaccaccaaccaaattaataccacctaaccaggtaataagattaaaggattccccttgggaccagcttacatgtcaagtaacgaaccaatgaagtaagctgtaaggatctaggagtcttttcaaagacccctagcctttggagtggagctagtgtgacgaactagagtacatttagaattttggcaccaaggaaactgccctttaaactgttgctcaggctgcatttataggtctgaccgtctgagcaggatacataagaaattacatgtgggtggccttaataaaggtgtctatggcctgggtgtacattagacattttcttatattcggtgcatggatcgttcccacggggagccatggactgtgtctatagcgaggtcgtccctggctattgagccaggaatgaagaacggaccactgtgtctcttaactggactcagtgtttggtagtcaaaggagtcttctctgtccttaatgaattgcatgtgggtgaatccttcttctcttggtagcttgtcggatggcctttgatggtcaatgtgtcttcaatatccaaagggcttggtcattcatcgatcgttgagggtgccagttgggaccatcccgcaaaacctgctaatcggaaaattttgaatgatacagaggctgtttctaactagcgttattcactttttctgccttttttctaatgtagataaaattgaaaactccatctctttagtgcaactattttgctatcttttccttgctacaggctgatgcgctatcagtatttcattatcattcttgatgtttcagttcaatgcactgctttgagggcccagaatggcagcatctgaagagaggcagggaatcatttgcttggggtcctgttataaaggctgatcctcttggaagatgtggtgctgcacttgcttatggacttcagatgattattctaaaagctgcccaggtgatatttccgtgatgtatcacatatttttgtcttgaaatatatatattttgtcccatctctatctcttattacatttctcattaccatcaggttttcattatgccaacacttgctctaagaatatgggcccatttagaaatgctagtgctatggatagtgattacttgtctggatcagtagattacaaatattttactctcctccaacgttgtgtgtttgattgataatctttggtatttttgtacatattaggttggccacagcttagttggagaagatgaacccacctgtgcattgagttctactgctgtttgtattgagtcgtcatatttgattgacttacgagctttagatatgaaccatgtcaaagattttgcttttgtacatggtgagataagatctgttttgcacatactatatcgcagactacacacatttgttttttcatgtttttctata

SEQ ID NO: 91272 - DNA, 6057 bp, Oryza sativa
gtgctacaactatccaaatgtgaaaccttgctattcatgctgttttccatttatgatttctttaggttatattgagcctgtgttggtcatacttcatgagcaagagcctacatgggctgggcgtatcttatcaaagcaccatacatgcatgatatctgcatttagcatcagcatgactctaaagcaacatccagtgatatggtctgcagctgtaagtgtacaagattgctcctaagcattgtcttttctgtctttggtagcttattcctatgttctttcggcaataaattttggcgttcagagtactagaatgtactaaggtggcttgtggtattcactaaataattacttatttcttttgcatagaacacggtaggtttatctgtgattggtaaatgttccgaatttagataagttatcaaattttgctctatttcaggactaatcctagtattcaagtccctcattttaggtcagcaataccgcattgaggtgaatggtattgatttgtagtggtgctatcatttctgtccactagatcaaatgtgtgtcatactatgatcgcgaatcctttttttttttcttgtagattgctcaattgtattacatattttagggattccattgcgtttaagcactggatttatttgactctatatataacttcttgccattacaaaataatatacttaccattacaaagtgtttgttcctttcagaatctgccccacgatgcataccaacttcttgcagtgcctccccctattagtggtgttcttgtgatctgtgcaaattccatccattaccatagtcaggtttgatccctttaaatactcgtggtgaaggcacatactttattttgatttgctgaacgtggatcattgatttgaagttctctttgttattgtagtccacatcgtgttctcttgacctgaacaatttctcatcacaccctgatggcaggtactgtttgtatatgttaaatgcaaagtactaattggattacgatagtttgttctttttctcggatcacatacaaatgggccctgtttctgcttaactactacacggctacacacatatcagtggtgcagtaccatcacaatcacataccaagatcaccaatgtggatacctgatttaaaagtgataagctcaagacgtgtagtgtggtctcttcttatatggttgtccatagaaaataagattaaaataaccatcttgaacttcccctaggtcctagcaacctaattatttaatttttttggaagattatgtttgaagctacatacttttaaatccattattactaaaggtgttaactgagacattagcacagcatttgagcccatcttgatgtactggtaaacatgtgaactgagtaattcgtaaggtgaaattactagaaggtgcttgctgttgattatgggtgattgggtgtgcataacacacctcattgtacttatttggttgtaaaaaggtagtcaaatctactgtactggcatgcttttcttgctgagagcaaatcttacatgaaaatagtgggttgatccaaaaagatatagaaaacctgcgaaatatggcacatatactactccggcagcagtgttatacctatcaatattgaatagttgattattcttaagttctgtagtctataccgtattgatattgcttagcttctttctttttcagtagatttgtatgctggtaaccttctgttcttttgctggctttgcagcccagaaatttctaagtcaaatttccaagttgagcttgatgcagctaaagcaacttggttgtccaatgacattgtaatgttctcgacaaaggctggagagatgctgttacttacagtggtttatgatgggcggtatgataattctatggttcattgtcctattgtctgtgctactgttgttcagagttgatcattacatgttcttttattctttttacagagttgtgcagagattagatcttatgaaatcaaaagcatctgtcctcagttcggttggttacctatgtacttctgtgcttatatgcttccttttttagatattgctcttttttaagtttactaacctatttatggacaggctgtgacatctattggaaactcattcttcttccttggtagtcgtctgggggatagccttcttgtgcaattttcctactgtgcatcaaaatctgttttgcaagatttaacaaatgaggtgtgtactgagatatctgtgttgatttactttttatctttgaagtaaaacatttcactacatgtcggatacctatatttttggaacaacacctgaaatgagttcttttttactgtcattatagaaaacatgtaactagagatgcaatatttctgtacttgtggttttgaaaatttgaacccaataattcaccattgggcttgaatgcaatgatttttttgaactgagcttgaatgcaatattagttctaattcttctcatggtgttgaagcatgaccatggcagcataaccatatgggtgctgctactttgtgccggtgcccggtgatccatctgctagtgtccgattgtttacaccattgtttgcagcttgcattattgatcctcctgtcaaacagatgatgccacatctatggcactcactgtcaagtcattctattggcacctcaattttatgttccaaatgcctcttatcatagttattaaaaccggaccggactgaggtgtgatctgatttgattaaaagactggggatgcacatgaatcggtagaaactggttatactgcccagttttgtataaaactggctaaaaacctggagcagtctctggccggctatacttttttcaagaaaaatcaaactccatgcgtgggaggagggatcgatcccgtgatcactggcttgcccatgtacctagtaaaccaactgagcaagccacattgttgatttcacaaggagaagcactcgatttttttccttggagtcaaccaaaacaacaaaaagtaaaaaaatgttatttaaccaacggtcctgccaatgaactgtgaactgatgggctcactggtttgatggccggtccaggtttaacaactatgcctcttatgtttctcaacttgccatatagtttttctgttggcagatcagtagaaatggttattgggttggtttttaggattttttagaccaacgtgatacttgagaactggcaaccagggtcattttactgccttgtggtggcttgtttttgtggtggcgtgagttcttgtacttttttctgttttttttgcgtgtttggacacctttcttcttctatttatgcaatgatacacagctcttgcgtatttgagaaaaaaaaagaactggccactcgttagagatcattaaaggttatttcctccattcccaaatgatcatcatattagtagtatttattccaaggtctatttgttatgtgtgcataggagtaaatgtacattgatgcatgcgtccatgcacacaaccctttacaaccaacatgcaatgtcttggtttgttattggctaggaaatagtggggatggtgcatgcatcagagtttgttactagattaaatgtagtacatgatagttattagcttttattggtttgggtgcactcctgtaatatgatgatcaattgggaacggaaggagtacaagccttggcaaattcatcttccatccactgccttttcttctcttcctctgctactaccacctctctatgcttgttcgatggtatcatcatttagggcattcaatgaatataaggttcattttcaaggctagacttttgacagaagtccagaaatcaaccctgaaccttcgagttaagacattttacgatcttaaactctcaaatacatctgctttaccccctggttcgaaacattacgtctttatgctgacctgacaccgtgtgtatattagtggcacataagatttgttatgagatgccccccttcccccctacacacctcacaccattgtatatttttgttaaagcatctaaagatacatttagttaattaaccataaaatgtacttctacacaatattaaattatacttttaattaatactagtatcgctatagaataatagtaaaatatgtacataacatggatggttatttttgttgcatgtagcgttgagcctttgaaaaataccacgtataaggtgagctatggctgtcccttgaaagcattggtgactaatgatatagcaatctacttttgtagcgctctgctgatattgaaggtgatctgcctttctccaagcgcctaaagaggattccttctgatgttctacaagatgtgaccagtgttgaggaactttcctttcagaatatcattgcaccaaacagtttagaatcagcacaggtctgagtattactttcagggtttcaactgtatgctagctacctgtggttccagaatcatatgttctaattatctgtactcctttaaaaagagcaagtggtggtggtgaatctgccaccacctcatcaccagtgtccccaattttgatatgtgggacctactagcggagaaaaggttgtgccaaacataatccttcaaacttggttagtcaatatttgctaatataagaaagttgagataaaagaagaaaagcgcacaatcttactcatttattggttatgtggattgattatacagtgacgtttatccttcctgtacaatgcacaattccattatctttttcaattaacaaagggtcttcatcttgtatatagttgtttactatttctttttggctaccattccaatcacgaactatattacttattctcttaaaaaatatcacagttgcttctcattatattctgactatataattcactggctttttctttgcagaagatatcatacattgtgagagatgcattgatcaatgttggtccactgaaagatttttcatatggtttaagagccaatgcagatcccaatgcaatgggaaatgcgaagcaaagcaattacgagttggtcagtggcatggcaatctttacttttgatcttttattactgttgggtctttgtcaatcagttctatggttgatttagctactattgttggatgtgcatatgtggtttgttttttttatctttagtatggcaaaccaaggtttcaaatcctacctgtaagcagcaggttacagctggttgttgaaaattccaaaagtttctgatattagtactagctaggttttgaagattagttgttctcaagtcaaggaattaaatacaagataatgaaaagattaagacaataaactgaatgtttaccagaatgggtaaattgctaactggaactctgatgagtttatatttatacatagtacatgactgaataaacataattaggaacaatgtgccatctgtaatcaattgaggtgttaacatcaatggtccataatgtatgctattgaataatctgcatgaatatgtgctaattattatgttgacgatattcgatcttaacattttactttttttatcacctttcacatatctgtcaattcagtgcaacaattaaaggaatgcaataatctatttatcctgatttaataaaggatagtatatatatattccacttcaaagcatgcagtttacaaaaatgttgctgagaattgtggattgggaatatgccattgcaatatggaggcaaatggactgatttaaccccattattctttcgtcctttcccatctccacccactccatggctgccattgaccaactagtggtgttccagagaaggcgggtgccaactgaatgagtaacgagcagtcatggcgtccttggctgctgataagctctagaaaaatccgtggagttatctcttttgataccaggtccagccagcatcattgtccttccactgacctacttttcttagtttctccaacgcaggcctcctaggcactagcgcaacccaacagcacacttgacattgacatagcctccgcaaggttcaccagtgctagtgtcagcattgtaaacattgatgagcattggcactgcctt

SEQ ID NO: 91273 - DNA, 1033 bp, Oryza sativa
cagggttgcacggccgaagatggcgttgtagttgtacgggatgtcgacgacgtcgaacagtacttgctcttcgtgtctgttctctccagagccaaaagctaccagcaaaagtgcttggccaagaacttgaactgcttctccgccgaaaccgcggagcgatgctggtgccggggtgagggcttgggtgagcaaccccatcttggtatatgcttcggcgaagataacatcggccgaactccctccgtcatccaggattcgagggacttcgaagccagctatctcggctgagatcaccagaggatcttgatgcgggaacataaatcctacagcgtcttccggcccaaaagaaattagctggttaagatattgcggtgccccttcacccgccgaagtgatgctgtggaccgttcggatctgcatcttcttctgccgtttggacaattggcttggcgggtcagcccttgtaatcacttggattacccttcgctgtgcacacatgggtgcgatgttttcgaccagaatgaaaaagttcaaaaagcaccaaaacatgattttcggacatattggagtgtattcggtacgttcgtagcaaaaactcacttcgtccttcgcgcggccaacttttgtcaattaaagccaatattggaacacgtggatgtgatgtttttgaccggaatgaaaaatttcaaaaaccactgaaacatgatttttggacatattggagtgtattgggtacgttcttggaaaaaaatcacatcgtgattcgcgtggcgatcttttgtcaattaatgccaatagtggcacatgtgggtgcgatgtttttgaccggaatgaaaaaattaaaaaagcaccaaaacatgattttgggacatactggagtgtattgggtacgttcgtggcaaaaaataacttcgtcattcgcgcggcgaacttttgtcaattaatgccaatagtggcacgtgtgggtgcgatgtttttgaccgaaatgaaaaagttcaaaaagcaccaaaacctgatttttggacatattgga

SEQ ID NO: 91274 - DNA, 4026 bp, Oryza sativa
gcattgtcattaatcttttgtagcactttgaaaggaccatcagctctaggtagcaacttagattttctcaaattagggaacctatcctttctcaaatgcaaccaaaccaaatcaccaggttcaaaagcaacatgtttctttcctttgctcccagcaagtttatacttaatattcatgcgctctatgttctccttagtggtctcatgcagttttaacatcaattcagcacgatattttgcatcaaagttcactctctctgaagttgggaggggcaaaagatcaattggagcacggggtagaaggccataaacaatctcaaaagggcacttcttagtagtagaatgttgtgaacgattataagcaaactcaacatgaggcaaacattcttcccacattttaatattctttttcaaaacagccctaagcattgtagataatgttctattcaccacctcagtttgtccatcagtttaggggtgacatgtagtagaaaataaaagtttagtccccaacttagcccacaaggttctccaaaatgactaaggaattttgtatcgcgatcagaaactatggtgtttggcactccatgcaagcgaacaatctcacgaaagaacaaatcagcaacatgtgtagcatcatcactcttatgacaaggtatgaaatgcgccatcttagaaaatctatctacaacaacaaagatactgtccctccccttctttgttctaggcagccctaaaacaaagtccatagaaatatcctcccaaggcacactaggaacaggcaaaggcatatacaaaccatgagggttaaggcgtgacttagcttgttggcatgttgtgcagcgagcaacgaacctctccacgtctctcctcatcttaggccaaaagaaatgatcagcaaggatatcctccgtcttcttcacaccaaagtgtcccatcagccctccaccatgcgcttcctgcaataatagcatacgcacggagctagctggaatgcataacttattagctctaaacacaaacccattggtgagaacgaatttgttccaagtccttccctccttgcaattcaacaacacatctttaaaatcatcatcgtgcgcatattgctcttttattgtttctaagccaaaaattttgaagtcaagttgggatagcattgcgtaacgtctagacaaagcatcagcaatgacattttcttttcccttcttatgtttgatgacatatggaaaagattcaataaattcaacccatttagcatgcctacggttaagttttgcttgacttcgaatgtgtttcaaagattcatgatcagagtgtattacaaattctttgggccataaataatgctgccatgtttccaatgttcgcactagagcaaacaattccttatcataagtagaataattcaaactaggcccactcaatttctcgctgaaatatgctacaggtttgccttcttgtaacaacacaccacccaatccaatcccactagcatcacattcaagctctaaagttttgttgaaatcaggaagttggagtaaaggagcgtgtgttaacttatctttcaaagtgtcgaatgcattcctttgtgttgcagcccaagtgaatgtgacatttctcttggtaagctcatgtaatggggctgcaatggtgctaaaatccttcacaaagcagcggtagaacccagcaagtcctagaaagcttctcacttgtgtgatcgttgttggaaccggccagctatgtatggcttcaaccttggcttgatctacttcaattccctgcggagtcacaacatagccaagaaaagagactcgatctgtgcaaaatgtgcacttctcaaggttaccaaataaacgtgcatctcgtagagcatcaaaaacagcacgcaaatgaccatgatgatcctctattgatctgctatatatgagaatgtcatcaaaatataccaccacaaatctgccaatgaaagcacgtaaaacttcattcattaatctcatgaaagtactgggtgcattagtgagaccaaagggcatgactaaccactcatataggccgaatttagttttaaaagctgttttccattcatctcctaacttcatgcgaatctggtggtaaccactacgcaaatcaattttagagaacacaagtgaaccactcaattcatcaagcatatcatctagcctagggataggatgacgatatctgattgtgatgttgttaattgctctacaatccacacacatgcgccatgagccatatttcttaggaactaaaagcacggggacagaacaaggactaagagactcacgtacataccccttgtcgagtaactcttgcatttgacgctgaatctcctttgtttcctccgggttggtcctgtatggcgcacggtttggcagagaggccccaggaatgaggtcaatttggtgctcaatccctcgaattggtggcagccccggtggaacctcctttgggaaaatatcagcatactcctgcaaaaggttagtgaccggaggaggcaaagaaataggagtatcctcaattggaaataaggtttctttgcaaaccaaagcatagcaaacaacagtgtcagtgtcaacttcatccaaatctgattttgttgcaatgaaacaagatcccttcagcttaatctcatttttattattttgaacagagttggtgggtttcttcttatgcttctcaagttcattagccgcaataagatgctcactcctagtatgctcctgatttttttgtttgctagctctagcaagttcatcctttaaaataacttcaggagacataggatgtaacacaagtttttttccattatgcacaaaggagtattgattggatttgccaaagtgtaaagaatctttatcaaactgccatggcctacctaataacatagaacatgcttgcataggcacaacatcacagttgattgaatcatgataagaaccaatggcaaaatgtactcttaccaatcgtgttacctttaccttgccgctgctattaagccattgaatatagtagggctgcggatgtggctgtgtgctcaatgcaagtttctccaccatttcagcactagccaaattattgcagcttcctccatctatgatcacgcggcaagagcgttccttgatcacacacttggtttgaaacaaggtgtggcgctgattctgttcagccctttccatttgtgcgcttagcactcgctgcaccacgaggctctcatagtgctctgcagcttcagccctaatgtgttcctcatcttggtggggcgcgtcaccttcccctgcattgttagttgcaagcaaagcataggtttcttcatctaaatcactagcggaggagtacccaccatcagctctcacgatcattacacgagtgcttgggcagtccttgcgcacgtgaccatagcccttgcagcgtaggcactgaatatctcttgtccttcctgatgaagctactgatgatgagctcttggaaggtgtagcagcaacccctcttgttggttcactcgggcgtggtgtagagtttgttgtagagggacgcagcttgttgcttgaggacgatggtgctgctgctcgagttgacggtgcagcagcgttggaagatgtccaagagctagcacaacctgcagaaatgttagtcctgaagctagctcttcgtccctgtacttccctttcagctttacaagcaagatgaaacaaacgattaattgaattatattctttgtaggctagaatgtcctgaatttctcggtgaagagcattgacttcatcaaatcagcgctgctagtgctgcttgcgatttggttcctctcccatattcctaacaacaagtagatcacaacaaccatttagtagcacccaattctgagaagaacttgtatgattagctaggaatgactttacctgataattaagttcacgagctcgagctctagtcattggtccttgctgtgcaatacgcgtggttgtatcgttggaagggatgtcctcatcacgcggcgatcttt

SEQ ID NO: 91275 - DNA, 2214 bp, Oryza sativa
aaaaaaaatcacttcgtgattcgcgcggtgaacttttgtcaattaatgccaataatgtcacacgtgggtgcgaagttttcgaccagaatcaaaaagttcaaaaagcaacaaaacatgattttgggacatattggagtgtattgggtacgttcgttgcaaaaaatcacttcgcgattcgcgcgtagaacatttatcaattaatgccaatactggcacacgtgggtgcgaagtttttcaccggaatgaaaaacttcaaaaagcaccaaaacaatatttttggacaaattgtagtgtgtttggtgctttcgtggcaaaaaatcacttcgtgattcgcgcggcgaacttttgtcaattaatgccaatattggcacacgtgggtgcgaagtttttgaccggaataaaaaagttcagaaagcaccaaaaaaagatttttggacaaattcgagtgtattgggtgcgttcgtggcaaaaaaaatcacttcgtgattcgcgcggcgaacatttgtcaattaatgctaatactggcacacgtgggtgcgatgtttttgaccggaatgaaaaatatcaaaaagcaccaaaacatgattcttggacatattggagtgtattgggtgcgttcgtggcaaaaaaaatcacttcgtaattcgcgcggcgaacatttgtcaattaatgccaatactggcacacgtgggtgcgatgtttttcaccggaatgcaaaagtttaaaaaacaccaaaacatgttgagtttgcttataatcgttcacaacattctactactaagaagtgcccttttgagattgtttatggccttctaccccgtgctccaattgatcttttgcccctcccaacttcagagagagtgaactttgatgcaaaatatcgcgctgaattgatgttaaaactgcatgagaccactaaggagaacatagagcgcatgaatattaagtataaacttgctgggagcaaaggaaagaaacatgttgcttttgaacctggtgatttggtttggttgcatttgagaaaggataggttccctaatttgagaaaatctaagttgctacctagagctgatggtcctttcaaagtgctacaaaagattaatgacaatgcatacaagctggagctacctgccgattttggggttagccccacgtttaacattgcagatttaaagccatatttgggagaagaagatgagttagagtcgaggacgactcaaatgcaagaaggggaggatgatgaggacatcccttccaacgatacaaccacgcctattgcacagcaaggaccaatgactagagctcgagctcgtgaacttaattatcaggtaaagtcattcctagctaatcatacaagttcttctcagaattgggtgctactaaatggttgttgtgatctacttgttgttaggaatatgggagaggaaccaaatcgcaagcagcactagcagcgctgatttgatgaagtcaatgctcttcactgcgcgcgaagcacgaagtgagttcttgccacgaacgcacgcaatacactccaatatgtccaaaaatcatgttttggtggtttatgaacttttgcattccggtgaataacttcacacccacgtgtgccaatatatgccaatatttgacaaaagttcgccgcgcgaatcacgaagtgagtttttgccacgaacgcactcaatacactccaatatgtccgaaaatcatgttttggttgtttttgaacttttgcgttccggtaaaaaacttcacacccacctgtgccaatatatgccagtattggcattaattgacaaaagttcgccgcatgaatcacgaagtgagtttttaccacgaacgcacccaatacagtccaatatgtccaaaaatcatgttttggtggtttttgaacttttgcattccggtgaaaaacttcacacccacgtgtgccagtattggcattaattgaaaaaagttcaccgcgcgaatcacgaagtgagtttttgccacgaacgtacccaataaactccaatatgtccgaaatcatgttttgctggtttctgaacttttgcattccggtgaaatacttcacacccacgtgtgccaataaatgccaatattggcactaattgacaaaagttcgctgcgcgaatcacgaagtgagtttttgccacgaacgcacccattacactccaatatgtccaaaaatcatgttttggtggtttttgaactttt

SEQ ID NO: 91276 - DNA, 703 bp, Oryza sativa
ttttgttgaatgttgtgaagtccctgcaaaacgttagtaacaggagacacaaaagattgtcctggcatgtttgcacaccatcattgcataaggatataagagattcagaagcaagagataaatcacattgttcatgcttcctcgcatttgatatgttctgactctcaatgctatgagcaagcatgaataggtgtccaatatgattatatgtcacattagcaagcaaaacctgaattttagaaataagccccttgaaaaatttgcgcattgtgttttcattgcactcttttagatcactgtagatgacacaaactttaaattcatggatgtactccctaacagttctgtcaccttgattcagatgttcgaatttctcatgaagagtacatttgtaataagaactcacaaaacgatttctcatcatgtttttgtattcatcccaagttttaggtttgttactaatataagtccaccaaaacaatgcagaagaggtaaacttattaccagcagccttaatcatttgagcatcagaaaaatcatatttgtcaaattcattgtctactgctagttcccaatcaatatatgcaacagaatcatacttaccattatagaatggtaacttagattcaactcgcgcaaaattatagtcatgtacctcgaatgcatcatgtggagaagttgtcatatcttgtagacagtgaag

SEQ ID NO: 91277 - DNA, 702 bp, Oryza sativa
attcctgcagccctatatggcaatattggcatcaattgaccaaagttcgtcgcgcgaatcacgaagtgattttttggtaggaacgcacccaatacactccaatatgtctaaaaatatgttttggtgctttctaaactttttcgttccggtcaaaaacatcgcacccacgtgtgccaatattggcattaattgacaaaatatcgccgcgcgaatcacgaagtgactttttgccacgaacgcacccaatacacttagaatatgtcgaaaaatcttgttttggtgcttcttgaactttttcattccggtcaaaaacatcacacccacgtgtgtatcccaatattggcattaattgacaaacggtcgccgcgcgaatcacgaagtgactttttgcaacgattgcacccaatacactccaatatgtgctaaaatcttgttttggtgctttttgaactttgccattccagtcaaaacgatcgcacccacgtgtgtatcccaatactggcattaattgacaaaagatcgccgcgcgaatcacgaagtgactttttgccacaaatgcacccaatacacccgagtatgtccaaaaatcatattttggtggtttatgaacttttgcattccggtgaaaaacttcgcacccatgtgtgccaatatatgctaatattggcattaattgaccaaagttcgtcgcgcgaatcacga

SEQ ID NO: 91278 - DNA, 844 bp, Oryza sativa
aaaaattgtccggacagacggaactatccgtaccagtttcaaccctgcccccacacttatcctttacccgtccttcagtaaagcttagggatctactagaattttgattttctgcccaatgatatgacacacaaaatattccaaggtttcagggttatggataccacatacctaatggtagttgactaaatctcggaaggacccaccacgtaccatgtcttgtacgaaaacaacctgcggatttaggaggagttccggataaggaaagacaaccagagttctacatggaaacgacaaggactactcggattgtatccatattggtttccctagttctacttggacaaggggacacctatgagtataaatacaaggccccctaggaggggaggggacaatacacacccaccatagaagacacggaacaacagaagctacaacatacaagccaacatacgccaagacaagacatcggatatcgacttcagggataggataagcacggctagtcccctacggtgtctccggatactgtcaggagagagaaagcgctatctctgatctcgccgggcacaaactcgaggaggaagactaccctgttgtcgactatgagtcagaccttcagaccgccatatcgaaaacagttagataggctaccccaaatattgtactggtgtgattatggtgaataagagcaataccggcttcggccaacaggatgtagggttattacctgacaattcaggggcccgaacctgtataaaaattcttgtctctgtctctttcacctcagtctcgcatatatcctagtaccaacgatccccatactatgcaaataccggaa

SEQ ID NO: 91279 - DNA, 583 bp, Oryza sativa
ctcggtacccatactggccatcacatgaggtggacggtactccaagatgctgtagttgtgaaagaatggaggtacgttcaattaccatgtttgaatttataaatctgattcagcatacttggtcagatatgttgctgttgcaaaattttgatcagttcatcaaaaaatggcttgtgctcttatcagccaagggaatcaagatatgtattgctggacgatggtcgcaaactctgcctggagtgccttgattctgcagttatggatacgagcgagtgccaacctctttatcttgaaatacaggaattttatgaaggcctaaatatgaaagtggaacaacaagttcccttgcttcttgtagaaagacaggctttaaatgaagccatggaaggagagaagactgtatgttgaccaaagctggacaatccatgattctcctgtttttcactatactaatgttagtaaatattttgtttcctgtggaaaccagggtcaccaccatcttccagaaacaagaggtttatgcttatcagaagagcaaactgtcagcacggtgagaactattctgagcatgagatgaatggat

SEQ ID NO: 91280 - DNA, 621 bp, Oryza sativa
actatagggcgaattcgagctcggtacccttgcaaaaactgcaaaagtagcagattacaccatatagtcacgagcgcgtccagcgtgctcaatttcaagcagacactagaattcagaacttgcgaatatagttgcaaaaagcagacaatagacaaccagtacgaccttggcaacagcatgccttttaagttcgataacttcttgacacattactatcatgatgatgtgactcagtaatcctttcgccttaatcccttccagcataggatgaggctggcccacgcccatcaatttctggatctgaaacagaggagaggaatagtcaagtttacattatagcatgagaaagtaaccaaaataatttgagcaagaccaaagaattaatatgcatacagctgctttcgaagtgttcctgcgtaagtagagcgaatcagactcgttgcagctgcggcgtccttccctgggccagcacagtcatgtgattggctgattgctaatcagagtcttcatacaatccctcatcgtcagaaagctcatcaaatgaccggatatctagctggtaacgcaagataccaccaatgccaccgaatcctctacaaaactgagatccctcttgagatt

SEQ ID NO: 91281 - DNA, 696 bp, Oryza sativa
gcctgcaggtcgactctagaggatcccccgctctccctgatcgacgtcaccccgaacacatccgtgaagaagttcgtgtcgtgcgcgaggtagaagaagagcacggtgaccaatgccatgtaggtgccgagcaccacccccgtgaggaagatctcgttgagcttccaacaatcgggcgtcggcgacggcttgacgcgatccttggagatggtcatgatggtgccgtcgttgaggatggcgatgatgagcaccatgaacggggcgaagtcgaacttccagatgatggcgatgaggaggaagccgaggacgatgcggatggtgatggacaccgcgtagatggtgtagttcttcatccgctggaagatggcgcgggaggtgagcaccgcgctgacgatcacgctcagcccgggctccgtcagcacgatgtccgacgcgctccgggcggcgtccgtggcgtcgtccacggcgatcccgatgtccgccttcttcagcgccggcgcgtcgttcacgccgtcgccggtcatgccccagatgtggctcatctcctgcagccgcttcacgatctcgtacttgtgcttcgggaacacgccggcgaacccgtcggcgcgctcgatcagctcgttgattggggaggccgttcacctggctgtttttgttgcccaggagggtggtcgacgggtacatgttggtgcccat

SEQ ID NO: 91282 - DNA, 688 bp, Oryza sativa
cctcactctcatctctattaattataaaaccgagctttccatacggacctgttaaatatgattgtaattgtctatactcagatggacctaattcttcaaaatttttagcatcaaaaacaacttgtcttgttttatagtcctccaatactcgtttccaaaaatcagatttgccaccattggtgcctataatatctcgtctctgaactgcgttaccatttggatgggacttgatgtctgttaggtgggatgcaaatactattcttagtgcgtctaaacaccattgttcaaattcagtggcaccttcatttcctatcggtatctgatctagatgagtagttatttgacctattgttttatttctaatggctgaattatctgaaataatattaatatcatattcgtcatttatctcctctgcttcctctggagcaagtgcattacgatttagattcaaaccaagccagtaacatggatgaattaataatttctcattactttcaaaacctttatctggagttcgcccgtcatggcaaaatgaataggatgaggtgtttttatcacgaataccaacaaatcctacactatacaaactttggagaattccacttgcctttaacaactgtatttcagacgttattttaggatctccattttcttcgattaattcgaaagatgcttctattttttt

SEQ ID NO: 91283 - DNA, 806 bp, Oryza sativa
attctgcagttatgcatacgagcgagtgccaacctctttatcttgaaatacaggaattttatgaaggcctaaatatgaaagtggaacaacaagttcccttgcttcttgtagaaagacaggctttaaatgaagccatggaaggagagaagactgtatgttgaccaaagctggacaatccatgattctcctgtttttcactatactaatgttagtaaatattttgtttcctgtggaaaccagggtcaccaccatcttccagaaacaagaggtttatgcttatcagaagagcaaactgtcagcacggtgagaactattctgagcatgagatgaatggatcttttcataatttaaattctatttcaattgtattggtctgctgtgttctgacttctgactgagttccagcatttatttttaatattttagatattgaggagaccaagaatggctggaaataaagttatggaaatgataacggagccatataggttgactcgtcgatgtgaagtgactgcaattctcattctttatggtctcccaaggtgaaccacttactatctgtttcataatgccattgttaccttgttgctactcttttaatatcaacaaaaactaggaggaatattcgaatttataactgatttgaaataatatttctttctgtgttggagaatacattcttctaaaaaatgttatggattcactgaagatattctggactgcatgctgactctacagagttaatgggaaaagatattactcttgtgccttgtcactgtagcttctgcagtacaatatgcaaattt

SEQ ID NO: 91284 - DNA, 1144 bp, Oryza sativa
ggtgcaatagctgcctgtggtgaacttggagcgctgaagcatggaaggcagctccacgcacatcttgtacagtgtggatttgaggcaagcaattctgccggaaatgcacttctaacaatgtatgccaaatgtggcgctgtgaacgatgctcgtcttgtgttccttgtgatgcccaatttagactctgtctcgtggaatgccatgatttcagctcttgggcaacatggacacggtagagaggcacttgagctatttgaccagatggttgctgaaggcatagatcctgaccgaatttctttcctcacaattttgacagcatgtaaccatgctggtttggtagatgaaggcttccattattttgagtccatgaagagggactttggcattagtcctggagaagatcattatgcacggctgatagatttacttggtcgctctggaagaattggagaagctagagatttgatcaagacaatgccttttgagcctaccccgtccatttgggaggcgattctctctggctgtcggactaatggagatatggaatttggtgcttatgcagctgaccagctgtttcggatgataccacagcatgatggaacatacatcctactgtctaacacatattcagctgctggacgttgggtcgatgctgcaagagttagaaagctaatgcgtgatcgtggggtcaagaaggagcctgggtgcagttggatagaagtaggaagtaaaatccatgtgtttcttgttggtgatacaaaacatccagaagcacaggaagtctaccaattccttgaagtgattggtgtaggatgagaaagcggggatatgttcctgatacaaagtttgtgttgcatgatatggagcctcatgaaaaggaatacatattatttgcacatagtgagaagctggcagttggatttggacttctaaagttgcctcctggagctacagttactgttttaaaaaacttgagaatatgtggtgactgtcatactgcaatgatgttcatgtcaaaggcggttggacgggaaattgttgttagagatgtcaggcggtttcatcatttcaaggatggagaatgttcatgtggtaattattggtgaatatttttttctgcggggatcctctagagtcgacctgc

SEQ ID NO: 91285 - DNA, 692 bp, Oryza sativa
tcttgaatagaactttgctgttcataaattggtatatatccatggttcttttggatatatggagaccttcataacctggatgtgaggggaagaacagttcctcattgaaaacagcttgatcccatgatttgggttcacgagaaaggcggccagctactctatccaaaagctcaatagaaggaattgttggccttatgaagaaaaatccggaattataaacccatatgcgcattgtgtgtgcgtatcttgcccagcccattaagggctcatcaaatacatcattgaaaccataagctgtcctattgtcatgaccatcactcattgactctacatcagcatctctgtaaagatgatcaaacggattctggaagaaaataatatcgatatctgataggagcacactatatccaagctgcaagaattccctcaatatgcgaaactttagtccagacacagcatggtttccacctacctttccaatattgtcaactccttcgtcaggatcccgcctataaaatggaacacctttagacttgcaaaaggtttcagtgctgtcatccaatgcaacaattaaataatttgaaatcccaactcgtttgatgttagtaaaccacatctcaagcatctctctcacattggagtttgccaacgcaacaattagttctttgggtaccgagctcgaattcgcctat

SEQ ID NO: 91286 - DNA, 1531 bp, Oryza sativa
aacttggattgatccatgacaagccattcgataggaccacaatgcttcagccaaccttgtatgccattgtcgagggaaatctaaaatcttcctattgatcagtttaatcaaactcttgttagacgcttcggcttgtccattggcttgtgcataatatggtgaagaattcaacaatttgatacccatgctatcggcaaactgaacaaactcgtcagacacaaagacagacccctgattggttgtaatagtctgaggaatcccaaatcggtagataatatgttccttaacgaattgtatggcatctccagaatcaactttcttcaaaggaattgcctccacccacttggtaaagtaatcggttgccaccaatataaacttgtgtcccttgctcgagggtggattaaccataccaatcatatcaattccctaacctctaaatggccaaggcttgatgatagggttcatagccgatgctggcgctctttgaattgctccaaacttcttacaatcttgacaccccttgtaatatctgaaacaatcctctagcatcgtcggccaaaaatatcctgcgcgccgaagcaaccactttatcttgtgagccgattgatgaataccacaaataccttcatgaacctcacccatcacaaccttagcttgatcggcactcaaacatttaagcaacaccccatctattgtgcgataatataactcatcatccaataaggtgtacttcaaagccttgtgacacaaccttcgtgaagccgattgagatggattatgcaaatattgatacacatcatatctctaatcatcggctatgatcgcagctatctccacctcgacgtcctttaacatcggcttgtatcctgatgcccctgagccaaatcatttgcttcaacattttgctcccgagacacatgttttagagttaccaaccgaaaactattcatcaattctcggcacttctcattatagattatcaatgtatcatttttgcactcatattctcctgccaactgactgatcaccatcaataaatcacccataatttcaattgcatcggcttcaacttccttgagcaactgcaagcctttgagaactgcttcatattcagcttgattgttagttgcataaggcttaatagtataggcaaactcgaaacttggcccccgaggagaaattataactaagccgataccacaatcatgagtgcacactgatccatcgaaaaataaagtccaagccacaatttcgactgagccgattgagtcatcacgatgatccacaataaaatcggctatagcttgtcccttaatcgccttcggtgactcataccgaagatcaaattccattaaagcaaatatccactttccaacccttcctttcaaaattggagccgacagcatgtacttaaccacatcggctttacatatcacagtgcattcattggacaatagataatgccttaactttgtgcaagagaaatacaaacacaaacacaacttctccataggagaatgccttgtttctg

SEQ ID NO: 91287 - DNA, 6872 bp, Oryza sativa
tgatttcttgctccacttcctggaaacgctccctgttccccattcgttgaaccctccttttctgattcttcataaaaataccagaagggcaccattgtgttgctctatcttcatcctcactttgatagtattctcgattgaccgggcccaacctttgatgaacgggaaccctcttccgactcagccgattacctctgttgtatgaccggcttgaacttctgtgtcattactacatccagggcaatcttcgatcgatggcagtctcatcccctcattccagtaaaacctgaaaaactcacaaccccaatgaggatcgaaaccatcaccttcttgctcgtagtacctctcctgctgcttatcatgcctcctttgatatttattgataatcttggtcgaattcaactgagagccttgagttttccctccattggctgatcttcctgctgtatgtaccatgttgacgggaaaaggattaccatcaactttcatcggcttcttggagtcatcaaatttgatctttcctccctcaatagccgcttggatctgctgcctaaagaccttgcaatcattggtggaatgggaaccagaattgtgccatttgcaatacttcctttttcccagctcctcagccgatggtattatgtgactggcaggaagctgtatctgtttctcccgaagtaaaaaatcaaaaattctatcggctttagtaatatcaaagtcatacctttcttcttttccagaattcttcacccattggcacggtataacattgcttcttacccactcagctgctgctacttcggaatcatcctcctcatcggaatcacatatataaggacacacgtgattgatctttttgaaattcttcttagcctccgcgaacctttgttcatgcaaggtcaccttctgtgcatgatgagacaaactttcaaattcctgagacaaaaacttctccttgatcggagctatcaagccctggaacgcgagatcggctaactaagagtctgtcaaagacaaactataacacttgttcctcatatctctgaacctctggatctaatcttgcacggtttcatcatgcctctgcctaaccgctgtcaaatcggagagtttcatctcatgagttccgttatagaagtagctatgaaattgtttctccaaatcaacccaaccttgaacagaattgtaaggcaatgaagaaaaccatgtaaatgctgaaccagacaaagacaaaggaaacaagcgaacttttaaagcatcaacaaccgatgccaagagtcggctgacatgctcataggtcgaggcaatgtcttgtcttgagaattttgaaaaatttggaaccttgtatcggttaggcaatggaactctctcaaaccacacagtgtaaggatgccgatacaaatttccagtatcttttggcttaagtgcaaactgctccctcatcacatctgcaatcatatcagcccattgtctctgctgaggtgccccttgcacttgctgctgtattgattcaaactgattgaactgaggagcatactgagactgaggtgatcctccttgctgatactggacatgaggcgaaggaggctggtattgataattcaaattacccccttgatagttctggaaattcggctgaatattacgcaccaagtgctcagggataacttgggctgcaaccgactgatctggttgtacagatgcacgagatgttcaggaaagacttgagtcacattttgatgtttgccgactatcgggtgtcctaaatccagtcggcatctgttgcaccgtctgttgccaaatcggttggattctcagctgccttggcggcgtctgctgaactggtccaccagtcggctgagttggcaaaaacaatgaagcaatttgctcctgggacagccgattgatattctgaccaggatgttgcgtttgctctcgggacaagagacgaggattattaactgtctgcctttgtgccgatgatggtgcagctggtgttggagtcgaagctgctgccatcggctgaacttgtggtgcattgggagtactgtgttgattacttgtcgccaagctcctgtagtttgggaaaacaccccctggcaaaaagactggccctgtggtctggtgttcagctattgtaccatcaatcacagacttaattatattggttaatgtattgacaggcactccggactggttaatcaaggcatgttgtacggcgtaatcaacttggtcttggaaattcatgcgcctaggaggttcttcctgtacttcagtgccatcttcaccaagatcttcaattgcaccatcctgaaggccgtcacctttatcgcctgaagcatcttcagcacctttaccaccttgagatgagcttgttccgacctcatcagtagcaacgacctttactttgtgtttttgaacaacttttccctgtcgggttgctgcgaacgacctcatgaactgctcctgagcgttcttcatcattagctcaaactcgttcttttgttctggtgataacttgtctatggtgactggaacaatgtttccttcattaagtacggacctagtaggttttggaatccttgtttgaggagggaccacaggctttcctgccgatgatggtgactgtggtggtttttcagccatgaggaaatgttgttgaaactcggtcccaccaggcgtgccaaaagcgtgttgatgtgaaaaacacacactggcctggaagatctgctaaacttcagtgcgggtccaaaagcttgcctttaggttcatgagcatgccagttgatttgatcctgcaatcaacaagaaataaagacaaaagaaaccgcggttaaatccataaacgatagccgatcggccagcagacgatgacatatcatttattctcgagccgatgtcatatgtgaatcgatcggcaattataagtaagcaaaataagactaaatccactcgatcggctatagatattaacgctatataatccttttatcgatgtatatttaaaccaagtgattgggatagatcggtcgccatgctgagacagtataaatcacttagatcgaagtatacattaacatgaagattataaactcttatagcatagctgatcagatagatctagcatgtatcagctaatactccgataccactctacgttaagatattaaaacatatagaatatatcaaatagaagcctaatatactttattgcaataagatcttaatataaagggcggatttagcatatcaattaagcatgtaagtcataagactaaatcaggtaagatcggctgaaaccccgatactatctctctagatgatcataaaaccagccagatatcataattataaatactactcaataaatcgaactcaaccgatgcaacattaagcataaagacaactatgagatctaagcaagatgatgaaaatctacaaaagatggtagatacacgacacaatctagattaataacaaaacataactctaccgattacttcctaacaataagaaccagccgctaacaagttatatagggcaactaacatagattgtaccacgtatatgataactcgacggattacataaacagggttaaagtgtcataaagatggaagcattaaccccgagaacgcaagccaccataacaagctttacctctagttgaagatcgaatcgatgcagctcaatcgaaagcaagaactcgtcgaaataaacgaaagtaaaatggtggcgatgcgccgagattgtattgaacgattgttaattgattacatgggttcgggtcatatttatacccaaaatacaagatatgtccttgccagacatgacgcttatttctaacaaactctaagataccataagtctttgcggcagactcttgcccaaacatttctctaaggaaattacataaaatatcctaattaatagatacaattgcctatctgagagccctatctccatcgcggcaatcttcgggaagcatcttgattgattctagaaacgtctttgaaaccgccattatcagaatcggctgcatcatcttcatcggctgtatcagttatcctctgtccgatccatctcagccgatgcagactccagctgatgccttcacagccgatgcatactctgttttttgaattaatctctttatcgaatccgcctcgatcccaatgtcgaacctagttcatgacttcccgaatttggttgtcaacagttggttcttcaaggtccaagttgcttaagcaaataagacaagacgagcaccgacataaccatgtcccacacgacactgcaagaagacaaacggaaaatggaaacacacgtgcaactactaactattcgtctactgctgcgaagggccaggacagaaggtgagaaacagcatgccctctgtgctgccactgccagaggctccatcctcctgaggaaccactagcgcaggctcggcgcggggagtctccaagaagcaggtccaagccagagactccaacaagctcgagcctggaggtactcttttgacagaggtagacgaggcgacgcttggggtggcagatctgctcctaggcgatcttgagttgacgtagctgctcctccatggcatccaactccttcttcagctgcaggttctcctgacgcagctccagaatcttcacgttgttctcgaccaaggcacgacgcaccaggtgatggaagtcgatgcgggccatgtcatacgcctccaccatacgtgccaggtgcacgatggtggtgtcgtcctctgagctggcatccttgaaggtggcgtagtcatgagatctgccatgacaagggtggtagcggaagggcgagtgctgcaactcgttcgggtaatgctgatggatagagccgatggcgaggtaggcaacgctcttacaagactccgggaaggaaccctgcctgccatgacagacagtgatgtcctgttgggagagccagtgataatcactgcggtgacctcccaagcagcacaaggcgtgtcgtcgtcgccgtcctgctccggtagcttcttgcctttatagtccactccatgaggatacccagagcaatgcgcaagctctgtagctttaaagcaaagccggtcaagttcagaccctggcggtcgaggttacgatggtatttcttacgatcacagatagaatccgcaagcgcatggatataccgatgtagcacttcccctacgaagtattccaagggtattgaatccaagggaacgtatgtgtttaactctctctccggttcatccaaggacaccaagtgaagataggcaaaggatatcgaggatttcctagtgagaaacagtttctagggaaagcttaattttaatcctaacgcaatacttcaggcactggcaacctgctgttcctagatgttgctctagtacgtacccgaacagggaggacttaagtgctctcgagagctgtcaacacctctacacccacctcaaacgtactgtggtatacactgcaattactagatattaactacctaaacacctaaacgcaatacttcaggcactagcaattaatatctacttcagtgtttataactcactaacgtaatcactatattttagttgattatagtgacaataatcccgtacgctgattaggaactaaccaagaggtaattctcacaagataaatctatattacttaggaagattattctattaatatcagagtaataaacagaataaaagaaacaagagaggattaccgacagctctagaattcctccgacttcttcaactctactctcttcctaattctagtatacaaatagtacaatacagcctcttgtaattcagctcaagcttggaagtgtgtgaagaagtgagagaagtgaagtctatttaaagggcatgtatgacgattattggaaggggaattgtcggaaatgccacccaaacgccatcagtaacgcatctgggacgtccacgccaaaccacatgatcaacggtggagatatgggttcggccgaaccgtggcctggcccaacaggcctaggttttggcctatggactccccatgatttgccttatccatttctgcaaattttgggccgactgtctagtgtttcaatgaagtctaaagcccatccttgatatggatacattctttcttcacttttagtctgaattttgtcccaacttctgggcttatcagcttcatacaaatatacaccaacacttgtggaatatgtgagatttaacacctatcactatgttggatgttttattatctaagttttatgtagacattggcagttttattatctcaagcacataaattattcaaaaccatacatgtacttgtgaactttatcagtggctaacttaccatcttgggtaattgataaatggaacgaccctgattccagtccttcttgctccttcttgctccctctgccaaattttatataaattttcgcaaaacagctctttccctcataatgactttctctctatcactctagtgtctctgaattttgtgggttctcaccaaggcattttgtgccataatttacccctattctacaggctgttatatgtagagcttgatagggataaattataacatacctgctgtcgcgtctcaaaacgactctaaaatacatcctcgaaattatgcctagaataattaaaatcgatgtgaaagcctccaacaattaaaatgtgcaaagttaaaagtcaaataaggcatggaggatttttgtatatttcctaaaagcctaaaatgcgtaaataaattttagtggaattttcagagcacaaataataattattaagaaataaacaaagttaaaatggttttataaaaagaaaagctctaaaaagtcctttcccccccc

SEQ ID NO: 91288 - DNA, 1804 bp, Oryza sativa
tccccacgcaccaaaggcatcatccaatactttacaaggcaagtgaagcagcacacagaaggacttgatacagatttgcaggtgacaaatgagaagattggacaattggagtccacgcagatctccaccaacactaagcttacagggttggagacagcggtcgcccgcattgacactagccttgctgctcttgtgaggcattttgatgctctcaatgctggaggcaatggtgggggtaatgacgatgacattgacggagagtacgtcgaggataatttagaggatgaatatattgctgacactgaacaagatgatcgagatgctcaagatcgtcgacggctacacaacaatcgacgaggtatgggtggtcgccgccgacgcgaggtacgcaacaatgatgatgctttttctaaaattaaatttaagattcctccttttgatggaaaatatgatcatgatgcgtacctctcttgggagattgctgttgaccaaaaatttgcatgccatgagtttcctgagaacactagagttagagctgctacgagtgagttcaccgattttgcttcggtttggtggatagaacatggcaagaaaaatcctaataacatgccacaaacttgggatgctttgaaacgggtcatgcgggctagatttgttccttcttactatgcacgtgacttgctgaatagattgcaacaattgagacagggtgcgaaaagtgtagaggaatattatcaggagttacaaatttgcttgcttcgttgtaaattagaggaaactgaggacgctgccatggctagatttttgggtgggttaaaccgcgagatttatgacatcgtagactataaagattacactaatatgacccgattgtttcatcttgcttgtaaggctgaaagggaagtgcaaggacgacgtgctagtgccaaggctaatttttctgcaggtaaaacttcatcatggcagacacgcaccactcctccggccggccgtactgcttctccatcttccacacccacaaccagtcgagcagcacctcctacatctagtgacaagtcagcgacaaaggccgctcagccagcaccgagtgcttcttcaatggcatccacaggccgaatgagagatgttcagtgccaccgttgcaagggcttttggcatgtgcagcgtgactgccctagcaagtgagttttggtagtcaaaaacgatggtgagtactcctctgctagtgatttcgatgatgatacacttgctttgcttgcggctgaccttgcagataatgagccaccggaagagcacattagggctgcatttgcggatcactatgagagcctcattgtgcagcgtgtccttagcgcacaaatggagaaggcggagcaaaatcagcgacacacgttgttccaaacaaagtgtgtcgtcaaagagcgttgttgtcgcatgatcattgatggaggtagctgcaacaacttggctagcagcgagatggtggagaagcttgcacttagcaccaaaccgcacccacatccatactacatccaatggctgaacaacagtggtaaggcgaaggtaacaaaactggtgcacattaattttgcaattggaaattaccatgatgttgttgaatgtgatgttgtgcccatgcaagtatgtaatattctgctaggtagaccatggcaatttgatagggattctatgcatcatggtaggtccaaccagtactcttttctgtaccatgataagaaaattgtgttgcatcccatgtctcctgaagatattttgcgtgatgatgttgctaaggctgccaaat

SEQ ID NO: 91289 - DNA, 1309 bp, Oryza sativa
tctgctaggtagaccatggcaatttgatagggattctatgcatcatggtaggtccaaccagtactcttttctgtaccatgataagaaaattgtgttgcatcccatgtctcctgaagatattttgcgtgatgatgttgctaaggctgccaaatccaaatgtgagagtgataaaaaagcccaatctgatggcaagaaacctgagacaatcaatttgaaacccaaatgcttacttgctactaaatctgatattaatgagttgattgcatcaccttcagttgcctatgctttggtatgcaaagatgctttgatttcacttcacgatatgcaacattctttgccccctgctgttgctaacattttgcaggagtactctgatgtgtttcccaaggaagtgccaccggggctgccaccggtgcgcggcattgagcatcaaatcgacttgatcccaggtgcttccctaccgaaccgtgcgccataccgaaccaaccctgaggaaaccaaggagattcagcgtcaagttcatgagttgcttgataaagggtatgtacgcgagtctcttagtccatgtgcggttccggtaattttggtaccaaagaaagatggttcatggcgtatgtgtgttgattgtagagctattaataacattaccattcgatatcgtcatcctattcctaggttagatgatatgcttgatgaattgagtggctctattgtgttctccaaagctgatttgcgtagtggttaccaccagattcgtatgaagttgggtgatgaatggaaaacagcatttaaaacgaagtttgggttgtatgagtggttagtgatgccttttggtttaactaatgcacccagcactttcatgaggttgatgaatgaggttttgcgtcctttcattggaaaatttgtggtggtctactttgatgatatcttgatttacagcaagtctatgggtgaacattttaatcatttacgtgctgtttttaatgctcttcgtgatgcacgtttatttggtaaccttgagaagtgcaccttttgcacagatcgagtttcttttcttggctatgttgtaactccgcaggggattgaggttgatcaagccaaggttgaggcaattcagagttggccgactcctaaaacggtctcacaagtgcggagctttctaggactcgcggggttctatcgccgctttgtgcaggatttcagcaccattgctgcaccattgaatgcgcttacaaagaagggagtgcctttcacttggggcacatcacaagagaacgccttccacatgttgaaagataagttgacccat

SEQ ID NO: 91290 - DNA, 819 bp, Oryza sativa
tctaagaaaggtttcttaccgatgtcacatggcattaatcttggcaagaattagtgtcctcaaacaactgatgagcgaaacaagatgagtgtgattccatatgcctcggctatcagatccatcatgtatgctatgctatgtacacgtctagatgtttcatatgcacttagtgcaacaagtcgataccaatcagatccaggtgagagtcactggatagctgtaaagaatatcctgaagtacttgagaagaactaaggatatgttcctagtctatggaggacaggaagagctcattgtaaatggttacactgacgcaagcttccaaaccaacaaagatgattttagatcgtagtctggatttgtgttctgcctgaatggaggcgctgtgagttggaagagttccaagtaagatacagtggctgattctacaacaagagccgaatacattgccgtttctgaagcagcaaaggaggctgtttggataaagaaatgtttctcaactaagtgtgatgactagtgcttctagccctatggacctctatttttgcgataatagtggtgccattgtgcaagccaaggagcctagatcgcatcaaaagtccaaatacattttacagcggtatcacctcattcgcgagatagtgggtagaggagatgtgaagatatgcaaaatacatacggatttgaatgttgcagatccgttgacaaagccattccctcagcctaagcatgaggcacacactagggcaatgggtataagatacattcatgattgactctagtgcaagtgggagactattagtgatatgccctagaggca

SEQ ID NO: 91291 - DNA, 1194 bp, Oryza sativa
agagtttttcaatcaagcgctatgttgtggatcaattgtagctaggaaaagggtatgtaagcctataaaaaaagtgacaatgggaatcattgatctcagggaaaagaacaaagctttattacccaaacatttgtacaagttcaattacaaatgcccttatccttcggtgaatttgatttggactacatattactcctcttcagttccacatgctgccagattatgtggtcgaatttggtggaaagatataacgcaatttgatatcattttcaaaggcatgactaaacctattgtggacacagtaagggtatgtttgctactcagggttcccaacccttctccctcgttttccgtgcgcacgcttttcaaactgctaaacggtgtgttatttgcaaaaagttcctatacgaaagttgctaaaaaatcaaattaattcattttttttaaaaaataactaatacttaatttatcacgcgttaatggaccactccgtttttcgtgcggaggggaagagttcccctccagatctccaaacgcagcataagttctgttttgttctgggtggacttgtgggaaggccaagttagggcacaagcatatccaaaaatgttttcctttgtgagacataaagatgattctatccagcagttcatgacaagacaggttcaagaccaattcctctatctgtgcaggctcatgatgaatacaataacatgaattgggaattggtaccattcactttgtccagcaaagatgctatatggacttatataagctctaaagtgtgagttctacaagctctaaagtgagttctacaaactcagtaattatgaaaataaaggttttcacatatatggttattgttgatggacataatcaattaatactagggagtagggacctactacctgataagaagaaatgtaagcctccaaatgtaactattaattgctccttttgtgccagcctgatactagatagaccggataacacctcttttttttttagtgagttcagtcagaactgttggacaaagattagttttcattggaacctaaaccaggagatccatgggatggttcaacagcgaaaaaaaaatctcttttggaggttcatattttatggatgtttttcggcttgctgcatggaatattgggaagcaacacaataagaatatcttcaataatgtccaac

SEQ ID NO: 91292 - DNA, 12607 bp, Oryza sativa
ctttggcacagtggcttactcttacccctgattcccacgagacactgcttctctttgctttgggctgttgaaagacagaacagtaattagagcaccaatcacccgatctttattcaactcttgttccggaagttttcaaatgattttagaaatgaaaaccaagttcctcaattgattcactcaatctctctaagtgtatcattttgaattcctcaccaagagatgcctttttgattcctagtctaaggtttatatgtggagctcggtatagataaaacatggcatacttgcattcacatttattactaagttaaaaacttagactagagcagattactaaacatactcaagatcaagatcgtgcataatgtgtgtgtggtatatagtggaaatggtatatgaggaaaaataaaacaaaaaatgcttctcctttgtgcttactttcttctcccaaaaatccttcttttatttattaggagagggcatgattacatttttttttcaatatcacactcatgcttgatggagcataactttattttttttcataaccatgcctttccctcgtctctttttttttcaaaaggatatatttttttctttaggagaagaaagcacatgaaagcatggagaatttattttggtggtaatatggaaatggagtggaatattgcttagctcccagtgtaggagtttagcatgtgcataaatgcggttgtatgatcttaatcatagagcatgagaagtatctacacaagtcacaagagtttgacaaagttcaatggaatggcaagcaaccaaaatgtatatggtttaatcatgatagcacatttttggctctggtaggaatttataccaaatgaggaactttcaattttattattttgaaaaacaaaacatctggaattcaagccaaactagtatcaaggtcatagctactcatatttactatctcgtatctcgcaacaacctagacttagattaggaagtgcagcccatttacctccggttcctggataattgttggctactcatatttaacctttgatagagtatataaaagatataaaacagagcaactattcatcatttcaacaaagagaactagcttgtcttacctagcatgactcaaacctatcctatttttttggtattttctattttgcaaatttttatgttgttttgaagttttataagatgcaattggaaatcaaatatgcaattggaaagggaaatatgcaatgtgatacaagttacctcattggagggagcgatgtctccccccaagcttggctttcgctcagggtccttgataaggattgaacccctgaaagcggaagtacgcctgaaggtcatcatgctgttgttgcatcatgttgttgatgttggtgaactgagcatcagcagattgttgccatcttgcgtttgtgctatgtgttccgtgaggtcgtactagatctcccccgtctgcatctcaagggtgtccatcctcctagtgatttcacccaagtcccaacgagaggaactcgagcgccattcacttggagctggaggcacaccacttgatctggagggttggttgtcccccctagtggatgtcatgaggcgcatgccaccggtcctcactggcgcttgcccaagttgagactccgatgctatggcgtggagcttgggtccatctgggtgcatccccagttggtgcccaacctgcctcatacatctgcacaagtgtcgaggatgatgaacttccttgttcgttccttgtcatgttgcgcgtctccctgtatgttccacctgcacgagattcttctatggtctgcaggggaatggttagttcatggcagttgtacaaatgataccccgcatttggcaatgggatttcatttgtacaaccggggaaaaagtataccaaagatccatctactccacgtttcaaaatatgcctttgcactagataggcctcatcaatacgcggacgagcggctgagataaaagcaatttggtcactaacgatccctagcccttttgttatccgagtaatcagagaagtgcactcaacaggagcagtgaactttgtactttctaaccattgtcttattatacatttcacaggagaaattttgatctttctaaccatggcaaacatgataattaattcatctcccctaatgggtctcagatcacttctaggaaacaaagtcatagcaatccatttgtgcatgagcctaagtgtaggattatggatatcattcgttctaggtatcttgcaaattggagcaccagaaatatcttcccaaaacctatttttctcgaacccagaaattcctttctggagatcgattttacaggaatcatgaaaaccaagaagtgtacttaagcctttccatgtgagcgtgaactccttacggaaaaagcgaaatgaaatatcatcttctatttctttcaaagtgtacagaaattgcaaagtaagcaaacaagaactgggctactctaccacagcaaatctctgccaaccaacagctttccaaatagaacgaaattcaacatccatacctattttttcagcaactccggtgagtattctcgcgtgtgagcatactcccggtcgctcagcatgtagtaggcttgtctctcccgatcgctgacaaggtcaaggtcagcgtcgctcaggagttgtcgcggagcgtcggcgtcttctatcgagacatcagctgaggaacgagtgctagactcgtcatgacgactttatggagagcttgaccccttgaacagacgagacagtcgcctcctcatactacacaatggagaaagaacaggctaacttggctggggttagaaatgacaagagtttcacccgccggttagtttcaccaaagcaacttgtatgtatgcaactaaagatttgaactagaggaaaattatcaaagcatgaatgaacttgagagcaaactttggagagggaatgaaaatgtgttgaaatggggtgaagtcccttctcccagccggttggcttaagttgtgcacccacaacggtcaaaactaacctgtggggcccactagtcgttgcctcaaaaagtgaggcagctgaccgttgcctggccggttcggccgaaccagggtgttcggccaaacccttggtgggaccaaccagccccactttcggccgttggattccaacggtcagtgtggtcatggcacaatgaattttcgttgaaaattttactttggtttgctctgaaaaattcaattgaagaatttcctccaaattcaataaccctaaaagcaattttgaaattcaaacatgtggtgatgcaaaaattcaaattgttgacagcaaatatgcggatacataccaatttacctgttggcgaaggtcgtgtcatttaaaatccgacgtgcaagaccgtacctcctttcgatttagttcgtggattttccacccatttccggaggtgatggagcgggcgtttttggcttcttcctccacaccttctttgatttcggtgcggaagatggcttcgtctgagccggctgttctagcttcttggctggtgcaggtgattttaccagcgtcctccaataacggttcctgggcattgttgtttccttttctaggaagttctacataaaccttaccaggctatccgtcttgggtggctccacatcgacaacttggatattctgtgggtttggcctgtactttattctgaccatggtgcattgttccatcctcggttgaaactcaaacttttcctccttcccgttggtatggaaacggatactccccgttcccacgtcaatgttggctcctgcggtgctaaggaacggacggcctaggatgagcggcgtctctttccctgtatccatgtccagcaccacaaaatcaaccgggatgaagaaatcccgtatcttggctggcacatcctccgctatccctaccgggtaatggactgacgagtcagccagttggaggcgcatcggtgtcggtgctaacaccgtgaagttgagcttgtcaaagacgtcttttggcatgacgctgacgctggctccaaggtcgcacaaggcctggtcgaattgttgtgccccgatcgaacaggtgatcgtgggacaccccggatctttcttcttctctgggagtttgtgcagtatcaggttgctacagtgttccgtcagcttgaccacctccgttgttgggagtggtctcttgttgttgagtatgtccttaaggtaacgggcgtacgttggcacttgcatagcgtccaacaacggcacgttgatgtggatcttttggattacttcaacaaaacaagcgaactgcttgtccactgacggtttcctactctgttgaggaaatggcagcagccgtgtgtcgcagtactcctgcggcactgttttgtctggctggatctccttgtcatccgagtcagtagatggcgtttcttttgacatcccattagttcctgcagggttaggatacggcggatcacgagtggacttacctccccttgttgtgatcgccttaacattttcaatggaggagtcgggttgccccggaatcctcccggactcatttgcagggactaaagatgccaactgagctaactgggtttctatcatcttattaaagctcagctggttttgaaatgcagaagcgaagccatctagcttgacatttatgttctctaagatcttatcattggcagcaagcttttttcttagtgcatcagtggttttagcttgcgcaaaaacaagatccatcaaggagggctggttagagaagttaccgttattgttgcctcctggataatatgggcgtggttgattccacccctcacctccttgtggacgatactcgttgtttttgcccatgtacatcgcctcctcatgggtttccaggcagtcgttcccagaatgacccgtgcctccgcagacttcacacgtgacgtgtgagtccaaggccttgacggtgccttgtggccgtttctcgtggtcgtccaagcatttcatgaggaggtccagcttggcagcaagtaactccgtctccttgacggtgtgcatgcctcgctgacgggtctggagtcgttccttactccaacccgtattggagaccatcttctctatgagttcaacggctccttgaaccgttttagagaagaaggctcctccagctgccgcgtccaggtgatcgcgggacattagggtgagcccattgtaaaagttctgcaggatcaaccagtcgtccatcccatgatgaggacaggcggccacgtactcctgtagtcgttcccatgcttcaggaatggactcgtcccttgtctgctggaatctggaaattcgtccacgaagggcgttggttttgcctatcgggaagaacttcgagaggaatgacgtcgagcatttatcccaggtgttgatagcagcacaattggcatagaaccactgcttcgctctcctgaggagggagaacggaaacagccgcagcctgacagcgtcaggactaacgcccttgatggtgtacatgctacatatctccaggaattgtagcagatgagcgttggcatcctcattaggcttgccacagaacgggctagcctatgccatcgtaatgaggttggacttcaggtcgaaatccacatctcctatgttgatttgtggcccgacggccacattcagcagagggagcagcgaactcgcgaagagtcttgctggccataatcttgaaggtctgtggcgctggtacggctggtttctctgtcggtagagttttctgcggagcaacgactcgcggcctgacgcttcggaagaaagcttttggattttctttgaagttttccggcaagttgaaaccagccatgcactaccctgttttcacaacaaaaagtgaaaacaaccaaggttagcctgcaaaggaaattgactatacaaaggtaaatataaagtattagttttaagtaatctctattatgaatcttccccggcaatggcgccagaaatgcttgttagtccttttatagctgaactatgacggttgtgacggttggaatggtcggtaataccctccaaccgtcattggggcttcatctcaaccgtccagccaaaacctggatccaacagaggcgagggaggttcgacagaatcaccaggttcgaccgaacctggtgctggcccaatccagcccaatttcggctggcggcctcctctgctgcttcacttcgtagacttgtgaattttggcctgattcttcgtgtcaagtctgtgttcttggcccattcatacacaagtctggttctcgacatcgtccgattgatttattgtctgagttgatgttgattctccttcactttattgtcattctctacaaaaggttagtagacttaatactagtggaatattattattcttgcatatttatgcattgcaagcatcactagttctctcttgttttggtaatattgacggttgaaactgatggataacgaccgtcaacagttacctgagtcgttgtggagtgtgatcgccccgtgcgaagaggtgtcgatgatgtcgaattgtccttcccatttgctgcgtagttttccatggccgaagagcttaactctggagttgaacattagtaccttgtctcttggcttgaatttcttgatttttatctgtttatcatgccagcgcttcgttctttctgtgtatattttggaattgtgatacactttctctctccactcttctagctcagccaactgcatttttctccattctcctgctccatcgaaatccatgatccagtttctgatggtccaatatgctcggtgctcttgttctacggggagtcgacatgacttaccataaactatatgataaggggacattccaatgggtgtcatgaacgctgtccggtatgaccatagtgcatctggcagcttgtccttccatcctatgcccattttgttgaccgtcttctgtagaatatttttgatttgtttgtttgatgtttctgcttgaccgctggtctgaggatagtaaggtgtagcaacattgtgtttggcgcccatatctcgtaggaggtgtcggaaggtttcgtcgatgaagtgcaagcctccatcacttatgaccaatcttggggtgccaaatcttgggaagatgatttctaagaacatatttttatcatgcttcgcatccgcggcgctgcacagcttagcctcaacccacttagatacatagtcgactgccaccaagatatactcgcaattacgggactaaagaaaaggtcccataaagtcaataccccacacatcgaatatctcgacttgtaagttatatgtgaggggaattgcatcgcgagcagtgattcctccttgcctcaagcagcttgggcgccttctgacaaactcttttgaatcttcgtacattgtcagccagaagaagccgcattgccaaatctttgcctgcatgcggaatgcaccgtaatgtccatcataaggcgaggagtggcatcgttctatgatcttaagtccctctttagttgaaacacatcttcttagcagcccatcaaagcaaatccggtataggtatgggtcatctcatatatgacgatgactctcatatttcagcttcctctggttttctcccggtagtatgtattttgacaccatataattaactatattggcataccatgggctggagtcgtgcactgtcatcagcatgtcatctcttaggaagtcatttatcggctgttccagcatattagtaatttgcagcctagacaaatgatctgttacggaattttctactcccgttttatccttaatttctaataagtcaaattcttggagtagcaatatccatcgcaagagacatggtttagcatctttcttagtgagcaggtattttagagcagcatgatcagtgtgaacaatcaccctagcccccaccaagtaagatctaaacttatgaatagcaaaaacaaccgcgagcagctctttttcagtggttgcataattcagttgggctccgattagagttttgctagcatagcagattgcgtgatgcctcttgtttttggtttggcccaggaccgcaccaacagcaaaatcgctggcataacacataatttcaaagggcagcgtccaatcgggaggttgaatgattggagctaagacgagtgcctttttgagaatttcaaaggattttaggcacgcatcgtcaaactcaaaaaggcgtgtgatgatgcccattgaaccgtacgagatggcgggtcgatgatggcagcagccccgttggcggaagtggccggattcatggcgccaaagatgaccagatggtccagatcttcttggcctcggcggctatggtgccggacgtcgacagttgggggaagagcaagcgcggcgtaggtggcaatgtgggcaaacaccatgggaagaccctcgtggtagccattgacggaagagagatctgcaagcatgttccctatcgacatctcaggcgccaccgccgatcctctcccgccacatgctatcaaggtcacttatcgaatgcaccgccgttgctggtgtccatctctacctcccgtatacaccgtcagctcagcttgtccacctgatttggctcgatagcggcggcttgatcctcaatcgcgggtgctgttgatgggggatcggctgtaactctccatcgaaggcatggaaggattggcgatggcaaggccgcgagggcagcggctagggaggggatggagtcacgggcaaagagagagagagagaggggcgaccggcgaaggtggaggaggagatttgtatgggtccgagtgggagaagaacgatatggcggcggctctggcgaggacgtggcatagcgccggcagtggggccgaggagaagtccgtgaggaggacagccgtggcggtggggaagaagaaggacggccgcgggctgaggtcgatgtcggttccggcggcggagaaggggccaaagtcggctccgacggcggctccggcagctgatccgagtgggagaagcacgatctgggaagaaggaggtggggaagagcggggcgcggcggtggggaagaaggaggacggccacggcggctccggctagggcgcggcgtagcggcggcagcggggagcaggagcagcgagtgaggaggacggccgcagcggcagcggggagtcgctcctgcgaggacacttggaggagtgagcgaggaagagaggcgcgcggtctccgcagctgcgggtggaggaggagtgatgtcttcgcgcgtggaatcctcggctgtgaaatcatgtggtggaggaagagaagcacgcggatggacggttcagattagtccggatgatttgacctgtagcattggaggggggcaactcctcctttttatattagtatagatgaagggtagcggaaaatgatccattttttagccttgttaagcttcctgtagtccatgcacatgctccgtccggttacagttcgttgtggaatgagttcattttgggcatttataacgaccgtcatccctcctttcttcggcaccacctggaatggactaacccactcactgtacggtacgggataaataatcccggtgtgtaggacttctagaacctctttctttacgacctcacgcatcgcattattgagccgtcgttgaggctccctggaggaagtactctcgggctcaatatgcatgcgatgagtgcaaagggcaggattaattcctttgacatcctggagggaatagccaagaacagagtgatgtttctctaacacagctagaagacgctgagtctcgtccttagaaagcttcctcagaaagcttgtcacttatgatgacaggagcttccttatcgccgtgcagaaaagcataacgtaggccttggggtagaggttttagctcaatcggaggtcgaggcggtggttctatgcttggaagctcgagagtctcacctggttctgcttcatattccactagtattcatgttagaataataatattccactagtatttggttcactaaccttttgcagagaataaccataaagtggaggagaatcgacatcaaactagacgataaatcaatcggacggtgtcgaggatcagacttatgtatgaatgagccaagaactaagaattgacacgatgaactgagccaaaattcaaaagtctgcatatgagaacaataaaggaggccatctaccgattttggaccatggcggcccagcccatggttcggccgaaccgcctgcagcgccattagatctaggtttctcctggatggctgagatgactccccaatgacggttggtgggtattaccgacctttccaaccgtcacaaccgtcgttctcaagctataaaaggagctctcctcctcacttcactcacacacctcaagcaaagctctctcatattctctcaagtttagtctagtgttttcaagctagtggagtaagaatagagtagaaatcggagtccggaagccttcggaagagttcgggtatggctctagtagctttcctttcctcttttgtaggctttatacttttattagaatactcttctttatacatttatggtattgaaatactttccgagtatatgaatgccaactttactttatattcatattatactgattatactgctagcttatctgggagatgcatcggtatgggtatagtgtttgcttatgcaattactctatgtcatgacgatgatattagagtagtatctggtagtttaggcgtggtgtctagattacggaatatcattatttgaggttatatgctgcggatgagagatgggccgctgatggtgacagcttagtatgggtattcctccgcgcgtgtatatagtcctaagttaatttcctggggagggtactcctccgtatttagccccggctgtatagtcatgacgggctgtcgtaaggaactcgacagtcaggggtgtcttgtcgaagtaccaagagggcattggaaagagggtattagctagttaatcatataactagaatgtatgtatactaggagtataggaatagattatcgtttctattttcttttcacttagcttagacattttagtatgagaatgagtagctccctgcttgtgtgtcactctaccctcggattattttaacccctgcttagactctgattattacaagtaacatataaattattagtccggttctctctactatgatcttcccacgagattaaataaatacgatacccttggaatactctcgggtgaaatgctacaatggtatatccgtgcgcttgcagatgacctctgtaaccataatgtaccaggattatttctgcaccattgctggaaattatatttctagtaatgacgttaagaaataccaacaacggtcaaggcgaaatttgctcgagaaaaaggaactgaaaatttgttccctcccaaaactatttcggggctatctaatcggggtgtatttacgaggagctgttctattgggtgcctgattagaatgttgaagtcttggatttcaaagacatgaagatccaagatcgcctccctgtcttcatagtagacatgcacgtcttgcacaatcccaaatccttcaatgatatttccattgggatgcttgaagaatttgtttgtcgggattattgctttatcgcttagataagctaatgcaaaggactcgaaaatgagattaaccccgacagttggattatagagaataccaacgttgttcccttctaaatgacatggaataactcagggatcggtatttatccgaattacgtcagatgaaagctctgcctcccttagccattcgtcacccattatggttgtcagctcccgaacagtttcccttaggaacccaagttccatagtatcgggaggtggcaaaggaacaagcggccactttttactgaaataattcagggtgtcgccgtaatcttcatcaaggccatccctgaatagaactggagcacgatccggagtctgaatttcttctttcgcaatggatgacggctcgggaactacttcgtcagtcgaataagttgaattagaaagttcaggttctgattcgactgttgaaggctcctttatcttagacacaaatgcctccaatgggggttcattgtattgtgccatgaagaaagtgttttccagaatgtgatctagaattacttttccttctgacggtgttttatgcatgaatgatcccccgacagttatgtccagataaaatgcagactcctaatctaggcccgtatcaaaatgttgcaaaagcacatattcgggtatagacaaggttggtccggattgcacaagattagtgaatctggaccaggctacacctattgattcgttgttaatctgttgaaaactaagaatttctactcgaagggcggtaatacgagtaaccgggaaaaaggcaagacagaacctgtcttgtaacttttccaaactaccgtttacacatcctacggtagatgtgtatcattgcttcatgccacgaatctgaaggcatgagcaaacttgctagaagtctcgcagatgatagtaggggttttcctgatcaagaccagaaaaaggattttccctaaccatactga

SEQ ID NO: 91293 - DNA, 566 bp, Oryza sativa
tgttactcggtagaatgctcgcaaggtcggctagaaattggcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaaggcgtggcaagccaacgttaagctgttgagtcgttttaagtgtaattcggggcagaattggtaaagagagtcgtgtaaaatatcgagttcgcacattttgttgtctgattattgatttttggcgaaaccatttgatcatatgacaagatgtgtatctaccttaacttaatgattttgataaaaatcattaggggattcatcag

SEQ ID NO: 91294 - DNA, 572 bp, Oryza sativa
ttatacaccgactgtacctcataaagatactactcaagatgcggacactcatgacgtagctctggttgaagccgactggcgagagcccttcatacgatttttaacttctcaagagctccctcaagataaagatgaagccgagcggatttcaaggcggagcaaactttatgctatgcatgaagctgagttatataagaaaagcccttcaggaattctgcaacgctgcgtatctttagaggaagggagacaattgctgaaagacatacattctgggatatgcggaaaccatgctgctgcacgcaccattgtcggcaaagcttaccggcagggtttcttttggcctactgcagtgtccgacgccgacaaaattgtgcgcacgtgcgaaggttgccaatttttcgccagacaaattcacttaccagctcaagagttgcaaactatcccgctgtcttggccgtttgcggtttgggggctcgacatggttggcccgtttaaaaaggcagtcggcggttacacgcatctctttgtggccattgataagttttccaagtggattgaagctaacccggttg

SEQ ID NO: 91295 - DNA, 2003 bp, Oryza sativa
attgcttaggagagcggggtttcattggccgaaaataattgatgattgtttctagtgctacagagggagtgaagcttgtcaacggatcggcaatgttcaattggcgcatgccgctgtattgaatcctatcatcaaaccatagccgttccgaggttgggctttggatttcattggtcaaatttatccttcatcatcaaaaggtcattggttcgtgctagttgcaatggattacttcactaagttggccgaagccatgctgctcgagaatattacttgcacggaggtaattgactttattctgaagcatgttgttcatagattcggtattccttaaactttgatcaagaagcttcttttatgtccaaagaggtgagaagttttgccgaattttatgatattaagttgttgagttcttctccttactacgctcaggctaatggataagctgagtctagtaataagatattgttgaaattagtcaagagggagattgaagaacactcaaataagtggcatgaggtgctttctgaagcattatggactcattggatatctaaacatggtgctaccaaagtcactccttttgagttggtttatggacaaaaggctgttctatcaattgaggtaaatcttggctctcttcggtatttcaagcaagacgatttgttggttgaagattacaagaccttgatgggaggcaattattaagacgtcatcgacaagcgtttgaagattttgaaagagatggaggcacttcaagacggtgttttcagagagtaatccatgggagatacatgaaaacaaatactttcctagcgtttggcaagatggttaggaggtcctatggcaggtaattggattttcgccctaagacaacatgttctatgcttttagattcacgatgttcatcaaaaaggcagaagggcagtgtttacacccaaatttggtacctatggacgaaatagaggaaaattgccaaagtttggaaagtgtcgggttcccttcacagggccggtcagaccacaggtatgtgggcggtctgaccggctagtagggccggtctaaccgcaggtatggggccggtcagaccgtcagggtccgagtctgagtttgttttcgttgggtctcgggtttccttactcgggaaggcatgtttcgggtttcttttggtttctatcccgagttggatgtagagaagggcctgtagagggtaagaccaacccctatttaagggacaatgccggttcattgtaatcccccgaatataatctacttgaatcattcttttaccatgttttctattttaccctagttttagtccatctttgtcgatttgcgctgaaaatcgtctgccgctactgtgagagtgtcacacctctttgttggtttgtcctaaaaaccttccgttttgcccacgagatgggtagttatcctcatatcgatttaaattggcctagaggctgattttgatttctaaatcggctccgctagccggtttagcttgtttttctacaaaacctatcttgatttggccttttggctagatcgaggtggttggcgactccatatcaccgcaaggcgtttaggtgttgcgatcgtgcttgtcgacttgtcacaaaaagttgccaactacgctacgcccacccactttctctagcaccaacagccccgtggatgccctggactggttgcatgcaagaaagaagttggataccgttcagtgcacggatgaagagaaagttgcctttgccggtcatcagcttcaggggcgcatcggagtggtgggacgacttcctggccacccaaccagccggacagtctatctcttgtgctcattttaccacagcattccgaaggactcatggagttttgggagctgaggcatggcaatcgctccatcgtggagtatgttgatatttcttaacaacattactagaaatataattctcagcaatgacgtagaaatattcatggtatatttatggtcgcagatatgatccgca

SEQ ID NO: 91296 - DNA, 1085 bp, Oryza sativa
aaagagatgggccgagccggcccaagagggggaggggggggggaaaaaggactttttagagcttttctttttataaaaccattttaactttgtttatttcttaataattattatttgtgctctgaaaattccactaaaatttatttacgcattttaggcttttaggaaatatacaaaagccctcgaagccttatttgacttttaactttgcacattttaattgttggaggctttcacatggattttaattattctaggcataatttcgaggatgtattttagagtcgttttgagacgcgacaaacctaccccccttaaacggaatctcgaccccgagattcggaaaaactggcgaagagatcgggatgggctgccttcagctcgtcttcacgctcccaggtagcttcttcctcggcgtggttgctccattggaccttgcaaaaacggattacccggttcctggtcctgcgctccatggtgtccaggattttcactggcctctccacgtaggtcaagtcttcgcgaacttcaatttgctctgagtcggtctgctcggacggcacccgaagacatttcttgagttgtgacacatggaacacatcatgcacgttgcccaaggaggcggacagctccaactggtaagcgacttctccgcgtcgggtaatgatactgaaaggacccacaaaccgaggtgcgagcttcccttttgtctgaaacctgtgtacacctcgcaatggcgtgactcgaaggtacacaaaatcgtccactgcgaattccaggttacggcgacggttatctgcataacttttctgccgggactgtgccacctttagattatcccgaatggttctgaccttcgcttcagcttctctcaggatatcagtcccgaacacttgactttccccaacttggtcccacaagagcggtgtccggcatttgcgcccatacaacgcttcataaggtgccatttgtatactggcttggtagctgttattgtaggagaactcggcataggggagactcttatcccaggtcttcccgaaatctaggacacatgcgcgaagcatatcttctaggatctaatt

SEQ ID NO: 91297 - DNA, 1476 bp, Oryza sativa
tggcttccaacgcagccaagaatccgcgaccaactatgcttaggttcagggcttccatctgttgactaagttcgagtggaatgccacggacgttaagagtgttgcaatggctttttcgacttagagcgtcggcgaccacgttggccttaccaggatgatagtgaattcccacatcataatccttgatgagttctaaccatctcctttgccgaagattcaggtcggactgagtgaagatgtatttcaaactcttatgatcagtatatatttcacagcgattcccaatgagatagtgccgccagatttttagagcatgaaccaccgcggctaactccaaatcatgggtagggtagttgccttcatgaggccgtagctggcgtgaggcataggccaccacatgaccatcctgcatgagcacgcaccccaatccttggcgcgaagcatcacaatacaccatgaagtccttgcgagtatccggcaagattaacactggcgaggaaaccagcttttctttgagagtttggaacgccttctcgcattgcgggctccacacaaatttctcttctttcttcaacaactgtgtcatgggtcgagcgattttggagaagttctcgatgaacctccggtagtatcctgccaaacctaagaaactgcgaatttgagtgactgtcttgggttgcttccaatcagtgacggcggtcactgtttcggggtccacagcgactcctttagcagatatcacgtgccctaagaatttgacttcggacaaccagaactcacacttgctaagtttggcatacaattgatgttcccgcaactttcccaacaccagacggagatggtgctgatggtcttcctctgattgtgagtataccagaatgtcatcaatgaaaaccacaacaaacttatccaagtattccatgaacactttgttcattaagttcatgaagaaggcaggtgcgttggttaaaccgaatgacatcactgtgaattcatacagtccgtatcgcgtggtgaatgcggtcttcggaatatcttcttcacgaatacgtaattggtgatatccggaacgaagatcaatcttggagaatacagtggcacctttaagctgatcgaacagatcatcgatccggggaagagggtacttgtttttgatggtgacttcattgagagctctgtagtcaacgcacatcctcttcgtcttgtctttcttctccacaaaaatcacaggagcaccccagggggaagtactcggacgtatataccccttttctttcaactcttccaactgtttcttgacttcggccagttcatttgctgccatacggtagggtcgcttgtacagaggagtggttcctggagcaagatctatccggaactcaatctctcgtttgggcggcataccgggtagttcttccggaaacacgtctccgaactctctgacagatgggatttctgacagtcctatctgatgaa

SEQ ID NO: 91298 - DNA, 1502 bp, Oryza sativa
aaaaaggaatcccctgaatttctatagggacggcaggactataatactttgctgtcataacccctccaggggtggtgatgaccagagggttcctaagcctttctacccccaactgatttctccccacgaatggcacagatataaacgagtgggatgctccagagtcgaacagaatggtagcagggatggaatgaatgaggaacgtaccaacgatgacgtctggagttgtcagcacgtcctcggccgtcacgtggttcacccgaccccgaatgacatccttcccaccgttgttggagcggggaggcgcttggccttgctgacgcctcggctttgggcatttatccgcaaagtgcccgggctcgaagcagttgaagcacagacgctgcggaccttgagcgtccctgcggccttgaccaggctgcacagttggcgtaggaggacggggcgcacgagtcccttgttgattctgctgctgctgcggctgtgggacgcgcaccacgaattgaggtcgaggcgcggagcgaggttgctgctgctgttgttgctgttgcgaggaggatccccctggatagggattggtgtagcggaccctttggttagcaccctgttgattgcggaaattcgccaagcggcgcttgtgcgactccagttccttgtgcttggcttccaagcggatgctcttgtccactagacgttggaaatccggatagtccccggagactagacggacggacagctcagggtccattcctgccaagaacttctcttgcttctcctcatcttcccgcacatcctccggggcgtaacgggccaggttgttgaactcatgcaaatactccatcacggagcggttgccttgcttcaactctcggaattctcttttcttaagggccacgactccggcgggcacatgggttctccggaaagcggcggtgaaacgggcccaagtaataggttgcccttctggctgcgtagcctggaaatggtcccaccatagagatgcgggtccctgcagctggtgggcggcgaagatgactttctcctcatcgctgcactgcacagtgtctagctttttccccacagcatgcaaccaatccaacgcgtccacggggttgttggagctagagaaggtaggtgggcggatgcggaggaactcggcgagtttagagtgttgtgggggtggtggtggagcattatgttgtggcggattttggaggtggtggaggaaagcagtcatcatgttggcctgctgggcgaggatttgggtgagaatggcgttggtgtctggtggtggtggtggaggcggaggaggaggtggaggtgggctgccctggtggtggtggttgctgccttcaggttggttgccatcaccggggttagcacttctcctggtcatcaccatctgaaacccccacacaagaaccagcatacagagagagctgacaatttaagcttaaccacccacgactaccataattcttgaatttattactgctattaaa

SEQ ID NO: 91299 - DNA, 2556 bp, Oryza sativa
atcgtccactgcgaattccaggtcacggcgacggttatctgcataacttttctgccgggactgtgccacctttagattatcccgaatggttctgactttagcttcagcttctctcaggatatcagtcccgaacacttggctttccccaacttgatcccacaagagcggtgtccggcatttgcgcccatacaacgcttcataaggtgccatttgtatgctggcttgatagctgttattgtaggagaactcggcataggggagactcttatcccaggtcttcccgaaatccaggacacacgcgcgaagcatatcttctaggatctgatttagacgctcggtctgcccatctgtctgcgggtggtatgcggtgctgaagtttaaccgggtacccagctcttcttgaagcttcttccaaaagtgagaggtgaattggcttcccctatcagatacgattttcttgggaacgccatggagactcacgatcctagcgaagtagagctcggctagtttgttccctccataggtggtcttcacaggaataaatcgagctaccttggttaatcgatccacaactacccatatagaatcatatccaccttgggtctttcgaagtccggtgatgaaatccatcccaatttcatcccatttccattcaggtacttggagaggttggagaagtccggccggtcgttggtgctctgccttgacacgctggcacacatcacaaagggccacgaactctgcaatttcccgcttcatactaacccaccagtatttctccttcaagtctaagtacatcttcgtactgccagggtggatggaataaggactttcgtgagtttcctgaagaatcagttgtttaagttctctgttatctggaacgcatacccgatttccgttccatagggttccgtgttcatcctctgtgaaaccagcggctttaccctgtttcatattcttgaggagtccatgcatgtccggatcgttcttctgagcctcgcggatttgatcgagcaaggtgggcttggcttccaacgcagccaagaatccacgacccactatgcttaggatcagggcttccatctgttggttaagttcgggtggaatgccacggacgttaagagtgttgcaatggcttttttgacttagagcgtcggcgaccacgttggccttaccaggatgatagtgaattcccacatcataatccttgatgagttctagccatctcctctgccgaagattcagatccgactgggtgaagatgtatttcaaactcttatgatcagtatatatttcacagcgattcccaatgagatagtgccgccagatttttagagcatgaaccaccgcggctaactccaaatcatgggtagggtagttgccttcatgaggccatagctggcgtgaggcataggccaccacatgaccgtcctgcatgagcacgcaccccaatccttggcgcgaagcgtcacaatacaccatgaagtccttgcgagtatccggcaagattaacactggcgaggaaaccagcttttctttgagagtttggaacgccttctcgcattgcgggctccacacaaatttctcttctttcttcaacaactgtgtcatgggtcgagcgattttggagaagttctcgatgaacctccggtagtatcctgccaaacctaagaaactgcggacttgagtgactgtcttgggttgcttccaatcagtgacggcggtcactgtttcggggtccacagcgactcctttagcagatatcacgtgccctaagaatttgacttcggacaaccagaactcacacttgctaagtttggcatacaattgatgttcccgcaactttcccaacaccagactgagatggtgctgatgttcttcctctgattgtgagtacaccagaatgtcatcaatgaaaaccacaacaaacttatccaagtattccatgaacactttgttcattaagttcatgaagaaggcaggagcattggttaaaccgaatgacatcaccgtgaattcatacagtccgtatcgcgtggtgaatgcggtcttagggatatcttcttcacgaatacgtaattggtgatatccggaacgaagatcaatcttggagaatacagtggcagctttaagctgatcgaacatatcatcgatccggggaagagggtacttgtttttgatagtgacttcattgagagctctgtagtcaacgcacatcctcttcgtcttgtctttcttctccacgaaaatcacaggagcaccccagggggaggtactcggccgtatataccccttttctttcaactcttccaactgtttcttaacttcggccagttcatttgctgccatacggtagggtcgcttgtactgaggggtggttcctggagcaagatctatccggaactcaatctctcgcttcggcggcataccgggtagttcttccggaaacacgtctccgaactctctgacgatggggatttctgacagtcctatctgatgaagttctgaactgcctacagagggtgggggtgcaaagaaaacaaccggtgttccggc

SEQ ID NO: 91300 - DNA, 979 bp, Oryza sativa
tttttgaaggctttcacatggattttaattattctaatcataatttagaggatgtattttagagtcgatttgggacgcgacaaaccttccccccttaaacggaatctcgaccccgagattcggaagaactggcgaagagatcgggatgggctgccttcagctcgtcttcacgctcccaagtagcttcttcctcggcatggttgctccattggaccttgcaaaaacggattacccgattcctggtcctgcgctccatggtgtctaggattttcactggtctctccacgtaggtcaagtcttcgcgaacttcaatctgctctgagtcagcctgctcggacggcactcgaagacatttcttgagttgcgacacatggaacacatcatgcacgttgcccaaggaagcaggcaactccaattggtacgctacttctccgcgtcgagcagtgatgcggaaaggacccacgaaccgaggtgcgagcttccctttcgtctgaaacctgtgtacccctcgcaatggcgttacccggagatacacaaagtcatccactgcgaattccaggtcacggcgtcggttgtctgcataactcttctgccgagactgtgccacctttaggttttcccaaatggttctgaccttagcttcggcttctctcaggatatcggtcccgaacacttggctttccccaacttggtcccacaatagcggtgtccgacatttgcgtccatacaacgctttataaggtgccatttgtatgctggcttggtagctgttattgtagaagaactcggcatagggagactattatcccatgttttcccgaaatctaggacacatgcgcgaagcatatcctcgaggatctggtttagacgctcggtttgaccatctgtctgcgggtgatacgcggtgctgaaatttaatcgggtacccaactcttcttggagcttcttccaaaagtgagagatgaactgacttccccga

SEQ ID NO: 91301 - DNA, 822 bp, Oryza sativa
ggcttccccctcctgaggaaccacgggcgcgggctcggcacgaggggtctccacgaagcaggtccacgccagggactgacaaacaagctcgggcctggaggtactcttgcgagcggtgatcttctggctgcggcagacgcggcggcgcttgggacgacagacctctccctgggcgaccttgagctgacagagctgcgcctccagcacgtccagatccttcttcagctgcagattctcctgacgcagctccaggatcttcatgttgttatcgaccatcccgcggcgcaccatctggtggaagtcgatacgggccgcgtcgtacgcctccaccatgcgcgccaggtgcatgatggtagcgtcatcctccgagctagcatcccggaaggtggcgtagtcgcgggctcctccgcggcgagggtggtagcggtagggcgagtgctgcaactcgtccgggtagcgctggtgcagagtgccgatggcgaggagagcggcgttctggcaagcggcggagaaggaatctccacccgcggtgactgccagcgaagtcctctcaggtgagccagagaggatcactgcagtgacctcccaagcagcgacgggctctgcatcgtcaccctcctgctctgggaccggcttgccctggtagtccactccatgtgtgtcacgtcctgataaattcatcccgaaataaaaatcattctctaaaaggaataatagaattaattaaaatttgaaaagaaattggcaaacattaaaatacgtacaagaaaaattcaaatgtgacccggagaatttttgttaaattctccttggtctaaaagg

SEQ ID NO: 91302 - DNA, 658 bp, Oryza sativa
tcttttaaagatcatttatctcttcagatcaaatgcatgatttacttatactgtgcatgcgctgtatgcctgcttttacttcctgggagaagttgaaaagtgagaattggttaattgtgccgtgacataccttgttttacttgtgcagtcaagttggattatagtgaagttatctgctgtgaaccaggctgcatgaaggcatttaccaacttggaatgcctcaaggcccataacaaatcttgtcatcgacatgttgtctgtgatgtctgtggaaccaaacagctgaagaagaacttcaaacgtcatcagagaatgcatgaaggttcctgtgttactgagagggttcgatgccacctcaaggactgcaagttgtcattttcaaaggtaggatttcaatctttcagggttgattctgtttcacagaatttttttatttctttccaataaattgcaaatcgttccatccttttcaattttttttttttgggggggggggggggactttgaactgcagaaatccaatctggacaagcatgtgaaagcagtccatgagcagaagcgaccctttgtatgtggattctctgggtgtggcaagagtttttcgtacaagcatgtaagggacaaccatgagaaatctagtgctcatgtgtacgttcag

SEQ ID NO: 91303 - DNA, 763 bp, Oryza sativa
taactacggggaggctactcaagctactaccgaaagctaggggggagatggagcgaggaggaagaacggagagaggcactaccgtgcggaggaggggcgctgtgacgagaggccgacggcgcgggagtgatctctccggcctcgggccggggaaggggaagagaaagaagagggtgcggccgaagtccccttccgcgtcctcgaacgcaccggctctcctggcgctcggcgagggacggcggaggcgagacagagcacgggggcggcggtaatggcgtggagacgaaagggagaggaagggaaagggggaggctggggtttaaatgggcggcaatgtcggtttgagaaccgacttgcgcggtcaagggcgcgagctggcgatcggcggtcgcggccaaagcggcgacagggaggatgacgccggcgaggaggaaaaaggggaaaaggaggggggaaaagggggcttgcccctttgccgatttgggaaaaaggaggaggggagcggggcgacgcggcagagggaaaggagagctcggcctccgcctcttggcggcttgcgcgcggagtggcgagggccgggcagtgacgacggcgatgacggcgggcggattggagcggagcgacgacacgggcgacagacacggcagacgctgacgacggcggcgaccaggcggtcggccaccacggcacgcgcgcgcgggaggcaacgggcggcgcggctgggcagcgggaccgggcgacgcggacggcgcagacgacgcgg

SEQ ID NO: 91304 - DNA, 1343 bp, Oryza sativa
atgcctgcaggtcgactctagaggatcccttaaatccacgcgaatcaatgcccttctttccaaattgattaggggaaattaaaccccattgaatcctcttcaattccccccaatttccctcttgaatggcgcccccaatcgtcgggaacggccgcgcttttcccggccaccaaccatggccgccggccgccattcccgtcgccgttccgccctcccccgtggccggctccctcttttctcatataaaatgggatcctcatcccccgttctctcgttttagccccctcccgagcctccccgtggtccctagccatctccccgccgccctcctctctctcccacgccgccggccgcctccagccgcctgtgccgcctcgcccgcgcaccggccggccgtgccgtcgcctcctccagcgtcgcagccgcctcctcttccccggcgccacctccgatttgtggggaaatcgccggaacggtgcccccgccggcaaccagtggcattggtgccactgtactccctccagccggctcctgtacgtcgccggtgcgccgatcgacgccgccgtctcctccttcgacaccgcggcatcgcctccttccccggcatcacctcctcctcgcccgaagctcgccggagtggcctcgtcgtcggcgtccagtacctcccggtctccggtcggctcctgtacgtcgccggtacgccgatcgacgtcgccatctcctccgtcgacgtcgcagcgttgtcctcacctccagctgctcctcggtttcgccggaacaccgccgtgtcgccaccaacccctccacccgcctcgccggagtcctccggccgcccgttcctcctcgcttgtttaccggtcagccgcggcaccaccacctccggcatcgcagcggcaaggtcgccctcggcctcgcctccccttcgaccgaacccctccgcggtccatcgtcgttgtctccgttcgttctcgtcgtcgacgtcccgtcggtcgcccggctcgtcgtctcgcggtgccgcctccgtcatcgtcatcgcagcggcgtgttccacgtcgtccccgtctccgtgcagccactgctggctgtccctcatcgccccctcgccggccccggtcgtcgtcgtcctcgtcctctcgtcgttcccgatcgtcgtggcgttcgtccctccgtcgagccgttctcgtccgtcgtccgcgttcgtcaagcgagccgctgcagccccgtcctcgtcttcgtcctcggctccgcgtcgtcaagccttgtgccggccgcgtctcgccttcgtccaaggatcgccgccgaagccgtcccctggccgttcgtctccgttgtgcccgtctgtc

SEQ ID NO: 91305 - DNA, 765 bp, Oryza sativa
acacacccacaagtgcagcatcattgcaaaggagtacaatggagttataatataggggttaggttttgcaataaacagcatttaaaagacccttagttgctcaaagctaaatttaaaacacgatcctagaactatttaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggtttgaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacaggcggaagacgtgacatagttcccaacccatcctagccatagacaagagtaccgacccaatcccacctacggccggaacccccgggacaggcaggcaggactgagccccctagcagcaggacaccggccctgtgccatgacatctcgactaccgggccgcagctcgtgtagccttcatttgccctggagatgtccatcgaacccccgacttcgtccatctccatccgtgtacttttgtttataaccagactgagccacaaactaagccttacccactagacatgtggaagtacggtagtgctttgcaacagaggc

SEQ ID NO: 91306 - DNA, 1032 bp, Oryza sativa
ttaagaaatctttctttttggaagaaaactataactctaaatttcttcaacaaaactaattggttgtgcctaacaacagaggctagagatgtaagccattcccgttatctttaagaaaattattctaaacttcttttttgaaggaaattaccaatttaaccacagagcaactgtcagaaatagggagcattaagtgccatatttgaagtagcaatcagtgataaattgataatgatgttaagatatattgattgcaaaattaagatggtagtactttcggcatgatttttactgtactcacaaatagtccagttgaggtatggcactcagatcaggaatagcaccctgcaaactgcagtttcgaagactcctgatgtgacaagaaatattatcctcagcataacaacacagtatttagacatatatagtagagagagaacatatagtgctcacagtttaaatagtccggacatgttgtaatacagagtagggatggaactcccgctgaagttattattgtcagcctgactagaaacagaaaaaaaatacgaatataagaaacaggtgtatgctatcatagcaagctattttcaattgagtttgacaattgacaatggatacatacagtattttcaagctttttgccgcagctagttctggaggaagaggcccagacaaattgttgttatcaacaaggctgcaaagttttagttagagtatataataagattaattccatgttacctgatacaacatgcattagaaaaaaatgcaaccaataggcttccacttacaggtgcaaaagtgtattcagtctggacaattcggacgggatttgcccacttaatgaattattattcatgtgactgaaatgaaaggggaaattgagtctagcactgaattcagattgaagaacaaagcaggaacaaaatggaaatgaacaatccttacagatgcttcacacttcttaagttggcaaatgatttaggtattgcgccggatagatggttttggtcaacctgtaaccttgtt

SEQ ID NO: 91307 - DNA, 790 bp, Oryza sativa
aaagaggagaagattctccggaatcagtggaagtagtgcagtagctattgactgggatttttgtaagcccggtcaataggttcccctgtacccttggagagaccctgcaagtgcacacagatcacgtatatatccacatgcctatatgtgcatagatcacataggcacgcatcaaaagctttttaatcctagctagcttactttaatctttgattattttcaatagaaatttaatgacgtttaacttgattcatcattcggcgacgtctcttgaacatgttaaaggctgggccgaggcccaccaaaaacggaggcccatgagcaaatttcaaattctgactcgcgcgcggtggcggcaaaattttgcaggcgagacgtacctgtactggctgcggcggcggccggcgctgtacgtgacggacccggagctcatcggcgagatcgggcggtgcgtgtcgctcgacatgggcaagcccaagtacctccagaaaggccaggagccactcttcggcggcggcgtcctcaaggccaacggcgcgtgctgggcgcgccagcgcaaggtcatcgcgccggagttctacatggcccgtgtcagggccatggtccagctcatggtcgacgccgcgcagccgctgatcgcctcctgggaatccaggatcgacgccgctggaggcgcggcggcggcggaggtcgtcgtcgacggcgacctccggagcttctccttcgatgtgatatcgcgggcttgctttgggagtgatttactcgagggggagggagatcttcctccgcc

SEQ ID NO: 91308 - DNA, 5119 bp, Oryza sativa
  unsure (1)..(5119): unsure at all n locations
gcgatgtggacgatgctatcatagcaaagcgccaactctttcattgttgccgacgctgccgatggcctcttcaacttcttcgcattcgctttcaccgccatgctccaggtggacaccatagcaccttatgcgcaagacacatggtacgtgaactcacttggatgtgttaattaatcactgctaggttgatcccttcttaaactcttgtaacaatagccttatttagctatttataactcgggccatgaatgccagccaaaattagatttgaaacgaacgcgtaaaaagattacacaccttatctcatttaatttcttctctactatatattataaaaattgaataaagatgttcccttctaaatctttggtacatggtcgtatgtctgatagcccgcccgcatgattcccacgcaactaagtactatcgattctgatttcgattccgattccaattctgatttcttcgtccatcgtctctcgttgtccgtctcctcgggtcgaacattgcttggccgctgttgttgctggcggcctgctgctcaggatcctgatcaggagttcaggatgagctcaacgcaccaaagtgtgattcacattaattcatcgatttgctgttttggcacggtgataggaaacaactaattgatcgctaatgtaaaatttacgcttgaaatcaacgcatcacagtagattcatggattcttccattcatatattgacgccaggtggaagtataccaaggattgctaggaaaaccaatgctaccatttagctgaatgaaatgctgaaaatatactggtagaatttactgttagtataaatgatctaacagtatagattgatttgatcttccacttaaatatatggtagtataaaatttacaagggtaaattcatctttctttgctattccacgagagtcatagttgtttaaaaaaggaagtaattaatttagataaaaatatttggaaccatcgtctggggtgtatgaatgtgttaacctagctagcaagattcaaaacatgtaagactactttccacgcacatctgctatgttacaacttacattatttgatcagtcattggtcacttgtgaccaaagtatgcaaaactttaatgataattagaattgaccaggaattgtgtcaccgcgacgcacgtcatcatctctcgcatgcttacaaacgagatccagtagcaactccagcggaccgacacgtgaacaagtcccaattggaccggattaactctcaaccacgaaataactagaatttatttttccaattttctataactcctaatttgtccatctatatacttgcagtatagtatactctaaaagttctaattcttcaactaatcatcgagtgctaatgttcaacacattaaaacatttgctgcaatttttctctgttattgcatactcataaaaaattgttggttcaacgattttcatcacaagttcaccaaaactggtatactatgatgtcttatctacctggggactatggcaagtagtacatcacctctgtgaagaacttgtagtattcatgcttgatcccacattantcactgcaaaagactccgtagcttccccatcctgactccacgccgcagccggtggccatgcagtggtggctatcctccgatagcaccagcatcctactgtgtcgccctttgaccttccacgtcgcttcctggatcatgtcctcggcgatcttccggtactgttggcactcttggttggtcctcttgacaccaacgccggtcgctgcctcttcgccatcaccctcgacttggctgatgtatttttcccggtagcgcgagtctcatcgaacatgtaggaggaggccgagcacgtataccgccgccttgtggcccgtgatggctgccttatcgaggaagaggaggccttgctccatatcctgatgcgcgaagacgagcgtgacaccgacgatgaagcatgcgtctaggttgtcggcggtaacgaggtggttaacgacgatgaagtagcgctcgttctccatccacttcatgttgtctagcctctccagcggcacataactcccaacatcacattccttggccaccgcgtgcatggccttacagctgcagtatgcatacacccagagacttatacaagtcaatatataaatatttttacatgcgtatataaataagcttatattagcgagttagcatacgtggcacataggctgagtaggtcggtaataggctccgatgaggtggcagcgacgaggcaggcgatgtggacgatgttatcatggcgaagcgccaactctttcattgtcgccgaagccatcgatggcctcttcatctgctttgccttcactgccatgctccgggtggacatgatagcaccctatgcgtgagacacacggtacgtgaactcatttggatgtgttaattaatcactgctaggttgatcccttcttaaactcttgtaacaatagccttgtttagctatttacaactcgggctatgattatccacctgttactagtagcaaacatacacggaattgcttaatgtcagccaaaattagatttgaaatgaacatgtaagtagattgcacaccttttctcatttaatttcttctatactgttatagaaattgaataaagatgttcccgtctaaatcttgacacgtgtggtatgtccgattgcctgcccgcccgattcccatgcacctacctacttccaattccgattccgatttcttcatctatcatctcttgttgtccgtcctcgggtcgaacattgcttggccgccgttgttaccgcggctgctggccagcctgctgcttaggatcctgatcggtagttcaggatgagctccaacacgcctaagtgtgattcacattaattgattgatttgctgttaggcaaggtgacaggaaacactaattgatcgctatagtgaaatttacgcttgaaatcaacgcatcaagtagattcatgcattcttccatttgtataatgacgccaggtggaagtataccaatgattgctaggaaaaaccaatactaccatttagctaaatgaaatgctgaaaatatactggtagaatttactattagtataaacgatctaacggcatagattaatttgatcttccacttaaatagatggtagtataaaatttacaagggtaattcatctttctttgctatttcgcaagattcatttctattaaaaaaaggaagtagttaatttagataaaaaaattcggtaccatcgtctggggtgtatgaatatgttgacctagctagcaagattcagaacatgtaagaccttcaacgcacatctgctatgttacaacttacattatttgatcggtcattggtcacttgtgaccaaagtatgtagatctttaatgatgattagaattgaccaggaatcgtgcccccacgacgcatgacatcgtctctcgcaggcatacaaacgagatccagtagcaacgccagcggaccgacacgtgaaaaagtcccaattggaccggattaactctcaaccacgaaataactagattttttttccaattttctataactcctaatttgtccatctatatacttgcagtatagtatactctaaaagttctaattcttcaactaatcatcgagtgctaatgttcaacacattaaaacatttgctgcaatttttctctgttattgcatactcataaaaaaaatgttggttcaacgatttacatcacaagttcaccaaaactggtatactccgatgtcttatctatttggggactatggcaagtagttcatcacctctgtgaagaacttggaatattcatgcttgatcctacaatcatcactgcaaaagactccatagccttcccatcccgactccacgccgcagccggtggctgtgcagtggtggctatcctccggtagcaccagcatcctaccgcgtcgccctccgaccttccatgtcgcttcctggatcacgtccccgacgatctttcggtactgttggcactcccggttggtcctcttgaccccaacgccggtcgctgcctcattgccatcatcctcgacttggctaatgtacttcttcccggtagcgcgagcatcatcgaacttgtagaggaggaggccgagcacgtatgccgccgccttgtggcccgcggtggctgccttattgaggaagaggagtccttgctccatgtcctgatgcgcgaagacgagcgtgacaccggtgatgaagcaggcgtctgggttgccggcgccaacaaggtggttgacgatggcgaggtagcgctcattctccatccacttcatgttgtccagcctctccagcggcacacacttcccgacatcacgttccttggccgccgcgtgcatggccttacacctgcaacatgcatacacccagagacatacacaagtcaataaaaaaaatattgttatatgcatatataaaaaaaacttatattaacaagttaacatacgtggcacgtaggctgagtaggtcggcaataggctccggcgaggtggcagcgacgaggcaggctatgtggacgacattgtcgtggcaaagcgccaactctttcattgttgccgacgttgctgatggcctattcatctgctttgccttcgccctcgctgccatgctccgggtggacaccatggcaccttacgcgcaagacacacggtacgtgagctcacttggatgtgttaattagtcactgcttggttgatcccttcttaaactctcgtaacaatagccttgtttagctatttataacttggaccatgattattcacctgttattagtagcaaacgtacacggaattgcttaatgtcagccaaaattagatttgaaacgaacgcataaaaagattacactccttatctcatttaatttcttctctattattacaaaagttgaattgaataaaaatgttcccattaaatctatggcatgtggtagtatgtccgattgctagcccgcctgattcctgcgcacctacgtactgccgattccgattctgatttcttcatccatcgtctctcgtcgttcatcctcaggtcgaacactgcttggccgctgttgttgctcctgattaggagtacttc

SEQ ID NO: 91309 - DNA, 9210 bp, Oryza sativa
caagaacatctacttcgccgggcacgagacgagcgcggtcaccgcgacgtggtgcctcatgctgctcgccgcgcacccggagtggcaggaccgcgcccgcgccgaggtgctcgaggtctgcggcggcgacggcgccgccgcccccgccgcgccggacttcgacatggtgtcccggatgcggacggtggggatggtggtgcaggaaacgctgcggctgttcccgccgtcgtcgttcgtggtgcgggagacgttccgggacatgcagttgggtaggctgctggcgcccaagggcacctacctgttcgtcccggtgtccaccatgcaccacgacgtcgccgcctggggcccgacggcgaggctgttcgacccgtcccgcttccgcgacggcgtggcggcggcgtgcaagcacccgcaggcgtcgttcatgccgttcggcctcggcgcccgcacctgcctcggccagaacctcgcgctcgtcgaggtcaagacgctcgtcgccgtcgtcctcgcccggttcgagttcacgctctcgccggagtacaggcactcgccggcgttccggctcatcatcgagccggagttcggcctccgcctccgcatccgccgcgccggcggtcaggacgccacgtcacaagttgacacatctactgcacccgtgcatagttctcataattaattggcttctgtaaacagctagtaagtcgtgaactgaaaaaaatacatcacacatacagagacaacagaggattaccattttaccagcatacatccatggcataccaaaacaatttactatacattataattaacatgatgctatacacagtataaaaggacatgcatttttctgcgattaatggattaagccgattaactgtttgtcaagtgattacagtgtttaattcagaatctagtaattaatttgttgaatttagatagtctgtagcctgttcctctctgaaagcaacagagcagagcaaaaggcaaaatcaagtttcagaagcacatggaaaagtatgatttctttggcaaaattgttgtgccattctcttatgctataggcctgtggttgagtgagcggccgtttgattgggacgccgacgaacaggtgtcttttcgtttctgctttctaatttctggcactaataaaaacatgttggttgctgagttaaaatcaccaaagtggagtggagatcgcgatgttatcctgtagacttgttgtatctggtctaatggtctctgtaagcaaaacgatcagaagtactgaattagttcaattttttgatagacctggtatggtcttttaaattcaacttttgaaagtacagtgaaatacaaatctagtgatgccatattgtgggcttgtgtagtataaattgtgaatcaagcctacggaattttttgctgaaatacagtacgtgcctgtcttataagaaaaacctgaaccgagaagccattagcgttgtcacatacgacgccacgctcggtgactcggtgagccagcgtgtgcaccatcagctcgccagcagcgcgcgccaagaaagaccagcagccatgtcggggtccggcgacgccgcgccggcgcggcacaacgcgggtcacggtcggcgacgacggcgcgtcctcgtctgggccagcttcgccgcgctggtcctgctgctcgtcgccgcggcggccgccatcgccgcgctcgccgtgctccggccgcgggacccgaccacggagctcctgtccgtgaacgccacgggcgccaccccgcgcgtcgccgcgctgccggccgtctccgtccagctcaacgtcaccttcctcctcgtcgtccgcgtgcgcaacccgaaccgggcggagttccgccacggcgccgccacgacggcgctcctgtaccgcggcgccgaggtgggcgccgccggcgtgcccgcggggacggtgccgagccgcggcgcggcgacgctgaggctgaacatgacggtgcgggcggacagggtggtggcggcggccggggtgggcggcctcctcgcggacgtgctcgccggcgagatggagttcgaggcgaggacggaggtgcgcgggcgggtgaagctgctcgggctcgtccggcggagcgccgtggcgaggtcgctgtgccgcctcgtgatcggcgtcgccgacgtgaaggtccggcgccaggagtgccacaacgagtccaagctgtgactggctctgatacgtattatacgtatgtacgctgtctttgtatttgtacatgtatacgtgtgctgaagacagtcgatttgtacgtactctgatatatgtgcacgaatttgtcgtggcaataaatgtttaggctattcataagctgtttctttggtagactgtatatgtatattgttaaaagttactgcagcctcattgtcattgttgtgtttccaaaattttggagaaatcaacaatatggttattcaatttacatttgcaacccctaaatatattattcaagtagataaagtggtcgcactgtgtgtttttcttccattttttcaaagagataattaaacttggtctgtggtgcacattgcagaaagctactgtgaaacggatggactattgaactactctcgttgtcattggttggcctaatgttagattacatttttctacctgaatatatgttttgagtaattcatgtgtgttttatttcccgtggcattacatatatgctgtaacattccgagttgtatttttctttttttatttttataatattcctacgtttcaaaggagagtctgtgaaacaaaaaggtagattagaacaacatatagctctcaaactagtgagaaatttttgctcttaatgcaacagaggcacaacaaggagaaaatattcaacaaacacgtctaggttgctcctacggcaacaaatttgagaaccgtaggaagtcaaagattcaaccttttgctgtgacaatgtaagaaccacaaaactatttgttgtcatgtattacaaattaacaaaaatagggtgaaattacacgagcgtgctggaactttgagatgaaaatatgagcacatatagatttaattcattctgtaaataaatcataacatttaacgtataaactagcaaaatcacatcatacaattcaaacatgtaaataatgaatagatcaaataaacgaaacacggtgaacacgtaccaagggttctggttctattgtaaactgggttgacaaggagcggcacgcgccgcaggaacaactctgtggtgtcagatgttgtcgtcggcatgcaacccttgagcatagaggtgcaggacatcgaaggcaaaggttccggagacctgctctccggatcgtcggcgcacgccggtgagtgggacggagtagactacaagcgacggccggtgcacgccgatgagcgaggtgcgtgattttgatttcacgtgtgttgcgaggaggcacctgcattacctccccctagagtaaccgtgcacaatgagtgggcacgtgatattgatttcacatgtattgcgaggaagtgctagcacgatctccactttgtagaatcaaggagttgatttagattttgttatgaaaatattgatggtttgctaatgttaatttggagattttataagatggttgattttgtgaagtgtgcagttttggttgaccttggcggtcagaccggctgagtgccgccggtcagaccgtaggtgttgcggcggtcaaaccggccggcccgacggtatgaccggcaggatcctgatcgatgtcggtttcgggttgttttgttggatttggatatttccttcggggatttggcttctagatagtttctatgcgtatggatactgttgctatactaatgtgagtcaagttgggacaaatttgggctcggaatatggcttcttggttgttgcatgtgcaggtgatagatcggagtcaacttgggagaagttgatgtctagggatcatgagatcatgcgggatactaaaggctagaggacaatgcacgtggtgatgaagaaattcatatggtatacaatagggatttgtgtacgtatggaaagaggagtcgaatttggaagggagtccgaattcgggaagtttgattgagataaggaaagagataagatatttacttacaagagagggtttcatacatggttaggagtcctaagttgtgttagattcatgggctttgcacaacctacttcatgtataaatagagagggagggtgagacatcccggtatcgagtttagagagactagagttgagagaaagttagggtttcgagtttagttcgagattttggtgaggagtgatgttggtgcactttgtaaacactagttgatgcaataaagtcgaaaagtttcaatctacatattcgagtttgtcatctaccggtgtttttgggtcccgacggtctaaccgcaagtgtgcgcgcggtctgaccggtgggatagcggcggtctgaccgcaggtgatcgggcggtctgactggcgaggcttcggcggttcgaccggcgacgacaggacttcatcgtcgtcttcgttcgagggtaatctttaattccgcaaaagatttttgggtttttggttttccctatcattcacccctctttggtaggtttgtttggacttgtgcgatcctacacactttgcagaactgaactggataagtcacacgtaacttaactagactccatgacatatacgcaccgcctgcctagctaggcgagacgagcgtacgcatattcctctagttctctccactacacgtctcgagtggttaggagagtattctccccttaaggaaatccctccctctctcttaaaataggaaagatggtactaaacgtgctcatacatgtcatcccaccatatggtgagcttttgttatttttttaaagaattaatcttcaaatgtgctaagacctatctattaattctaacactttgtaccgatgcacaaatataacacttgtatgctagagcttgttctatgcataagcagaacatcactgctagttataaattaattttttttgaacgaatcgacgagcgccaatttcattgaatagagaagtcgaactttacaaaaacaaggtattattttcttgtttttgtcaatgctgtaccgacgctgtggcaatcattcgtcatacagtagttggccaaatttcgctataccacaacgtgcacaattgatacatttccgcacaaaacacctacggtcagcgcacatgattaaaacatctatgattagttcgtcgattatcgcatcattcgcttcattgcgcatgaattggaccatgagcctcacaaaagtttctcaaattagctttctttttagagctaattaacatggctaggcgtgtggtagtggtacacgatcaggcacgtttctaaaatttcgttacctttttatacggcagcaaagaggagaaaccaggcgctgcatttcaaatttcgaattcccaaacctatccattccaaaaggggcaaacactccgcagtccaaagtccaaaccacagcgctacttccaaattcagctccagctcaccacgctggagaaaaaggtaaaaaagaaaaagaaaaatgcccagcaagtttcccatcgaagccttacccctaacatcccctactttactcactgacacgtgggcccaagaaattctgggcccagacgtcagtgacaactcggagggaggagcctggtcccgcttggttcggacacgaccccgaaaatattcaaaccagcagtagcccaacgtttcgatcccgccccgcgcctcccgccgcctccctcactgacgggtgggccccacatgtcaggggtcgcctccgccgcgcctcatctttaacacctgtctatttcctgcacgaggcaatctcatctccctcctccccccccccctcattttctctctcctctttctctctctctcttcctcccaatctgcgaagcgagagagagagagagagagctcgaggcgagctctccccgcccttctcccaaaccctaatccttccgccgcgcggaggagagccgcgtctcgggcgcgcgcgtggaggcgtgaagcgatctgtattggtggaggggaggggaggggatggaggcgcggcggatctcggcgagcccgcggccgtgcagcgggaggagggtggtggcgaggaagaggccgaggcacgaggcggcggtgaacagcgtgcggaagctgcagcggcgggagatcagctcctgccgcgaccgggccttctccatgagcgccgcgcaggagcgcttccgcaacatacagctccaggttcgcccgcacgcgtccttgcccttgccctaccgtttctagcttcgtttcgatttttttcttttttgttcgcgtgctcctgcggcgaggtagttttttcgttcgccgtgtgtggggaatttgtggctctgggagagcgtgcttggcttcgttttagccgatttgtggtcgggatgggttgccacgattgactaattacttcgcatggggacctgagatctgttcaggttgggccatctgttggtggtaactggaattggagtgggttcatggatgctgtgctgtgctgattttgcaattatctaaaaaaatgctgattttgccagattgtgatgagaaggctgcgtatttcgttaagtaggttagggaccactgctgattcgtggaagtcatgtgcagccgccatctgcatggcaaattcctgtatcgctccgtgcagctgcttgtctggcttaactacaacaaactttataattttagggtttcgttttcgtatggtatcatgttggcatattatttattgcattgtcagaattaacgaagtgtggattaactgtcagattgcaggattggtgtaattgtacatagagaatgactctatctgctgtctttgccctttgcagcaagtatttttttagatgttaaaatttagtacttgcctcgggtatcgttgtcttggttacttgttgttcatgacttctgtcactttgctgctcagataacgatcttagtggctttgatcctccattgaaaaaacaatgtgggaccctgcttggactaattcatgcttataatggcccacagtcaccttatgaaaactgtcaagcttgcacctttggcctgcttccattgtttatgttgtagtggttttacctcacggctgttttagtagtttctcttgactttttatctgtatttttaatcatgcactttactgtcactttcaggaggagtttgacacccatgatcctaaggaaaacagcttgctactaccttacttgaggaaaaggtcaaaaattattgagatagttgcagcacgcgacatagtttttgctttatcacagtccggagtgtgcgctgcttttagtagaggtatgtttgtgtcattgtggtgcacttctgcttcctatgatcatactaagaacagcttcatgtattatcagagacaaataggagaatatgctttctgaatggaagtccagatgaagttatccgcagtttattctacaacaagaataatgagtcactcattacagtatcagtgtatggttctgaaaatttcagtgccttgcgatgcaggacaactcggatagagtaagctttgtgttctatgagtttccgttgttgtgaattccatgctatgccatctgcttaagatactggcaactctttcaaggtatatacgccgagcaaaaccagatgctggtttccctctttttgagagtgagtccttgaaatggcctggattcgtggaatttgatgatgtcaatgggaaggttttaacttattctgctcaagacaggtacacactaacttctgtaatgattataaagtatgtttattctgaaactgtactgatgccattgcattctgcaaacagtacttacaaggtgtttgacttgaaaaactacactctgctgtattctatatcagataagaatgttcaagaaataaagataaggtaccccctctctgacccacctttttttttcttctgttcccatttcttgcagataccctaactaagaagttttttggatgcaccttattactttgaattcaacaggctgttcatcatttgaattcacctcatcttagtagaactaacaataaactcaacaagcatgctttagattgactgaacttgtaagaccagaatgcactatagtgcacatataaatggagagagtgatatcataactgtggtgttgccatgcagtttaacagaactgttcttttttctatagactcttagcttatattatatttttttaattattaatggcaacatgatgtggctttatatgtataatcctgtgttaatttgtggcagtcctggtataatgctattgatttacacaagaacaagcagctctgttcctctgaagattctttccattgaggatggtaccgttttgaagtccttcaaccacctcctccatcggaataagaaggttgatttcattgaacagttcaatgaaaagctcctggtcaagcaggaaggagagaatcttcaaatacttgatgtaatttttcccctaatgccacaattgtcatttacaatcaagagaaacaaattacttttattgtttaggtttttaacactcggtattgtaggtacggaacttccaattaacagaagtgagcaggaccgagttcatgactccatcggcctttatctttctctatgagttgcaactgttcctgactttccggaatcgatctgtagcagtttggaatttccgaggtgaactagttacatcatttgaggaccacctgttgtggcacccagactgcaataccaataacatatacataacaagtgaccaagatctaattatttcttactgcaaagctgattccaacgattcatcttcagaagaaaatggtacgatttttttggtgtttttttttggcatatttgtatatattttactcatcatacaattgaaatcactgcttgctgtattttactatttatcttatgttttcctctcagacatctttgtttgtttatgtgcccatcctcttgccacatcgaactattttaattagacctttgcatgatatcatgctttgctgtgaccaaatatacggaagtctgttgttttgctcactttggtagtgtgcttcttgttggtgctgatatttacgattagatgtactacaacttttgttttgcttcatctcgttttcttgtattt

SEQ ID NO: 91310 - DNA, 887 bp, Oryza sativa
aaaaacaaccccaaggctgtacacatcacttttatccgtcaatttatgagttaggaagtattctggatcaagatacccctgccaaagtaacaaggatatagttagtatagtatagctgtaaaagagaaagaacaaccgtgtgcaactagtacttacaggggtgcccttaacaacggtggagacatgagctggtaaagccccttcaacatctggtactggagcaagcctcgaaagaccgaagtcagctaccttggcgacatatttagaatccaacaaaatattgctggccttaacatcacggtgaaatataggaggatctgcatcggtgtggagatacagaattccctttgaagcacccaatgcaatgtgcagcctcaaaccaaaaccgagaggtggtttggactttcctgcgattgaaaaataaaacgaggagattgaagtagaacaaggatattggcaacagaacaaagtattacacaattcactataagcaggttcaagaaggcacatcaactataagattcagtaaactgacaactgaatggctgatcttgatatcaaagccataggagtcagttcaggattgcagtagatcagtgggataaaagaactagccatgtgcttaccagaaagatgatcacgtaaagtgccattcggcatgaattcataaactagcatctgtaaaaaaaacacaatttttatcttatcaggatgattttgccagaatattatttccacacaaataaataaaatcaaagagatgcacctgttcattttcttcatcacagtaaccaaccaacgcaaccagattgcgatgatgcaatctagacaacagctctatttctgtgcaaaactctgttgaaccttgaagagaatcctcgtgtgcc

SEQ ID NO: 91311 - DNA, 1203 bp, Oryza sativa
tttagccttggaccaacttcccatatgtagttctcaatatatagctggtaaggaaacaactgcaacaaagaagttaggtcaatcttgaaagcattttcgtatggatgaaagtctgtgactcctggactcttcaaccgaagtccaactccaagtggcaccgcacaaaaacattggtccgagaatgaaggattgtactcataatttttttctgtcgggcaagctccacaaaccatggcagtgcttgtttcctgtttagatttttccaggtttattgactggaggcggcaaaggttgattatcagagtttcactagaattctcacatataggatttccatataacctgcacaaataacattggttgtgacaactataagaactgagtattttatgtaagcaatattcagttatagtccagattttcactcataatacgatgatgaataaactgtttttggttatgatgtccattctcaaataagaatagtgtagcctgaaaactgttatataagcagtataagcttgctttaaataaatgaaatggtgttaatcatcaaaatggaaattaactgcgaaacttgcgtgctcacagttaaatatccatccgcaacacagaatttttatgcaggaatgtagattgatagtgtattgcatatatgtaggaacgtacacgacagtaacatttggtggaggaggactaatttcagctggaagcatattgagagaattattttggaagtccctgcacaattgacaaccatgtcaaatatatgttattgtcagaacttagaacaagatgaaaaaatatatatatatattcccaaaaagaatcatacagtacaaggcttccgtttctgttagggttgacgccagcccaaatttccgagggaacagaaccatctaaaagattatttttaagtgacctgcaaatttgcaacattgacatgtttttaaatgcattgtttttaaaaaaaagttcatagagggtttaatttgtgttatgtcaaaacgagtggaaattgtaagcaataatgagtggatcacaatatgcaccagcaagaactgatataacctcaagtttgtatgtaataaataagaaataatgtaaaatgcatgagaagaacagaagaaatttttaaaatcaaattcccccaaaccaccaggttgatcacatgcgagcacctctttaaatttgctatcctct

SEQ ID NO: 91312 - DNA, 686 bp, Oryza sativa
ctaacaacaattgttaattctacaacaaatgtggggggcttagaatggtaggagaccagtattcgccgaaataaatatgaatcacctcaacacagacctcttcgtggccggcaccacctgaggcagtcgttaaatcaattcaattacagatgaccaacaccttgttggcaaaaagcagtattcacggtcaattcgaccacacatgaacgaggccttgccggtttccagtgtagatctcgtcacgctcttcgtcatagtacagcgctgtgatgtcctcgagggcctccaaggctgtactctggaacttccaggctttcttctgcttgcacaaatcgctggccttaattttggccaagcatttcccagtcagtatgttgctgatgtttattgagccagctgcattggagtagacagagaaagtgtcccaattagattacggaagcaatgtttgcatgtttagttacgtggtgcttctttacagaagtggaaaaaggctatgaacaaacttatataagttaatgctatctagttatttggtcgaacattagaaagatcctaaggccttctcaaactcattcagagatcagaaggtccaaggattctcttgtattgtgcagtttgacaaaaaatacaagaaaacgagatgaagcaaaacaaaagttgtagtacatctaatcgtaaatatc

SEQ ID NO: 91313 - DNA, 6704 bp, Oryza sativa
atgtggaatggttggcctgggttggcttaggacgagctgggacccagggtcgggttgccagttcggtctgaatcatcataggccttgggttaaggcaggttcgtgtgggttcacggccttgattaataatattgtatagttctaagatcgtgtttacaaaatggcctggagcaactaaatgtcttaaaatgctgttttctgcaactctaaccctttatattataattcccttgtactcccttgcatttattatgcattcgtgggtgtgtcttgttgagtacggtggttgtactcagtcttgcttaattttcccaagcccagatgaggagttccctgaagatgaaggcttcggtgtctagctcgtgcctgccgtcaagcgcctgtggtcgtcgccctagtcttccgctgtctttcgttgtctttgagtgtgctgggccttcgttgcccgtgtaataattttatatacgcttccgcttgttaaactctgaattgtatcaacttttggtgtaccttgcctcctgggacaaggaataatacacgcacgtcaggaacgcctgttgggtgatttccggtcgtgacaccggagttcaccacgccccggggcacggctcggttctgggccccttttggcgatttaagccgacccgagcccctgagggcaggattgagcacgagtgacctatttcaagtcaagattcttcaaaaggaaataacagcacagatacagcctttaggaaattgaaaatgcttttattgaaatacagatataagagaaataaaaatatgcatgtgtggtagcccccggccaaccctgcacgcccgaggggggtgcggggttggcccgagcccgaaacctgacacccgatcccccttaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcggctcagagggccgcgcgccgccttcgctcctccaagtagtcgaggtcatctctgcgaagctgatcttgatcagcctcgcagtacatggtggcccgaggggacctcagggtgagctcggatgggagaaccgcttccgcgccgtagacgaggaagaaaggcgtttccccggttgctcggcttggtgtggttcggttcgcccagagcaccgctggcaactcctcgatccacgaatcgccgtgcttcttgaggatgttgaaggtcttggttttaaggcctctgaggatttccgcattggcgcgctccacttggccattgcttccggtgtgggcgggtgaggcgaagcagagcttgatgcccatgtcttcgcagtagtcaccgaaaagctcactagtgaattgggtgccgttatccgtaataatacggttaggcactccaaactgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccagaatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgacgaaaggctttgccaaccaatgtgcgcgaggcggagtgggctccgcattcgccttcatggatatcagcaagaagctcgacgccttgttcccgaggaatgcacttcaggaggattccgttagccgcgcgccgatagagggtcccttctaccagcacgtagcgtttggagatgcgctggacgcgttcactcccttcgcggtcctcgggtagagtcttatctgtgaggtatgcttggatctcagcgatccaagcaatcaatctaagggagctgggagcgctcccctcgggtcccgaggcctggactccgacgggcctcgggggctggtcaggcgcgtccgtctcccctaaggggtcgggtcgcgccgacggctgggcaagcctttcttcaaaggcgcccggtggggtctgggctcgcgaggaagcgagccgtgagagttcgtcggcaatcgtgttatcccgtctgggcacgtgccgaagctctatcccgtcgaaatggcgctccatacgctgtacttggcgcacgtaagcgtccatctgcgggtcagagcaccggtactccttacagacctggttaacgaccagctgggagtcgcctaataccaggaggcggcggatccccagtccagctgccaccctgagtcccgcaaggagtctctcgtactctgccatattattggtcgcccgaaagtcaaggcgaaccaggtatctgaggacgtctccactcggcgaggtcaacgtgacccccgcaccggcgccctgaagagacagggagccgtcaaactgcatcacccagtaggcggtgtgaggcagctgcgaggggcccgagttggcctcgggaatggagacgggctcgggagctggggtccactctgccacaaagtcggcgagggcctggctcttgatagcgtggcgtggttcaaagtgcaaatcgaactcggaaagttcgattgcccatttcaccacccgtccagtaccctctcgattatgcaagatttggccgagggggttgtcgcgaccgggaaaattgccttttcccgaacgctagtgtattaatccccgtcccaggaaaagccggggtacaccatacaaacatgatataaaagacacctctttattaaatcgataatatttacattattacaaaggcatttaaggcctgacaatcaaaaataaacagcagcggactagcgggcctacggctccatcttcacaggcgctcaactggggtataagccaggactccacctaagacttcttctccaaagcttctcttactgaagggggaaaagattgagcaagaatgagtacaaccacagtactcagcaagccacaccggcggatgcatgattaatgcaagggggtacaaggggataataatataggggttaagttttgcagtaaaccgcatttaaaagtcacttagttgcccaaagccattttataaagacgatcctagagctacacagtattattaaacaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaatttgaaacactgacttgggtacattgctcggcttgcccataaccgagggcgcggctattcgaatagattatactctgatcagaggtgtacatctttacccacaagacacatcttcctcgcgtgcaaccacgtgccacataccaccacggtatacggacggaagacgtgacatagttcccaccccatcctagccataaacaagagtaccgacccaatcctcctacggccgggacacccgggacaggcaggcaggactgagccccctagcagcagggcaccaaccctctgccatgacatctcgactaccgggccgcagctcgtgtagccttcatttgccctggagaatgtccatcgacccctgacttcatccatctccaatccgtgtacttttgtttataaccagactgagccacaaactaagccttacccactagacatgtggaagtacggtagtgctttgcaacagaggcccaagcttaatccttatagtacccgaggtacgactaacaaaacccaaccacgcacctcgagcctagcctaaaccattttgggggttttgaaaagagggggaggtgtgtgtccaattccaacataagccaaccattccatagtgtccaaatgataagagaattcccaaagtctaaagttataaaaccacctaatgttgcctaattaatcagcgaagcatctacctaaatttatactagtggaaccatgaatataatgtccactagttagggttttgtttattctagggtgaacaaggtaataataacaatagcaataataatgtcttaacaaaggtgaataggcatggctaaataaaacagtgataacgcgggaatttaaataaagcggtaatgcaataatttaaattaaaaataattttgtaaactgggattcaatatgctcaaggatgatgtgacttgccttgctcgctttcccaaccgacggcttcgacttccacgaagagcggatcttccgaagctgcagcgtctacacgaccaacggaaaagaaaaggcttttacactactaaactccacataacagcagaaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaaattttaattaaaaaatctcatttattgcgtcagccgagggagagggcgcgcggaccgggtccacgggagtggggcccacgcgtcagcctctcggtccacggtggaccgggagcacgcggctggcggcggtcggcgccgtgggtcccgcgcgtcagccgcacccgcgggcgcgggcggctgacggccgggcccacttggcagccgcgagggcgcgcccgaaggcggcctcgccggcacggccgacgggagcggcgcgcccgcgccccgatggtcaccgccggcgaccaccggcgcggcggagcggcgcccgagagagcggagaggagagggaagcgaaagggcggtcctcggctcaccccgggacaacgaggacggcggaaacgacggccgaagcggaggaaggcggcggcgcggttcgggatgacgagggcgacggagctccggcggtcggcgggcgaagcgaaggggcggacggggtcggcgacaacgcggcgaagccgatggaggtggcgccgagtcgggagggagcccggagcgacgtcggcggcgtaccggaggtcggcggcgacggcggagagagaggtggacgtcgcgagcacgaatccgacggcgagagcaagcggcgaacggcggaaacggaggagggaggcacggggagcaaatatatagcgccgagagggggagagcgcggccggagagggaggaaacgggcgcggagatctcggccgcccttgaagacgccggcgaaacttgcgggattaactccgaacgaatccgagggagagagagagggaaaagcgggggaaacgggagagggaatcgcggggaatgattcccccctcattatggcgcgcggggacggcgggatgcggcggaatccgcggcggcggcggcgctagggcacgggcgggcggcgggagcggcgggaggaaggcgatgacaggtgggccccacccgtcagcgagggcggcgggcgggcccgcctgtcagcggcgcgcgcgcggggggaggccgatgggccgcgggggagaggagagagagggagagaagtgggccgagccggcccaagaagggaaggggggaaaagaagacttcttttagggttttctttttataaaaccttttcaactttgtttatttcttctcaattattatttgtgctctgaaaattccactaaaatttgggggctccttttagaccaaggagaatttaacaaaaattctccgggccacatttgaatttttcttgtacgtattttagtgtttgccaatttctttttgaattttaattaattctattattccttttagagaatgatttttaattcgggatgaatttatcaggacgtgacaaatccaccccccttacaagaatctcgtccccgagattcgaggaggctagcaagaagataggttgggcggtcttctcttcttgtctgacttcttccgctctgtcttctataacaaacttgtctaactaaacttctccactctggactgcttggctcgatctcctgttgcagatgaaatcttctcttcacccgacttgtccctggttgcatgtcgcgtcccaaatcggctctaaaaattcatcctcaaaattgtgccaaagaataagtaaaatacaatgtgaaagcctccaacaattaaaatgtgcaaagataaaagtcaaatgaggcttggaggatttttgtatatttcctaaaagcctaaaatgcttaaataaattttagtggaattttcagagcacaaatgataattgaaaagaaataaacaaagttaaaaaggtttataaaaagaaaaccctaaaagaagttctctttcccccccccttccctcttgggccggctcggcccattccctccctccctctctctcctctcccgcggcccatcggctccccgcgcgcgcgcgccgctgacaggcgggcccgcccgccactctcgctgacgggtgggacccacctgtcatccccctcctctcgccgcgcccgccgccagcgcccgtgccctaacgccgccgccg

SEQ ID NO: 91314 - DNA, 1612 bp, Oryza sativa
ccgcctccgcctccgcctccacgacgtagcccagggcggctagggtttcggtttcctccgccgccgccgccacctcctcctcctcctcgtgcgcggcggcgaccatggcgatggtgcaggccggcatgggcctcacccgcgtcgttgtcctcatcggcgccgggatggccggctccgtcgtcctccgcaacggccgcctctccgagatcctcggcgagctccaggtgcgtcgcgtctccaccgccttggggggaagaatcccccgctcttcctcctcacctgaatcggtgatcctggtcctgggagaggtggcggcgcgccaccggattggattttgatttggtttggttctgatgatgatccgtgccttgcggacctctctcactcgttgcaggagatactggacaagggggagaaggggaaagacggagaagggggcgggggcgccgacatgacggacgcgctcactagacaggtgcgtcggtgatctccctgtccctagatgtttcagctagtatatgctcagggatgtgtccgattcagctgttcgattgattattgcgccatttttctttgccattagttaggtgctctggcttccccaccagagccccatgtcaataggagaagcatgggatgcattttaatgcgattattgtatttaaaaatggatgttatctgtgcctatcagtatatgtatctatagctgcagtgattgctgaattattgttttatagtggcaatgattcacattgcattgagtcagttctgcttgtattttttcttatttctgggaattgctagcttcaacaatgcattagttgttcttccattatgtataagttaatattgtcatgtgatacattaggttgtggccttggcatttctacgttcacaatgaagagctgttgagtatttttggaagtgtatagtagctgttgtaatattaattattactacaagccacaacacaagtgtgtgctcataagaagcatttgcgtgtgttttaaacagctgtggtatatgcaacagtaaacatactacttcaatattcccataatatttttttcattgtcatttatgagtaaaacagtttgcctatcttcatacacatatttgatactttgtttaattttgtcaagctagacttacaccttggtccatttaggtgcgcaacttggctatggaggttaaacaacttgcttcttcccgtggatctataactgttcttaatggaggttctggtcaaacaggtcagtctagcttctgcacaacctacataactgttacttcctcagtctagacatatatgtgtgccttgattcattaacatctatatgaatgtgggcaatgctagaaagtcttataacctgaaacggaggtagtaaatcacaagctccacccattttatttgccctctttttttcttttctttcttgtagtgttctgacatgagtattacttatcgcttggcttcattttctcttgttttaaatttgaaagaattcacgtagttagggaatgagtggactgaacaataatcattactcactaattcagcctacatatttctgttgtagcttatttcagaaattggcttaattaaccagtg

SEQ ID NO: 91315 - DNA, 505 bp, Oryza sativa
tccattgcctttctgcaacgtttggtagtttgattgctttccatgttatttccatttcaggcaatatgcttagctttatgttggttcaaaggaagcatttgaagtctctctagcagacgtagcacaaactcagatgcaaggaaaaacagatgttgttctggagtttcatgtggatgatactactggtggtaatgaggtatgtggtttatccagatatacatttctctgcatccaatttcgcccatattttattagatgctacttttctgtttgttaggtgcaattggttataagtaatcaatttatgtttatcaatctgaagaaatgtggatgtaacaattgtacaagctatctgttacatttcagtgtcatgtattattagctactcaactgtctgccttgtaattaaagagtgattttactgtcctgctttttcattctcatttgatggtattgcaagtaacacactcccattgttagagaaaaaccatttcataaaattttg

SEQ ID NO: 91316 - DNA, 1942 bp, Oryza sativa
cagtaagaaactgaaaagccccagttcgtttcatttatcgaaaaaatataagggattctaaagatgtcaagaaaaaagtacaacaaacttcacctttgtttttcattcaatacctcaacctaacacttattttatttacttcatttctggtaaatatgccaaaagtacaacatacaacttgtagttaacctgcgcgaacacacgaaaattactgacttgtagcaataattctggaacaattctttgccaaaaaaaaaatctggaacatctgaaacaaaaaaaaaacaattaagagaaacacccttcacttatatttctatttgcatttttgttacattgcatcaactttctttatttaatgaaacaaacctttcctcaaaacactacaaattgaatctgtttttttacaggcacaaaatgcacttgtgaagcttatggcatgatttatatgtacaagatataacaaagacgaagaccattgccggttctgttgtccaaataatctccaaaactaaaatattgaagaaagcttcagagaggctcacacgcttttcaaataagtcgcaatgatgcatctgtatgaaacaaagaaagaacaatgtcagagaaaaacagtctagagtgtcctatatttttaactttgttaaaatattcaaaagcagagagatctcatgtgcaaattaaaaaagcagagagatctcatgtgcaaattaaaaggagaagttgtatacctgtacatggtaagtaccatctgttttctattatgcattatccacaatccaaaaggcaaccttcaaatttcacagctgtccttggtactttttacagcatcagaatcatcagcctttccctcgtccaatttcctcaaatccatggcttcttcatgttcgctgcactgcaccccacagtcaccatctgcatgcgaatcacccaaatgcgccttgtaatttgggttctgttctttgttctccttgccagcatcatcagccaccttgctcctatgcgcccacagatggcttctcacaggacgttctcctctgccaccagcagcaacgctctttgctgatctcgggctgtcaaaccgtttagcagcagcatgcctgttcttctctgcagcttcggtttcagagccaggttgcttattcagaactttccctgacaccgatgcccttggctgagacgccggccttctcttgtcggcgccgtcagctgagatgattggtcgtcttggctgagacgatgacctctttggagtggcttgcttgctagtagcgttgtccttattgctagcagacgtgttggatgattcatttctcatgtcatcttccaacgccttgagcttcctcctgagcttgtcctggaaaaggagccaaagtttcagacaacgacatggagaaattaattgggtgaaaaattgattgaagtatctttgccacgtttctcacattcagctgggcttctgccttggcagacttctcggccatggcaatcttgtcgcgcagccgttgaatctctccctagacggtcattgtgaaaatgacaaataatcagatgataaattgagaaaaatctagtacaaaggccagtaaaatttggaggcgccaccgtgtggtgtacttacctgcaggagcctccgttcctcgagccatctcttgacaggcatcagcttgtcagcatcgtccttccactcgttcgcggtcgtcgacgcgacacggttgacgtagaccttggcgcgagctagctccctctcgagcgtcctcttctcttcctgcaggttgaaaaagctcgtcagaaactaacgtaatcaatccgtcttctgaatacgctaccccctccgtccccaaaaaaaactcctatgggacctctcctaggacaacgaatctgaactaccctttgtttagattcgttattttaggaggagttgagttttttttgggacgga

SEQ ID NO: 91317 - DNA, 914 bp, Oryza sativa
agtggagtccatagcaatgtaaggcctgcatccttccaaaaacccatcgatacagggtttaagagcaacaaagaacctcctaaagcagacatcaccattgcactcttcagtgtccagctcaactacactgcctggcactgatctcaatagctcttcacgataggtaggcagcagatcgtagctgtcatcccactttccatttataatgtcaagtgctctctctctacctctgaagaccttgaaatatgggatatcaatctgatgcttcctattcaactcctcctgcaaatcctttgctccccttgaggggttatcccgcaacaagtccaccactcgatcagctacccacttagtggtgaccattgtttcaccacacttattgaaagatccacaagtgtgctttggtccacttgtcttaacctacaagcaaagaataaatagctcatgtttcatcttgaacaaaaattccaaacagaataaccattcataaatacgcatgtaaaagtaccttgcatccaatgtacttagggcttgtagatgcaaaaaaacaccacttgcaaccctcttctgctcttttgcaaatggctctaaaccttttcttgtcattcttgacagtttcaaaagcatgatcattcaagatagcatgatgggtaactgctaacttgcattgatccacatctgggaacactacaccaacatcaatacaaggatcctgaacatcatatgcaaagacaggtacatcatcatccttatcaacaatttcttgatcaggatcaaactcagggtcagaacaatcagagtcggaagattcggccaaatcagaatcatagctgctatcactatgtgccacaagtgattcattggcagagtatatgccctcatcatcaatgcctactgcatcctcatcatttgac

SEQ ID NO: 91318 - DNA, 4323 bp, Oryza sativa
ttcctgcagccctgcaatgaactggacacagagctgctgttgtattttttttttgaacaattcacaaccctgttgtattatccatgtagcgttgacctgtagtttaggggttcataatgaatgcacgtgcttaggccgttcaaagcctcacatcataacactcacaagctgaaaaaaatagggggcaaaatcacacaaagctgaacaaaatgggggcaaaattgcaataaccaccaagggtatatatgtccttttctctacaactaacaccgttagttgtggctgttaggaatgggggtacatggctgcttcagattcaaaaagtgggggtaaaagtgcaaatcctaaaaagtgggggtaaaacagcaattggctttgaaagtgggggcacggatgcaattgcccctaataataatggtattacaattgtattgcaatggtgcccttttccagtgtactacagctgctcccttcgggctgataatatttgtcgttttagacaagggtggagtcaaactttagaatctttaattatggatcatttttaaaatattcatctttcaaatatggtaattgtatgcatagagtagtcttaaaaaatactttaataaaatcatatatttttttaacagttttatacatatcataatgaaaaataatggtcaaagtgttatcaacccagagagagtaattaacaatagtaagttctgcactagagatggtaaaaattacaaaaacaaaatactaatatttattgatgggggtatatatgcgcgtatgaacatgtgtgtatacatatttgataaaacgcaaggggaagcacgggaacatactatatatagtactccctccgtttcaggttgtaagatgttttgactttggttaaagtcaaactgtttcaagtttgactaagtttatagacaaatatagtaatatttatataataaatttgtgtcatcaaatcaataattgaatatattttcataataaatttgtcttgtgttgaaaatgttactatttttctataatttttgttaaatttaaagcaatttgactttgaccaaattcaaaacgtcttataacctaaaacgaatggagtatcatgataaagtggagaactttggggatttggaaagagtttttttctattatcttgaaaaatgttattacacacaattttataattcatagtatctcatataattagaaaaaggatgggtatacgcatgtgttttttagggccattgaaatatggagcaatgaatgcctagtgagatatgatatgcgatgacaaacagacaagaaagtagcgtggaactttgttgctcccttccacaaaccactaggcaggcatcgctagctgcacagtactactgtggttctatatatttcaattttcaaccagtatcactataattgtactatccagtgcaccaagttcagctacagtacaaaatgcatcaggaaatgcgcaaaacaaaattatatctagaattgaaaaaaaatacgagttaaatctatcgatatacggatcctaaaattaacataggacttgtttagttccaaactttttcttcaaacttccaacttttccatcacatcaaaactttactacacacaaacttttaatttttccatcacatcgttccaatttcaacctaactttcaattttagtgtgaactaaacacaccatagtggagtactttgcaaaacagacctaaggatgcaacctagtagaaaatagcaccatcggtctcttttatttcaggtacatttgggcctcgaggagtatttgggtgcagctggaaatgggctagatggggcacaacaattgctccgtggatcaattggaaattaattaaatttcaaatggtggaataaaaatttcaaaataataatattattaattaaagtaaaaccaaactagagatgcaattgataatgcagtggtaagttggcatgtggtttcaaccctgagctctcgtgttcaattctcaacacgttcgcaatttcttctttaaaatgtttggagccttggagggatagatctccctccaaatctctctttttttttaagaaacaaaaacaaatcaacagtgatctgggtaacctttcagttttgttctcaatcatgttgttgtcgatctcaaacttccatactccagtacgtagaatcgtagaatatatatcttttttggctcaccataacgttttgttctttgcactacgagaggcatcaggatattcccccaaccaattcaaacagtgtattgtgcagaagatactacgtatcagattgcgtacctttgtatggtcctccttgatgtgtccaaaaccatatgctacgtatcagatttctgtgagaactttccagttcagctaattgggagaagaatattaaatcagagtcaatcaagacaaccagaccatcagcaaatgatgcaaataaaagataaaaagatcaacctgcatctcttcataaaaggggtgttttttttgttttgttttttttttgtgtgcaaaggctactgttctcgatgcctcctctccacgttgaccctcctcaatataaagtgaataagcatctggacgcttttctgaagccccaccttaatatccaacttaattttaaccgaggcatccacctctatgatctttaattttgaaccaccagattgttacttttgttctttgtctggacctcccactggataaggtattgaaaaggaaagtagtcatagaattgaccaaattttaaaatgctttcaataggttcgacagaaataactgacaaaacataaaataagaaatgtggccttattctgccatgacagagaccaacatatgcttatttttcaaagaaatatgaaaaacagtttgcctgtctccagaatccacatttccattattcattagtgtccgaccattaactccataaacatggagtatttccaagttattgaacgtgaaacaaaaggaacgaagaatatactcccttctgattcaagtgaaagttttaataagaactcaggaatgtccagaaaattaccagacaatttgtatcctttttcgtcgttcaaaaaatttgtatccttgagctggctggcacctttcatgtcttcagcatcagctaattgtgcatttgagctccttctcatcttggctgcctgcacaaatttgtgtaactggtacaatatatgtgagaatgaatatacaggtagaaccatagatgtagcatagttgttgcagtgacctaagtcgtagcactccaaaaacctgagttcaaatctctataggagcaattttcagattatattatttgagaggtaagttccatattaataggctaagttactaatttaaaaatatgccatatatccaacagtaaaaaatactcttctctaaggaaaaaagttagaaccgtagaaaaccaagaattagttgtacctgctgtacaataatttctctgcgccaacatgtctaaatcaacttttggaaattgctcggtaaattcagtctgttgaggaaaggaaaatgatttcaattttcatgtaatttgtgcagattttgcacagtatactatgttgacatatagcacactgcagattagtaactcacacgttcgtgtgcaaactacaactcaatgatctactacccacttgattttgtaaatgccaaaatttcgtaattatggaagatataattgtcaaacacttgcaaaactgaagaaatagattcacttcatgcacacagattgactaaccaaacaccccaatgcaacgaaatgcaaacacaaatcaccacggacgaggaaaaaaattttgagagcatcacacgaatttatatatagtataacaataatgcaatctggatatgctacctcaggtcatcagttcgtattgaaccactccatcccaacccatccgaattgaatggatattgggatgggttcatcgctagatttgaatgaattcggacgatgaaatgatgctccccagttgctggacattattcacgcagggcagcacgccggtttgagtatggcgtcggcccgggaccagcagcgtaggcgccagtggcggcgacgccgtggagacgcctaggtttcgtactacgcctcgagatccattgaacgctctgggctctggggcgccgcggttggaatctcgaaggaatatgttcagtttttgtcccttatctcgacgtcgagtttaaatcacgtcattgaactataacgtgtttaaacttataataccggagtatttgaaatctcaaaacaatattttgtccgatttcaattgacgtggtatgtttactatggt

SEQ ID NO: 91319 - DNA, 907 bp, Oryza sativa
tggagagaatggactcctcgagctcggcgatggtgtgcgtgagcctctcgatgtccagcacctgctgcctgttgctcttctccagcagcttgttctcctcctgcagtcacaaagaccaaaaaatcaaaaatcagttcaggctgacgaaaattaatctagctgatgtgtcagtgatggatttgcatgtgtgctagctcacatggtagatctccatctgtttcttgagctcgatgttctggttctggacgtcctcgacgatcagcgccctctcgagcgcgctacgcaggatgttccctgcctccaccagcgccgcctccttcagcttcaggtgccgctccaacgccttcttgtcatcctggagcaatgcaatctgacagccgagacgagcagccacaatgtcatcatacagaactgaagttaaactgaattgtcctggtaactgatcgtcaggcagctgctttagtgcagtttcaggtgttacctcgtgcctgtatgctttgatgtcagactccaggggcgcgatgatggcgtcgaacgggacgacctcctcgtccttctgcgacgagtggatccgcctgagcgtcgcctcggcggcgaattgcgcagacagcgcttctttcctctcgttgcttagcctcttcacgtccaggttctgttgcaccgagagaaaagctcgttagtatcgtagaaccgtagaattggtcacctccctccgtataatattatgaattgttcctaatcaaacctatttaaatttgatcgagtttacagaaaaacttagcaatatctacaacagtaaattagtttttattaaaactaacatctaatatattttaataataagcttgttttgtgccggaaatgttgctatatttttctataaatttgattaaaacttaaaaagttt

SEQ ID NO: 91320 - DNA, 1241 bp, Oryza sativa
atctgcatacaatctccgcttttgacccgagagtacttgatggaaagctctcatagtcctctttgcaacgcatccagcctcatcgccaaattccatcctagtcatctgcagatgaagaaacaatgtgctacgtcacctgtcatgggcctttgggcttgtaactttgtttgagacccggcccaagtggggcccgcgtggggtgcatcccaaccaggggagcatgaccttaggcacccccaggtcctccttccctctcttgggccgaatccggcccatttccctccccctctctctcctctccctgcggcccactcggcctctccccgcgcgcgcgccactgacgggcgggcccgcccgccaccctcgctgacgggtggggcccacccatcatccccttcctcccgccgctccgcccgcgcctagcgccgccgccgccgccaaatccgccacgctccgccgctcccgttcaaaattgaatggggaaatatttcccccgattccctctccctttccccacattttcctctctctctctctctctatttcagatggaaaccccccctaatcccgccggcgccattaatggcggccggatctcccgcaccggtttccttcccgccggccgccctctctcactcccaaccctttataaaccctccccgcacctccctcgtttgtttccaccactcgccgacgacctccggccggcccactccgctcgccgggaccgtctcccacctcggcgtcgtctcctccggcttcgccgtgccgtcgccgaccccgtccaccacctcgccgagctcgccgaccgccggagcgccgtcgtccccatccacccgagccgctccaccgcctttctccgctccggccgcctcctttgccgtcgccgtcgacccggggtgagccgtggaccgccgcctctttccccctacccttcccctctcttggccgccgcaccgccgtgcctatggacgctgccggcgaccataggggcgcgggcgccgtctcccgccggccgcgccgatgtggccgcctccgggcgcaccgtgtggccgccgcgtggggcccggccgtcaccgcccgtgccctcgggtgcggctgacgcgtggggcccatggcgccggccggtgtgagcccgggtgcgcccggtccaccgtggaccatgaggctgccgcgtgggccccactcccgtggacccggtccgcgcgccccctcccctcggctgatgcaataaattcttt

SEQ ID NO: 91321 - DNA, 700 bp, Oryza sativa
gtgtcagctagacttcccgtctgcttgttcttcgaaaccccaacttatcatttgtattcaattcctatttgcaattcagattgcttttatcttttttgcttgtttttttgatttgcttgtaggaataaggttgatctgcaccggcaagatcaataacccacagagaggtgtatcgatcgcaaaggcacaacacaatgtctcgtacggttgtaatcgggtcatcaatgtttctcccaaatcgtatttatcatcaactcaccgaaagatcgggccaacaacagccttgggtgtctcgagtggagctcagggttcatcaagtggtatcagagctttcgttgctcggtatgtttttatctacatattaccagaaaatagccacaaaaaaatattgcatccattacctagccatctttgtgccactgcattgttcttttcagtttttgctttgttagttttctgttgcattgtcgcgtcaagttgctggacttagcgtagtacgtttaggctttcgagttctgtcatgtctattaccactgtcgtcgtcgtcgccctgtctttgttgtcgtcgggacctatgaaaacaaaatcatctttccgccagggttctatttttctagttttcaaaagtttatgtcggttagttttagagttgttgagttgcacctagggtttgtagatcctgccgtgtgttgggctgcag

SEQ ID NO: 91322 - DNA, 1115 bp, Oryza sativa
ccctatcctggaggatcctcctcacagcagcagcagcagcagcaacctcgccccgcgccccgacctccatacgtggtgcgcgtcccacagccgcagcagcagcagaatcagcaagggacccgtgcaccccgccctcctgcaccggccgtgcagcctggtcaaggccgcagggacgctcaaggtcaacaacgtctgtgcttcaactgcttcgagcccggacactttgcggataaatgcccgaagccaggcgccagcaaggccaagcgcctccccgccccaacaacggtggtaaggatgtcactgggggttgtgtgaaccacgtgactgccgaggatgtgctgacaactccagacgtcatcgttggtacgttcctcattcattccatccctgctaccattttgttcgactctggagcttcccactcgtttatatctgtgccattcgtggggagaaatcagctgggggtagaaaggcttaggaaccctctactcatcaccacccctggagtggttatgacaacgaagtattatagcccggccgttcctatagaaatccagggaattcctttccctcggatctgattcttctggacaccaagaacttggatgtgatccttgggatgaattggttggctcaattccaaggagtagtggattgcgcaaggcgcactgtcactctgtaccgggggcccgatcaaccagttgttttctttgcactccaactcccgccggcacttcagtacttcatcaactaggattatccgtaatctccatcgtcagtgagttcggtgatgtgtttccggaagagctacccggtatgccgcccaagcgggagattgagttccggatagatcttgctccaggagccactcctttatacaagcgaccctaccgtatggcagcaaatgaattggccgaagtcaagaaacagttggaagagttgaaagaaaatgggtatatacggccgagcacttccccctggagtgctcccgtgatttttgtggagaagaaagacaagacaaagaggatgtgcgttgactacagagctctcaacgaggtcactatcaaaaacatgtaccccctttcccagatcgatgatctgttcgatcagcttaa

SEQ ID NO: 91323 - DNA, 729 bp, Oryza sativa
tcctgcagccccgataaatccacccttaccatttaattaggcacatattcttccatcaatcaagatcgaattgatctgccatggcatcaaacaagcaaattgatctcgagtcccagaagccggcgacgtcatctccggcggccagcgtttcatcggcagcagctgccaccgcgccgccagcttctagctcggctgtacccgtttcagttggcataaccaaccgccacaacgtgcagccagagacggagcctctgctgctgctggcgggcggcgacggcgatggcggctctgacgacgagacaacgcggctggagcggaccatcacgcgggcgttccggagcacggcggagctcgccaagcacctgcccacgggcgcggtgctcgtcttcgaggtgctgtccccggtgttcaccaacggcggcaagtgccaggacgttaaccgcgtcatgacggcgtggctggtggggctctgcgccgcggcgtgcttcttcctctgcttcacggacagcttccacgacgggaaagggacggtgcggtacgtggtggccacgcgcgccggcctgtgggtcatcgacggcaccgcgccgccgccgccggacgtggacgcgacctaccgcctcaagttcatcgacttcttccacgccgtgctgtccctgatcgtcttcctgtccgtcgccatgttcgatcacaacgtcggcgcctgcttctacccggtgatgtcctacgaca

SEQ ID NO: 91324 - DNA, 609 bp, Oryza sativa
gtggatgctcttgtccaccaggcgctggaaatcaggatagtccctggagaccagatgcacagacagttcagggtccattcctgccaggaatttctgttgcttttcctcatcttcacgaacatcctctggagcgtaccgggccaagttattgaactcatgcaaatactccatcacagagcggttgccttgcttcaactcccgaaattccctcttcttaagggccatgactccggcgggcacatgggtcctccggaaagcggcggtgaagcgggcccaggtgataggctatccttccggctgcgtagcctggaagtggtcccaccatagagatgcgggcccctgcagttggtgggtggcgaagatgactttctcctcatcattgcactggacggtgtctaactttttcccaacggcatgcaaccaatccaaggcatcaacagggttgttgaagctagagaaggtaggcgggcggatgcggaggaactcggcaagcttagaatgctgcatgggtggtggtgggggcggagcattgtgttgcggcggattctggatgtggtggaggaaagcagccatcacgttgccctgctgggcgaggatttggtgaggatg

SEQ ID NO: 91325 - DNA, 919 bp, Oryza sativa
ccgactctggctcagatgaaattttctggccctttctggatcccatcagcaccttaggctctgcaacaagatgttcctgctcaatagagaagctccatctgcggccatccctgtcgatggagaaactagctctccttgagtccttcaagctcgagaagcttgaccgacgtgcttctgtctcggctgagaagctgtgccgccgcccaaccctgtcactgcccgatgaggccctactactgctacctacccgtctgcggctgctcaaccgtcgcagtttcctgtcctccttcagtgctgtcgatggggagcagcaattgcttgacctcctgcccttcatctcttgctcctctttctcaggtcctggaacagaaacttcttcctgagcttccgccacagtctccaccatctccagcaacggcaattggatatccctccctgtagcttctcctgacaaagctacctccaaaactgagtccttccgaacaattggtgcttcctctggctcaatcttctcttcatcctctctgcagtcaccgtactcgctcgcttcttcaccaagatctccgcattcagaggtctccactgcttccgtctccagtggatctacttgtcctgcttcacaaccatcatgtagggaaccatcacactcacggcatccagcttctttagtggaaaccgctgaatcacgagcttgctctttgcattccttatctgtgtcagcaccatcttcgtcttcctcatcctcttcctcctcttcgtcgtcgtcgttttcgttttcatccttgacattgtcaacctgactgacatttgccgctgcaggggagccccagaagcgagtggctaatgcagccatacgaacagggtccgacctgcagcgcatcagcagcagcgcgtttcgcggcgggatgcagacgctgac

SEQ ID NO: 91326 - DNA, 2028 bp, Oryza sativa
aaggtagacgagatcaagaagatcgtttcccctgaattgattcaaccggaaacggaaaggcacggccgaatttggaaagggcgacggcgcgtctcggttagggttcgaccgcggcgatggcgcgaggtagacgacgggcctgacaggcggctccacctgtcagcgggcgaacgcgcgcgcgcgggggcggctcgcatgcgggccggcttgggccgagggagagagagagagaggtttgggccgattttcggcccaaagccaaaagagaaatttttaaaaactttttcaatttaaatttttcatgaaatgcaattccatttattaaaaatacttccttggctcaaataaatcccagaaaaatttaggaactatagaatcaagcaaagtatttaataaaattttatctagccaaattttatattggaatttattatttaaaattacgtcttctcttgtaggcttttaagaatcaattctaataattccaattaaacaacaatttatatatatgggtttcttagggtgtgacaccaccacacatgaagacaaacgaaaaacagcggaagactagggcgacgaccacaggcgcttgacggcaggcacgagatagacaccaaagccttcatcatccaggaactcctcttctaggtttgggaaaaactgagcaagactgaatacaaccaccgtacttaacaagacacacccacgagtgcagaataaatgcaaaggagtacaatggagttataatatcgggggtaggggttgcataacacatcattacaagacacttaactgctcaaagctactttaagaatacgatcctagagctatacaatattattactcaaggccgtgaacccacacgtcaaattaaaaatgcatattttaaatcattgttagaaattattttaaaagcctacaagttaaactctaataatctaggaaaattttcaacataaaattgagctagataaaattttattaaatactttgcttgttcctctattttctagatttttctgggaattatttgagcaaggaagtatttttaataaatgaaacaacatttcacgaattatttaattgaaaaggtattaaaaatcctccctaagtcgttgggccgatttcggcccaactcccctttttccctgcgcggccaagccggcccaagtcggcccaagccgccgccgcccctcctctcacgcgggtcaccgacatgtggggcccacatgtcgggcccttctcctacctccggccggccggccaccctagcccgagccgcccccttctcccttcaaatccgcctcaaatccggccccctcgagtccgattgattgaggggttttgatcccgtcatcctcctctatcttcactcccaaaaatcggagcaaaccgttgagttttctaaccaaatcgaattccttttcgaatttatccccaaaaccgaatttcgattttcttggatcgatttcttgcggtgggagtccgatctcttcaatccaaggctataaataggaccccctagttgtcctctttcgtttgccccctttcccgagctctctagtgcgccgtagagccgccgccgccggcggccaaccaccagccgcgccgcgccgtcgccctagccttcgccgctgcctcctctcaccgccgtcgggtgcgcgtgattgagggaaagcccggccgccccttcgccgttgtcaccgaccgccgtagagccgccgccgccgccgcgcctctcgtcgccggccgtcgtcggtcgccgttcgtcgttttggtgagcaccattgggttcgtgtcgttgccctctacgtgtaggtgtcctccaaaaccccagccgaccctcctagcgccggcgaggtcgccatccgagccaagccgccattgatgacgtcaagctgacgtcatcatcccctctttttcagttttttttaatagatgaaatagattaaaacttcggaaaatcataactaattaactgtagctccgattcaagtggttcaagttgctaaatttttctaaaattga

SEQ ID NO: 91327 - DNA, 681 bp, Oryza sativa
ctgcagcccgatctcgagagatcgaattgttgacgacgatgatggttctgatctggttaggttggatctccccctcatctgaagtcgttgagtagctcattgtcggagaatccatctcttaaacccatctcgtcgaaaccttgaagcaccaaaaggtcccctacctggcgcgccactgtcgacgtttgatgtcgcgattccggtatttgcatagtatggggatcgttggtactaggatatacgcgagactgaggtaaaagagacggagacgaggatttttatacaggttcgggcccctgaattgtcaggtaatagccctacatcctgttggccgaagctggtattgctcttattcaccataatcacaccagtacaatatttggggtagcatatctaactgttgtcgacatggcggtctgtagttctgactcgtagtcgacaacagggtagtcttcctcctcgaatccgtgcccggcgagatcagagataacgctttcgtctctcctgacagtatctggagacactataggggactagccgtgcttatccctaaagtcgatatccggcgtcttatcttggcgtatgttggcttgtatgttgatcttctgtcttctatggtgggtgttgattgaggtggtcgtgtcccttctcctcctaaggggccttgtatttatacacata

SEQ ID NO: 91328 - DNA, 5047 bp, Oryza sativa
ccctaccaaacccctaaccccgacccccacagcgccgcgccgccattcccccatcctttcttccccaaccatcccagcgagtcgacacctggtgcccttgtgtcctcttggcacgcgacgcgaccgaggtcttcgtgctagctactaccactcgctaccgacgaggaggacagcgatggcactggcggtggatcccctcgcggtgcgatcgctaccccaccccacccctcctcctcctcctcctcctcaacctcttcctccccaatcattcaacggcatttgattcttcgtgaggcgagcgaggagttaagagtacaagcggtcaattgtgtcgggacgggaccagatcaggctagttgggcaagcatccggacgacacgcgccgaaattactgcggttagggtacgaaatcaatgcggttgaggcggtgattaggttagttaagtttggtataattagaaccgcgaggccccaggtggatacggcagattttttttttttgtttttggtgtgtgtgcgcttttagatccacttatgattggtggggtattgaatactgttgctgcgatcgggcggcacgaaagctacgctttagaaagggaagttttgtggatgcattcgttgcggataattagttatatatgactaatttgtctggtactagcagtctataaattgttgtgagatcagattcgtccatattctacctattggcatgacagatcccaaaaatcactcacctgactacatggctagtggatttattggacatatataatagcggcaagttggttggacgacctaaacacgtttaggagatagagtttttaagagaggataatatcattcactgtatttaaatgctttgttcattgtcggggccccttcattgtcactatcaacactaccaaattttgacatattttaatgttaccaaaatttttggtagtataacaatgataatgatatgaatagctttttgtctttttcgtattttgatatagttaaaagtggtaacaaaatagacaagccctaattttaacttgcatgtgttgtctgcaagttcttgttttcttttgcaaataatattgttgcttgtggattggttgtcgctaggccgcctcatgcaccaaatgcgtctattataatattctatgatactgatgtgtgagatgaggttgtacatatttaagtatatactccctttggtcacaataaattgtgttttggacatcatatggctttaagatgcgattttcgacgctaatttattttgctaaatattaaaaaaactgataggttataatattatgaaaggaaatttcaaggccaatatcactttgatggcttctttaatttagtaatatatcacgacatggttaaccaagaggcatttcccattttgccctatgtgaaactcatatgaaactttgttagtaaaggcagttagaactcataaattgttctttcaaacaagaaaaagaaaacatgcccccacataggggcattttttgtcatttaagtggaaagttgaatagataggtgtatgtgccatgttcaatagtgagaggtaaatgaaaaactagacaaattctttttggctctttatagtgttatacgagtacacatttgaaaagagaagcttccatttttgctacttccatttttcaagtatagtagctggccgtttccatactttctaacaaagtgattatcagttactatcactattaatgatattgatttttataccacaatattcactgtttctgtttatgaatgcaaaaacctttgcaaataaaccaaataaaatgtatcaagatgtttggaacttacatatttaaaaagcttggttaccatttgggtctgtgtacattattgaacacaattttatccagttgtatttagcacaactttttgatatggctgcttggcacataggtacacattgtcaagtctgctgtctattacttgtgtttgtcagtgacctactatacttatgaacttgagtgcatattgcattttccaacctaatttttatattagaagttcttcagattttattccatacaacttggtacatgaaccaaagatatttctatgtatgatgtgagaaatcctcttgttttggtgctttgagtactcatttcaatacaatatacttattgtgtatttatcctttttgcatatttatataggatttgtcgatagcttcagtcatgattctttaggttatcaaagggtcacttatgttatattccaaatatatgtgataattctctgaacttgcatagagcaatgttatattgttatggacagtgctatacatgcatgagaccatctaagaatacactactcaattcttattactatagatctaacgtattgtatacaaaaattatttacatctatttttaataaaaatgaatttccagtttttattaatcttaactaggctttgtttctttgagatcccagcttgaatatatatttgttgtggatacataaatccatccatttgtgcactttataatttccattaattgtaaattatgttaggagaacatttgcaaaaatgcctctctggtacaattttcgagaatgtatagtaaaacataccaattaattataggaaatataaatatcttgcaacctgtgtttaagattaacaatgtacgtactagctggtacccatatagcataggtgataccatttctctttgtcaagaagtcttgctgttatttcttggacttgttttgcattatttgagtaaagaaaaatagacatttcagcaggatctagctcaagactgctcaaatgaagcacgagcaggccacataaccaaatatgaatattttgtattagtattttgtactagtgtatagctacttcagggcgccttcacgatgtcgctgcttgtctctggttgcgtcctagagagtcggtgcctcctccgcaagcgcaatcaccattagggcatgttcaatggtagagacgagtatgatctcttaaacaataaaagattatttagagaccgtgtctttacaatagttgggacgacaaagactcaatcattaactcaaaaaatattccttttgttaatattctttccatttttttacccttatgtaactatatttctatattttagtgattaagagtcgttgttatgcataacaacgatgttttgtctctcctctttctatttcttccatgtcaacaagtattcctaattagcaacgctaagagaccactattgacaaaccattgtgtatgcctttactagataggacagacaagtgggagcataggatggcatggaatacactttatgaaaatgcagagatgctactggtgtgatcattgaagtcagtgacagtgtgcggatgatagattggcatttttggatgtctatatatatatatatatatatatatatataagttcacctagaaatgtgctttagacttgtgttttgcagaagtattatgaggtttttgtttgtcagttgggaactatattgcaagtaaagctgtgtatacacattagtagcaaattggcaatatgtgatgtgtggatattttgttttgattataaatcaaacctgcttgagcagctgtgttttttttgttctgcaaattgaactaaattggtgacaggaaagcacacatcctaggtcttgtttaatctggtatgggttgcttctttctcttatgtgactttgtctaatgctgttcaggacatatatactaggtcaagtttatgaatttccatataatgtttcaacttccagcttaattgtccttattggtaggcattttcggtagtatggaatgcatgttttaattaacttgaagtattctggtttgatgatctgatggcaacttggtttgtgaaaaacatacttttgcttttatacctgaaaaacaatcttttgccgtcatgctattattgtctttgcatcttattactttgagttatttaaatatgtggaatagctaatgacaatcattcatgatattgcagggccttcatcacatagatatcgatgttactgatccaactcagggaggatacacgacggcgcttaattccattcgagaacgggatcaagaacgtgctgggcagaatacttttcatggagtagcgatcacttcactgaacaaacaatggcgtcgcatcaacctcgttcatcaggacaggcctaccgtttcactgctgatagatgaatcgaatggatatctggttggatttcgcagaggagatggaacctggatgcattttaacgaccaagagctgccaaatgtgcctggcacagagcagagggtgccaggcataccaatccaattaagctcctcgtatatgaatttgattaaggataatgaaaggtttataataaaattcttcttattttaatgaaaaagttactacctaaggattcttacatgcaaagttcttataagtttcttcttttcaggccttacttttcagtggggagacagagtttacgccactcttactttgtgctgctcaattatgatgcggaggtggacttgaggagtgcaatgatgaagagacaaaggaaggcgttgacacagttgataatccttttctgtgaggcggcacggataaggccagttctggagttcatttctgaggccatgtcaaccgaggacaccacaccactggacgagacactctggacatggatcaagaactggtccaccctgtcccgtttcgcactccactgcagaagatgtgagcgtgatgctactccacttgaccccaacgaaatcaagcacgtctccccctacggcatcaccagcagggagcaagttctggaggtgctactcctcatcctgtcccgacctttgtcccaaccttgatcgtatggtggtcagctggtgatatgtacatattttttttcctagaaacttactagtcagacgaccaacctggtgataagtttgtcgacagcaccatcttgagatgtttacctttgtgagttctgtgaagccctggtttagcacctcaagtggagaatcc

SEQ ID NO: 91329 - DNA, 6953 bp, Oryza sativa
attcctgcagccccaagatgaaaggattgaccaccaagtgaggctgccacttaggatggcagaagatgaggataccttccaaggcatgcatgatgggatggagcgtgatgtgcagcactcttaccgtggagatgcactaacacgtcatcgcaggacaaggaattctgatgtgcgctactcacgttctcctgaatctgagcgtattaaacttggaagacacccagttcaacatgggtattcttcatttgatgatacccatgagtttagtgaccaagaagtttctcctgtggtttctagaggaagaccccggaaggctatgtatcgtgatcatgtgacagaacactaccaaactgatgatagccctctaggacgggagtattatgatgatgatgtggattcatatgacctatcacctcagagaatggcagagccttatgatatggttgatgaccaagacaaatatgatgcaagatatgatttaccaaacaatcgtaatgttttctcaaggattactttgcgagatgacaacaatgatgggtgggctgatgaagatcaggaaaacaatcatcaatcgaactcaataacctatgggcattcacaaaacaagcctatatctcagaggctgtccagacccactggccactcacaatttgggggatttcccatgcatggaagaggaagaggaaaaagtgcaaaaaagagattaagatctgctcttcctcaattccatgttggatctacacaagggggagatggatttgttaggccaaataaacgtttcaagctgacagaagttaatcatgatgaccctgaaatgagccatgaggatgccccagaggacgaggacatttctatgcagaaagatcctcctgaaggctcagaagaattcactaagcaagttcaccaggcctttcttaagtacacaaagctattaaatgagagcccgaccgtgcagaagagatatcgtgaggcagcaaaaggatctttgtcttgctgtgtatgtggcaggtttgtatttcttcatctgtgctaacattctaccacctaaacagttcctcctatgactggaatggaggactccttgaaaactctataactttatcgtaccttggacctagatgttgcctagtcatgtttatcatacctggccctcgatcttgtagtttaggttacaatagctaaatcatattatgaattttatggtacttgacttccacatggttctacgagaaactttaggtgccctccacacagcgcatagaagttaaccttctagtttaattataggtcaagttatttcttgtatatggtactgttagggtgaaatcggacgatagggtagtatgtggcgggatgattttgaggaaatttcatgtagagttactgccaagattgtctgttcatggttcaatcaagagtcaggcaataaactaccgcatgttggcattttttatcagcttcaggcactgagagatagatgccaaagattttgatcagtgcagcaatggtctgttatatgagttgaccatttgacaatcttccctaatgccacagccaatagtgatgtacattctgtggactaatgcattgcaaggatttatcaggacaagatgacatgaagagtgtacaagtgaaatatggttctgttgactgattgttgcttttggttgctagtatctgggtctggggcagccaagtttgtatcctgttgaggtcaggagcatacaaaccaaattgctgttatgattctttggattaccataatcaaacacatggaaggcacaaaaacttgtgtttccttaatcaggcagaattgttatgtcttttttcaagggcattcaacgcttgccaagtcgttaaggctgatggataacatgtgttagtttgcgaactaagacacaaaccaatagcatcggctcttgcagtattacagcatgtcacttttttatattctggctagagagtagagactgtaggttgaaccaattgctgcatttgatgttgggtatttcgggtacacagtacatgctgcatattttgttatcttctattttgctctttccatcctggtgagtaatttatgcttgaaaattcacttttgcatttgcattagtcaattcctactgtttacaatatgagcattagtatagcgctgataagcttcatatggattgggatttcatttcatatctgtagcctttggtaggtatcagaaattgccattatttatgccttgacatcttcctagtcctaattaaattggaatctctatattgaatattactttttattgaagtaccaattactacagaagtttttgccagttaagtgacttaatgtttattttttttaacttttagctttgtttcaactttgttttattactcttctggttgctaagcatacaacaaaccttaaacacttggtttatttttcttgttcaaatcagatatcgttgatctttgctttcttggagtttgttatgtgtcatccttttttggtttattttaagctttagacttctattaaaatttattgcatgaagcaacagtttgtttttgctgggtgcatgaatcaacagtactgcatttcatttcttgagatagctgaaggtaaagtatcttcaattctgtatagttttccacctttaccatcttagttgcaacaatttgtttggctgatgtttttgctgttcctaaccatttattttgtttagggatactaaatatttggaatatttgcattgctatttcttatatactcttttcttttccactatgttttcgtctgctgcacagaagccacagccatgttctgcataaacccttctgaattcattacaatttgtcatacattatactgcactcaaaagcataatggataccatatttcttgtgtcgtagaattctgatttcattgaacatttacattggatgtctaacctgaagaactgctttgtttatttgttttcttttttgttcacttctttcgcataacagtgtcccaaggaagtttccggacatcgatgccttgatatcacatgcttatgatacatgcaaaatgggtttgaagacaaaacatttggggtttcacaaggcactctgtgttatgatgggatggaattggcatgttgctcctgacactaccaaaacctatcattccatgccagatgaggaagtaaatgccatgaaggatgatctcatgttgtggccaccagttgtcataatacataacagctccattgcaaccaaggcaaaggctaccgatgcaaagattgtgtcgaaagaagaaattgaaggtgtgctgacaggttagtaattcatttagtcccaatataatttacattctatcagtcccccttttatttgtttgtccctggagatattcaacctaaggatcgtggctatctagctcgaacaaaccatttttttggtcgcacgcttccttgaactagtatgcatcttcatttatggctataatctgttagaattttttataagatcagctgatacagtgtgaaatcatgtaactgcttttcccttctagatataatctgttagtacttttggataagaggaatgcttggtgttgtatatctgcagtttctggcacaaaatataatgttgagttttgaaaatgccctcatgcgttattcttagtgtcccttaagttgatattttcttctgtatccagaaattggggttgcatgtgacaaggcaaagattagccatggcagaccagccaatcagagcgtgttcctagtgaagtttcttccaacgatatctggatttcaggaggcgatgagaatccacgagcatttcaccgtcaaaagccacgggaaggaagagttccagcatatcaaaggtggcaaaggtaagaaggatgctcctgttgatgaactcgaggagttgctatatgcgcatattgcagtcgccgaagacttgggctacctggatgaggaaacaaagaagagatgcctggtcaggagcaagaatgacattgaggctaaagcagatgctacactgaacttggattcgtgaagtaacagcaacaaattaatctaggctaggtttactgcggctagttgaacagatcaagttatcctactttttgcttaaattgtatcgctgctcgaccacgtggctgcaaccttggaatccattatactgctacggttgaaccttaatgcaatttatccaagcccttgagcttttatattctagttttctgtcatttaatcgttttctttctcctgcaccttcaaattggagttgtgatattttccagatgatgcgtgatcaaatgaatgccacatgcacacatgattcttatgttaagtctccgtgatatcatttttgtttggaagtgttgggatggaaaatgatggaatgaaaatggttgattactggccagagatgtgctctcactgaaagagcatctgaaggccacaaagttgtgaaacttgtgcctcattactgttgctaatatgtactaagagtttaagaccatcttttaacactgttgggcatcagaacagagtgcggttaataggggtgttacactgttactgtattggtaatctaagattgcagcatgaaaatgcttcctgccaatttccatgcctgaaaattgacatctatcatggcatagaaatttgctaagctggaactggattgttatggtagtacttctattttgtctgtccccagctgtgtcagtaccagaataatctgtgccttgaatgtgcagaaacaaccaaccccttttgctatttctacgcaatacgaatttctgttgctgctacaataacactgttctgtaatagttgccattctcgtgtgctgctgccattgatgagattaagtggagaagagtagtacagtagatggcatcaaccaagcaaccaaagctttgaattgttgtttgcaccggtgcactgcagtgccagccactgacaggcttttcgagcaacggttgcctcttggcccgagaggactaggcacgggtattcatggcaaacgtcttcttttttccttctcttcttccccttcaaagctagggtgggtgccactttctttgtacacattcactagttcaagatcgataagtataatattgtactactccctctgtcccaaaaaaaaaagacaaaccctggtttccatgtccaatgtttgaccgtccgtcttatttaaaaaaattatgaaaaaaattaaaaagataagtcacgcataaagtattcatcatgttttatcatctaacaacaatgaaaatactaattataaaaaaatttcatataagacggacagtcaaacgttggcacgcaaaccgcgggtttgcctttttttttgggacggagggagtatgtagtagggttatcgtcaatgtcaagtagtacttcgtgattaataaataatattaatccctgttcgaatgtttatgagccgatgaagattatccatggcatgtttcctaagcttataaataatgtgatttttttgttacaactttttgcttctataccaaatatatatctataaccggatgagacaaattattgtactacgaatctggactagggcttgttcagattcatttctatctaaatttatagtactagattttttttaaagataatagtactataatgtttcatcaaattctagattactatattttaggacggagcgaataactttataacaattactccctttgttctttttatatgacgttggttagttcacgttatatattcagggatggaggtagtaattcattcgttggtacccttaaatattatcacaaaatcaggtaatccgtcatccgttcataagtttaaaaagtagttcagtgcatatgtagttatgtatgtataacatgttttacttcttggcttccatagttcagttggagaatgtataaagccttcccatccagcaactttttcccccttaaaacttttgtataaaaaacacgaatattaaggaatgacataatatcaaataattagaaggggcgaagcttcgaacccacgtcgtctagcccaccaccttgtgaagctagccagaaaacccttgtttggcaacttgagggaaggggattgggagtttacacgagggaattgatggtgagattaagatgtgaatttgatttttcatcccagtctcttgtttggtagaggtggtggaaattgacagggagtttagttagagattaggtcattaatgaaaacggatggctgagatttgtttaggcgaagtaaaggaggaattccctcccaattaccacccccacccgggtattgaaaaggagggagttcattcctcaattccccatccccatcccaccaaaatttccatgtctcccaaccaaacaaaacagttaatagcctcatccctctaaactctcaatccctcctaagccgtaggtgtttctgaaaaaaaaaagaacttttgtatcacatcaagctagttcggggaacccatgagaattgcaactactctggctattaacccttttcaattagtacatattcttaattcaggttgcgagactcgttgcctaaagagccgaaaaatgaataaataaaactggaaccagattcttaccaattgcaaatttgcaatatgagaatttctagttcccggagaaaagcccagatgaactcccaaatcataggccatccacgtggcattctaattaaaatgctgtatacttcacaatcgccatggatggtgattgcagcatcttaatttgatttttgctatgatgacactattaattaaggaagatggttagcagtagcagagagcttaattagtgctccctccactccccggtaaggcgacaataggatcgattttgacagtctgaaggccaaacaccacacgggtcacccgtagaccgttgaaagtcgcatcatccaagtccaacacaagtctccaaaaata

SEQ ID NO: 91330 - DNA, 3826 bp, Oryza sativa
ggatgctgctctgtgcccaatcttcagatcattttatttcaggatactatacagtttctattattaaaacaaaaaatggaattagttgtagctttaggatttgtatcggagtaatggtgtatttaaagagtcccatcttgagatgctatatatatggtgtgtaattacaagtttgccatgtttgaaaaacaaagggatggatataacttggtttgtcaaggcctgacatttattgcatcatgggataagtaggtgggcagtttattaaagaggaaataaacaagaaaaaaataatttctcattatagaaaaataactcaggattcttggctctttttaccagtttcgatcatttcgattatgacaactccattgatcacaccataattgttactaggtgattacgtgttgacgaattgactccaacagattggaaacatgaatatgcatttctatagtggtattacaaaagcagatagggacagacatgcttaaatattagccattgaaatgtgtctatccaaagatacactcgattaacatcgtttcaaagacaataaacttaaatatataaaaaatgccttctatatattaatactccatatatgatactaccaaaatgttctttaactttactccatatctctaaaggttttttttaaaaaaagtagttacacgaaactcgttcgatggtgctaaccacaatagctatttcacgaagctagcgcttgctattatagttgctgccagcttaaccatgcgtgcagagccatatactctctccatccttaaatgtttaacgttgttgacttttttaaacatgtttgaccgttcgtcttatttaaaaaatttaagtaattattaattctttttctatcatttgattcattgttaaatatacttttatgtatacatatagatttatatatttcataaaagtttttgaataaaacgaatggtcaaacatgtataaaaaagtcagcgtcaaacatttagggaatgagggagtatatcatcaatttatcaccaatctgaatttattttccacctatactataccttttatcaatcatcatccttcaacaaaaagggttgaaatctttttcaattctcaaattttttttccaaatttgtgaacgcgttgccacttgctactaattttggcaacacaaaaaatccatattacaagctttgctactcgaatattataataacagtagccacttgccccacacctctgccggcggttacacgcggtctcctctccttaaccccgtcttctcttctcctccacacgggagctcgccgccgcggcgagccaccgcgacctcccctccccctccccttccccttccccttcccggcgcgcgcatcgcatgttcccgcgacagcttcgtgcgccgagctgaggcgatgtcggtggcgctgtacgcgcgtgggggtggctgcggcgcgaaggcggccgcagcgcggcgctcggggcgcggcggtggtgggcggaggcgcgccgcggtcgtgctgctgctcgcgctggcgtacgtggcggggctgctcgtgttcgtgcttgcgggaggcggtggtgttggagttggagggcgcgtggaggtggggcgagaggtgggggtgatgacggtggcctcgctccggaggcggcgcgccgcggcggcggcggcgccgcagcccgggtcggtgtaccgcagccacctcgtgttcgagcggctctggccggacatccgcgacgacgccagctccgcctccgccgccgcctcgtcgctctcctccacttcttggcgtcgcagcatggtgagcgagcagagcagcccaactagttcttgcgattcttgattgtttcttgcctttgattttgggttctcgcgattcttgattgtttcttgtgagaaacatttctttcttgtcttttgatttttgtgttcttgcttctttgtgcgttgtaacacgatggaataatgaatcagaagataatttcgggaccatttcgtttattttgctccgattcatcacgggaaagatgcgcaatccgttcttgtttcgtgagatgtgcacttcttgatgctattcttcagaaaagagaagaaacaagttcagttcttgattcctttgtgccgttctttgtttctttccccttttctggttacagacgatggattttagtgagctcacatgccttgcgcattatgattttactgtacggacgcttcattctgctttgcttgctcatgattagatgtagtacttttgtacttttgggtgacagcattatgcttgatgagcatttagtccatgattttaattcgaccggtgaatatgtgctttcatagttagtgcaaaaccattcttaggatgctccaaaattgggtcactaaaccatcctacttttgttcttcgtaagaaccaacttttacatttcagaaagattcctggttctatccattatcatgtagtactaatatatggaaatatttgtttgcatttgtatcgtgcagttgatgacatcgcactatcagaatcctggggagctatggatgccttgtgtcaacaggaagctgattcgaccaggttccactttgttgaaaactacctttttctaggtcttgtgccccataatcataagcactgaaaagggagaattttactaacaatgtcgtgttacgcatcggttctttgcagagttgccaccttcaaatggttatctcatgatcgaagcgaatggtggtctgaatcaacagcgtctttcggtgagttctaggatcatcttttatgtttattaaaaaaaaagtactcatatatgatcatgcctctgagtagataactagatatgcgattatcagtatcttatttaaaagtctagtgccatatgcacctttttaagcaccactaaatctagttgggtagtcacattattgccacaaggtgtcactcaactgagatggcatcttcagcaactttgtgttgaagaagtgggattgtcactagacttgggtttgtcctggaaaaatgatttcattgagactcagaaccttctaaatgtttctggctttggatgctccaaacaagctgcttaatatctgttggctagaacctgtccaaacacgcctggggtagctatcttggcggtcctgtaggacatctatgatttatccagtgtgttatacatagttttcttttttcagcaggttatatactatttgatttattgttcctaacatatttcttttcatccaaaaagtttgacaacaatgatgtgttctctaccattaactcttagctgtgatacagatgatctgacacttctgaacttcttggaatctttcacatatgctaagtaattattaacacatattttccaatgcagatctgtgatgcagttgctgtggccagtttgcttaatgcaactcttgtgatcccagcatttcattttaatagtgtttggcgtgatcataggtaaatatctatttttttcatcgctttgtgtcttattatgaataatgcctgtctgtagctgttttcactttgaattgcaaccacatgtcaatccttgggaaattttcttgtgtgcacaaagttcataattgtttaaatataccaattttatttgacatcccaactcaagaagcgctcagtacttcttttcttttatattcctttcttccaacaagtttttgttttccagtgtaagattgaagcacatgttatttgacaagacaaatcacattcgaataacacttgatggaatgcaaatttgccatctgtctatagtggcatttgcaatttctcatatatgctattttactttccatttatgcagt

SEQ ID NO: 91331 - DNA, 2193 bp, Oryza sativa
tatgcaaaaggtgcttccgaaattgctggagttagggtatggtaaacactcaccacccatgatagagagaatttgattgaacattgtttcattttattttctattccattcagggctgtgcgaattgccccattctcaaatagactggcacaatcagttccatcaaatctccaggccttgagatgttttgttaactaccaagcgttgagatttgctgagccaataagagttctcgcagaggatatggttgaaaggatggtaaaacggagtactttgactggtgggaagtttgtatcagtacatcttcgcttcgaagaggttttgacattctctctcctgtaagttaccaattgcatgttttcattcatgcaactaaccttttgtgtaccactgtattgtttaggatatggtagctttttcatgctgtacatatgatggtggcttgaaggagaaaactgaaatggaaaatgctcgtgaaagaagctggagaggaaagtttcatcggcatggtcgagtgatcaatcctgaggcaaacagaagagatggaaaatgtcctcttactcctctagaggttaccttttcctttcccttcttcacttctcgtttattgcataatgttaaaaattgttgagtctaggtttggccttttagcagtttaggagaccatctcatgtgactgacacagttgcacatgtgcactgaagcttgcattgcacaccattatcttagactatttaatacgtgccgcatctcctttctattttttattcatactgaattatgtaagtgtgcttagttgttgaaacctcaggttattaccaccatgtgtaatttaattaccatcaagtgaaatgccttcttttaaagcactaaagataatgtgcaactgaatgcacttgtgcaggttggtatgatgctgcggggcatgggatttgacaataccacctccctctatgttgcttctggtaaaatatacaatgctgaaaaatacatgggaccgcttcgacagatgttcccttttttggcaccaaaggatactcttgctttgcctgaagagcttgctgagtttgaggtattgtttgccccccaggaactctgttttcttttcagaattttgattgtataggcactcatgaaactactcaccattttaacatttgggtttgttgtgtttaatactagaagcatttgtttaagtgaatgacatcaattggattatctccaattcaccaacctattgttctctgtattccacaggggcactcatctcgattagcggcattagattactcggtctgtcttccgagtgaggtctttgtgacaactcaaggtgggaacttccctcactttctgatggggcacaggcgctacctgtttggcgggaatgcaaggacaataaagccagacaaacggaagctggttttatctttcgatgatccgaatatcaggtcagttttgatcttccatttgcaccatcacaataataacccattaacctagcaggcaatatgttttgtgatcaatgaaagtagaaatgtcatggctgtcacaaatcttgcaaaatcagcttccattttgacattctgctagaaagactcttccacacaattaaaactgcttttagacaatatatctgttgaccgaagatggtcggtgtttcctttccaacaatgtatatttgagttgaccttagcctaacttcctcattgtcttgcaaactaaatacaacaccttcttagtcagactttcacacacacacgcacacacattattgaataatctcacttgcttaatagctttgcaatgtcataaaattggtttaggaccaaactgaaacacctcttttgtactactgcagatggaatcggttcaagcgccacatgcaggatatactacaccatagtgacatgaggggcactgcattgaggaaacccaatgattccatatacaccttcccaatgcctgaatgtatgtgccagcaagatgggatgatgtaggccttgtatgattcatgcacatacgtcgaggaggaggaaatatgcaattttgtacactctgtaatgatctgtaggtagccaccaccaccgtacagaagcaatctttggccgggaatttgttgatttctgtctgtagattgtagagagaggagaggtgaaaattggttctggttgtagatatgatgaaacacatgct

SEQ ID NO: 91332 - DNA, 1524 bp, Oryza sativa
ataacttgtaagttgaatatctgaaattcataaatactactagtaaactgaaattctgaaagaagaaatgaaaagcatagaaacacaaggaaatgagagtgaccttgatgttaggcctcaaatggttgaaccatctttctctgcattgctttcctactcttccaggcagcatcccccctatcagagaccacttcttcagtccaaattgttccactaatttcaccagcttcctatcaaaatttggaagaactcaatttactcatcactggcagagtacagttgtacagagagcaaaacttgtgatttctagttactgtggacagtaccattacaaagcatagtagtacttgacagaatcacagagaattcatccaacttacagttttaactttcaaattacagtgcacaaaaacattatcaagtatgctactacttgacagaatcacaaagagttcatccaccttacgatttcaaattacagtggacaagagcattacaaagttaacttggtatagaaaaaaacaaaaaagaaattcatctttcttttacctgtcttcttccactgtccagtggcctttgacagcatcagccttcttgatacctttccttgacgccttgtttcttgaaatcaacctgccattcatctcatacgcaccaaatgctccaacttgaacatctcttacaagatgagaaacctcagtcttggggttcaacagaaagatcgacgaagcattgtcgatgaaatccttcctacttcctcttctgaagaactcatgatcaagatcatgaagagttgcaaaaggaagcacagatccaccttcaagttcagacccatgaacagtgatgccttcagcttcaaatggatgatcaagatcagcatgatgatggagctcatcttgcagcagaaaggaatcaaatggaatgccatgagagattgctggttggggattgaagcagctgaaatccatggtgagattttcagaatctgaataggagatatcgagtaatgtctcctgaatctctgagaggagatatagcatttggtaataaaatctaagcaacaacttagtagtgcccttaaactggggtggccagagataaatggcaggttaatgcaagttaatggatctcatttactgtcattaaccgagaaaacctcatgcatgaggagggaattaaggctccaatgctccctgcgagtctccaagactgcaaacatgcttgctatacagtcgtgcacgtacatagcgtagacacacgttttcagaaatgcaaccaaaacattcacatagaaattaacttttcagtttataggccatggccaaaatttaaaatttaaatcttatgtttatagttcattttgatttttgtattatagtttttttttcaacattgacttttaagtcgttatgacacatataaaagttttacatataaactatttcctggacgctaatgatgtatgtgaaataataggacagcatatggattgagatagctaccatgcccccgttcgttctccat

SEQ ID NO: 91333 - DNA, 651 bp, Oryza sativa
catgatatcgaagaaaactagtggaaaatacatctccaagtgacacagggtactgacaatatcggcctgcaacccatctaggtcttctggatctataatcttctgaccgattgcattgaagaaggcacaaagccgtggatcgtgtgacggacttgtggtggtagaatgcctctatagcaactggcaagatctgtgtgattagcacgtggtaatcgtgagacttcattccaaccagcttaagatcctccaatttaatgtacttacttattctcgtgcaatagcccgaaggaactttaatatctgccagacatgatagcattgcgatcttctcatccttcgacaatgtgtggcaagctggtgggaggtacactcttcccgtcttctcatctgtaacaggctgaagttcactgcgaatgttcatctcctgtagatcgagacgcacattcaacccatcctttgtcttgccaggcatattcaacaatagccccagcaagctatcgcacacattcttctctacgtgcatcagatcaatgcaatgacggacctcaagatcttcccaataaggtagccgccaaaatatggattttttcttccacatcctcttcttgtcctccttgctacgttttcttttctttccaaactcattagtaa

SEQ ID NO: 91334 - DNA, 2943 bp, Oryza sativa
  unsure (1)..(2943): unsure at all n locations
ttaacataagatagtggcaacggtagcaagttntagtgggatatggatgtnnagtngagatcccgtctgctccgaccctaaggaatatggatgctacatatctgctgacgaggcgaatgcagatagaacacacaggcaaccaaaacccttcctatccaagatttctagacttatctctaacgtaatcatcagcaaactcctagatttctagaaatgttgtatttgaacgaaatgttctgtttaccaatttgtcttggtcggtaccgtgcaggcagtaacctgaccaaaccagatttggcaaccaggacacttcgtattctcctaaatgccataatttcagtaacttcatttaataacagatttctatgcatatccatcccatttcctatgacccatttaatattattcttgtacctaaaaaaacacaagtcatgacatataataagtttggcctcagttttgctcagaaattatgcttcaattatcatcatttgcaactgccccacccccaaaagaaattaagaataagtgtagagggtctgtccttatgcaaaaaagaaacaagtgtagaaacccacatttaaacctaaacaagaacaagagtgaggccggcccaacaatgcatccattttgcaaaacatcccatactgccactcccccccaaataaaatgaacaagtgtagatacaaaacagccataaaaaacatacaaaaactcacaattcccccaaaataattcaaccatcacagcccacatcaattcatccatcccattggacccaaaatatcccaaaaatggtatgttcttgagcaatcatcactggccattcatccatcatagcccacaatatttcatcatcacagcccacatctaaacaattttcccaacatcccattctcccccaaattcacaaattcatccatcacagccatataaaaatttatcactagctaacacatatagaaatgcacaagtcatcacagccatataaaaattcaccactaggtaacacatataaaaatgcacaagtatcacagccatataaaaattcatcactagctaacacatataaaaatgcacatgtcatcacagccatataaaaattcattattagctaacacatataaaaatgcacaagtcatcacagccatataaaaatcatcactagctaacacatataaaaatgcacaagtcatcacagccatacaaaaattcatcactagcacaagtcatcatatgtagacattagcatctaaacattgaatcaacaaataattgcactatcacattatcgaatttaaacattatcatcgaatcatcaaatcatcacatataacatgtacacaacaaatcatcacattatgcatcatcatcggtgaggagtacctaccttgcacggtggcgggctcggtgaggaggttgacgtgggctcggggacggcggtcttgggcggcaccgggctcggggacggcgtggagggaggcgccgggctcggggacggcggtcttgggcggcgccgggctcggggacggcgtggagggaggtggtggccgttggggaggccggatcttgagtggccccggcctcggggacggcggtcttgcacaacggcggcggtcggcaatcgatagagggaggcagcggcgtggaggaggtcgacgtggcggctagcacgaggtcgacggccactgggcatagatctggagaggaggatgtgggacggccgtggttggtgaggccggatcttcgagagaggaggaggcgacagcgttgaggacgaggaggtagcggtcttgaggactaggcggagaggaagccggcggtggcggtcttgggcgtggaggacacggacttggaggaggaggaggcggcgtcagcggtggtggaggaggacgaggtggcggcggcggtggatctgagagagtgagagtgtgagagagtgagaggcggcgtcggcggtggataaggacccgtggatgaggattgactaaataaaccctagtcaatcctcatctctatcaggcagactattatgcccgatgcggatgacacttatccgtgacgggcgttagtaatctacccgatacggatgatacctatccgtgacgggcattagaactaagcccgatagagatgtaataatctctatcgggcatagtactaaagcccgtcacagatgacttattaaaatatttttaagttataaaaatcatttataattatcttctgcccgatttaaaattgctattacatttgatttatcacatataattaacaaatgtcttatttacatagttcaaaattcctattaattttttaaaatcatataattgacaattgcctttctcacatatagtttaaaattcctattaattttttaaaatcatataattaacaattggctctctgacatatagtttaaaattcctattaattttttaaaaccacataattaacaaatccatttcttcaaagagttttaactggaatggcatgaaacatatgcaattcattcattaaggctccaatacaaattaaatacatcattcacagtgatatgccttccgaatggtctaaacaaacgtaagccacttcgtcttcgggatcatcgtcaaggtcgatctgaggtctgacatgaagattcttgttgtattcttcttcatcgacaacgttgtccacccccacaattcttcgcttgccatccctaacgacgtgcatcttcttttttgcggggtcttttatgtagaaaatctgttcgacctgcttcgctagtacgaatggttcgtctgcgtatccaaccttggccaggtccactaatgtgaagccttccttgtcgaccatgacacctgtgcggatattcacccaactgcaacgaaacaaagggactttgaagttcagatagtgcagctcccatatctgctctatgcggccatagtatgtgcg

SEQ ID NO: 91335 - DNA, 614 bp, Oryza sativa
caggcgccgtggctgtgagcccgcagcagctgcacgaggctcttgttcgcgatcacacggaccacggcgagcgcctcgccggcacgcctcctcagcagctcagtgaacgggctgtcccacctcccggtgcgcctccaccagaggacctcgaacgacatggtgtaccagtgctcgatgtacggcaggtgctccgccgccacgcgcgcctcaccgctctcccacctgctcgacacggtctccccgactggccttagccgcagggcttgggtcagcaccatcgacagtgttgccacgccacgcctcatcgcctcctcgccggtggcaccggcgtcgtaggaggacagtgccccgatggcgcgcagcgaggccgccctcctgagcggcaggccggggatgttctcgaggccgccaataaggtcgcggtaggtgttgcggaacgggagacgcctggcgttgtcggggaggacgtcctcattaccggggaagacgtgccaatggccgcttcggttggcgaagccagcgaaggagtagtcgtgtttgtgcacggccaggtgcacggtgcaccacgtcgccgtcggcgcctttcatgctgacaccgtacttctccaccacca

SEQ ID NO: 91336 - DNA, 704 bp, Oryza sativa
tccctaccgccgacgagaaaagctgacaagagattttgtgtgaataacctgatgtttcatatgcatattagtacagatcatcacaatgaatttgctgtaaatttgcttgattaccaccgttaccacataattacacccgacgcaatttcaaacacgtacaacgaatgctgaaacaatcccagcgttcactaacacatcctacacaaagaaggttcagatagacgaccgatcgatctacagtagattgtacaaaagaaaaattggacgaaatggaaaacccaaattcaaattcgaatgaagtatgcatcaaaaaaaaaaaattcgagcattgcatcgacctcatattctcaatgaattctcaagcctgaatcgactgaattcgtcgagctagctagcgcgccatggtgatcgagccgtccttgatgaggctgttgctgagcgtcttgaaccgctccctcgagtattgccgcgacgccttcctccaatccgtcccggatttcatcatcgccacgaactcctcgtagctgatccgcccatcctgcatgcaaattcagagattgatcagtttcagagtttatttgggagagctctaacgcctaaatttaactccgagagccgagtttgcagtggagttgtggaggaggctaaacccagttacatttctccagttcattttgtaagagcgcttcaagggctgcaggaat

SEQ ID NO: 91337 - DNA, 797 bp, Oryza sativa
cctctcggtccacggtggaccgggtgcacgcggctgacgccgaccggcgccgtgggtcccacgcgtcagccgcaccgagggcgcgggcggctgacggccgggccccacatggcagccgcggggcgcgcccgaaggcggcctcgccggcacggccgacgggaggcggcgcgcccgcgccccgatggtcaccgccggcgaccaccggcacggcggagcggcgcccgagagagcggagaagagagggaagcgaaaggggcggtccacggctcaccccgggacgacgaggatggcggaaacgacgaccggagtggaggaaagcggcggcgcggttcgggacggcgaggacgacggtgctccggcggtcggcgggtgaaacggaggcgcggacgaggtcgacgacgacgcggcgaagccgaagggagcgatgccgaagcgggagacggtccggagcgacgacggcggctgaccggagctcggcggcgacggcggagagaaggtgcgacggtgcgggcttgattccgacggggagagcgagcggcgagcggcggaaacggaggagagaggcacggggaacaattatatagcgccgggggagagagagaggggccggagggggaggaatcggccgcggaaatctcggccgccatcaaagacgccggcgaagattgcgggagcgattccaaacggatccgagggagagagagagagaaaagagggggaaaagagagagggaatcacggggagtgattccccccactttaatgcgcgcggggacggcgggaggcggcggaaacgga

SEQ ID NO: 91338 - DNA, 3756 bp, Oryza sativa
cagcctgttcaaggtcgcagggacgcttcagtccgcagcgtctgtgcttcaactgcttcgagcccgggcactttgcggataaatgcccaaagccaaggcgtcagcaaggccaagcgcctccccgctccaacaacggtggcaaggatgtcattcggggtcgtgtgaatcacgtgacggccgaggacgtgctgacaactccagacgtcatcgttggtacgttcctcgttcattccatccctgctacaattttgttcgactctggagcttcccactcgtttatatctgtgccattcgtggggagaaatcagttgggggtagaaaggcttagaaaccctctgcttatcaccacccctggaggggttatgacagcaaagtattatagccctgccgttcctatagaaattcaggggattccttttccctcggatctgattctgctagacaccaagaatttggatgtgatccttgggatgaattggttggcccaattccaaggggtagtggattgcgcgaggcgcactgtcactctgtaccgagggccagaacaaccggttgttttctttgcacctccaacctctgtcagaagttcagaacttcatcagataggactgtcagaaatccccatagtcagagagttcggagacgtgtttccggaagaactacctggtatgccgcccaagcgagagattgagttccggatagatcttgctccaggaaccactcctctgtacaagcgaccctaccgtatggcagcaaatgaactggccgaagtaaagaaacagttggaagagttgaaagaaaaggggtacatacgtccgagtacttccccatggggtgctcctgtgatttttgtggagaagaaagacaaaacgaagaggatgtgcgttgactacagagctctcaatgaagtcaccatcaaaaacaagtaccctcttcctcggatcgatgatctgttcgatcagcttaaaggtgccactgtattctccaagattgatcttcgttccggatatcaccaattacgtattcgggaagaagatattccgaagaccgcattcactacgcgatatggactgtatgaattcacggtgatgtcgttcggcttgaccaatgctcctgccttcttcatgaacttgatgaacaaagtgttcatggaatacttggataagtttgttgtggttttcattgatgacattctgatatactcacaatcagaggaagaccatcagcaccatctccgtttggtattgggaaagttgcgggaacatcaattgtatgccaagcttagcaagtgtgagttctggttgtccgaagtcaaattcttagggcacgtgatatctgctaaaggagttgctgtggatcccgaaacagtgaccgccgtcaccgattggaagcaacctaagacagtcactcaaatccgcagtttcttaggtttggcaggatactaccggagattcatcgagaacttctccaaaatcgctcgacccatgacacagttgttgaagaaagaagagaagtttgtgtggagcccgcaatgcgagaaggcgttccaaactctcaaagaaaagctggtttcctcgccagtgttaatcttgccggatactcgcaaggatttcatggtgtattgtgatgcttcgcgccaaggattggggtgcgtgctcatgcaggacggtcatgtggtagcctatgcctcacgccagctacgacctcatgaaggcaactaccctacacatgacttggagttagcagcggtggttcatgctctaaaaatctggcggcactatctcattgggaaccgctgtgaaatatatactgatcataagagtttgaaatacatcttcactcagtcagatctgaaccttcggcaaaggagatggttagaactcatcaaggattatgatgtgggaatacactatcatcctggtaaggccaacgtggttgccgacgctctaagtcgaaatagccactgcaacactctcaacgtccgaggcattccacccgagcttaatcaacagatggaagccctgaacctaagcatagttggtcgcggattcttggctgcgttagaagccaagcccaccttgctcgatcaaatccgtgaggctcagaagaatgatccggacatgcatggactcctcaagaatatgaaacagggtaaagccgctggtttcacagaggatgaacacggaactctatggaacggaaatcgggtatgcgttcccgataacagagaacttaaacagctgatacttcaggaagctcacgaaagtccttattccattcacccgggcagtaccaagatgtacttagacttgaaggagaaatactggtgggtcagcatgaagcgggaaattgcagagtttgtggctctatgtgatgtgtgccagcgtgtcaaggcagaacaccaacgaccggccggacttctccaacctctccaagtgccagaatggaagtgggatgaaattgggatggatttcatcaccggacttccaaaaacccaaggtggatatgattctatatgggtaattgtggatcgactaacaaaggtagctcgattcattcctgtgaagaccacttatggagggaacaaactagcggagctctacttcgctaggatcgtgagtctccatggcgttcccaagaaaatcgtatctgataggggaagccaattcacctctcacttttggaagaagctccaagaagagctgggtactcgattgaatttcagcaccgcctatcacccgcagacagatggacagaccgagcgtctaaatcagatcctagaagatatgcttcgcgcatgtgtactagatttcgggaagacttgggataagagtctcccctatgccgagttctcctacaataacagctatcaagccagcatacaaatggcaccttatgaagcgttgtacgggcgcaaatgccgaacaccgctattgtgggaccaagttggggaaagccaagtgttcgggactgatatcctgagagaagctgaagctaaagtcagaatcattcgggataacttaaaggtggcacagtctcggcagaaaagttatgccgataaccgtcgccgtgatctggaatttgcagtggatgactttgtgtatcttcaggtcacgccattgcgaggtgtgcacaggtttcagacaaaagggaagcttgcacctcggtatgtgggtcctttccgcatcattgctcgacgcggagaagtcgcttaccagttggagctgcccgcctccttgggcaacgtgcatgatgtgtttcatgtgtctcaactcaagaaatgtctccgagtgccatccgagcaagccgactcagagcaaattgaagttcgcgaagacttgacctatgtggagaagccagtgaaaatcctggacgccatggagcgcaggaccaggaaccgagtaatccgtttttgcaaggtccagtggagcaaccacgccgaagaagaagctacttgggagcgcgaagacgagctgaaggcagcccatcccgatctcttcgccagttcttccgaatctcggggtcgagattccgtttaaggggggtaggtttgtcgcgtcccaaatcgactctaaaattcatcctcaaaattgtgcaaaagaataagtaaaattcatgtgaaagcctccaacaattaaaatgtgcaaagataaaagtcaaatgaggcttgtaggatttttgtatatttcctaaaagcctaaaatgcttaaataaattttagtggaattttcagagcacaaataataagtgaaaaga

SEQ ID NO: 91339 - DNA, 5682 bp, Oryza sativa
ttttcgatccattttgttctacgttataggaagcactcgtgctttcctttcgatcgagtgtaacggtgttcagctaattgttctccgaaacaagctgttgcggtttcaatcgttcggcaagtgatgcttcggccgattcgtttcgcccccctggcctttttcgctgatcaggcgtttgccttggggtttttccgcaaattatcaatcgcacaaacaagtaaaaagaaggtagaggacacaaagattttatactagttcgggcctccgtggtggataatagccctacatccagtttttttttttgtcttttttcattttcctcttctttttttcttttttttcttttttttcttgccgaaaggcttacatagtgtcgaaggtcttacataacgatatatacatttttacaagtttggcgatttgggtgccacccgttctagacatagaaacgcttgagagaggcagcgttctaggaatggtcgaactcttcgccttccagtgtcaccagtcgaaaggatcctgtcctggatttgtgcttgatgaggtacggtccttcccacttcgattcaagcttgccaatggctatcgggttcgcctttttcctcaagacaagatgaccaggcaacagctccgtcggtcgaacttttttgttgtaagtttccgaagtgcctgtggcatacttttgcatgtgctcgagtgcttcgactcttaccccctccaagagttcgagcgacaactcgcacccctctgttgcccccaggcaacagagttagcccctagctctgttggggtcattgcctcatcgctatagagaagcatgaacgggctgaacttggttggtctcgtgggggtcgtccgaagggcccagagaacagatagcatttcctctggccatttgcccttcgctgccccctcaagccttttctttagtgcttctaggattttaccatttgtacgttcggccactccgtttgactgcgggtgcgtgactgatgcaaacctgatttccaggttaaacccttcacatatttctcttaacttgttagagtcgattgccgttgtcagtgatgaacttttttggcacactgaaacggcaaacaatgcttttccatacaaactactgtactgctgccgaagtgatcgcaccaaggggttcggcctcaatccatcgagagaagtattcaacggccacaattgtgaacttgtgcccgtttcgcgccgccgggaacggcccaataatgtccagtccccatctggcgaatggccaaattggtgcgatgggctgcaactcatactggggcgcggtttggcttcggccatgacgctggcaactttcgcacttcttgatttgctcaagacatactttcaacacagtgagccagtaaactccttgtctaaatactttggaggcaactgttcttgcggcttggtgcgcgccacatagcccctggtgtatttccttcgccatttcctcgccttcggcgaaagaaatgcagcgaagcaacggttgaagtatcccggagcgatagagctgacctgagaccatcttatacttcgtggctctgaattgcaagcgctttgcctctgcttcgtcttccggaagccagccagtttcaaggtgcttcacaaacggggttcgctagtcgtatgggtctttgctcaatttgacgtggtcgattgccaagacctccaagctgtccatgggcacgcttggtgcatacaggacctcaaaaaggatgccaggcgaatgtaggccaccacaagcggcagatttcgccagggtgtctgctttctcgttctggcctctaggtaaatgttcaaccgttatgccggtgaagcacttttccatagaccgaacggcatctaaataccttttcatcccttcttcttttgcctcaaaagacttgtcgacatagcccgccaccagcttggagtcggttcggattagcaggcgccgaatccccaatgctttcgcctttcttaggcccaaaagaatggcttcgtattctgccgcattattagttgtgtcgaactgtagccttgcagcataccgaattggcacaccatttggcgaagtgactactgccgcaccgcccgcccccttgtgcgaccacgaaccgttggagtacatcacccagggctgtttgacgagctcgggttcaggggcgaatgccggtgtccatttggccacaaagtcggctagcacttgggacttgacagcagtgcgggcaacaaaatgtaagtcaaagggggatagctctgctgcccacttgctaagctagccagtaacttctttaccccggagtatttcgcccaaagggtactgtgatggcactatgactttgtgggcctgaaagtaatgcttaagcttgcgtgaagccatcattagggcgtaagcgagcttttccatttcaatgtatcttgtcttcgctccttgcaatgcttcggagacaaaatagaccggtttttggcctaaatccgtttcttggacaagagcaacactgactgccactggcaaagctgctaggtatagtagcagttcgcttcctgatgctgggctgatcagagctagcgggctttgcaggtcttgctttagctcgtcgaacgctgcttggcattcgggagtccagttgaattttcccgcgccccggagggttttgaagaagagcaaacctctttcagctgcctttgagaggaatcgacttagtgccgcaattcggcctgcgagcttttgtacttcacgtacgctcgacggaggctttatttgctgaatggcatcgattttctcgggattcgcctcgatgcctctttcagaaacaaggaaacccaacagcttgcctgcgcgaacgccgaaaacacacttctcaggattcagtttcatacccgctgcgtgcaagttgtcgaaggtctcctgtaggtcggacgcgtggtcgaaagccttgcggctttttacgacgatgtcgtcgacataagcttccacgttttgccccaactgcttgtaaaggaccttgtacaccagcctagcaaaggttgctccggcattcctcagaccgaaaggcatcctgaggtggcaaaaggtgccaaacggtgtgatgaaggctgtcttggggatgtcggctgggttcatgcgaatctgatgatagccggaatatgcatctaggaagctcatgagttcgcagccggctgtcgaatccacgagccggtcgatccgtggcaaggggaaatcgtccttcggacatgctttgtttaagtctgtgaaatcgacacacatgcgccatttgccatttgacttccgcaccagcactgaattcgccagccactcaggatgatcgatctcttgaatgacccctgccttgagcaatttttggacttcggcttttgctgcctcctgacgatcagcggacatcttgcatagcttctgtttccttggctttgcatccggcttgactgccaggtgatgcatgatgagatctgccgaaacacctcccacttcatcagggccccaggcgaagatatcaatattcttttttagtacctctaggatgttcttagcttcttcttcgcccatgtcgccccctcccagtgatacgagttttatggggtcggcatcatcaatctgcatcttgattatcttgccgtgaggggcgggctttggcacgtgcttcgctcggtcatgcggttcggcctcaacattgtgcactgctttgttgattatggccaaatcgccttttgaagcagccgaaggatgaagccccttgatcacgatcactcctgctgggccggacatcttgagcttgagataattgtgatgggaaatgacttcgaacttgttcaaggttgcacggccgaagatggcgttgtagttgtatgggatgtcgacaacgtcaaataatacttgctcttcgcgtctgttttcccccgtgccgaaggctactatcaactgtgcttggccaagaacttgaactgcttctccgccaaatcctcggagcgatgtcggtgctggggtaagggcttgggtagtcaaccccatcttggcatatgcttcggcaaagatgacatcggtcgaacttcctccgtcgaccaggattcgccggacctcgaaaccagctatctcggctgagatcaccagaggatcttgatgcgggaacgttactccttcggcatcttctggcccaaaaaagatttgctggttcaaatactacggagcccctttcgcctgccgaagtgatattgtggatcgttcgcagctgcatcttcttctgtcgcttcgacagttggatcggcgggtcggccttgtaatcacttggatcactctgcgttgcgcatcttagcgctgttcggctgggggtgcttgttcttgagctacttcacgagttgcatcggccgctgctccctgctgcgtccttggatcttgcgcgttgccacgttgccaaatatttcggcattgctccgtggtgtgcgaagagcgtccgtggaaggcacagtagaggtcttttcggaccttctttcggacaggctgctgatggttgcttgcttgctaagcgtcgaactccttgcggagggcttgcacttcttcgacagccatcacagccttgcccgctcggtcgattctgaacttcctctaggtcatgggggcttgaccttgccttggcggttgtgcttggatcgccggctggggctggcgaacaacgagaggaggtggttcggcaacttgaacttgttgttgggcttgagcagtggtgacggaagccttatcgtactcaacttgtattgcttgccatcgcttggaatcctcttcgccccttgtgaacccgtcaatgatgcgaagtaggtgttcaagcgtctgcatctccttgttggcgatttttcttgtgagttcgtcctcgagtaaaccagctgaagtggcgtttatgactgatgcctcaattatgtcttgaacttggcacgggcttgcgagaagcgacgcatgtactcccttatcgactcccccggcctctggcgaatgccgagtagatgctgctgcgtcttcggcccctcataggtgcctcgaaagttaaggacaaagacatcgcgcaattgctcccatgagtaaatgctattggctggcaaattgaaataccaagagcgggcgatgccgtctagggcgagatgtattactgacttggtattttcgtcgccatgagccgcttcgatcgcggattcataaatggagaggaattcctttgggtcagtttcgcctgggtagcgtgggacgggtgggaacttgaattggggtgggattggacgggtcttgattcccccactcagcggtagccccttttcgccccctgccctgttcacggcaccttgctacgggtatggcgtggcgaagggcgaaatcacggcttgcgcgtgaggttgggccatagcattcggctgcccagccccgattggtgatgcttgctgtgccgccatgaatgggtcgaaagttggctgtgaccatgtcatggtgacctggtttggtgcttggtttgctccgaagcctggtgttggtgcttgcggccgaacggttggcgcctgagcagcattgatagagtcgaactacggtccttgactccacggcgaatccccagacctggctgattcgaaggcaactaacgaggcgcaccttgacttgtattcccctccgggcgggccgaaggg

SEQ ID NO: 91340 - DNA, 10369 bp, Oryza sativa
cgaagtcggagtcggagaagaaaaagttgcggtccgcccccgagacgacggagtgctgctggatcccccgcgagacagggggctgctctcagccccccttctgcgcgaccagccccgagggcgccccaagtgcaagggggagcggttgttcctctcgccccccacttcgggccctcgggtagattcggcctcggcctcgggctcgggcccgcccgcagttttggcctcggcctcgggctcagggccgtctccggcctcggcttccgggctgcgacctccctcgtcccccgctcccgggtggcgctccgcatggatccgggtctcagagccgccctcgggagggacgtcaccgccgctatcgctcgcggcgggtcgagtcccggctgaggtgaacccagggtcggactcggtgtgcggcccgtgggccccgccgggaggctgtgaaggccccgcggccctggatcggccaagtccgggccgctctgatcgttcggattttgtcccctgcaaagggtcggacctcgagatccccaggaaggaatctcactacaaaataaccctgatcgcgttaacgaagaaaaagaagaggagggaacaagagaccgagatgagtaaaaagcaccgaagcgggtgccggcagtcgtacctgcggggagggcggttgaaagtccacttcgggggctcaatgaagctcccccgacacggctccgtttggcctatcttccagagccgcttcttcttccgtccggcctcaggcgcagtggggcgcttgtggcccgccgacggtcggtccgccccgcgctcggcgccccctctgtgtgggggagagggcggtcgagattcggacatcttccgcttccctttcgggtcgctggccgagtcgaccccgggtccgcggctcgggccgggtgccctggagctgccacccccgctggggccgcttgtccgactcccgcctgtggtcaacccgccaccacccacgccgatagcgctaccaccggtgccgccccggcgggaccgactcctgctggcgccgatggccgacatcacagccaagatactctcccggtcgcggtcgctacagaggggaaggatcccgtctggaatcagtgtttgctcggcagtgtccacacccagcacccgccgaatcaccgtcttcgcgtcctcctcgccccagtcccagcgctcgcccacatgcgtgcgcatggggtcgttaggtccagtgtactcccacgcgccatgggatcgatcttggagaggcgcgatacggcggcggaagtagtcgccaaagaccattgcccccgtgaggccaaggcttcgcaggcccctgaggcgatcccgcaccgcgccgtactcttcgcccaactccgaaaccgctagccatgtggcggatcgttcgggagggccagcgggaagccgaagtcgcgggtggtccagcagcgcggtgtagaaccagtccttctttctgtcctcccatttctttcggagatggctctcgatgtattgccccgctgtgcctggccggggctagaagtaacatccccccaccaccgcgccttgcagcagctgccggacgaagaaagactggaacagccgcatcgtcggtcgcaccccgatgaacatctcgcacagatgcgcgaagatggccagcgtcatcacggcgttgggtgcgagatgcaaggcatggatctcatataaatccaaaacctcgtggaagaatccagagaatggcgggatcaaccccgccatagcaaaggacaggaggtgcacagatcactccgggtaccgcggccgcggccgcgactcccccgccatcacggcggcgccttccgacatgatcttgcgggggagactaaggtgcctatccgccgtaatgcgcgatgccggaagcactgcgtcaccagcatcttgagccatgatgaccggcggagaaacggtgaggggcttagcgtgcggggtagcgtggagtggcgagaatgttagggcttagggaacgagtttgcgggtgagcagttggcgaaaggaaggaggcaaagtccccgcctccgtatccttttatccttgcctcgcccgcactcgcctcctcgtttcacgccctcacggttgcccccacgattctcgcgcccgcagttgcctaatcgtttcccgcgaccactcatcacgtcgcccactgaatccacgccccgcattcagtgcgcctgtcagcggcacactcgataaagggcgtgcgacggtcacgggcgcaatctaggcgaaccgtcaccagtaccgccacatgcgtggcgggcgagggagtcgaggtgtggtatagccgaccccctaattttcacgccttaagcatcctcatcatcagcgcggtcagtggcgatcaaaccgctgttgtggttgatacgccgacctggccactcggcaacatccgcttaggttccctgccgggcccgcaaccccagcttgggaagtcgtgaggcaccacgtcagaccgacctcaggaggccaatgtccgatatggtgccgggggctactgtcggagatatgggctcgggggtatgcgaagtgtggggaatctaccttcccatcctgccatgtgtccctacagcctggtcctgcccccgcagtccgcgaaccgcaggagcggccgggggggtcggggcctcggggtgccacgtcatgcccctcgggcccttgcaccgctttgccccgaggccctcgcccagccaccatttggcggggggagcgagcgaggtgagggcccaggctgagcctcctttaatgcgtgcaacgccccaactgccccctgtcacatttaatgtagtgggggcagacgtgcggcgtgctaaactgacgcgccatagtcaagaatgaccggtctgtgaccggcctaacgctggtcacgtctgactggaccgacaaccgtgctcccacgtcgcatctgcttctggcggagtagaggtaggtatgacccgtcccatcggagggtcattcggacggcggccaccacaagtcttcacccattaatgagggaatgacagggctgtcccccgtgtcatgcgagggacggcgctgagccccattcaaggacaagctgtggttcaggttccaggcgaaggcacgggtcgagttccggtcaagatagggtgggaccccacccgaaagaagagtaggtagaggcggtgcatgtggtatccccttgagatataaaaggagaaccttgcccaccgagcaaagggacgattctcaactaacttgggctctaggagaagagtgttctcccgagtttaggaacccttgtaactctcaatctaaatcccaaacacaggagtagggtattacgcttctcagcggcccgaacttgtataatttgattgtgtgcgagctagctaggggccttagggatggatacgtttctagaggcgagtttcttcccccggccgaactcacgaaaggggggtttcacgacctcccgctagagaggatcatccctcgacaatctcccaatcacgatgtggttgtgctgcataggttttaaacttttgaggagatgttttctcattgtttacatatcgcatattaattaataatatagattaatatatatcgcatattaattaataatatagattaatatatgatacaagttaaaattcgactactacaagttcaaaaaaaaaactatagttaacggttaaattcttttctttatgttgttgcaacttgtaaaggttaaatttatcttttatgtttgtgaaataatctactgatctatcacatattaatcctatattgttgatttttttcagttttttcataacaatttaaatgatatttaaataataagtgatgtccctaaagagctccttataatcatttcccgtacatcgggaggaggatttgtacagcgtcaggactcacgacaacggcgtgcagaagcagatcacagttgcagcagtttctactgcctggcagcaggataaactcccagcattaacatcacatctaggcatctatattgataatagtttctttttccagggaatgcgcacaaatatgatgcctggaacagatgtcattcaccaatgtgttacatttagctggttactggtcagagaaacaggagggagggagggagggaacatttggaattttttacatggagagaactccacatggaaaatggaaaaaaagaaaaaaactccatcgagacaatttggagaggacttaaagtgttccttcaagagacaaactatgaagtgctctagatagatcgctagtcctcagtacacattttcctcccagaattttcattcctgtcaagcagcaaaacaaaaatgttctaataagctacagtagtaaagaactaaatcacataggcatgctgtcaacactacagtaaagcctataagcaatagactgagatgtaacactgccaaacatctcgtttgagttttatcttttttctctttgttattttcaaaaccggtgtttcctcactactcaaatatgaccaaagtatttaacagcacatgtgattattctgagaaaacggtagacatctcctaagccaagttttcttaaaaccaggtaatttgattcctttgaaccataaactgtttttaatgtcaattaaaacgtaatactatgaagttcattgaagataatctattccagtgaataccatcatattactatcattaaaagaaaagaaacagttggttgaaaggcatttttaggatactcaccccaaaactttgcatcattttcgtcagtggataacagaacctcatggatctgacagtgctctatgactcccaggctccaaaattgattccatcggatcatccatcctacccacagcaacagatgaaggtataaatagatgttggacagattcaatttcagtagttcaaagtacacctcacctctctcaagtaaaaactgattatcaaccaaatacaccagagtacataggctagaggaaaatacaaaatagaagagagagagagagagagagagagagagaggaagaagaagcaattaatctggcataccctgtaagatgtgctggaaattttggtggccagatcatcagcagtggatatattctttcaatatccccatcctcgggacagatttcgtaaaccttggtcatgttctttgcaacgatgtccaataagaatatagaatcatccagctttagaaatgctgacttcccagcgtttgcgattccgagaatactgacatgggcacacgattctccagcctctgtaacggatgcttgaagtatatcatcccttgcaacagaatgagataatgtccatgtaatttgagacaagttgtgagtccacacttgaagttttgtggggtggagacatacgagagtaaactcatcctcgagcttgccttcgcacagatcaacctcatcacaatcttccaattcaatctcatcagtaatattcactttggtcaactccagagtcttgcaatccaacacaatgatgatgctgaagttagtgaggagaaataattttccaaaagcatgaactcctaatggtatgaccagctcggcctgttcatcaggtcctgggaatgaaatagtgtcggacgcacgaccaacccagatgccatcaaccaaatgaaacagataagctatcatgcacttgcatttgtagcctaaagccagtcggtagtactctctcccattaccaccatcctcaggaagaaattcatggaggttgtaggtgaaagaacgatctagccacactttcagaggggtctgtgggtagacagaaatatcagcaggcggaagaagaggactatgcaccgcaagtttcccatagatttcgacaagcacacgcccatttctggaatcccacatgctcaagggcacatcgctccacgcatcgaagtgtcggctggcgcggccgaggagaacacctagctcaggaggatggccttgcagggctacgaagcgagggcaagagagtaccgaggaatcgatgtagaaccccagcgtcggaggggggtggaggctgcggaagcggcggaggaagaccaggtcggaggcgttgcggagccaggacttgcagacgagggaggcgcggactaggcagtggggcaacgcgacgcggacgaggatctcgcggaggaggtcgtcgttgtcgaagacgctggaggtcgccgtagccgtagccgtagccgccatggccgtcaccgttgctgatagggataaccgcgccatcccctccgatgcagcaccatcacccagctccccgacggccattttctcttgaggggaggggaggagagggagtggaggttgacgagggagagacggggaggaggacgacgacgacgaggagtaggaggagaaaggggaaatttcgataccccgccgccgccgccgcgccgcttgatcaaccaggggaaattttcgtttctccgtgcacagtgacttctggaaacttcgggaatcccgcggagacttctggaagcagcaaatagattctggcctcctgtgtcacttggaaaatttacacgcaggaactaggaagtactagtaggagactactagtcattcccaatgaaatacacaaataaaataacaggatcgctaaccatcattcggcagacaatccacctttttaactcttgagaatttcggacaatccgaatgagaaaacatagaaatagaaaaaaaacatgattttgataggaatataagtgtaaaacagatgattgcaatacacaggaaaaacacatgaatggtcgtttgattggactgcaggaaaaatacaggaattagagaagagataaagactcaaaggaaagtttccaagaggttttacctcatgttagaattcctccaaaacttgcatggcattaggcaatccataggaatttcataggattccataagatccattcctttgattcaaagagctatataggaaaaattcctataggaatgaaatcctctaaaattcctatgaatttcctttgaatcaaatggggccttatcattcgtgttccccttttccttcagctctagtgatctactcgtcttctccaacacttgcgacaccttaaattttggtagagacctacgaattagggtctcgagttagggtcagggtgggtagggggaggtggagtttgttagttttaatgggatggcagaaacagcctagtggtgggtggtgggtcaggcatgcagcgaggtgatggcagcgccaccaaagccatttggtcaaaagcgggcgttgggccagtgagcagtacggaaaaagtaaaaggaccaataaggaggcgaaggccggtggtggtggatccgatagcaccgaagatagggaataaggcgatacgggggtagctcgctgccactggcttgacgaaaagaagaggggagggatggggcatgacgaaaagaagaggggagggatggggcaggggggaggaagcccgttgaccggggagggggctgggggctcaccagagccgttgttgccctccggccaagcggtagcgcggtggggtggtagagacgggggatcgggtgagcgacgacgcactgatggtgtgcaaggggaatggaaggaggagaggagttagggttaagggggtgctacacgaatcctaaaacaaatcgaatggtccaggaaacacaagatatatggtgggattttctacacatgttgatgttgacacaaaatctggtgcaacaaaatgaaggcctaggagatctgcgcggtttctgaaacgctgagcagtactcaagggattgcaactattgaaggaagttgtggccgatgcaattgagattattggtgtccccagccccctttgaaacctcgaccccatcagcctgtgcccctgaccgagccaaagtggtgtccctagccccctttgaaaactcgaccccatcggcctgtgcccctgaccaagccaaagtggtgcagccagaccacgtatttttttcgcccaagcgcacactaacatggcatcgctacagtaaaaaaccatgaggtggcgtgctaatgtggtcctcttttcctccctctctcaagcatatatgtatgacatgtgggtccagaatgtcaggaacgaggtatctcgacggaattgcggctatgtgataatttccagcgttaatgttgcagttttctgaaatgtggtgtaaaggttgcagcaaagtgatagtttagtcaataaaagtgtagttttctaaaatttactctaataataagtagaaataatacgtaagatagctagagaatataagcttatataagttgatgtggtttacgataattattaaatagtatatagaatgatgattcaaatgtaaaagtaagctaatgtggctttatgagaaaaaaaagagagagataatttggataatagattaatcatctaaagacaattatgtgcaatatgttcagcaaaacacaattatgtcccagcgagttcaatattatcctacaaatataataaattatacataaaatcaatttaactgatactcaacacatcgtataaaatgaacaccatatataagagtgctttcccaatttcaattgcacgcacgtttgaatgagtcagtttgcggtacttattaatacaactcaaagctttcacttcagtttaacacttcattccagacacaaacgaagtgttttatttaattgttagctgcaattcacagtaacaatgcatcactgcagtaatttacaaccaccatgttagtttatccccatgacatacgaccagcgctgttaccagctcctcctcccttttttccacttgtcatcttaaccagcagttgttggtgcaaatgtcgccctgaaggatcatcctgcatttgcaataagaaaaaaaaaaactctagtcagaagttgattgcaatttaccagtctattctaatatttgctccagtgtggtgataatgaattattagcgacaaaataataactatggtgcatatctcaccctaagacagctgttgaatgtgccatctttcagctgaggaggaaggcaagtctgcagtgcagcgaaacccctgaattgaagagggaaggaaatggacaaacgacattagtgcttctgaaggagaaatatgaaaacataattcggtgacatttaagcgatagaataaacctaggattctctgacatcctgaggtaacaacggataacgtgtttcagcaacctcttggaaggctgatcaaccattgaggtaaccacggttgctaaagcagctcccacagcatagaaccgatcagcattggcacaaacataagctagaccggcgtcatctacgacaattttttcagtgataaaagttgccacctgcatgcatatttgactgaatcagtttacgagagcaatgggtttaaaaattagcagactaagggaccattttcagaacatcaagtatagtttatggtacctatatttggttttaggtctattttttggggggaaataaccgataattggtgatgacaacctagcgtggccgttggttatatgtgctaatttatggtttgtttggttatatataatccagaaaaagcgagccacttaatttaatgtaaagagtattcatatatattaaaattatatagatacaaatatggtatactgagtgagagtagtgtacttcacatattacatgatcaaaaaatagctaagagtactcaaaagtcagtagatggccactagtttgaagcattcaatcaatgaattgatgcaaaactgcatgatcgaccaggcctaaagcacattttgaattgactagtaaaatgcccaagctttgctatgggcagaagaaaaaaaaatcataatatgtcataccaatatatatatatatatatatatatatatatatatatatatatatatatatatatatatatatatatatatattttatcaaataccttactattacttctttacttatttacttatgttattcacttgtttggaccaaacgttggactattccataataatacaaaatatcatacggtaatttataaaaactacaaaagcaatagcaaggttagagatgcaagtgggcagtcccgctacccacataaaaacccatttgctagttcatttcccacatggtagtacaaaattttagaagaaaaaaataaactagaagtgacttaagcgggctaaaaaaacccgcttgcccgccccgcttgcattcctaagtggggtgacagattcactgccaccaccactagaggcttttaaaggagtataggtgactctaggtgaaaaaaaattaaacgtgttccttccattttttttgacgggaaagaatactgaagaactaaaggtggtactccctccgtttcacaatg

SEQ ID NO: 91341 - DNA, 1890 bp, Oryza sativa
tttaatagttcggggagtcatcttatctggttttctggttaaggttttctggttaagggttacagattagattcagcctactttttaagggagtcaaagtggactttttcagctccaaaaccatcaaaaggtaacagtttcttcattccaggccatacagagcacggcccacaagtactgtacatttttctttcagtaaattgttacatggtagatggcaggtagatggattaacaaatcatccaaaaaaatatatagctccggcctagttgattgcatgaaaaaattggcgttgagataccatggccttaattacttggatttaaacttgagtacctagaatcgtttacatagaatgaggtaacctcccaggtactcgtgttcaagggtacagttggcattttccagttccagcacatactgtacattcctcaacattacctgcaacgtgtctcaggcagtacttgatgcgatcattcataacatcctgaaaaacatgtttgcatgcgattagtaaatatgataaaaaaaagaaaacaaatcctgctcagtttgctagacattagctaatagctattgaaaccaaagttagcttgcttgaaatcataagttacatttatgattatgcaagaatttcctgtaaatttcttaaatagaatctttcatctgaacaccccctaatatttatgaaaagaaggcgataaggtaattttggactcattttcatacgatagcatcctcttcaacaccatctaaaagtgatgacaattgagaggataatcaaatggatagcactgagacacctgtactgaatctatttattgaggcaaaatcacactactttctctttatattcagtgaatatagagttttctattaatcgatacagactgcacaacgctttttcaaacagtgtaaggagcacaatcaatcaattgtcagaaaagtagtaaacattatttttagacagcttctataaagagtgcacaatgtaacagtgacacaaataatctagaagaatttatagggaaatcaatgagcacataccaccataagctcatgcaatccaagaggggcagtgacaacataagttatgtttgagtgctccttagatgcttccgcagctaaagcagggatatcctgggtgaaaaatatagtgccaacttgaatgaaatttttcatcttaattgtggagaataatacataaggcaaatacccatctacctaggaaatcattgcaataaatagaaataacctgatgaacttaacacccttaggattgagtactaacaatcttaaataattcaaaggcatacttgtttccagtgtcgtccaggtgaaagaaaatatggactgacaataacacgggacgctccttgttgcacacattttccaaatgcatctttaatagtaggctcagctagctcctgcacacattcatctactataagagtgtaatggaaggtaaagtgacaaaatacacagaccatagagataagaaaatatatttaataataattcattgccccagaagaactagccatacagattaacattacaaaaaagaaggcaattggaagttgaggagtagatagagacacatttgacaatatatacctttcatgaaacaaattaaaaaagcgctcaagttacacttacacctaattatgtgtagtgactatagcacccttgtccatgcaacactgaaagataatgtgcattccattttataatattaacatgctatgcgggggagacaggaccagtgtcgtgcaagtatccatacagattgcttttagaggttagagataagtttagaaacaaattttggttgtcggctctgttcagtcgagctatataaagtcagggtgtcagattggtttcctttaa

SEQ ID NO: 91342 - DNA, 514 bp, Oryza sativa
gtggccattatggtgcattccgcacccatgccaagatttgacaatgtggttttttctagccaacaatgtacgaagattcaaaagaatttgtcagaagatgcccaaactgctagaggcaaggaggaatcactgcttgcgatgcaatgcccctcacatacaacctgcaagttgagatattcgatgtttggggtattgacttcatgggacctttccctaagtcccgtgtcacgccctgataaatccatcccaaattaaaaatcattctctaaaagaaataatataattaattaaaattcaaagttaaattggcaaacattaaaatgcgtacaagaaaaaaaatcgaatgtggcttggagtatttcttaaatcctccatgctctaaattggtgcctcaatttttactcgaattttcagagcacaggaaacaattttaaagcaacaacaaccaatttcagcgttaattaaaaatgagaaaactaaaaataattctctcttctctttgggccattttcag

SEQ ID NO: 91343 - DNA, 2246 bp, Oryza sativa
ggaaagcattatccgcctattctttgtgtctgtggtagattgctccgtggaggatctgtcgatctgtcatattcagttcaagaacgttgggaatgatatgctctcaatatcctccatatggtctattgacaagaggttccaaactgtaaacctgattacttgagcttatcttggaatctctagaagattatgtggaatgatccacatttccaaatatgcacgagcagttttgcaggttctaaaatttactaattgtttctccaagatggatctgttgaaaaggaggatggaatttgaagatggcctattcttaggtgccagagaataccctgctaatattttatcttatgcttgattgatctatgccatatttcctgaagctatgttgtcatggctatggccgtaaggccgtgtatcaaaaccagccaaaataatagtttggctccatctcggggtgactgccttgcatgttacagtggttatcatccacaatgttacaatggagccgattgtgccatccaaacatgtctgaaatttcagtacatgttttcatgtgtcatgtacaactatgaacagtgataaaagatttatcttagctctatacagaactacaaagaaaatatgtagtaatgtttctctcttccttctgagtcccagtatttcggttgtctgatggatttagaaatcgatatttagacatgcactgcacccatagtttccaagaagcacaaacatgaagaagctagtaccaccaatcggatgggttcatttacaatctcaatcaactaatttgtctgaaccacaaatcttgctctgattatcatgttctatgaaagtttaacatcaataatctacatacacagtgaacaaatgtctgcgacggacatacatcactgaacaatctatactatagtcaactacatgaacatgttttaacacaaacaaattgcatgttcagagactcggtgtaaaagaaaaatggaacctatcaggctaacacactactaaaaaaacagagttagacaacaggggccagctagctgaatgcatgtcgatcatctcccacttgagaagctacttagttggcttatgctcgccatggacgataacgacttagagatggcatatgaatcaagacctcggctttgcgccatggataacatgctgaagctcgtgtgagacgggacgagctcagggaatggtaactgaccatcgaggtactgcatgacttgtcgcatgctcggccttaaatcgggcaatggatgcgagcacaaaagccctagcttcaacactaaactcgcctcatcagtgttatactcaccttcaagtcttggatctaccatatccatgggtagtgtctccctgtccaaatgcgcagatatgagatcaaccaacatgtgtatgcctccttcagtgtctcgctccacaggtttccgtccagtggtaacttcaagaaggaatacaccaaacgcgaacacgtcggttagaggggatgcctttccggttcgagttatctcaggagctagataacctaaggtacccgcaataattgttgtttgcatatcgctgccatggttatacagcttagcgagaccaaagtcacctaacctagcattcatctcgctatcaagtagcacattgcttgctttgatgtctctatggactacaacttgctcccattcctcatgaagatagtataaaccagacgcaatgcccttgataattagaaacctctgagcccaactgaggacgggcatgttgttgtgaccatataaatatttgtcgagactcccatttggcatgtagtcgtaaaccaaaagtaattcatttttaagtcggcagtagccaagcaactgcacaatattccggtgccggaggcgaccaatactgacaacctcggcaacgaactctttcattccctgtctcgattcatgtgacaccctcttcaccgcgacctccaaacgagattttggtaatactcccttgtacaccctcccaaaccctccaacaccgagcaagttcttgttcttgaacctttccgtggctcgacgcaaatccttgtaggggatccgatgcggcccaaactcaacctcccaatcctcacgcaattcaccgtggttgtaccgtttccgcacaagtataacacaggaaaccataaacagcaggagaaccacagagagtatgggtagagctatcaccattgtcttggactgatcagaccgggtcctccttttgggcatcttggg

SEQ ID NO: 91344 - DNA, 1003 bp, Oryza sativa
taatgagaagcatagattcagtaggatgtttgttgctttgaagccttgtatagatggatttttgaatgggtgcaggccatatctaggcattgattcaactgtgttaataggcaagtgaagatgacagttggcttcagctattggtatagatggccacaattggatgttcccaatggcctatgctgtttttgaatctgaaacaaagtaaaactggaaatgattcatggtttgtctaaataaggcaattggatctcccaaggcctagtactgtctactaatgcaggcaagggcatagatgctgcagtgacaagggtgttcaacaatggagtagagcatagagagtgcatgaggcatttgtacaataattttcagaaaaggttccatggagaagtatttgaaagaaatctatggccagcttcaagagcatataggaaagatgtttttgacaggcatttcaatatcatgaaggaggcttccccaagatcaatgcaatggattgaagagaatcaccagcatttgtgggcaaggtctaccttctccacatctaagtgtgactatgtcacaaacaacattgcagagacatttaacagttggattaggctagagaagtcactacctgtagttgagctacttgacaaaattaggcagatgatcatggagaggatgtgtacaaggcacaaactatctctcaagctgcaaggcaatatcctgggaaatgtaatgaagcaactccatgacaaaagtaggaatctcaactacaatcgccacaagagtctgccatttgtaggtgaagtcagtggtgcaaacatggacttgacaacatggagacacacagtggacttgaccaaacaggaatgtagctgcaaggaatggcagctaacaggcctcccatgtagacatgacatctctttcattagatccctgagagaagtggatctagaaaactatgtcagcccctactattcagtggccatgttcaggattgcctactccacaattgtgc

SEQ ID NO: 91345 - DNA, 1318 bp, Oryza sativa
gcgtgctgccggcttctttggggggaaggcgggcgacgatgtcgccaaggatggcgtccgggaggttgctgatgtggtcggcgctttcttcgtcctcctccgccgccgccggatgctcctccgcttctccgatctcaggtggtcccgacctcctcctcctcttcgcactccgacccgacgcccccatttcgtcgagcacttgtgtttcactgcttcttcttcgctcctgttggcgcctgtggttctgtccttcgccggaggactcggcggcggcgggcggcgggcggcggcggattgcccgctccctggccgtgtgaccggtctcaacttcctgtcatggcccgtggccggcggcgtgcgatgccgaggtgaagcaggcgacgcgcgggagatgcgaattgacggcgcgagaattagggatttcgggagaaggaggagacttgaggaggggaggaggaagaatctgagaaatgatctaacagagcccagcgtcatgggcccaccaggcccagtaactgcttcatctgccgtcattgttgtcaaccgatgggaatgatgatataaaatggcccgtgctttatggtgggatatatctttgatattagagaaacgatgaaatgatttatagattaaagtattatgaaaataatttaagaatggtgatttagaaaaacggcatcattgctatggcatgaaaagagtttctggtccggatatacaaattatgcagacaaaaggccatgtcgagtgttcgtcgtgaaaaaactttgaatccaggaaacttgcagtttaaatacagtaatctagttttagaatgaaataaattgtagtatacttgcatgttgagtttttgtgtgtttaatgggttgatgtggcatgtttacatgtaggttttaggagcgctaataaatactatgcttgcatattaagttttaggtgttttatgggcattagttttatagaaggaagatatacgccccgttcttttaagatacatattttgttttatattagttttggttaacacgtcctttaaactattgtaaacggtgtattttataaaagtaattgtttatataaaagtcattctaaaatatcagataaatctattttcagtttaaaataattaaattatttccctcattttagtattttacgtgtccagatgtgatttttatggtataaacacggtattcctctggtactccctccgtcccataatataagttattttggacccaaaataacttatattatgggacggagaaagtaataatgaatttgggatggagtgtcacctaaagtttttatattacaa

SEQ ID NO: 91346 - DNA, 1828 bp, Oryza sativa
cgtgcaacatgcgcaaataaccttacgatgctaataatcgctcatttggctatatattcattggcaggggtcggagatgtagaccatttcattatataaacaacatgttaataatcgctcatatttttcttaccctaataatcaacgagtttagcagtggaatatgcacacgaagagccgcgcgcgcggtcaccgttaaataaatgcaaatgcatgaagtagagattaataagttctgaagctgacacaggattgaacatgaacagaccttgtgggaatggttggagcaggaggcgatggcactactgccagtggagcagttgctgttgacgtcgtcgtcgcgcagaggaagtaggcagcagcggaactagtcgctgcggcaggcggcgcaggggagctacagatcccaaccatgtcgtcacatgccggcatcatcggtagcaccaccccaccaccaccaccaccaccatttcctcctcctccagctgccgcctccatggccacctccattcctgcctgctgctgcagctgcgcctctcctgcaaatgcgcgcgcaatggtcaatttaagccgccgcgtgcagtgcattcttagttgatgtagaggcgagatgcacttgatagtttagtgcaaatgaatgtatgcaggtttaatttctaacatgcgcacattttttttaaaaaatatatttggaggaacgtctctccctcaaaatctctttttttcttttttaggcagaggctggaagtcgtttcagtacattagaataaatcaccggggtcactgcatatatgtttagcttagttacagctggtatgtatatatacttctcaatcaatggatgatatgctttttttctaatggaaataaattgagctacatgaatacctgaggcaatgtgggatgatctgtctgtgctcttcactgtcctatacatctgcataccagtagatgagtgagtgatcaatgaggtgcatgtcttgtgttgcatgatccaaatggcttgtataattaattacatatgctaaggtggtaactagtttaaaggatatatatctggcttgtcctggttaggctagatgccgtttgtttgtcacttagtacttgacccagggattcaccagagacaaagtacacatgtagttaccaatagtaagaacacccataaaagtggtggaaaaaacaaaaagaagccatcatgcaacaagattcaccatcttctttcccttgcatggtggtagcaatagtagcttcccttttatcacctctccactctttctttctttctttcttttttctcttttttctcttctttttccaagtgatacacgtacctggaggtgactcttgacatgcgccagtgtcagatccttcacgttcatcagctccagcaccgacttcggcgtcgctcctgcagatcgatcgatcatcgccaagaacgagctcgtgagaattgagcacgcaaaacaatggagtaatcaatcgatcaatctcactatctcaggcaaaaggaaaagaaaatgtagctgcacgaattcagatcacattacgagaggacacagtgatggtgagataaggtagagctagctaggcgcttactctcgtggccgccgaggagctcgacggcgtgcacgaagcgggcgtggagcgcggtggtccatcgcatccgcggcgcgcggacgctccgcttcgagcccgccggcagctgggacgccctggccgccgcgcgcttgaacggcgcgcacccctgcggctgcaggtggtggtcgccatggcggccgccgccggcgtccgcgtgcgccggcgtcgtcggcccgagccccaggct

SEQ ID NO: 91347 - DNA, 2084 bp, Oryza sativa
catcattcagagaagtttaatgcaacaatatcctaacagcctaacaaccagatatatgttacagatgggatgacagtagcaagaacagcttcgatatgttacaaatgcatataactatgcaagaatagcctaacagccagataatcagcataagctgctccaaaacaacaaattaaaatggggtcactctgactgagaaggcaaagataagtttacctcaaattagtattcattagctagcctttcaaccatccttgatagtcatccatatgcatgtcagtagttaaatattatctgaaagaaacggaaatagatcaactggcagaggaagctcgccatttgtagaaagaactagcgtctaatttgttcagctagcatagaaattgggggatttgtagagtatccaagaacacacccaaaaaaaacttctggtaagaggtctaacaaggaaaataaaaatagatttagtgatgcatcaacttaaatagaacaagaaaacaaagtgaaacagcatgcatgcccactatccaaacaaaatactagtacacaaagagcatctaactaatgatccaatagctcatgatttttgatggggttaaagctagatgcatccttggacaaggatttagccacaggaaccacaggagacgccggaatcggttgactgcaagctcagatctggatgcaagagaaggaaagggtgacttctgcttagcactaaactgagtaaaatagatgaggcggcagtgactaccgagaatggggtggaaggggacagccgacgcctgctctccccacgacatgttgacctcgacgacgtggggtggtgtggacggcggaccgcttacctcacgaacggatctggcgtcgctgaagctaggactgcaggatctggagcacccaaactcgggatggttggatccgcgacctctgagttcagggtgtccggatctggagcccccgagttcatggttgctgggaccgtcagggggagggtgggggatgtagaagctcgtcgtcgaccggagataagcggcgatggacggaggggcttgtcgatggcgttgggcagcggtgtggtgccccgttcgccgatggtcctgacaccggcgttgtcttcgtctttggctcgatacgacccggatctggcgtggtggaggcgggaaggaggcggcgacccggatctagagtggtggaggcatggcggcgaccgtgggcagtgggtgaaggaggcggcgaccgtgggcggtgggcgaaggaggcagcgacccgtaggcggtgggcgaaggagccgatgacggggcggcggagagacggcggcggcgacaatggggcggagggcgaaggaggcggcgacctttggaggtgggcgaaggaggccggcggtcggtgggaggaagagaagagagactgagaggaggaggagagagactgagcaggtggcggtgggccccatgggtggtgggtgggggttccttttttatatgtcaaaattgatcacctttgacgggcgcaaacttaaaatcagtgacgagccagaagtcatatccgtcacaggtgacggcccatcacccgtgacgggttgtaactccctggcccgtcacaaatgaggtcataccaatgatgggttagaagtcaaactcgtcactatcttacctgtgacggcttaaaattccggtccgtcacaggtaaggtgatacctgtgacgggccatggccagatggctcaccgatgacggtaaacctaacgacccgtcaaaggtgacggtcatctgtgaccaatttataaacccatcactggtgtgccatcacagatgtagggttctggcgttgtggttcttttacaataggattaatctctggaaaaaggcataatatataagtacatagaatgatctttttttagtaatgcatatatgcagtattaaaaaacaatatagcattggtaccttatactggaaatcctagatcaattatcaatatggcaaagtacatcttaagagaaattgtttatgttttaatttcagtgactggcccatcaaattatttaccgcggcctctatatccaatcgaatagagcaattc

SEQ ID NO: 91348 - DNA, 653 bp, Oryza sativa
actcacccatcatgctcatctaaattccctgcgcatattctcagcaaaatctacaaccaaagcgtgagtcgaacaacaaaagatgatatcatccatataaatcttaacgaaaagttgattatcaccatgcttaagaacaaaaagcgttttgtcgacctttcccattgtaaaacctttcgcaagcaaaaagttcttaagcctatcataccatgccctaggagcttgtttcaaaccatataaagctttagacaatttaaaaacatggttgggaaaatcaggattttcaaaacctggtgattgtttgacataaacttcctcttgtataaaaccatttagaaaagccaacaaaagtttaattgcctcaattctagcaacatgagcaaaagtttcatcaaaatccaaaccctccacttgggtaaaactttgagcaacaagtctagctttattcctcacaatcaaaccatcctcattttgtttatttttgaaaacccacttggttccaataatattatgtccaaaaggtggttcaactaaagtccaaactttgtttctctcaaaattttcaagttcttcatgcatggcgttaatccacgattcatcagttaatgcatgtgacacatctttgggttcaaaagaagcaacagacgcagaat

SEQ ID NO: 91349 - DNA, 1088 bp, Oryza sativa
ctcaaacttatccaaatttccagatttcaagacaaagcacttgcaaccaaaaacacgcaaatgtgaaactttgggttgatgtccaaatcgaagttcataagaagtttttccaagtttagacctcaagaaaacccgatttaaaatataacaagctgtgttaattgcctcagtccaaaattttctaggagttttatattcatccaacatcgttctagccatctcaacaaaaacacaatttttcctttcaacaacaccgttttgttgtggaacacgaggagaagaaaattcatgttcaagacctctttcattgcaaaattgttcaaatgaagcatttttaaactcaccaccattatcacttcgaattcttttcaaagaaccaggaaattcaagctccaattgaagaaacaaaccacgaaagtgtttaaaagcttcgtccttagttgccataaagaaaacccaagaatatcgagaaaaatcgtcaacaataaccaacacataccactttgctccaatagattgcactttagctggaccaacagtgtccatatgtaatagctgtcccggtgcatccgtcatcacagaaacaataggagcatgtgaagtagaaaccatcttagcatgacgacacggtgtacaaaccaaatcaagatctttgttaagtttaggcaaaccacggacaagatccaaaccacttaacctagagagatgatcaaaaccaacatgtccaagtctacgatgccaaaacatcacatctttatcaaacttagcaaccaaacatgttatcataggtgaaacaggattttcaaaatcagctttaaacacttttccatagcgagaaatattcaacacagaatcaccacaagaatcaaaaactttacttctagttttcttaaagtgaacctcaaaattttcatcaacaatttgtgaaactgaaagcaaattgtactttaagtcctcaaccaaagctacattcttcaattcaaaattttcatttaccttaaccaaacctgtagcgagaacggcacttgtagcagcatcaccaaagataatcgattcagtcttagatgccttctttagggaggagaacc

SEQ ID NO: 91350 - DNA, 1971 bp, Oryza sativa
cggcggtggaaacccccacctagatccgcgccgttttggccggatctagcggggctgacgccgggcgacgacgggcggcggggaagcgggcgtgctggcggcggggaataggcggtggtggcgacggttgcgggggcggcgcagctgggcgaggtcgcgggcgcgtgtgagcgtcaccaggcggcggttgaggctttttgcccggaagccggcgaggatggcgacgcagggcaagctcgtggcagtggcggagcaagctcatggcggtggcggcaccgcggagctcgcatcgacgtcgtcagcggcaacggcgcgggagcacggggcgacggcgacggtggcaacggcgcggatttcatggcgacggtggcgtcagcggcttgtcgacggcgacagcacgatggctggttgacggcattggcggctgtcggctgctgtggcattagagctctcgcggcggaggcagcggcgcggaacttgtggcgacggttgcagtagcggctggacaacggagatggggctgcggctggctggtggcgaggtggccgtcggcagcagcggccgtggtggtggtgggaggtggcatggtggcctcggtcagctagccgaggacgtggcagacggctgcatctggccggcgcgggagagtacggaggaggggtcggagaccggcttggcgcagagaggcgcagccgatggcagcggaggccggctcggcacgagaggcgcgggcggcagagatggaggccagcttggcgcgagaggcgcgtccggtggaggaggccggtttggtgcgaggcgcagccggtggaggagccggtttggcgcgagaggcgcggtcggcggaggaggaggcgaccctggtgcgaggaggagatgccggtgggcgtggcacgaaggatggccagcgggggcgccagtgcgggggtcccacatgtcggcagaggttgtgtggtggtggagcatcgatgcgtcagccgtagattcgcaggtggtgtgcggcgggtgtaaacccagtccggccttagccgggccaacaacgatggttaattccccctcctgagggcgttgtcgtgttgtctcacccctcaagggcagttgccgggcgaaagcccagtcctggctcctttgagcccggacggacggcggcggcggtttttccatcgcttctcttcttgaagacgtcattttggcacccctagctgtagggcgatctcgtctgtgttcctttgttagtctagcgacggcaggtcacgcttagcggcggccggtccggtgctagcctccccctggtcgtgtgtgttggcgctgtcggtgtgtgggggtggtgtatttttctttttttctagttatgatcctccagggttataatcttgtaattttttcctgctctgtcaatagaacttcgcaccgtctcgtgcgagtcgttcaaaaagtagaaaaaaagctgcttgtcaaactgtactactgcttgtgtgatcgagcaggatggaaccgcatggttcgcgagcctaccacttcgtgcgaggggagttgttctcgcggaccgcgcaacgctgactggccgcacccacggcgcacacgcggtctctttggaatcagcagacgatgcatcgaatcgtatgcgaagcggtgtgaaactgcacgcgcgcgcggcgtcagcgtgaaacgggagtgcgacacttggggtctattcgtgatactacactttgaaaaacagagcatttgactctgttgcacccaggtcttcttttctctttgcctgaaacagaagtcgtcggtcaataagacaacactacctacgaaaagttgcttagcaactcaaagaaccaccacatctattactgcgtgcgtcgccgaccagttcgccttgatcaagctgggagcttccaaatcaagtgagatcacattcacatcacggaggaggcgtgacaaaaaaatgtgtcggaaaggaggcgcacccgcacacaa

SEQ ID NO: 91351 - DNA, 1709 bp, Oryza sativa
gtagtagctaggtgtagttcatcggatcaagggggggatggccacggcggcggcttgcatctcgttcgcgtcgccgtcgccggcgcgcgtcgtgatcaggcggcagacgcgggcgtcggcgtcggcgtcggcgacggaccggcaggaggtggtgtcgccgaagcggcggctgccgctgcggaaggtgccgggggactacggcccgccggtggtgggcgcgatccgggacaggtacgagtacttctacggcccgggcggccgcgacggcttcttcgcggcgcgcgtccgcgcgcaccgctccacggtggtgcgcctcaacatgccgcccgggccgttcgtggcgcgcgacccgcgggtggtggcgctgctcgacgccgcctccttccccgtcctgttcgacacgtcgctcgtcgacaagaccgacctcttcaccggcaccttcatgccgtccaccgacctcaccggcgggtaccgcgtcctctcctaccttgacccctccgagcccaaccacgcgccgctcaagaccctcctcttctacctcctctcccaccggcggcagcaggtgatccccaagttccgcgaggtgtacggcgacctgttcggcctcatggagaacgacctcgcccgcgtcggcaaggccgacttcggcgtccacaacgacgccgccgcgttcggcttcctctgccaggggctcctcggccgcgacccggccaagtcggcgctggggcgcgacgggcccaagctgatcaccaagtgggtgctgttccagctcagcccgctgttcagcctcggcctccccaccctcgtcgaggacacgctcctccactcgctccgcctcccgccggcgctggtgaagaaggactacgaccgcctcgccgacttcttccgggacgcggccaaggccgtcgtcgacgagggggagcgcctcggcattgcacgggaggaggccgtgcacaacatcctcttcgcgctctgcttcaactcgttcggcgggatgaagatcctgttcccgacgctggtgaagtggctgggccgcgccggggcgcgtgtgcacgggcggctcgccaccgaggtgcgcggcgccgtgcgggacaacggcggggaggtgacgatgaaggcgctggcggagatgccgctggtgaagtcggcggtgtacgaggcgctgcggatcgagccgccggtggcgatgcagtacgggagggcgaagcgggacatggtggtggagagccacgactacgggtacgaggtgagggaaggggagatgctgttcgggtaccagcccatggcgaccaaggacccgcgggtgttcgcgcggccggaggagtacgtgccggacaggttcctcggcgaggacggcgcgcggctgctccgccacgtcgtgtggtccaacgggcccgagacggcggcgcccaccctgcacgacaagcagtgcgccggcaaggacttcgtcgtgctcgtcgcgcgcctcctcctcgtcgagctcttcctccgatacgactccttcgacgtcgaggtcggcacctccacgctcggctcatctgtcaccgtcacctcgctcaagaaggccaccttctgaccaccgccggtcaaagtctccggcgcccggtcatcttattttccgtcctcttcttcttcactaaatattttagtagtattagtaattttttcactctgtatggtgtgatcaatcagcttgtacggatacggag

SEQ ID NO: 91352 - DNA, 2937 bp, Oryza sativa
atgaattttgtgagcaggaaggagagagtactgcagcaggagtgataagcttagcagagtatctaggcactaatgtagctgaccacattcctgaaactcccaacaacctatcggaggagatggtgagatgcatggcaggggtgtactgcaaacttgcagatccccctttggttcaccacggctcgtcgtcttcgccaacgtcatcgttctcctcgacgagtgcgatatccccgcagtatctgggggatatctggagtcccaattacaagagagaatctactctggactctcgtttgataaaccctttccatgttgaggggttgaaggagttcagtggaccatacaatacaatggttgaggttccactgatttgccgcgatagtcggaggctaaaagaagttgaggatctgctccagacttacaagtgagctgttctttcttgtctctgtttggtgaatgcagatatttttcttatatgttcaatgtcctaatacgatatactgaattgtatacttcaggttgattttgtaccggttggaaaccgtcgatctcaggagaatgacgaacgaagaaaagattgcattctgggtcaacatacacaacgcccagctgatgcatgtaatgcttctactgtttcagttcactacaaatttctagcattgtctcaagttgtttttttgttaatgggtataatttgtactacctccacaggcttatctaaagtatggcgtcccacagaacaatctgaagaagacatcacttcttgttaaggtaaacattttcctttgtagaatcaatggaatgcacctttcgtgtacttaattcagacgaagtttcttctttccctgacatctgttcaccacaggctgcctgcaaaattgctggacggagcatcaatgtagctgttatccagagcatggttcttggatgcaacacatactgtcctggacaggtaaagcaaacatgattattaggtcaaaactagttaaaagtgtaatattcacactgtactgattatatagcaagcatgctaattctatgtgttgttccttttaatgcagtggttacgtactttgcttcacccaaggatcaaaagcaaagtgggcaaagtagggcatgtgtggcaagcctttgccgttgcacaatcagagcctcttttacgctttgcgctttgttcaggaagccattctgatcccgcggtaagctcattgcgttttctcaaattggtgtcatcttcattgtacctcgatctattttaaactaaccaatgcttccttttatcaagccatacttgagtaattcaaccctttttagcttttaggcacaaattcggtatgaaaaagtctcacgtgtcctgaggaaatcataccctgacacattgtcaaaacatgctaatgaaatgaaaacctttcactgattggggaatattgttaggaatcattcaatcattctccatgtttggaatctctcaccaaagttactgcaggcattattacttggtggtgccaactactgccaagccagtcaatcccctttagtcacaatcatctcacaaactcctctttttctgcaggtgagagtgtacactccaaagaggctgttccatcaactggaggctgccaaggaggagttcatccgggcaacggtgggcatctggaaggagcagaaaatactgcttccaaagctcgtcgaggcgtatgcgaaagacgtcaagctctcgtcgcagggccttgtcgacatggtgcagcgctacctcccggagagcttgaggatggcaatgcagaagtgccagcagagcagatccagcaagatcatagaatgggtgcctcataacctgaatttccggtatctgctgtccagggacctggcatttcctcacctgaactgactaatcttactgctctctgctcaaataggctgtgaaatgagctgaagtatatgcattgtatcatatagatttagacgtaaggattgtgtagggttgatgtgtgagtagtgtttatctttgcctgtaaaaatttttgtagatgaacagtaaaaggggaagaaatgagaaagaagcatcctttggttatctgacaatttcggtatgttgtgtcattgtgtgccatgttaagcctctttgtgtgggccgaaatgcaggtttaatttttcggccatgttggactgacttgattacatagatgggccaggacttttgcccatccaaacaaccaaggttcagaccatttgatagctgacaaatgtttaggtaacaataatctatttgggctaagagaacaccacatcggggttttttttttttggcagtttcagagctgaagattccaaatgaacactgggctataaagaaagctactatctcaattcagagcacattggacggtgtgttagctagagattggagaatacattttgctctcttggtagattaatcgattgattattcttttattcagatgagtctgttgactcttgtgttctgaacttttgatccacatgccattcaacaatttcagtttttgaagatgcaaaaggcacaaatagaagttatgagcttaggcagtgatttggcagttggtagcacaccatttcttatactttataatagtagtagtagtatcatttatatttacatttaaatctacctacattttcttctcatgtttttggcgcctaaattaaccgcaccaagaacggacgcaggctggctaccgttgctacacatcacaacgcaagcgcaagctcaaagcatcacaaggattcccagccgtccgatcgagttgggcccacccgtctccccttggcgtgggacccactgccagtgagacagtgcactgatgcttctcgctgtctcgaggtcgttggccatggcggcgaggccggggcgctctactcggactccggaatggcggtcaggtcaggagagaacttgct

SEQ ID NO: 91353 - DNA, 4323 bp, Oryza sativa
  unsure (1)..(4323): unsure at all n locations
tttaggccgtaacatttagcaaaaaactaatcttaaggtcctgtagatactagtgcaacattccctattcatagatccgcgcccgcctttatcgagttagatacgaaattatccatctttgaaactggtattaaggtggtcgatcttttagctccttatcggcgtggaggaaaaatcggactatttgggggagctggagtaggtaaaacagtactcatcatggaattaatcaacaatattgctaaagctcacgggggcgtatccgtatttggcggagtaggggaacggactcgtgaaggaaatgatctttatatggaaatgaaggaatctggagtaattaatgaaaaaaatcttgaggaatcaaaggtagctctagtctatggccaaatgaatgaaccgccaggagctcgtatgagagttggtttgactgccctaactatggcagaatatttccgagatgttaataagcaagacgtgcttctattcatcgataatatctttcgttttgttcaagcaggatcggaggtatctgccttattagggagaatgccctctgcagtgggttatcaacctactcttagtacagaaatgggttctttgcaagaaagaattacttctactaaaaagggatctataacttcgatccaagcggtttatgtacctgcggacgatttgaccgaccctgctcctgctacaacatttgcacatttggatgctactaccgtactttccagaggattagcttccaaagggatttatcctgcagtagatcctttagattcaacctcaactatgttacaacctcggatcgttggcaacgaacattatgaaactgcgcaaagagttaagcaaactttacaacgttacaaagaacttcaggacattatcgcaattcttgggttggatgaattatcggaggaggatcgtttaactgtagcaagagcacgaaaaattgnnnnnnnnnnnnnnnnnnnnnnnnnnnnnnnnnnnnnnnnnnnnnnnnnnnnnnnaaagtatgttggtcttgcagaaactattaggggatttcaactaatcctttccggagaattagacggcctacccgaacaggctttttatttggtgggtaacatcgatgaagctagcacgaaagctataaacttagaagaggagaacaaattgaagaaatgaaattaaatctttatgtactgactcctaagcgaattatttgggattgtgaagtgaaagaaatcattttatctactaatagtggccaaattggcgtattaccaaaccacgcccccattaacacagctgtagatatgggtcccttgagaatacgcctcctcaacgatcaatggttaacggcggttctgtggagcggttttgccagaatagttaataatgagatcatcattttaggaaatgatgcggaactgggtagtgacattgatccggaagaagctcaacaggcacttgaaatagccgaagctaacgtgagtagagctgagggtacgaaagaattggttgaagcgaaggtagctctcagacgagctaggatacgagtcgaggctgttaattggattcccccatctaattgaagacaacccaacggtttagttgatacaaagaaaaagggaagaggggtagaaaaaattattagatagcgaagcgaagtagggccaatgctatctagtaatttttctacctacctacctactattggatttgaaccaatgactcccgccgtatgaaagcaatactctaaccactgagttaagtaggcaatttatcaccacaaaggaagaccctttacttcgatcgattatagatcgaatcctttttataagcaaataccgcttcgttattggtatgttattatagtaaacagatcaaaggatatcctctactattagagaatattcatcttgacaagaaattctctatatattaagatatctctgacaagggctatagctcagttcggtagagcaactcgtttacacgtgcgccaatgcttttcaagggagcttattatgcaatgaacatagtggatcttcttgcaaaatcaatgtcttacttcatggattcgagagaataggagaacagtcgcctgacaaatagttggttcagtccgattcaggtaccaatccaggtgcctaaacaaatagaacctttattgatttgctagttgataaggtaaatatccagcccactaaatgctaggcttaatgaggataagggcctccaaaaaaattcttttcgttctatgaactttaaggtgtatgaagtctcatagtcaactcttgtagcggaacgatagagactctatttcacttaggttgatttaatttaggccggaggcagacctaagtcaaggtaatcctcctttgaaacactttggtattgctcttagatagatcataatacaaataatcaatcagagcgcagggagccatctcattatctttccgtaaagaaaaactatggtggactaactgatctttctatcagttgataaaagagcccaatgcaaaaaaatgcatgttgggtctttgaaacagttcgaatcatttcgataataatccgtttgatctgttttaccgagaaggtctacggttcgaatccgtatagccctaatatgtcctttgctaattctcaaactacggaaccaactgctttcgcaccgggggaacaagatccgtttcaaggaccctaagaatttggaagatatctcgagaaaaggttttagcaccggtctctcatatatgtactccagtttatccgaagtatcccaatggtgtaagaccgtcgactatttgggaaaaaggaggaaaatcactctgatctcagatttcggagaaataagtggctcacgaggaatggagagacagattctctatttgatctcgaagtcctcatataacacttcttccagtcggatcacttgttggaaaaaaataatgctcacacatgttccacacgggcaaggaagcataatctaatgaaagccgtctgagattctttctataggaaccctgaagagaaaggaccctcaaacaaaaggttcctgaataaagaaggatgtaaggaagctgtcgtaaagtttcgttgttcgttccgtagttgaccctatctatgtttctacgatggcccaagaacacgctcattcttcagccgtagagagacttttgaattgtgaggtaccattacgagctcaatatatacgagtgttattctgtgaaataactcgaatttcaaatcattcacttgcttcaactactcatgctatggatgtgggagcatcaactccgttcctttgggcttttgaggagcgggagaaattgttggaattctatgaaagagtcccgggagccaggatgcatgccagtttcatacgacctggtggagatgaattcagaggactcaatgaagagtgctctaaaagaaacctcctcgcatctaagttttataaaactagtgggtgtcaaaatcccaaattgacagatctctatcatcatgtacatgaaacataaaaaactttaaaaaaaaactacaacccgaaaaaacaaccacctgtcaattgaaccataggcagacctcttgagctacccacagcaagtccggtggcattgtagcccacactcgcccatccctatgcttaaacaacccccaaaagacccctatgaaaatacctgtgaagatcgtgcatttcagtcacattcagatccgttttttgagtccatgatataaccaaattggatggatcttccacccgtttagctaagaaagaatagatgcagaggtggataatagatcgatatgaagatcatgagctgccccataatgaaaccaccaggagtcgcgaatatctccttcttccctaatccaagattggagaaagaagatctaagagggacccatggagaatgtggtcagaaacccataatagagtccgaccgcaacgaccgaattaattatcctcatcgagaaacttagactactaagtagaaaagatttgaaaatcatggcatgggtctcctttttttctttctttagagttttctatatgcacaatttctcgatgtttcgatgagaatttcttgactttccatatatagaaagagatagactataaatgacatctcttatgtcaataagaccaaagggatggatattaaatgataggaagtgctaggaagtgaaatagaatgaaatagagccactctgggcttacctatgaaatgaggcatggaacggagccactacgaagaaattccgggagttacgaaagaagcttcggactcatattgttcatgggttgagagcgggagttgaactcta

SEQ ID NO: 91354 - DNA, 764 bp, Oryza sativa
cgaggaccaatgtccgtctggcccgaggaaacctttgcacgcctccgttaccttttgggatttggatctttttcgtatttcaaaatagtgaaaaagtcaaataagaggtgttaagctttttatcattctggcatcgagctattttgccgcaggacctcccctacagtatcgtcaccgcagtagagtttaaccaccaaattcgggatggattggtgtggttcctctacgcctaggacaccagaatatcgaaccatgaacgaggaaaggcatgagagaaatattggctagtaattgtgaagccccaattcttgactggaagggacaccaaaggcctctgccctccctctctatctatccaagagatggaagggcagagcttttttttggttttttcatcttttcatcaaagagttgaacaatgaagatagatggcaagtgcctgatcgatttgatcaggtcgtgtaggaacaaggttcaaatcgttcgttcgttaggatgcctcagctgcatacatcactgcacttccacttgacacctatttaaacggctcgtctcgccgctaccttatcctatttccatgcttctgtcgctccatccccgtatgggtggagaacccgtcgctgtctcggctgtgctaccggaggctctagggaagtcggaggagagagcactcatcttggggtgggcttactacttatatgctttcagcagttatcctctccgcacttggcttcccagcgtttaccgtaggcacgataactggt

SEQ ID NO: 91355 - DNA, 664 bp, Oryza sativa
tcaccgccagcctgcatcagtcgccgccgactggtgtctccgcctacacagctgacctattatgccgtcgctgttgggtgtctacgacttcaccgccggcctgcctccgtcgccgccgattggtgtctccgcctacacggctggcctattatgccgccgttgttgggcgtctacgacttcaccgccggcctgcctccgtcgccgccgactggtgtctccgcctacacagctgacctattatgccgtcgctgttgggtgtctacgacttcaccgccggcctgcctccgtcgccgccgattggtgtctccgcctacacggctggcctattatgccgccgttgttgggcgtctacgacttcaccgccggcctgcctccgtcgccgccgcctggtgtcttcacctacacggctggcctattatgccgccgttgttgggcgtctacgacttcaccgccagcctgcctccgtcgccgccgactcgtgtcctacacggctggcctattatgccgccgttgttgggcgtctacgacttcaccgctggcctgcctccgtcgccgccaactggtgtctccgcctacacggctggcctattatgccgccgttgttgggcgtctacgacttcaccgccggcctgtctccgtcgccgccgactggtgtcttcgccta

SEQ ID NO: 91356 - DNA, 762 bp, Oryza sativa
caccgtgcggagcgagcacgcggcgcacgcgcgcgggcgggggagggatgcggtgcacgcgcgtggttcgcggtggaacggatgcggcgggcccacgcgcatcctcacggcttgcggtggaacgcgcgcacgggaggggctgaccggggtcggcccgatccgatctcggccgagctggcgccgacgtggcgcctacgtggctgccacgcgagctggcgggaggaagacgaaggcgccggccgcgaatggacggcgggcggcggcagtttctccggggcgccttgcgacgatgaggggcgacggggcgtacaccgggatgacgaggaagaaggagagggagcgagccaacggctcggattcgccggagggagtccgtcggcgtcaaccggcggagggcaaagggggaaacggcgacgaggtcacgaggggccaattcccggcggtgagagcatctacgcggccacgggaatccgttgctagcgtcggattgagtggagcttcgccgagcgaggccggcgacgagcgggtgctacggagctcgggcggcgacggcggcgagcacacggcgagcgacggcaacggtcggggtggcgccggctagctacggggaagctactcgtgctaccaccgaaaactaacggggggagatggagcgaggaggaagaacggagggaggcactaccgagatgaggagggcgctgtgacgagaggccgacggtgcgggagtaatctctccggcctcgggccggggaggaggaagga

SEQ ID NO: 91357 - DNA, 778 bp, Oryza sativa
cagaataagtcgcaagcaatcaagataaatattatgaaaattgtttaaaaaatatgatataacatctgtaacccccgactcactagtcaacggcgaaccagttgatgtagtgaggcaaaggaaaaggcaaaatatcatataaagaatgaaataaatgatgacttagctttatcgtattccctcgatgacagcaaaagtagccgatgtgggaacgaaacagtccatcaatggtgacaaaaacaccagttggcgccagtggaaccaagccagtggtgtagatgatgaagcccattaacggtggcgaagtccgccaaccgtataagcgaaaacaccagtcagtggcggcagaggcaagccggcggtgaagtcgtagacgcccaacaacggcggcataataggccagccgtgtaggcggagacaccagtcggcggcgacggaggcaggccggcggtgaagtcgtagacgcccaacaacggcggcataataggccagccgtgtaggcggagataccagtcggcggcgacggaggcaggcgggcggtgaagtcgtagacgcccaacaacggcggcataataggccagccgtgtaggcgaagacaccagtcggcggcgacggagacaggccggcggtgaagtcgtagacgcccaacaacggcggcataataggccagccgtgtaggcggagacaccagttggcggcgacggaggcaggccagcggtgaagtcgtagacgcccaacaacggcggcataataggccagccgtgtaggacacgagtcg

SEQ ID NO: 91358 - DNA, 8227 bp, Oryza sativa
gggagatgggccgagagaaattcggcccatcgaccccggggaggcaaaatagacttttgcggaggaatttgatttggaaggatttggattcgggattgaactcgacgatagatcggggatttgagatcttgagatggcacggacactagacaacaagcaaagaaacaatttcgcaattagggtttttaagagataattttcccgctaggcgccacgacggaacgggcgctacatagctccacaaagtaatgggctagctggcctgggtttgaagtttcaacctttctaattatttgatattaattccttctcaaatattcgtgttttttttcgtgattttaaaggctgactttgtgaaaaacatgtacttacaattgttggaggccccaaccttaaaagttgtgttgctcctttgctttacaacaaaaggacttttttttttgttgaaaaaacataagcaaatggacataaaccccaaggccatatgtaaattaattaactagctgcttaattgagtgcatgatcttttctcactacgccagattagcccatctgtgacggcctatctatgatggaccaaaatatctcgtcacagatactatcacctttgacgggttaaaataaatctcgtcatagatgaggctaaaaaaaatgacccgtcacaggtaaatactcacctgtgacgggtatatataaggacccgacacataatgattgtgacgtgtccacatataaacccgtcactgatgagtacttacctatgacgggttttaagtttacacccgtcaaagatgagtaacctcacctcatatattcaattaattttcacttataaaaaaggaaacaccaaccctcccctaccgcccaccaccccaacccacccccaccgcccaccgcccacaacccatctcttttctctcttctttctctcttctctcttcctccaccatcgcctctcccctcaaccatgcgccagctgcgtcgctgcctccttcgcccctcgccgtcctctaggagctcagggttgccggctgcgtcgcctgccgtcggcctccaggaggtcgggcccggcggccttcaacatcgatgccgccgccacctcctgaccgccggtcaccagatctggccgccggtgccttctctcgcctcccggccactgacgtcgccgcctcccgaccaccggctttaaccgccgacgccgtcgccgcctcctaaccgccggtcgccagatctggccaccgggaagccggatctggccaccggcgccttccctcgcctcccggccgccgacgccgccaagtttggcctccgagaagccggatctggcctccggcgccttccctcgcctcccggccgccgacgccaccgcggatccggccaccgacaccttcgccacctccacaacctcttccctgactgccggacgccacctcctccgccaccgatcgatgaccgccagatccggcctccacgaggtcgggggacgcggatccagcgtccgcggcctttcccctctgccaccgactgccggccgccaccgccaccgaccgccggccgccggatttgtttgtgcttgatgttgtttgtgcttgatttgctcatgtttgttgcttatgtggatgtgtagtttgttaaattggacatggatacttgtgtgatgtatattttcagattgcttcatgtgtagttgtttgttgagatgtatttgatttaaaatacaaagttgctgtatcatgtgcatcttgagatgtatttgatttttcttcatttcgtacatttgggctgaggcatttctttttttttgggtgatttttgacatctgtgacgggtgagaactaaaaccagtcacagctgtttcgtcacctttgacgggttgcaaagagtcacccgtcacaagtgtgagtcacctgtgacggctatattttttagcccgtcaaaggttttaattaccagtgacgggctttcacccgtcaaaggtgaggtgttgtcatcagtgaccactagtctctaaccagaaccaaatccgttaaaggtgagggttagagcccgtcacagatgactggatccggcctagtgtctatggttctcttgcaagtacatctctgctcctccatccagctcgtaattaaaacggagaccgatcgaggtccatcgccgattcgcgttcgtacgtcgtccatggaactgcatttacgtacccaacacgtgatcgcatccaaatcgcagtactcaaaagcagctaatacctagtcaactacaagtcaagtcaacacaacaacatgtacgtgccaataatgcatgcgcatcttattcatctcgattggccaacttgtcgcaggttttacaatttcgatttcgtccaaaattttggaaagtcccgaaattttgggatttttggcacttcttggaccaattttttttgaaattttaatagaatttaaccgaatttgattaaatttgactaaatttgctaaaaattgagaaaaaccaaatatttcggccgagataataacttaccggggcactactacatgatggattttcacgtgcggatatttcaactgtgtaagaaagtgtctgcaaaaatcgctatttttccatgcaggtggcgcagccgcacgcgaaaatcgattttcgtgtgctgattatgtcgcccgcacgcaaaaatgaaaaaccaaaaaaaaataaaatccaaaaaaacaataagctaaccctaaagctgccgccgccgccctcctcgccgtcgtcgccgtcgccatcgctggtgccgtagcttgatccacagccgccccaccgtccgctcgccgccaccggatcccccccccctcccagagctcgctgccgtcgacacgccactcccggtagcccgctgccgcgagctcgccgccgtgcgcacgctgttcccggtcggcgagcccgccaccggaggagaaggagaaggaggcggcaccggaggaggaggggaaggagatgtgcggtgccatagaaggagaaggtgagagagagagagagagaaagagggaaaagtgaggagaagataagggggagagaggagagagaagggggcggggggtgagagaaggaaatttaaaattttttttgaataggatgagttggaacgagtattttcctttgcgggtagattatgaggcccgcgcgcgaaaatagacatatttttgtatgcgggcctattaagtgatccgcacacgaaaattgattttcctatacgggcgatggcccggctccggtccccctatttttccttgcgatttcacttacgacccgcttgaaaactaaacggtccagcgtccatgaaaatatttgctgtagtagtgggggtccgaaatttccgaaattgcaatccctgagttgtcgtcgtatcagtcacggtacatatactatgcgttgggactatttgataattaaaccgataacgagaaaaatcattagcacattaattaattaagttttaattattataaacttgataattgtatttaatattttaaagaaacttatatataaatttctttacgggagacatcgtttaatagtttgtaaagtattctaacgaaaataaagataaaaatatgaatcttactcagaaaatggaagggcccggtctcacattaaatactgcactcaattgcttccagccattcacgcattcgatcgcatcatgcatccggcagccaagttaccgctgctcttcctcctcctggtcggggcaaccgccacgacgtccacggcaaaccatgcgccggctccagccgccggcagctgcgtgccgcgggagagggaggccctgctggccttcaagcgaggcatcaccggcgatcccgcaggtcgcctcgcctcgtggaagcgaggtaaccatgactgctgccggtggagaggcgttaggtgcagcgacaacctcatcggtcatgtcttcggccttcaccttcaaaataacttctcgtggtacaacgaagcaacagctttggtggggcacataagtacttctctgctcgctctcgaacagctagagcaccttgacctcagcaacaacaatctcgtgggtccagccggccgattcccagggttcgtcagctatctcaggaacctggtatatcttaacttctccggaatgccattaaaagggaaggtgcctgtcgaaacatgaattccgcaataataaaaggggtagcgcacgagacctaaaagtggatggatgcagagacaaaggatttagacaggtggccctctcaatgagaggtaataccctactcctatttggggatttgaatccgccaggtgaattatagatctgacgatctaattgtctcatgccccctagagggcctcctgcccaccttatataggatggggggcaggattacaagataaaaaccttaaccaacacggtatcagtttcctaaatctactaccaaaccaggactttaggccgttctgtaatatacaaggaaacgtaatacccaagtcatgatctgttacatattccatatatataagttatcccttataactagtcggataaccatgccgtgtgggtatggggtacccataatcttcacagtagcccctgagaccttcatagtcgaaaagataatcttctctcgaaccagattactctaaagccaagtgcttcaatcatctttgccatggtctcccgagtacttttaccaaatatgaagactgtggagggctgaaaaataaagtcaggtgcatcgactagatgcacctaataggtgtagcccccgactatgtggttagctgaacaaactaagcatatagtcaaggaataaataatccaaccaaccgagtggttttgataattgcaatcaaccaagtaacttgatatcaatatatagcatatgcggtatgaatccctcaataacatgatccaagtgatataccgactgctttgtaaaatataatgagtgtaacctaaagttggctacatcattgaaaattcacatagcaaaacagctataaagaagcttgtatgttgtgaataaagaaatttccaaagtattaggcatacgccatgcgcacactgctttaacagatatgcttaagtctctaaaacacacatggtttcaccacacctagaaatatatatatggcatatgtggtgtaaaatctgtgtaaataaactcataaaggatttaccaaccgcctggaaaatgaccaaaatatataatcagcctaagccataatattggtcaataaaagtgcacacttacgtggcaaaaagcaataatattgtatccaatcaattactttatgaacccaaacagcgccttgacttatataaaaaagtcagcgggcagctatataaagtattactgtttggcaccttttaaaatgcattgtaccaactcctaaaaagttgagtaactgtggtataaaaggattttaaggtattggacacttgatcacgtgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatataaatagcttctgatctaagtgattatcctttatgggatactccaaaatagatataaagattgaatcctgactggcgcaagtattcagttgataacccttacggggaataataaatagtccagtctttgagcacagaaaataaacccatgatcatgaattcatgttgcatgtatccggaacaattccaaattgaaggtatgatacttgtgtttgagctagtaagcccctgagcatatagcttatacttttggagtagttgaaattatccatcggtgatagctgatgcaatcggcatggaagtgaagaaaccagtcggcagcagtcagataaactaacagtgaagatgaatgcacccagcaatagcggcagcgttttgtagccttagtgacgaaataatcagtcggagacgaaaaggcagctagtgaagaagatgaagatgaagacgaggataccagtcggtggtgatgaaagcaagccgacggtgaagatgtagacacgcatcaaaggcgatgacgaaatccactaatcatgaagatgaagacaatagtcggcgacgacaaacgcaactgacagtaatgatgataagcagcaacagagatgatcaaatatgatgacgaagttgcccaccaatagcagtagagtgggcaatgttgaagaggcttgacaagttattgatgaagatgacgatgtcggtgatccagtcaacagcggtgtaacagccgatgataatgacgaagatgctcatcagcgtttgcatagtaggtcaaccatgaaggcgaaataacaagtcggcaatgacggaagcagccagaggcgaagacgtagtcacccattagcaacggtagagacgtcaggaccgatgaaatagaggtgctggtgatgatgtcagtgacaataatccatcaaactgttgagaagatatcaaagctcgagtaatttccttgatgcgagcatgtgcataacgaagatgatgcaatgccccttgatttatgaagatgactgcagaacttagtgttatagcgttgcagatgcttcacttgaaagaaagtagatgctgttgtccaacttgttgaatctgagttaattggttgataactctaatctcccgaatatttagattaaatctcacacttgatacttgaagtagattatggcagcatggggcatctaaaattgtcagtgaaataattgaagttgctgaagtagaacgtctgctccgaagcaaagacgaagataatgactcctggagttgactcattgattgattgattgcttcatcttgacctaaagcttgtcgaattttgagagtcttgtatttgtgtagcccccgactctttggttaattgagaaacaactgaacatagagtcgagaactgtagcttcttgtcatcgagtagtcattgcttgagtgaatatactcatagaagatgtccgagtagaaatctttaatattggaacaccacttgttgtagtaaaataacatggcattatacttgttgacgcatgccgagatgtcgaggctcctgtagatgtcgtggtcggcgaagtagcaaagcttgcgaagtagaggcaatagagtttgccaatgccgaagataataaagatgatgttgctccaccatggtgacaaagttgcatagccgtgatgacgtgaacaggagttggcggcaacagaagcaaaccggtggcgaagatgcgcagtcatgaagataaaaacaccagttggtggcggcgtaaccagtcggcaacggaagaagtagaatgatgatgaaaacgaagacgttctttaacagcggcaaaataggccagccatgaacgtgaatacatcatgggcagcgccgaaggcaaactggcgatgacgatgacgccagtcaataatgacaaagacgcgcagccgtggaggtgaacaagccagtcggcgtcagacaaggcggccagcaatgaaaacaatgacgtctatcagtagtggtaacaatataaaccagcagtaaaggcgacggcactagtcaacagcagaagagacgaccggcggtgaagacgtagacgctcaacaacggcggcataataggcaagccgtgcaggcggagacaccagtcggcggcagacgaggcggccggtcggtgaagacgtagacgcccaacaacggcggcataataggccagccttgtaggcggagacaccagtcggcggcggtggagacaccagtcggttgcggcgaagacgtagatgcccaacagacggtggcataataggcccgccgtgcaggcggaaacaccagtcggcggcagacgaggcggccggtcggtgaagacgtagacgcccaacaacggcggcataataggccagccgtgtaggcggagacaccagtcgacggcagacgaggcggcctgtcggtgaagacgtagacgcccaaaaatggcgacataataggccagccgtgcaggcggagacaccagtcggcggcagacaaggcggccggtcggtgaagacgtatacgcccaacaacggcggcataataggccagccgtgaaggcggggacaccagtcggcggcagacgaggcggccggtcggtgaagacgtatacgccca

SEQ ID NO: 91359 - DNA, 1540 bp, Oryza sativa
ttatcatatttgagtgatttggatttatcacacaacaatctatcgggaagaataccatcgggatcacagcttgacaccctctattttgaacatcctgatatgtatagcagtaacgatggtcttttcggatttcctcttcaaagaaattactcggaaggaattgcaccaaagcagggctatcacgatcatagtaaaacccgacaagtagctgagccaatgttcttttaccttgggcttgtgtcaggatttgttgttggcctatgggtggtgttttgcaccatactcttcaagaagacatggaggattgcctatttctctctttttgacaaggcgtgtgacaaaatatacgtgtttactgttgttacttgggcaagagtatctcaaaagacgaatgtacaataagctaattggaaaatttgattagaacgacgtgcgtatgttggtgctgggtcacactaaaagcatctaatactctaatgtggtgtggtgtggcacagtgatgcttgtttatttaattagttctgtgtgttgtatcttaatagggattatacgatattatccttactttccattattactctgtaattttttatcataatgtttgtttctttaagttgctttactaggaacatgttatactgttttttttatcaatataaggcagattctaacgaaaagtaataactatgaaggtagccgtgcgaatgcacgggcatgcgttttaaggtgtgtgtagaaatagatgaaatatcaaccgaatggcacctaccatgtttgaaaagtactttctccggtttttaatagataaattaagttaatttttttatacatgtttgatcatttatattattcaaaaatagcaaaagtgtaattaatgcttatagtacttttgatgataaattaaaccaagtcacaataaaatgaataatattatttatttatataataaaactgaattgtcaaacatgagtaaagaagtcgacggtgtcatttattaaaaaattaaaggtagtccaagttcttcaaaatattttttatcgcattgcttatttttaaattgtttgttaatacatgtgcttatagattaatactctgtatgcctcaaatattagtatttttggactttggtgtgttacttttgactaataatatttaacatttataaaaagtaagttatttcaaacaaaacaagttaaatattatgagaatgtgtttaatgattaatttagtaaaatcatttttacgtgatcggccttttttattttgtaatgccccgattttcgcccgtcaaaaaaatctattttattaagaacctatgtttaaaacttttggttctttgagtgtatctagtttgtgtgccaaaaatctcaattaattcattccttgtcaagtcaaaattgtggccaattttttttcttttcaatatctcagaattcgaattttgtaatttgagtctcccctaaataaatcatcccaaaaatctattaccaatgtccaagttagaatttatttctttgaacctaaaaacctttattcaaat

SEQ ID NO: 91360 - DNA, 1831 bp, Oryza sativa
ctaatgcaccagcagttaaggacaagatggatgaaccgcacacatcaacttggatgtcagtagttcctaagatgatgacaattgacataaggtagacaaacaccatgaactgatcaagagccaaccctttagaagcaagaatacagacacagggagactgatgagtgtatagagtatataggtgttctattgctcgccaatggtctgagttatttggcctgaaccctgaagactcattgagttggagggccttagactaaggcactccagttcactatataatttttttaagggagggaagtctgctacagagatttttgtgagaagtgtcttatatataaaatctagttaagaaaatctcaagttacaacatcagtcacatgacgcaggggcatcaaccatcacaatgtacacacaccgcatccaattgtatggtttatatctaagttatgtattgcctatggtctggtataccttcagcctgctggtgcttactcctttgtagattccaattgaaacacttttcttcgttatgttgtctttcggtttatcagtttctggagggtaaaaatgagccaaaaaccaaaagcaaaattagatgtttttccaccatattggatacaagaaccttttttccaaataaaacaaactaaacttgaagttagcaaacttatgttcagttcaatttatcaggagtgtcttttagtttatcaatttctggagggtaaaaatgagccaaaaccaaaagcaaaattagaatgtctttccatcagattagatacgagaaccattttccaacttaatacaaactaaatttgaagttagaaagcttatggttagttcaatttatcaggaccaatctagttctgcagtctgcacaagggcacatgtctacagttattggtaagcaaaacacacatgtgaagtgtgttcttcagaaatatctagtcattctacaagaattccaattacttgttgtccattgtgaatgatttgatgcttgtcaccttatgagcctacttgaaagttgaaatacaagaaactcaaaacacagtaacaggaaaaatgcaggaattgagtgtcatgatcaatcaagtcctacggcagctgaaaaacaaaggaaaacttcaaaaggtgtttagatacaacaccagaaaattgtaggtttggaagagacagaaacagaagcatgagatatggaaatattcctccaaagcccatattgagtagtctaccatattaggagtttcaaaggaaatcatggagtccaatcctttgttccaaaggcctccataggacttttttttcttacagaaggattgtaattgtccaaaattccatatttatcctccattttaaacggggcctaaaaaatgcaataatccagcgacattgaattttacctagtgcacttgtaactgagtaattgtgaaagaaagttctatccaaaaggaaaattcacatgggcatgagaaagggtctcgtaaactttacctggtttctgattgctccaatcaacatatcatgacaaccagatgcatgcacattctttaattttggacactgaagaagcaaccgttctgcgcaaaatatttagatggttaataacgatggctactatcaacatactcaacaacatgaagaaaaggggaaaggacataagacctggatttagatttgtacaggagttgaggtttagatcattcagctctggacaatttagatatagagcctgccatatgtgaaattagtaaaccatatgaatgattatttcaataaatcaaagcctgcaaattccaaaacacttacatctattgctgagcagccccat

SEQ ID NO: 91361 - DNA, 1157 bp, Oryza sativa
tatatgtatatgtaatccttatgagctgatgcaacatccagataactcaccggctgaaaccccgatgaaacccttattggcaatcaagaagcaggtaagagattatggttctaagcacgacttagtagatcaaacttaaccgatgtagcactaagtatgaaacgaaacataatatctagataatcaagctgttgattgagttttcagggtggtagatgtctaagctaatctaatctaatctagcaacacgatttagccgataccggcagaaaccctaaaacgagaagcagccgatagagttaaattgatatgctaagactagattaacatagacatatgataaataggtaggcaaatgtgtcatccaaactagagcaatccaagaggtcgaatgtattgatgcagccttaaacaacgccgacgtaaacaatacaattgcctgggccgacggaacattggacttaccctttagccagagatcgaacaccgatgcacccccgtgtcaggtgtcaagtcccgtcggacgataaaataaagtagaaaaggtaaaaggtggcgatgcgccgaattatattgatcgtgaagataaattacatagaccccaggtgtacatatttatacccatgggtagatactagtccttgtacgacaagaaagaaactttcctaaagataaagggtgaatagccaaagtggtcctccaagtctcatctgaggctcagtttagtccttgatgtttcaatctatccatattagtccttcaagttttcattttagttcaaacttatccttgaaccaacaactcttttcataaatgacacttatacccctcatcatttacatatataagagagaaattgcatgcttaaattttttatagataatacatagtatattatgtaaaacgaaaaaaaattatgtactagcaagtgtatatgatagcaattgcttaagtttcatgtgtatatgttgaaataatgggaagtagatctgtaatattgtttattcatgttggctttctcttttctagtatatagatgtatacaaattaagggcaaaattgatattttctaatagaaatattgcctagaaatagccatatggcatattaagtggacccaagaatgatttcaagccaaaacaaatatttgaaggatc

SEQ ID NO: 91362 - DNA, 535 bp, Oryza sativa
cagtttatagatgtttcttgtgaaaacctcaaccacacttgctgcagtataaggatgtgacaatggtaggaaatgcgcaaacttagaaaacttgtcaaccactaccattatgcagttgtacctctctgaaactggcagcccctcaatgaagtccatcgagattacttgccacgcaccctcaggaactagaagtggtcgtagtactcctggatatataaccctctctggtttagcctgaaggcaaacttgacattgtgacacatactacttgacttgctctttcattcctttccaagcaaacaagtgcttcaattttccagaatgacctccaactggattatcatgcatttccacaattagtttgtgctacaattcagagttgtctcctacccagagtctgcccttataatgaagcagaccattctgaagggaaaaatgctcgcaataggctgaacagcaagttcagtaagcaattgagaagaatattcatccttatcatacccttgaactacctcatgtatccacataggaactc

SEQ ID NO: 91363 - DNA, 731 bp, Oryza sativa
ccggatgcgcgggagtctgtagggcgagtgacagctcgtccttctctctgtcgggtcggaacgtgccctgagaagaggcttccactgcgtccattagtcgactcgcagcctcgcgtatctgatcgctgaagaccaaggagccatcaactgggttgagcgttacaccatgagcatagtaccagaacttcgatcgatcaggccatttagcggtggccggttcgatacccctctcaagcaagcttgcctccatctcctcccacttcggcatcgcgacgctatagccgcctgaccccaagtggtgatggtacttcttcttggcggcattttctttgtttctttccatcatcgcctgcccttgttgacctgtcttgtaagcaacgaactcgtcctagtgatcccttagcttcgggaatacgtcgaagttcggtgtctgccccttcaggatgtatttccggtacagatctcccttgaaggtctggaactgttctgccattttcttaagagtccactgtttcactatgttctccgtacccgcagggagcgtgaacgtctcgagcattgtggttcacagcatctctttctctgatttcgggacaaagctgtcattatccccgcgtgcccttgttctgcgctagtacaccttgctgacaggcacgttatccctcacaacccaaccgctgtggcgtacaaaattcttggctgcttgtgccggggcactaggtcggctgtct

SEQ ID NO: 91364 - DNA, 687 bp, Oryza sativa
cttcaccgaccggccgcctcgtccgccgactggtgtttccgcctgcacggctggcctttatgccgccgttgttgggcgtctacgtcttcaccgaccggccgcctcgtccgccgccgactggtgcttccgcctgcacggctgggctttatgccgccgttgttgggcgtctacgtcttcaccgaccggccgcctcgtccgccgccggctggtgttttcgcctgcacggctggcctttatgccgccgttgttgggcgtctacgtcttcaccgaccggcttgccttcgtcgccgccgactggtgtcctcgcctgcacggctggcccattatgccgccgttgttgggcgcctacgtcttcaccgaccggcttgccttcgccgccgccgactggtgtttccgcctgcacggctggcctttatgccgccgttgttgggcgtctacgtcttcaccgaccggccgcctcgtccgccgccgactggtgtttctgcctgcacggctggcctttatgccgccgttgttgggcgtctacgtcttcaccgactggccgcctcgtccgccgccgactggtgcttccgcctgcacggctggcctttatgtcgccgttgttgggcgtctacgtcttcaccgaccggccgcctcgactgccgccgactggtgtttccgcctgcgcggctggcctttatgtcgccg

SEQ ID NO: 91365 - DNA, 2025 bp, Oryza sativa
cttgggtcctaatattcaagtttggtgatataaaaaacctatgaaaataatttggtgatgatggtgtggatattatgggtaccccatacccatacggcatggttatccgactagtcataggggataacttatatatatggaatatgtaacagatcatgacttgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatctatactacactcggcggattcaaatccccaaacaggagtagggtattacctctcattgagagggcctgaacctgtctaaatcctttgtctctgcatccatccacttttaggtctcgtgcgctaccccgttttattattgccgaaatcatgtttcgacagttggcgcgccaggtaggggttgcgtcgagtttcctatcaacgagcgcgatggaattaacttcatgagtcgccgacttcgttttcgcttcgagagttttcacttcctttccgtcgaccacttcttcaagctcctcttctctgacttgatccaaatcagtcagggggaaactcaatcgagggattacaacaatctaccgcggcaagtttcagattcaatctcctatggctgccgtcagcaccgccttcatcttcggaccggttcttttcttctggagttcggcttgcatcgccgccgccggaaattccgacgggacgtcagtcgtcaacttgatcgtttgacatgccgagtccatcatctgatgatgtcaaatctcctggcgatattcaattactaatctaaattggagtcgacgtggaatctgagccaatcaataggagcaattttcacgcagggaagtgcagcactcatgcatgtattgcatgtctgtcacaagctgccgatatgatctcctgtccacccattaacacatatatacggaggacactgagaaaaaagctaagtgcctttatttttcctctttatgtgatattttccattgagcaatttttttatatctactcatgctaactactcgtccagcgccggacgcctagttttatcattatttatcatattgatttttaatctcagattaatctcttgttattttttgttgttgttcgcatataattacgcggcactattgaggcgattaatgctggtcatggagtcgaggagtctcagctttccggtcgatcggccgcgagtccactttgccggcttgtcttcgccaccgccattgctgataacaacaacgatttcaccgccggcctgcctccgtcgccgccgagtggtgcctccgcctacacggctggcctattatgccgccgctgttcggcgtctacgacttcaccgccggcctgcctccgtcgccgccgagtggtgcctccgcctacacggctagccttttatgccgctgctgttgggcgtctacgacttcaccgccggcctgcctccgtcgccgccgattggtgcttccgcctacacggctggcctattatgccgccgctgttgggcgtctacgacttcaccgctggcccgcctccgtcgccgccgagtggtgcctccgcctacacggctggcctattatgccgccgctgttgggcgtctacgacttcaccgccggcccgcctccgtcgccgccgagtggtgcctcgcctacacggctggcctattatgccgccgctgttaggcgtctacgacttcaccgccgacctgcctccgtcgccgccgagtggtgcctcgcctacacggctggcctattatgccgccgctgttaggcgtctacgacttcaccaccggcatgcctccgtcgccgccgagtggtgcctcgcctacacagatggcctattatgcccgccggtgggaggcgactacgacttcaccgccggcctgcctacgacgccgccgagtggtgcct

SEQ ID NO: 91366 - DNA, 1845 bp, Oryza sativa
gttgggtgtctacgacttcaccgccggcctgcctccgtcgccgccgactggtgcctccgcctacacggctggcctattatgccgccgctgttgggcgtatacgacctcaccgccggcctgcctccgtcgccgccgactggtgtcctcgcctatacggttggttggtcataccaccgttcatgggcgtccacgtcttcgccgaccggctggccttcgccgccgccgactggtgtttctgcctacacggctagcctattatgccgccgctgttgggcgtctacgacttcaccgccggcctgcctccatcgccgccgactggtgtcctcgcctatacggttggttggtcacaccaccgttcatgggcgtccacgtcttcgccgaccggctggccttcgccgccgccgactggtgtttttgcctatacggttggcggacttcgccgctgttaatgggcttcatcatctacatcactggcttggttccactggcgccgactggtgtttttgtcaccattgatggactgcttcgttcccacatcggctacttttgctgtcaccgagggaatattacaaagctaagtcatcatttattttattctttatatgatattttgtcttttccttcgcctcactacatcaactggttcgccgttgactagtgagtcgggggctatagatgttatatcgtattttttaaacaattttcataatatttatcttgattgcttgcgacataatctgagtacaaaagtacctatcgagttatggagttctatgttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaattctgatccgtgaaactttgttccattaatgacgaactcatgtcactcatatgcatgtttgggaagtgcctaggccgactcccgatgcttggggactatgactagtcgggcagagtgtttaaacgtaaggagtcatctgctcggggaaatcaaaattgataagaggagaaatacatatttataaatattttaaaatacttgattttttctcgagtattatatttatatcagatactactcatcctatatgtttgttctgcaggatccaaatccagatatgcataaaagggattcatggttttaagcttatctcttacgctctaggaatggatctgtcagaacatcaccgaccggcttgccttcgccgccgccgactggtgtttccgcctgcacgttggcctattatgccgccgttgttgggcatctacgtcttcaccgaccggcttgccttcgccgctgccgactggtgtttccgcctgcacggctggcctttatgccgccgttgttgggcgcctacgtcttcaccgaccggccgcctcgtccgccgccgactggtgcttccgcctgcacggctggcctttatgccgccgttgttgggcgtctacgtcttcaccgaccggccgcctcgtccgccgactggtgtttccgcctgcacggctggcctttatgccgccgttgttgggcgtctacgtcttcaccgaccggccgcctcgtccgccgccgactggtgcttccgcctgcacggctgggctttatgccgccgttgttgggcgtctacgtcttcaccgaccggccgcctcgtccgccgccggctggtgttttcgcctgcacggctggcctttatgccgccgttgttgggcgtctacgtcttcaccgaccggc

SEQ ID NO: 91367 - DNA, 1770 bp, Oryza sativa
cacggctggcctttatgccgccgttgttgggcgtctacgtcttcaccgaccggccgcctcgaccgccgctgactggtgtttccgcctgcacggctggcctattatgctgccgttgttgggcgtctacgtcttcactgactggccgcctcgtccgccgccgactggtgcttccgcctgcacggctggcctttatgtcgccgttgttgggcgtctacgtcttcaccgaccggccgcctcgactgccgccgactggtgtttccgcctgcacggctggcctttatgccgccgttgttgggcgtctacgtcttcaccgaccggccgcctcgactgccgccgactggtgtttccgcctgcacggctggcctttatgccgccgttgttgggcgtctacgtcttcaccgaccggccgcctcgaccgccgccgactggtgtttccgcctgcacggctggcctattatgctgccgttgttgggcgtctacgtcttcaccgactggccgcctcgtccgccgactgttgtttccgcctgcacggctggcctttatgccgccgttgttgggcgtctacgtcttcaccaaccggccgccgcatccgccgctgactggagtcaccgcctgcacggctggcctcttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggccttaccatcttcatcgccggtcgtctcgtctgttgctgactagtgcccttacctctacgtctggtttatacagctaccactactgatggacatcatcatcttttgtcgccgactggttatgttgtcgccgactggtgcttttatcttcacaactgcgcgtcttcactaccggtttgcttctgttgccgccgacttgtgttcacttcattacggcaatacaactttgtcatcatggtggagcgacttcatctttattatcttcggcaccggcaaactctattgttgctacttcgcaagttttactacttcaccacccacgacgtctttgtgaacctcgacatctcggcatgcaatgccatgttattttactacaacaagtggctctccaatattcaggatttctacttggacatcttcaacacatatcttcaatcaagtgatgactactcgacaacaagaagctataattctcgactctatgttcagttgtttcccaactaatcaaagagtcgggggctacacaaatacatggctcaaaatttgacaagctttatgtcaagatgaagcaatcaattaatcagccaacaagtcaactctgggagtcatcaattttgtcttcgcttcagagcagtaggtcaagattaaattggagtcatcaaccaatcaactcatatcagattcaatgagttgaacaacagcatatactttcctccaagtgaagcatctacaacagtttgatggattattgtcactgacatcatcaccagcacatctgcttcatcagctctgacattccgcgttgctaatggatgactaagactttgccaacttgctattccgccttcacggttgacctactatgcaaacgctgatgagcgtcttcgtcattatcatcggctattacaccgctattgactggatcaccgacatcgtcatcttcattactgtcggttacatttgtcgtcgccgactattttcctcatc

SEQ ID NO: 91368 - DNA, 2106 bp, Oryza sativa
aaatgtataaagctgaggtagaaaaccaacttgaaaggaaaatcaaacggttgaggtctgatagaggtggggagtatttttccaatgagtttgcatccttttgcgaagagtttggaattattcatgagatgacgcctccctattcaccccaatcaaatggggtggccgaaagaaagaaccgtactctaactgagatggtgaatgccatgttagacactgcggggctttccaaggaatggtggggtgaggcagttttgactgcgagtcatgtcctgaataaaattccaatgaagcataaggaagtaacaccattcgaggaatgggaaaggaagaaattaaatctctcatacctacgaacatggggctgtttggccaagataaatgtacctatagccaaaaagcggaaacttggaccaaatactgttgattgcgtgtttcttggttatgctatccacagtgtgggttatagattcttaatagtaaactctggagtacccgacatgaatgctggtacaattcttgagtccagagatgctacattctttgagaatgaatttcctatgaaacattcacctagcacttctagtaaagaaactgtcatgccccatgagcactttgcaccgacagaacacaatgatcaaacgcctgaggaaaatcctgatgaggacaacattgtagatactcgcaagagtaagagacaaagggttgcaaaatcctttggagatgactacattgtatacctcgtggatgacaccccaagaaccatagaagaggcatattcatctcctgacgctgactgctggaaggaagcagtacgcagtgaaatggactcgattatgtctaatggtacttgggaagtcgttgagcgtccatatgggtgcaagcccgtaggatgcaaatgggttttcaagaaaaagcttaggcctgatggtacaatcgaaaagtacaaggcaaggcttgtggccaagggttatacccaaaaggaaggcgaggacttcttcgacacatactcactagttgctcgcttgaccacgattcgagtactacttgctctggcagcctctcatggtcttctcgtccatcagatggacgttaagacagttttcctaaacggagagctggaggaggagatctatatggatcaaccagacgggtatgtactagaaggttaggagggaatggtgtgtaaactattgaaatccttgtatggcctcaagcaagcacctaagcaatggcatgagaagtttgacaccacgcttacatctgcaggctttgttgtgaacgaagctgacaaatgtgtatactatcgctatggtgggggagaaggggtgatcttgtgcttatatgtcgatgacatactgatctttgggactagccttaatgtgattgaggaggtcaaagactatctgtccaagagttttgaaatgaaggatttgggagaggctgatgttattcttaacatcaaactacaaagaggagatgagggtgggattacacttatgcaatcccactatgtggacaaggttttgagtctctttggctatagtgactgcaagccagctcctactccttatgatcccagcgtgctattaaggaaaaacagaagaatagcaagggatcaactgagatactctcaaatcattggttcattgatgcacttggctagcgcaacgagacctgacatctcatttgttgtaagcaagttgagccggtttgtctcaaatccgggagattatcattggcaggctctggaaagagtaatgcgctatctaaagggcactatgagctatggaattcactataccgggtatccaaaagtactagaagggtatagtgactcaaactggatatctgatgctaatgagataaaagccacaagtggatatgtgttcacacttggaggtggcgctatttcctagaagtcttgcaagcagaccatcttaacgaagtcaacgatggaagcagagcttacagcactagatactgcgacagttgaggccaagtggcttcgtgaactcctgatggatttgccggtggttgaaaaaccagtgccagctatcctaatgaactgtgataatcaaacagcgattattaaagtgaacagtt

SEQ ID NO: 91369 - DNA, 1697 bp, Oryza sativa
ccggttgttgttagcaaccggcagtgcagatatctttactcccggttcttctcaccaaccgggagtaaagatattttcccgctatttccaaattcttttttaaacccggttagggttaagaaccgggactaaagttaatagcactgaatattgaatttcgttgcatatatgtttctaaaatagtaaataatgcattaaaaattctaattaacatatgtaaatcccacatgcatgatttaaaacttttaaaaattctaataatcatatataattagcatatgcatgatattaaattgttaaaaattgtaacaaacatatgtaaatcccacatgcatgatttaaaacttttaaaaattctaataatcatatataattagcatatgcatgatattaaattgtcaaaaattgtaactaacatatgtaaatcccacgtgcatgatttaaaacttttaaaaattctaataatcgtatataattagtatatgcatgatattaaattgttaaaaattgtaattaatcatatataactagcatattcaatacatccaaaatagtttacaacaattacggcaatagattggcggtgacggttgtccacacgtactttctcctcactattgttccttccttgtgatcgctacatgagtaaggggtgtcttcgtttgataggaggatgctagggtcaaccgtcaccgtgaaagggggttgcccatcaaactgatcgtaatcctcgtcagtcttgtcctctactccgacgatttttcttttgcctgggagaaccacatggcgcttcggctcgtcaggccctttgcccttctttcctttgctagacatgtccttcacgtaaaaaacttgtgttacatcattggcaaggacaaaaggttcgtccgagtatccaaccttgttaaggtcaaccgttgtcatcccactgtcatcaatcgttacgcctccaccagtcaacctaacccattggcaccggaacagagggaccttgagaggtccatagtcaagttcccatatctccttgatgacaccgtaatacgtgccagttgtaccatcgtgtcccatggcatcgatacgaacagcactattctggttcgtgctcttcatgtcttgggctcttgtgtagaatgtgtacccattgatctaatatccctggaatgtcgcgatcgagccagatggacccttcgccaggaaggccagttgttggttaatcgtctcgttacccatgagatgttgtcgcagccacgcggggaaagtatcaatgtgatgccgtgtaatccatgcatcggagttaccgatgtttctggcgcgaactagagccaagtgctcctcgatgtaaggagccaccaatgaagattattgtaaaaccgtgaaatgggctttacggaataaattgttgtctaccgtcataattgctttccttccgagagtcccctttccccgtagtctcccttcatggcgtgattcaggtaccccgattgtgcgaaggtcttcaataaattctatgcaaaattcaatgacctcctctgttccataccccttggcgatgcttgcctctggacgagcatgttacgaacatacttcttcagaacgcccatgtacctctcgaaaggaaacatgttgtgtaggaacacaggcccgggaataccaatctctttcactaggtgacaaagcagatgcgtcattatattgaa

SEQ ID NO: 91370 - DNA, 984 bp, Oryza sativa
aacgaattgccgcagtcctcccacaagtttgttttgaaaaaaaaaaatcgccaccaatccttccggtgataaatgtttgtattcatctatttgccacatgtcacctaacatgctcttgtttcagatttgttcctttcttacaaaaagaatcagtcagcaatgccaaaaggtttcaaaaagatgttggtaaacattccccctatctctaatttgcatgtcctatctgaatgaaactaatttatgcagcacaccagacctagccaaatattgttccactcaagtacagctaaaattactggtagtaaggtttgagcatccatgttgcatcatttttgcatctttgcaacattgctatttccttcagcagattcttaaatagcagcatatccttggacataatggagttcttaaaatgcctggttaatgcttgttgagctggctgaagcctgaaggtgcatattggtaaattaggacttgaggttgcatgataatgttcctagtagaagagcttgatgcatgacctttctatgataaacttggtgtgtgattagaagctagtccctagatcatctttttctttgtagcgaatatgcaagagatgttctaagtgcatcctacctaaaagtttgcagactttggccctgctatttgaagtttctgatggctgagaagaactaaataaaccaatgcctattgagtgttgacttaaacttcaagaacactgaggatggtgtctcggcagcaccagctcttaccagtcgaactagcaaccaaaaaaaactatcatgacttccgattggcgtcaagcttctggtcatcattagcatgcattatggcatcgtgattaattgcactctgagaaaaatggaaaaaaaatatcattttcagaaacaaaagccgagacaaattatttgtgttagggataagaaataattgcttacatgaatccctgagcatcaaaaagactcttcaaaatgtgagatt

SEQ ID NO: 91371 - DNA, 907 bp, Oryza sativa
acacatgtccgtcaaagaaaggcggaacaagtctccgctgtcataaccttttccaacaaaagtcccatatttagatacgacacatttattggactcaaacacaagtctaaaaccttctctatacaagattcttctttattgaagggacatgctgcacgttcttcagctgcacggtctttcccgaagtaaacttcagatcaaccgtaccaacaccatgaacagccgcaagcgacccgtttcccatcaacaaggaggaacctctcccgacctgataagaagaaaacagagaaatgtcagcacatacatgaatattagcaccagtgtccacccaccaatcaggtgaatgaaaaacagagagaactgtaggtaatattttaccgtaccccgatgttcctccgccctcgctaattaccatgttggcagacttcctgtctttgcgctcaggacagtccttggcccaatgcccagacttgccacacacaaagcagtctccctttgcctttcccttgcctttcttcttaaaattggttgcagccttgggtttgacatcaggcttgactttcttgttgttgtgggatgcatgagagttcttcttctgtaccatattggcactagaacctccctcaacctttttgccccggacgtcctttgccctcaccttctcctcaacacccaaagagccaatgagatcagaaacactgaactcttgtctcttgtgctttagagaagtggcaaagtccgaccaagaaggtggtagtttggcaataatgccacccgccacaaacttgtccggcaactcacagttgttgttctcaagttccttagccagcatctgaatctcatgagcttgttctactacagaacggcatcgaccatcttgtagtcatagaactgctcatgacataca

SEQ ID NO: 91372 - DNA, 1028 bp, Oryza sativa
cggcccggcagcgtacgtcggcgtcggcgtcgtcggcgttcgtcagcaaaagagagagagacagagagctacatcgagagagagaggacgggggctctcacccaagagacgcggcggcggcgtctgcggtggaggcggcgaggaccgccaggcgacggtgagagacaacggcggcgtcggcgcggggttgccctaggcagtggcggtgaaggagaagccgatgctcgatctcgatggaaaaacgtctaagtgttggtggaggagacgagggcgcaccgggaatatttatacccccggatctttactcccggttggtgagaagaaccgggagtaaagatatctttacttccggttcctaacaacaaccgggattaaagatattttcccgctatttctaaattcttttttaaacccggttagggttaagaaccgggactaaaattaatagcactgaatattgaatttcgttgcatatatgcttctaaaatagtaaataatgcattaaaaattctaattaacatatgtaaatcccacatgcatgatttaaaacttttaaaaattctaataatcatatataattagcatatgcatgatattaaattgttaaaaattgtaactaacatatgtaaatcccacatgcatgatttaaaacttttaaaaattctattaatcgtatataattagcatatgcatgatattaaattgttaaaaattgtaactaacatacgtaaatcccacgtgcatgatacatactttctgtttcatccatacagtgagtgcaagccttgtaccccttgttggactgcccggataggttgctaagtgtaggccaatcgttgatggttacgaacagcagcgctcatagattaaactcctcctgtttgtcctcgtcccacacggggacaccttccttcttccacaacagtttaagatcttcgaccagttgtcttagaaacacatcgatgtcgttaccaggttgcttggggccttgaataataatcggtatcattatgtacttcctcttcatg

SEQ ID NO: 91373 - DNA, 715 bp, Oryza sativa
cctttatgccgccgttgttgggcgtctacgtcttcaccgactggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctttatgccgccgttgttgggcgtctacgtcttcaccgaccggccgcctcgaccgccgctgactggtgtttccgcctgcacggctggcctattatgctgccgttgttgggcgtctacgtcttcactgactggccgcctcgtccgccgccgactggtgcttccgcctgcacggctggcctttatgtcgccgttgttgggcgtctacgtcttcaccgaccggccgcctcgactgccgccgactggtgtttccgcctgcacggctggcctttatgccgccgttgttgggcgtctacgtcttcaccgaccggccgcctcgactgccgccgactggtgtttccgcctgcacggctggcctttatgccgccgttgttgggcgtctacgtcttcaccgaccggccgcctcgaccgccgccgactggtgtttccgcctgcacggctggcctattatgctgccgttgttgggcgtctacgtcttcaccgactggccgcctcgtccgccgactgatgattccgcctgcacggctggcctttatgccg

SEQ ID NO: 91374 - DNA, 2504 bp, Oryza sativa
aacggatcaacccagccaatctccaacatgtcctcctccatgagagttgctctcctagccatgctacccatcctcctcgtggatgcccaatccatggctgcgccaattcagtgccttccaggccaggccgcggcgctgctccagctgaagcgctccttcgatgccaccgtcagcgactacttcgccgccttccggtcatgggtcgccggcacagactgctgccactgggacggcgtccgctgtggcggcgacgatggccgtgcgatcaccttcctcgacttgcgtggccatcaactgcaagctgacgttcttgacaccgcactgttcagcctgacctcgctggagtaccttgacatctcctccaacgatttcagtgcatccaagctcccagccaccggcttcgagctgctcgccgagctcacccaccttgacatctccgacgacaatttcgccggccaggtacccgccggtatcggccacctcacgaatctggtttaccttgatctttctaccagcttccttgatgaagagctagatgaagagaacagtgtattgtactacacctcatactcactttcgcagctctcagagccaagcttggacaccttgctggcaaacctcaccaacctgcaggaccttcgtctgggcatggtggacatgtccagcaatggagcacggtggtgcgacgccattgcccggttttccccaaagcttcagatcattagcatgccttattgctcactttctggtccgatttgtcggtccttctctgccttgaaatcacttgttgtgatagagctgcactacaattatttgtccggtccgattcccgaattcttggcccatctgtccaaccttagtggtcttcagctttcaaacaacaactttgaaggatggttccctccaatcgtcttccagcacaagaaattaagaggcattgatctcagtaagaattttgggatctctggaaatctgcctaatttttctgcagatagtaacttacagagtatatctgtgagcaacaccaacttctccggcacaatccaagttctatcatcaatctcaaatctctgaaggagttggcacttggagctagtggtttctccggagtactgccttcttccattggtaagctgaaatctttagatttactagaggtgtctgggttacagctattaggatccatcccatcatggatctcaaatctgacttctctcaatgttctcaagttcttccattgtggcttgtctggacccgtaccatcttccatagtgtacttaacaaaattgacagatttggcactgtacaattgtcacttttcaggagagatagctacactggtctcaaatttaactcaattagaaaccctcctgctccattcaaacaattttgtcggcaccgtggagctagcttcattctcgaaactgcaaaatatgtccgtccttaatctctcaaacaataaattagttgtgatcgatggagaaaatagttcttcggcagcatcctactccagtattagtttcttacgtctatcatcttgcagcatatctagcttccctaccatcttgaggcatctacctgagattactagtcttgacctttcatataaccagatcagaggtgcaatacctcaatgggtatggaagacctcaggctatttttccttgttgaacctatcacataataagtttacgagtactggatctgaccctttacttccacttaacattgaattcttcgacctcagtttcaacaaaattgaaggggtaatacctataccccaaaaaggaagtatcacgcttgattactccaataaccagttctcatctatgcctctcaatttctctacttacctgaaaaaaactattattttcaaagcctccaaaaataacctttctggaaacattccaccattgatctgtgacgggattaagagtttacaactcattgatctctctaacaactatttgactggcataataccatcatgtctgatggaggatgcaagtgcactacaggtactaagtctaaaagaaaataatcttaccggcgaattacctgataatatcaaggaaggctgtgcattaagtgcattagatttcagcggcaatttgattcaaggaaagttgccgagatctttggttgcttgcaggaatctggagatccttgacattggaaacaatcaaataagtgactctttcccatgttggatgagtaaacttcctcaacttcaagtcctggtcctcaaatctaacaggttcattgggcagatggatatttcttatactggagatgctaacaactgtcaatttacaaagttgcggattgcagacatagcctcaaacaacttcagtggcatgttgccagaagagtggtttaagatgctgaagtccatgatgaccagttctgataacggaacttcggtcatggaaagtcggtattaccatggacaaacctaccagtttactgctgcactcacatacaaaggcaatgacataacaatt

SEQ ID NO: 91375 - DNA, 2725 bp, Oryza sativa
tatatatatatatatatatatatatatatatatatatatatatatatatatatatatatatatatatatatatatatatatatatataatcaaccatgcagcaaacatggcaatgcaaataaaaaaaatggtacatagatctttagtcccggttggtaacatggatcagccggccacgtggctgaccgatctttagtcccggttgtgttaccaactgggactaaagatcgatctttagtcccggttatttcacccgggactaaaaatcgctatttttagtcccggattcgtagtcccgattagacaaccgggactaaagaggggtgacgaaccgggactacaaacgatttctccaccagtgaatcatggcacagtagtacgcgatgggcatggatattggcctggattgcaggtcggatacggagtcggaagctgtccactttgaagcaacaccctcgcggcggaggccatcgccggcgcctccagcagcgctgccgccaagacgaacatcatcatgacgagcacctccgccagccgccggccgccggtggtcctgagcgccgccgccatcgccgatcctccgatgatctttgctatctaagctactaattaactgattttgagacagttgtttgggttaatcactgaatttttctgcacgtttaatttaactatgtctggttatataggacgagctgagcgtacctagctaggagagatgtagaaaaaacaccggtggtcatgcattggtttgaccggcagcgtagtagctagtatatagtagtatctagggtggtgtttggatctagggacttaactttagtctctgtctttagacactaatttagggtattaaatatagactacttacaaaactaattacataaatgaaaactaatttgcgagataaattttttaagcctaattaatgcacaattagagaatgtttactgtagcatcacataggctaatcatggattaattaggctcaatagattcgtctcgcgaattagtccaagattatggatggattttattaatattctacgtttaatatttataattagtatctaatctatacgggccctaggttatctgtctggaatttagttcagttttccaccagcacattaaattatgcatgactaactgatgactaattaactgaactgaaagagtacagtacaattaaacggtttgactatatatttctcgtcaaattttctctaaaaagatttgccagatacaaatccaatacaattatgatgtaatcacttttaaacttttatcgacgacatcacttgtacgtaacatttaaaaacactccaattttgcgtttgtttctccaacaagaattggatgaaattttggatactcgtggcacgttttttaaactattaaacggtgtgtttcgtacgaaaactttctatatgaaagttgctctaaaatatcatattaatccatttttcaagtttataataattaaaactcaattaatcatatattatagccacctcgtttgcgtgaaacatttaatatttatctccatcttcatcttcaggacattattcatacaccacctttgtgtgtaccatgtgtttttttttacccccaactagctattgtatatccagcttgtctgtctggagtttaatttagttttccaccagcacatgcaaattatgcaagactaactgatgagtaattaactaaactgaaagaatataatattgtgatcactatgcaatagtgtgtacctaacttatcaagacaagtcgatcggtcagtcccgatcatcttggaaatctattagtcctatataaagtttatgtggtcgtgtagaaaatatataggcttgaactaagagagaagaacaaacacaatgacttgaactgtgacaatcgcatgttttatttctatgccataatcagaggccattcggtaggaaagaaattaggagttgtttggttcatggatacactttgccacatcatacttttggtaatcacagtttgttatgtatgtgtctggttcgctattatagctgtggcttgccacacttttttaagtagcatgacccacatgtcataggcttatttttcttgtcaactttgtcacactttgtggttagaaattcatccaaaatacttttatggctgccacaacttgtctaatcttagttgtggtaatgtgtgaccggcaaccaaacacacaataaaagttgtgcacatagcacaaggagtgaggaaaaaaagataatatagaaaatttccttttgtacatatatagtatgatatatggaagagcaattaatacatagaaatataaaaaacattattgcctcattgcagcttccactggtcgtaggtcaggctgtagtacacgcagatcgaggtattacatatttgcatcgctctcaaacatcacatgcaaataaatattttatttgaaatatatcttaagttgtagagaagaaactctgtaggaacgataactatttcattatatgctgttggttgattaaaagtaaactaataaccaacggcgtacagcttataatcatggcacagtagtaggcggtgggcatgaatattggcctggattgcaggtcggatacggagtcggaagcagtccactttgaagcaacaccctcgcggcggaggccatcaccggcgcctcctgcagcgccgccgccatgacgaacagcatcaggacgagcagcgcc

SEQ ID NO: 91376 - DNA, 828 bp, Oryza sativa
gacgcccaacacggcggcataaggccagccgtgcaggcggaaacaccagtcagcggcggtcgaggcggccggtcggtgaagacgtagacgcccaacaacggcggcataaaggccagccgtgcaggcggaagcaccagtcggcggcggacgaggcggccggtcggtgaagacgtagacgcccaacaacggcggcataaaggccagccgtgcaggcggaaacaccagtcggcggcagtcgaggcggccggtcggtgaagacgtagacgcccaacaacggcggcataaaggccagccgtgcaggcggaagcaccagtcggcggcagacgaggcggccggtcggtgaagacgtagacgcccaacaacggcggcataaaggccagccgtgcaggcggaagcaccagtcggcggcggacgaggcggccggtcggtgaagacgtagacgcccaacaacggcgacataaaggccagccgcgcaggcggaaacaccagtcggcggcagacgaggcggccggtcggtgaagacgtagacgcccaacaacggcgacataaaggccagccgtgcaggcagaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtaggcgcccaacaacggcggcataatgggccagccgtgcaggcgaggacaccagtcggcggcgacgaaggcaagccggtcggtgaagacgtagacgcccaacaacggcggcataaaggccagccgtg

SEQ ID NO: 91377 - DNA, 690 bp, Oryza sativa
atttcaggggaatctacgaactataccagctggacgccctcgacgtctctattatgagttgctggattttgtaagtatatcgttcagttagatttcttactatacgtctcctttaattaattaggtccttgtatataagtagactatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacaaatcatagctttaaactccatgtagggcttggtatcggttccgtcatttggtccgcggcaaatggagagaa

SEQ ID NO: 91378 - DNA, 704 bp, Oryza sativa
ccacagcgacccttcatccgacgacgaaccagattttcctaacttcgaccaacacgtggcacacatcttcggtggttcaacatcctattcctttaagcgagaatgcaagaaggtagaacgtgaagtttgctccacatcccgggtatcaatgtccaaaatgaagtggtcaggtcagaagatcgagttctctgataacaacccctgatagatatccgatagtagtcgagcctactatttggaatgtcaaagttgcacgtgttctcatcaacgatggcagcacaatcaacctcctctttgcagatactcttgacgcaatagggatccctagaagtgagctcatttcttcaaagcagctcttccatggcgttacacatagtcatcatcaagattgttatggaagataatgttgcttgtgactttcggcaaggctgataacttccggacaaagcagatcacctttgatgtagcagagtttcacactgcgtacaatgctatcatcaaaagagcggcacttgcaaaattcatggggcttcgcactgcgcatactagcggattaaggttccaggacctaaaggaataatcacaataccgagaaacgaaaagatggttgtgcagtgtgacaaaaggaatctcgacatgattgagcaaactgccaccactcccgccgcaaccgagccaccccaaaaagtgagtaaacccaactc

SEQ ID NO: 91379 - DNA, 2386 bp, Oryza sativa
ttaatgtaagaatgtgggtcctccatataagggcatgtatatagtgaggatactatatagcctataccttgttgatcggtatatgcactactatagaaagttagaaacaatatttccaaacagctaaaatatatttttgtaaatgggtgtagcatctgccaacccctagctgtatgtagaaatagggatttttcaggtgggcagcataaccacatgcgaaaacaaaatattggcacggggcatgttattgccacctaactgtattttttttcatgctaaacgaaacaaaaatccccaaaattgaaatcctataaaccctagttcacctaccgagttgggtttactcactttttggggtggctcggttgcggcgggagtggtgggagtttgctcaatcatgtcgagattccttttgtcacactgcacaaccatcttttcgtttctcggtattgtgattattcctttaggtcctggaaccttaatccgctagtatgcgcagtgcgaagccccatgaattttgcaagtgccgctcttttgatgatagcattgtacgcagtgtgaaactctgctacatcaaaggtgatctgctttgtccggaagttatcagccttgccgaaagtcacaagcaacattatcttccataacaatcttgatgatgactatgtgtaacgccatggaagagctgctttgaagaaatgagctcacttctagggatccctattgcgtcaagagtatctgcaaagaggaggttgattgtgctgccatcgttgatgagaacacgtgcaactttgacattccaaatagtaggctcgactactatcggatatctatcaggggttgttatcagagaactcgatcttctgacctgaccacttcattttggacattgatacccgggatgtggagcaaacttcacgttctaccttcttgcattctcgcttaaaggaataggatgttgaaccaccgaagatgtgtgccacgtgttggtcgaagttaggaaaatctggttcgtcgtcggatgaagggtcgctgttacccttgtctcaggctattttcctagccttggctttttggaacacgttgcactcgaatatgtgagcactagtcttatgcactgaacaccattgttgttcctttgacattgatgttccttgtgtcaagtgacctgcatattgcactgtgaagactcatttccggttacctcacctgctcctgcatgaattatcttcttcagaaaatataaccacataattgatgccctacacagttcagatacttatgaagcagtaatttccacgaaacaagaacaattcaagtgaagagcacggtgctggccagggaggtcgcgcggtggccatgatttgcagtgcggggatgatgagatgtagatatcgcgtaaattcctatgcaagcaatcaacgaggaatcgccgagtgcagcagaagcacctggattccatatttccatgtgaggaacaaaaatggggagatgtggaggggcagcgacgccgagtcaatttcgcacgatgggcggtgacaggcagtgggaaatcactgaaggcggaaggcgtgtatgaaccgagggggtgagatagacgagtggttcggtcgaatcaggatgacttgaaccagaaggcggacgccgttgtcagtagcgtcccgagctagacattgataaaaatagcgtccgaaagtggatgctctttccaacggcgtccttactaattttctaattcatgccttctatttattacttgtttaattttgggattaataattctataaataaaaaatttagctcagcagcacagcactcatgtcatctaaattaccctcaattttcataacccatttacacaagagacacaagttcataactttaagtattttaaaaccccatatctccatactccataggtctacacagagcttgccacttgaccatgtggtatttcctctttttctccacaccctgccagtaaaacctccccctcactccaaccatcttcttatggaactcctcaagaagtttataaaacccatagtgaataagggaatactggaaatgcaacaagtaattctaatttccctacccccataggaaaaatatccactctgccaagaccctagcctgttttcaaaacaccctcccccctccccattgcttgatcagattgtgcatagatttggttgtgaaaataccattttttgtgtgaggccaaaatgttttatctggttcctcacttagagtaagcccacttagtaaggccataatctccccaaaactctacttgtccaagaggtccagctttcttgtagaggatatatcccaagaaacctcattagtgacttcttttgaagttgcatattgctgccttcaaattttg

SEQ ID NO: 91380 - DNA, 4958 bp, Oryza sativa
  unsure (1)..(4958): unsure at all n locations
cgaaatggagataaacggtcgcagctataaggttttcaaggttgccgattggctgcgggtgcaccccgggcgaaccttagaagattacgatcttattcattcaagacatttggaggatatggctcgcttttggcgaaaccatcagaagactaaacgtcaggaaacgatctttcagcgtcgttatagtttagtctgtgtttcgccccctactcctcttaaggttgtgtacgatattagtagtgatgacgaacctagttcgcctgacccttccttagggagggatagtgattatgggggcgaagatgtaatttacttgtaaggtgaattgtatcgtgtgaaccttctattctttcgaagttaataaaaatgtgttttatttccttttcgctatttttcgcatcgtcacattttgtgcttttgttaggtcggaacatgccggcccctttgcgtatattagcgaaataggtgtactgacttttcagcttttcgtcgttcgttttcgatctgtagcgttctgtgttgaaagaaacgcttttgcttttatgttgatcgagcgtaacgtcgttcggctagttattttccgagacaagctgttgcggtttcaacgttcagcgagcgatgcttcggccgattcgtttcgcccccctggcctttttcgctgatcaggcgtttgccttggggtttttccacaaattatcaatcacacaaaaaataaaaagaaggcggaggacacagagattttatactggttcgggcctccatggtggataatagccctacatccagttctttctcttttttctctctatcttttttttcttgccgaaaggcttacatagtgccgaagggcttacataacggtatgtacatttttacaagttggcgatttgggtgccacccattctagacatagaagcgcttgagagaggcggcgttccaggaatggtcgaactcctcgccttcgagtgtcgctaggcaaaaggatcccgtcctggacttgtgtttgatgaggtactgtccttcccactttgattcaagcttgccaaccgctactaggttcgccttcttccttaggatgagatgaccaggcatcagctccgtcggtcgaacttttttgttgtaagttgccgaagtgcttgtggcgtacttgtgcatgtgctcgagcgcttcgactcttaccccttccaagagttcaagcgatacttcgtggccctcttcgcccccagagaacatcacccttggtgagttagcccctagctctgctggggtcattgcctcatcgccataaagaagcataaacgggctaaacttggttggtcttgtgggggtcgtccgaagggcccagagaaccgatagcaattcctctggccatttgcctttcgctgccccctcgagtcttttctttagtgcttctagaatcttgccatttgtacgttcggccgccccatttgactgcgggtgcgcgaccgacgcgaacctgatttccaggttaagcccttcgcacatttctctgaacttatcagagtcaaactgcttgccgttgtcagtaatgaactctttcggcactccaaaccggcaaataatgtttttccaaacaaacttctgtactgctgccgaagtgattgccccaaggggttcggcttcgatccaccgagagaaatactctatggccacaattacgaacttgtacccgtttcgcgctaccgagaacgggccaatgatgtccagcccccacctggcgaagggccaaattggcgcaatgggttgcaagttataatggggcgcagattggcttcggccatgacgttggcagctttcgcactttttaatttgctcagcacaaacttttaacacagttggccagtaaaccccttctctaaataccttggaggccaccgttcttgcagcttggtgcgcgccacatagcccctggtgtatttccctcgccatttcctcaccttcggcgaaagagatgcaacggagtagaggttgaagcgtcccggagcgataaagttggcctgagaccaacttatactttgtggctctgatttgcaagcgctttgcttctgcttcgtcgtccggaagccaaccagcttcaagatatttaacaaacggggttcgccagtcatttgggtcttcgcccagtttcacttggtcgattgccaagactgtcaaactgtccacaggcaaacttggtgtgtgcagtacttcaaaaaatatgccaggcaaatgcggtccgccacaagcagcagattttgccaaggcgtctgcttcctcgttctggcccctaggcaagtgttcaactgttatgccgatgaagtacttttccatggttctgacagcctccaaatattttttcattccttcttcttttgcctcaaaggttttgtcaacttggcctgccaccaacttagaatcggttcagattagcaagcgccgaactcccagtgctttcgccttccttaggcccagaagaatggcttcgtactctgctgcgttgttggttgtattaaattgcagtcttgcagcgtaccggactggtacgccattcggcgaagtgagtattgccgcaatgcctgccccgttgtgcgaccacgaaccgtcagagcacatcacctagggttgttcgacgggctcgggttcggaagcgaacacaggtgtccattcggctacaaaatgcaagtcgaacggggatagctctgccgcccatttgctaagcctacctgagatttccttgcctcggaggatttcgcccaaggggtacagcgaaggcactattaccttgtgggcctggaagtagtgcttgagcttgcgtgaagccatcactagggcgtaagcgagcttttccatttcgatgtatcttgtcttcgccccttgcagtgcttcggagacaaaataaaccggtttctggccagactctgtttcttggacgagggcagcactgaccgccaccggtgaagctgctaagtatagcagcagttcacttcctggtgttgggcttacgagggctggtgggctctgcaagtattgctttaactcggcgaatgctacttggcattctggtgtccaactgaactttcctgcgccccggagggtcttgaagaatggcagacctctttcggccgcttttgagaggaaacggctaagtgccgcaattcggcctacaagcttttgtacttcatgtacacttgacgggggcttcatttgctgaatggcatcgattgtctcggggttcgtatctatgcctctttcggaaactaggaaacccagcaatttgcccgcgcgaacgccgaagacacttctcaggattcagttttatgcccgctgcgcgcaagttgtcgaaggcctcctgcaggtcggacacatgatcaaaagccctacggcttttcacgacaatatcgtcgacataagcttctacatttcgccccagctggttgcaaaggaccttgtataccagtctggcgaaggttgctccggcattccttaggccgaaaggcatcctgaggtgacagaaagtgccgaacggggtgatgaaggctgtcttcgggatgtcaggcggattcatatggatctggtgatagccggaatatgcgtccaggaaactcatgagttcgcacatcccttccttccttcgcatccggtctcgatctggaagagttttgctcttcgtattaaccttagtcattactattaatcagtttgtttggggaaaaaatatttggggggagggggtggttcaaactgccccacgttaggtctgccctttttgtgctttgtatgtatgtatctcaatggcattgtgttggcagttttgctatctgttagatgactgagaactgtataaagaaaagatttagtcgagtttgcgcaccgtcgaatccatgtgggggatgtgtgagatttgtgctctagttgtcctctttagcggcatcctgcggtagggggatggcggcggcggcggcaccagattagggnttcatggtggggggattgggggagggggtctttgggcttatagcgatgactggagcggtggtggccgtggtggggtgttgaggcgacacctcggccttggaagaggatgagggcgagttccggtgatggcactgaggaaagattctcatataggctaagaggggtgggtgggtggttccggaggttcaagctggaggagacaggcgaataaatgggatgagggaggctctcaatggagttgaggagagggcaatgagatagtggtgatcgagggtggcctggtagggagggagtggtggcacggaggggctgaagattgggaggatgaggtggcaaaagaatgagagaaagagtaagggctaagtttgtgaaggctgcacgtctttgaacaatcgtggccatcaaaaagtgagttcagttgaccaatgaatagacaacccctaggttgattcaattgcatttggtaatttttgcgctctaatttgaatgtgaaaaattagtaccatggtgcaaaaaaagagaggaaaatatggttggaacattaaacttgattctcgtagcactggtgaagtggtaaggcaagtgcaggataagttcctcttgcattgcctctgctttgcatatataagtaccagaggtgagggggatgggacgggagtaagttcacccccgagtcaccagccaagtacacccacccaaaatatgtgaaatggtgagagtattgtttacatctgacccacccaaaaatccttgttctatccccctccccccctcgcttcttcactttctttctctttatcctccgtcttcgccctactttgtactatcccacacaggcccctcttgcgctaatttaaccattttgcttatcaaaaccagattagagtctattccaggaaaataatctgaaacgttgggcctccgtgtatacctgagtgtgcataccccactcattatactaaggctgtcccactagccagcag

SEQ ID NO: 91381 - DNA, 663 bp, Oryza sativa
tctacaacaagaacaaaagtagtggaagaaatcaccgatgttcaatttgatgaaactaatggctaccaagaggggcacgagaatttggatgatgtaggtgatgaaggcttgatgagaactatgaagaacatgtctattggagatgtcaaacctattgaagtggaacacaagccatccacctccacttaagatgaaccatctacttccgctacgccaagccaagctcaaattgaagtggaggaggagaaggcacaagatccacctatgccaccaaggatacacaccgctctttccaaggatcactcaattgaccaagtgttgggtgacattagtaagggtgttcaaactcgatctcgtgtcgcttcgatttgtgaacattactcgtttgtttcttgtcttgagccaaaacatgtagatgaatctctttgtgatccggattagatgaatgctatgcatgaagagctcaacaactttgcaagaaacaaggtgtggactttggttgaaagacctagagaccacaatgtcatagggacaaagtggatctttaagaacaaacaagatgagaacgggttggtggtgagaaacaaggcaaggttggtggcacaaggtttcacacaagttgaaggtttggactttggtgaaacttttgcccccgtggcaaga

SEQ ID NO: 91382 - DNA, 797 bp, Oryza sativa
accatatgatcggcttgaattctcggcaatattactgcacctaggacaatcttcaatagatgacagcctcataccttcattccaacaaaatctaaagaactcacaaccccaatgaggatcaaaaccatcatcgtcttcttcatgatgcttctcctgctgcttgtcatacttcttctgacatttgtttataatcttagccgaattcatctgaaaaccccttacacggcccctatcagctgttcggccagctgtatgcaccatattaacaggaaaaggattgccatcaaccttcatcggcctcttagagtcgtcaaacttgattttgcctccttcaatagccgcttggatctgctgcctgaagaccttgcaatcattagtcgtatgagatccagaattatgccacttgcaatatcttttcttgcccaattcttcagccgatgaaattgtgtgaccggcaggaagttgaatctgcttctctcggagtagcaagtcaaaaatcttatcaaccttggttatatcaaagtcatacctttcctctttacctgagctctttacccattggcatggtataacattcttacttcttacccactcggctacagctatctcagaatcatcatcctcatcatccgatccatatatataagggcaaacatgattaacctttctagaatttctcctagcctctgcatacctttgttcatgcaaggctaccttctgtgtaaggtgtgacaagctttcaaagtattcagatgagaacttctccctaattggagcaatcataccctgaaaagcca

SEQ ID NO: 91383 - DNA, 2042 bp, Oryza sativa
tgggagaattggcaagtgggcatatgctttgattgaatatgatttggcttatgaaccattgaaatctataaaaggccaaattgtagttgattttatagtagaccatcatgtagatattgcttatgaagatgaggttttgcttgcttgatgttaacccttggaagatttattttgatggttcttgcaaggaaggtcaaggtctaggtgtagttttattttcacctagtggtgtgtgttttgaggcatcggttcgtttggaatattattgtacaaataatcaagtcgaatacaacgctttattattcggcttacaagtgatggagatgatcggagttacacatgtggaagcatttggtaattcggaattagtggtgcaacaagttgccggagtttacaagtgcttggacgggtcactaaattggtatcttgatcaatgcttggatattattgccaattttgatgattttgctattagacatatttctagacatgataattctagaggaaatgatttagcacaacaagcatctagctataatgtgaaaaggggattatttctgatattggaaaagccagtacttgatttcaaatctttggacgaaattggcaaagttacagaccaggggcggtctgaccggcattgcactaccggtctgaccggtgaccatgggcggtctgactggccggatgccgccggtctgaccggctgacccgagcggtctgaccggtcctgtgtggccggtttgaccggttctggacagggagctacgggggcacgattcattcaaaacggaggccgaattagttgtaaattcagatgtttgtgcccaggaaacagaagaatattggagaattcctttgattagatatttaaaagatcctagccttaaggttgatcggaagattcagcggcaagtgttcaaatatacatggcttgatggagatttatatcgccgaaatatagatgcagtgctattaaagtgcttagatgatgaccaatctaaggttgctatgggagaagttaatgaaggaatttgtggaactcatcaatcggcccataagatgaattggtttcttaggtgagcgaggttctattggctgaggatgattgcagattgtttcaaatattatagggcatgcgaagcttatcaacgatttggcaatgttcaattggcgcccgccgccatgttgaaccctatcatcaaaccatggccgtttcgaggttgggctttggatttcattggtcaaatttatccttcgtcaccaaaggggcataggttcgtgctagttgcaacggattacttcaccaagtgggcataggctctagaatatgactcatatggaggtaattgactttatattgaaacatattgtccatagattcggtatcccacaaacattgactacggatcaaggagcttcttttatgtccaaggaagtgaagagttttgccaaatcttatggtatcaaatagttgatttcttctccttactacgttcaagctaatggacaagccgagtcaagtaataaaacattgctaaagttagtcaaaaagaagattgaggaacacccaaagaagtggcatgaggtgttttctgaagcattatgggcacatagaatatcaaaacgtggtgctactaaagtcactccttttgagttggtttatggtcaagaagccgttttgtctgtctctacagttggaaatattacatgtgttctctacagttgcccgtctcagtggtcaaagctattgacactgcaaggaaaaattgtctctggaggggaaacaatccaaacttacgtaaaagatctcttgcttcatgggatttggtatgcaggccaaaggaaaaaaggtggtttaggagtcatcaacttgagagttcaaaatacaacacttctgcttaaacacctagtcaaatgggttcatttgatctggaatacttattatggctccaaagtgcctcatttggtttggataaaggctctttctagtggagagatatagtggttttgtctaatatcctcaggggaatttcaaaatg

SEQ ID NO: 91384 - DNA, 2834 bp, Oryza sativa
atgtggtgccgtcttagtaaaagaacgtaaacggaacccgcgaactaaaacggtcaaggctcgtcatgcaaaacgaaaccgcggacagagaggggagtgaatcacgcactattcacgaccaaaggtggaggacaaagattattattattaattcaaatcttgacaaataaaattaacaacattaactccgatgctccgaatattcagctttaagtcctgttagtgattttagagccaagagaattcgaaaaaaaattctccctgacaattccgaatattaaatacatttgtaattaagtttttctcctggttaaccaaagtaatttctatagttcgatttattggtgaagtagaactacggaaatagggaaaactataagtgcgacaaacctacccccttaaacggaatctcgtccttgagattcggaagaacttgcgaagagatgcggatgggcggctttcaactcatcttctcttttccatgtcgcctcatcttccaaatgatgactccattgaactctgcagaacttgatcactttattcctggttctcctctcactggtctcaagaatacgcgtaggcttttcaacataagttaaatcctcatgtatctcaattctgtcgggacttgcctgtaactcaagtactcttaagcatttcttcaattgtgacacatgaaacacatcatggatactcgccatattgggtggaagttccaactgatacgcgacttctcctcttcgttcaagaattctatatggtcccacgtaacgtggtgccaattttcccttggtttgaaaactgtgcacccctctgagcggcatgactcgaagataaacatgatctctggcttcaaaactaagctctcggcgacgattgtcagcataactcttctgatgagattgtgcaatcctcaatctctctctgattgctcttaactttttccttagcttcactcaacacttatgttccaaacaactgacgttctcctgtttgatccaaaaacaaaggcatacgatattttcttccatagagggcttcaaacggtgccatctgcaaactggcttgatagctgttattataagagaactctgcatacggcaaattcttatcccaagatccaccaaaatcaagggcgcaaactctcaacatatcctccaaaatctaattcactctttcagtctgaccatcggtctgcggatgataagctgtactggaattcaaacgtgttcccagttcttcttgcaacttctaccagaattttgaagtaaactgacttcctcgatcatatacaattttctttggaacaccatgcaaacaaataatccttgccaaatacaattatgcttatcttttccctgtgtaagtagtgtgcactggcagaaaatgtgccactttcgtaagtcgatccacaattacccagatagaatcatgtcttgacgacattctaggcaatcttgttataaaatccataccaatttcttcccatttccattccggaatttggagaggttgcaacaaacctgctgtgatgttctgctttaactcgctgacacacaccacacatagctacaaattcagctatctctctcttcatactgacccaccaaaatttttccttcgtcttgatacaacttagtactccctggatgaatagaatactgggtctgatgagcttcactaagaatcaaatccttcaattcctcattatcaggcacacacaatctttctcccatccagattgttccttgctcctcttcaggaaaatcgcgggctttaccaacccgcataatcttcttgagttcggctatcttgctccacgagcgtaggttgtgcttccaacatagtaacgaaaccatgttccactatccccaaattcagacgctctaggtcttgaatcaactgactacttactcctttttcgaaacatgttgcattgcaataacttttccgactaaaagtattgtcacacctagagttttcccttcccttaggtttcaaatcattaaaaaatggcttctagaatttgccttggttaacccggagaaaaccccaattaacaatatatttaataatcggagttatcaggtgtaacaaacccaaaatttcaggacttaaaatttcttgtcaaaatagttagaggttaacttctccaatttttagagtcaaaaatttccgttttaatttaggtgatgaccaacttaaatcattgcatgattaaaatttgagaacaaaataaaaccttttcattcccaacattagactagaaatgtcaccaagtatatgagcatacatgtgcataatgcatgcctaggctcgagtctcatgtgcatttggattttggtcttgcttttcataatatgtctcatgagcataaactaaaagggttaaaattactaaacaaaactatagttaatcttgggtgataacatgtggacttaatattaaactcaaatatcgtcttctcagcccaaaagaagtttaatgtaatccctgtaacaatattaggtgcaattatgaagtgggaacacatatacaaagtaaagtaatcctaattctctaaaatattatgtgcaagttaaaatcatggaaaaaattagatagataatgtttagcacaagcaattcactataatattggtacaagttaataactaagtttaataccacaaattaatcagtcaaagcagaaaactaaaaggaatcaaattaaattttaattggctaaagccatacttcatccaaaagtacatttaactgctcataagtgaacatgtaaaataatttattcaaatactagattatttatcatgcctaaatataatttttctagaa

SEQ ID NO: 91385 - DNA, 3318 bp, Oryza sativa
ggcccgaacctgtatacatcgcccgtgtctcgtgtttcttcctagctggcgatctttccacataccgagagagcttgagatttcaccctaagcccccggccgaaccggcaaaggggggcctgtgcggtctcccggtgaggagccacgagctccgtcaatactacttatatataacaatctcatcatcattctcaaacatttagttccaaaagcatttagaaatcacaagattatacccatagtataccatcatgccactgatgatcgtgagcatggctaatcgattagtttttagaactctgcaaagtttgtatagctttacccacatgatatgaacactctagtttgtttcgagtttgcaaggctctaccacattctacacgttgaatgtggtctagaggtcataacgaggcttttacattaagtattatctaaccttgcatgagcacgatacatgtttccccatcctaggcatacttggaatatgacctagaaccgttaagtggcggggccacgctttaaacataatgctgtggtggtgaacatcgaacggaccccaccacgtggcacaataccgtagtattggaaagacatagacgcccattccgtgaggcagaacattacactcgtcccctcacggaaaatacacacgtagggaatttatcatcgtacgatcacacacacatatgggtagtttctataggtagcccagcatacactcgtgaccgctacctctactacaacggcctcccaaatgcaaggctagacaagtgtttaacttaataggccaaggtcccccatagacacatgtggatgtacggtaaacataatgggtgatatgatgtttggtccttaatcgactcaggcgaacactccccctatcggtatgcaactactaccatatgcataccacttgccgcccaagtctaaaaatcacattttatctcatttgatttcacaaataatcagagattcacctctgtccataatattcaaaaaagccttaaaaaaagtatagtaagtgacccataaccatgtttttactttttatttatcactaaccatttgcactttataaacacatagtatagtcatatgagcacaaataaagtactctaattaatcctaaggttcaaaacagtaagggagtgattttaaaaaggggattcatgcatctttaggacataactacaacttatagtttttgaaagtttcgatagttagaaatacacgtgcaactttacaaacaaaacatttagcccgaaaacataggattcaatatgttcaaagtaagggaaaaacttgccttggttgacatatgacctccctaagattaattataattcatctccttcaccggtattgatttcatacttttaaagaaaataatggtaatgataaataccaaaacatgtaaaaattccaaatgctcgaagatgcatgatttgtgcacagttggtaggttctggtctaaaatgaatttaggtgaaataatttctattttatcactttttatttgggatttacgaattttagaagttacatcgatatagtgtagtattggcttaggtagcattatgaaatttttttccatgtgaattttattagatttaacttcacagaggtgtggtggtgttttttctaagactatacatttggttttacaatttttgaagttataatgattttcttatgaattttacaagttataatgtgttgtaggcatataatgttctacatgtacatgtcttggaagttgggagttttatatccagaacatgttacttattgattgagttgagtaaaaggaataatttggttaactaaaccatttttaattcataagtttatggtcttatcatggttcatactttataaactaggggtgctctagtctatgctagcaatacattatattaaccttgaaattattatataagctaagtgcattaagttttggtgggagaggttggagttatattttctctggtccatctaggatccatttggtttatttggagtttggatgtattttatataatttgcttaacttgtagtatgtgattagcatctagtttatcaatttaaagtttagagatatatttagtacggaaggtgccatattctattttactgggatgaagctcacttcttgctggttacatatatacttggttcactccatttggattaaatatgaattttctaaaaaattttacaagttaatgtgtgctctatgttgattatctcctcacattaaagtttaggagattttcatgtactgtgaatgtgtattcttaatttatatcattgaagtgcataatttttgtgattctacagaacttgagttcatctaaaaaggagttgagacaaattttatttgaatttctaatgttcagcttatccaaaactaatcattttgtagataatatttttgtaggcatttgatgtaaagtatgtatactattttattttactttatagaagaaaataagtcggtggatctgtagaaactgatttttattcattttgagttgtaatgaattttctatgcattttataaatttgtgcaagttttatgtgtgattttacttagatgaattttagaggaaacgtttgtacagtgagtgcaagtttttatgccataacattaaagttaatgatttgttgagttcacagaaatttgatttaatccaaaatgagttgttttcaatttgttatggattttgtaaatttacatgtctttctgttgaaaatataaagctttaggcatttcatttagatttttctagaaatatgcaaaaagacccctaaagttcgaagggaatagaccccgcggtcctgtgactgttctctgtgtgagcgaatgtttacaaaatagcacctagagttttgattcttctcagtagaggtccctgcgacctgtacaggggtggcatgaatggccggcggccatatttgggttcgccggtggcgaacggtggccgatatcgccatgtgtccaaaatagaaaatgtatctaaggtctagagcacccgtttgtagttgaatcacggctgatggtgaccaaatttgattgtagcggtggcgcaagcggcggcggctctcggggtgatggtgaatgtgaaggtagagcatcgatctagatgttttgctacatgcatgtgcctctatgggatcctaggatgcttaccgtgcgtccaatgaaacttggcgaggtgttggtagcggtgaccatgcgcagaacggttcggcgacggcggggagcttcgggtgaacggcgacgactcgatgccctcaaagaactgccatacaggt

SEQ ID NO: 91386 - DNA, 605 bp, Oryza sativa
gggggtgtttgctggatgggttgcacaacctgctgccttggtggtgtttgctgaatcggctgctgctgggttggatcaacagtgttttgaggaggcaaaaacatagatgcaacctggtcttgtgttagccgatccacattctgtccagcgtgttgtggctgttctgttatcagcaatcggggattgtccaattggccgggagctgaaggtggtagagtaggtgcgggagccgatgctggtgccatcggctgagccgatggtgcaatagaaggagctgcttgaacgggtggatgagtattggtgatcaaaggccgataatttggaaatactcctccttgcaaataaactggacctgtagcttggtattcagctattgtatcatcgaccatcgacctcatcatatttgacaatgtattgactaacacaccagactgattgatcaaagcattgtgcacggcatagtcaacccgatcttggaagttattgaaaaactcatgtgatgcattacatcctgattaaaatttcctccctgcaacccctgagcaccatcaccttgaactccatgcaccccatcaccatgaaccccatggactccttgagaattg

SEQ ID NO: 91387 - DNA, 764 bp, Oryza sativa
aatatggtgaagaattcaaccatttaaacccatgctatcggaaaactgaacaaactcatcggatatgaaaatcgagccttgatcggttgtaataatttgaggaataccaaaccggtagattatatactcttgaacaaattgaattgcatccccagaatcaactttcttcaaaggaatcacctctacccacttggtaaaataatcagtcgccactaatataaacttatgtcctttactcgatggtggatttatcataccgatcatatcaattccccaacctctaaatggccatggcttaatgataggattcatagccgacgccggtgctcgctgaattgctccaaacttctgacaatcttgacaccctttgtaatatctgaaacaatcttccaacattgtcggccaaaaataccctgcacgccgaagtaaccacttcatcttatgagccgactgatgagtaccacaaattccttcatgaactccaccgattgcaactttagcctgatcggcacttaaacacttaagcaacaccccatcaatcgtccgatagtaaagctcatcgtccaataaagtatacttcaatgccttatatctcaatttcctagaagccgattgagatggattctgtaaatactggtgcacatcatacctccaatcatcggctgtcatagctgcaatttcaatcttaacatctttgatcatcggcttataccccgatgccccctgggccaaatcattagcttcaatattttgttctcgagata

SEQ ID NO: 91388 - DNA, 3098 bp, Oryza sativa
acaccatccaggactaaagatcacgtagtcccgttctacttataaaccgggactaaaaaccatctttagtcctggtttttactgcatccgagactattgtggtttttgttcgaccgggcaaagatgatttctccactagtggagtacgtactcctaggtgtatggaatcatttactcttctgtatacctaggtgtatgtgtatgtactccctcttccttgttggatatccattagttgataatgaatagttagattaaaaagaaataaataatattattttttcaaatttcttcatgtccatccgtaggtgttctattttttcaaatttttgcatgcatgcacactgccgaggaatgggcacgtttaaaatttgcatagcacttcatacagctttttctagatcatactatgtaccaccatacattggctattggtagtatatactttttttttctatatcggtactatatttcacttttttctggatcagtagtatataccactatttctagatcagtagtcactggtggagaaaccctttgtagtcccggttcgtaacccccctttagtcccggtttccaaaccgggagtaccaatccgggactaaagatcgctatctttagtcccgggtgaaataaccgggagtaaagatcgatctttagtcccggttggtgttaccaaccgggactaaagatcgagctgaccttttttttttgcatggccctgttgctgcatggtttatatatatatatatatatatatatatatatatatataaaccatgtatatatatgtttcaatacatatatatgcatacatatatatatatatgtatatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtagtcgctgctagctcagaagctaaggaccggtgaattgtgtttccgtcgtagtagaattcacccttgggatcaaggatttcttcgttgatgaatcccatgagttgttattgaaccgctgcgataaattccttgtgtgtggtcaggttatccctcatgcgaataaactatatgaatgtatgaaattgattagtaattaaacaagaaatcgttacgtaatgaaattttgaatttatttgtacgtacatcgagctctcttgtggtgataatttggtctgcaaggcagtggcaatactcacacacgtagtagccgcacaagttagttccctgcttttgctttgcgcattacaaataaatgacaaattaacggcgtgagatctaattaatatacagttgtatgtattaatttgaatcggagaaatataaatgtagagcatgtgtactcacaggaaatttgaacctccgcctaagtctttctctccagttgccgcggaccaaatgacggaaccgataccaagccctacatggagtttaaagatatgattcgtagtagaaataattaacataacaagaatttcttaattaacagagaaacttatgccagtacctgtctataagttcgaaaaccttgtcaaacgtagactcttttttatccattgagtcatatacattgacggtgcaggccgacaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtacggtaacagtatgaacgtcttgtaatgctgcgccttcaggagatggacgagattgtcctctgtttcctgcggatattggtcgagcattccaacgtttactctccgagggtcgatgaatccagtatcgaaaaccctccgccgtcgggccctttgaatctccattctacaacgataaaagggagtattttattttatatagtctacttatatacaaggacctaattaattaaaggagacatagtaattaagaattataattgaacaatatacttacaaagtccagcaactcataatagagacatcgagggcgtccagctggtatacttcgtagattcccttgaaattgatccagagaatatcatctccttgcaagaagtccgggtccctgatcctcgctccgatcatctctctaccggtggcgctcatctccacgtacagctgatggaacttgtacatttgtgtgggtagggactgcaccagctcaggcttgacaagcggtttaccgagttcgtacatgtatttcaattccgccttttctattggttcaactcctagcaattgatccgtagttagaccggtgtcaataataaattcttctatcgtcatgtctttcccggtcaccaacggctcgatctcctggtttggttgctctccaagctgagggactggtttggactttccagaagatgctttcttcagcgttcgctcatagtccgatagcttgatggcctccttgacaagtgcagacatacccctgaagaagttcatgacactggggtctataggaatcttcttttctggacttcgaggcttgaattgtctcttgacttctgacgcaacgtaagcgtcaagctcctcttgcgtgcaatcgtaccccgggtccttgttcttggcggcgtcaacttttgccttcttcgttgcccttgtgtgggcaggcggtggagctgggggggcctttgactttgaaggtgccggaagaggagcttgcggaggagtaggtgtaggagcacgaggaggagtcggtgcaggatcctgaggaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcttgtgtctcgta

SEQ ID NO: 91389 - DNA, 751 bp, Oryza sativa
ggccgagccggcccaagagggggagagggggaaaattttaaggtttttctttttataaaatcattttaattttgtttatttcttcttaattattatttgtgctctgaaaattccactaaaatttatttacacattttaggaaatatacaaaaatcctctaagccttgtttaacttttactttgcacattttaatttttggaggctttcacacggattttaattattctaggcataatttaaaggttatattttagggtcgttttgggacgtgacaaacctacccccttaaacggaatctcgacaccgagatttggaagaactggcgaagagatcgggatgggctgccttcagctcgtcttcacattcccaagtagcttcttccttagcgtggttgctccattggaccttgcaaaaacggattacccggttcctggtccggcgctccatggtgtccaggattttcactggcctctccacgtaggtcaagtcttcgtgaacttcaatttgctctgaatcggcctgctcggatggcactcgaagtcatttcttgagttgcgacacatggaacacatcatgcacgttgcccaaggatgcgggcagctccaactggtaagcgacttctccacgtcgagcaacgatacggaaaggacccacgaaccgaggtgcgagcttccctttcgtctgaaacctgtgtacgccccgcaatggcgtgacccgaaggtacacaaaatcgtccactgcgaattctag

SEQ ID NO: 91390 - DNA, 987 bp, Oryza sativa
cgaaggaggctaatactgataattcaaattgccccctggtaattctggaagttcgactgaatattgcgcatcagatgttcgagaacaacttgaggtatcatcgtttgatctggctgcacataatgaactaaatgcactgggacaacttgattcacagcatgctgccctaggtgattgttaggtgttgcaaatccagtcgatgcattcatcaaaccttgttgttgaataggctgaataacctgttgccttaatggcgtttgctgaatcggctgcaaaacctattgtcttggtggcgtctgctgaattggctgcacaacctgttggattgggggtgtttgttgaaccagctgcacaacctgcagccttggcggtgtttgctgaatcggctgctgctggactgggtcaacggtaggttgaggtggtaaaaacatagctgcaacctgatcttacgttagccgattcacattctgcccactatgctgtggttgttctctcaccaacaaccaaggattgattaattgacctggagccgacgaaggtgcagcgggtgcaggagccgatactggtgccgtcggctgagtcgatggtgcgttaggaggaactgattgaacggcttgttgattatcagtgattaagggccgataatttgggaaagtacctccttgaagataaactggtcccgtagtctgatattcagctattgaaccatcaaccattgacttcaccatgtttgacaaagtattgactaatatcccaaattgattgatcaaaacatgatgtatggcatagtcgtcctgatcctggaagttgttaaactgtagctgtgccgcgttaccatcttggttaagattaccaccttgaaatccctgagaaccatcaccttgaactccttaagagccaatgccctgaactccttgagagccatcaccttggtctccttgaaaaccatctggcagcacctttattcactcggttgagctgagccat

SEQ ID NO: 91391 - DNA, 962 bp, Oryza sativa
ctccacaccatcagcttcactgtagaactcttcctctaatgaatgattgcaaggtgagtatatgacatactcagcaagtcacgcagcaaatatgcaagtgcacaggataacaaaggatggcataatagggtttcatttgcataaacaacatttaataaacatttcagaatttaattaaacagttgagtaataattaaacaatatcaatctaacgctatacaacataccctgttgtataggcccaacctttctgaacaaccatacccggctgtacagatctatctccaaaccaggaatataccattccaaaccaggagctaaacaaattattaccagttatagcatctgttatcatgatgagaggtgtgagactaatcacgaaagacattgttagaccagcccataaccgcgggcacggctattcgaatagttttactctggccagaggtgtaccactgtacccacaagacacagccccacaacatgtcactatgtgcctcaataccaccacggtacctcggaaaggagctgtgacaatacccctcgcacaacacaatccaccacagggcacctttcctggatcataatcacccccttataaacaaggcatggactcccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaagtaattaattaaccaatcacgattgaccatcgtgagctatcattaagccatcattaaataatagtgaatcataagttatcccaatcgctgcactgcacgggtctagcttttttccccacggcatgcaacc

SEQ ID NO: 91392 - DNA, 1867 bp, Oryza sativa
cttcagcttctctcaggatatcagtcccgaacacttggctttccctgacttggtcccacaatagtggtgttcggcatttgcggccatacaacgcttcataaggtgccatttgtatgctggcttggtagctgttattgtaggagaactcggcaatggggagactcttatcccaggtcttccctaaatctagaacacaggcacggagcatatcttctaggatctgatttagacgctcggtctgtccatcggtttgcgggtgatacgcggtgctgaaatttaatcgggtacccaactcttcttggagcttcgtccagaaatgagaggtgaactggcttcccctatcagatacaattttcttaggaacgccatggagactcacgatcctagcgaagtagagttcggctagtttgttcccttcataggtggtcttcacaggaataaatcgagctaccttggttagtcgatccatgactacccatatagaatcatacccgccttgggtttttggaagtccggtgatgaaatccatcctaatttcatcccatttccattctggtacttgtagaggttggagaagtccggccggtcgttggtgctctgccttaacacgctggcacacatcacaaagggccacgaactctgcaatttcccgcttcatactaacccaccagtatttctctttcaagtctaagtacatcttcgtactgccagggtggatggaataaggactttcgtgagcttcctaaagtattagctgtttaagttccttgtcgtccagaacgcatacacgatttccgttccatagggttccatgttcatcttctgtgaaaccagcggctttaccctgtttcatattcttgaggatcccatgcatatctggatcattcttctgagcatcgcggatttgatcgagcaaggtaggcttggcttccagaatagccaagaatccatggctaacgatgcttaggtttagggcttccatctgttgattaagttccggtggaatgccacggacgccaagagtgttgcaacggctttttcgactcagcgcgtctgtgaccacgttggccttaccagggtgatagtggattgccacatcataatgcttgatgagctctaaccatcttctctgccgaagattcagatccgactgagtgaagatgtatttcaaactcttatgatcagtatatatttcatagtgatttccaatgagatagtgccgccagatctttagagcatgaaccacagtggctaactccaaatcatgggtagggtagttgccttcatagggccgtagctggcgtgaggcataggctaccacatgaccttcctgcatgagcacgcaccccaatccttggcgcgaagcgtcacagtacaccaggaagtccttgcgagtgtccggtaagattaacactggcgaggaaaccagcttttctttgagagtttggaatgccttctcgcattgcaggctccacacaaatttttcctccttcttcagcaactgtgtcatgggtcgagctattttggagaagttctcgatgaatcttcggtagtatcctgccaaacccaaaaaattgcggacttgagtgactgtcttgggttgcttccagtcagtgaaggcggtcactatttcggggtccacaacaactcctttagcggatatcatgtgccctaagaatttgacttcggacaaccagaactcacacttgataagcttggcatacaattgatgttcccgcaactttcccaacaccagacagagatgctgctgatggtcttcctctgattgtgagtacaccaggatgtcgtcaataaagaccacaacaaacttatccaaagtattccatgaacactttgttcattaagt

SEQ ID NO: 91393 - DNA, 1882 bp, Oryza sativa
cccttttctttcaactcttccaactgtttcttgacttcggccagttcatttgttgccatacggtagggtcgcttgtacagaggagtggttcctggagcaagatctatccggaactcaatctctcgcttgggcggcataccgggtagttcttccggaaacacatctccgaactctctaacgatgggggtttccgacagtcctatctgatgaagttctgagctgccgacagaggttgagggtgcaaagaaaacaaccggttgttccggtcctcggtacagagtgacagtgcgtcttacgcaatccactactccttggaattgagccaaccaattcatcccgaggatcacatccaagttcttggtgtctagaagaatcagatccgagggaaaaggaattccctggatttctataggaacggcagggctataatactttgctgtcataacccctccaggggtggtgatgagcagagggttcctaagcctttctacccccaactgatttctccccacgaatggcacagatataaacgagtgggaagctccagagtcgaacaaaatggtagcaggaatagaatgaatgaggaacgtactcacgatgacgtccggagtcgtcagcacatcctcggcagtcacgtggttcacacgacccggaatgacatccttaccaccgttgttggggcggggaggcgcttggccttgctggcgcctcggctttgggcatttatccgcaaagtgcccgggctcaaagcaattgaagcacagacgttgttgtccttgagcatccctgcggccttgtccaggctgcacggctggtgcaggaggacggggcgcacgagtcccttgctgactctgctgttgctgcggctgtgagacgcgcaccacgaattgaggtcggggcgcggagcgaggttgctgctgctgctgctgcgaggaggatccccctgggtagggattagtgtagcggaccctttggttagccccctgttgattgcggaaattcgccaagcgacgcttgtgcgactccagttccttgtgcttggcttccaagcggatgctcttgtccaccaaacgctggaaatccggataatccccggagaccagacgcacggacagctcagggtccattcctgccaagaacttctcctgcttctcctcatcttcatgaacatcttctggggcgtaccgggccaggttgttaaactcatgcaaatactccatcacagagcggttgccttgcttcaactctcggaatttccttttcttaagggccatgactccggcgggcacatgggtcctccggaaagctgcggtgaagcgggcccaggtaataggctgcccctctagctgtgtagcctggaagtggtcccaccatagagatgcgggcccctgcagttgatgggcggcgaagatgactttctcctcatcgttgcactgcacggtatccaactttttccccacggcatgcaaccaatccaaggcatccacggggttattggagctagagaaggtaggcggacggatgcggaggaactcggcaagtttagaatgttgcgggggtggtggtggaggtggagcattatgctgtggcggaatttggatgtgatggataaaagcagccatcatgttggcctgctgggcgaggatttgggtgaggatggagttggtgtctggtggtggtggtggaggcgggggaggaggtggaggtgggctgtcatggttgttgtggttgctgccttcggggtgactgccttcaccggtagcagcacttctcctggttgtcaccatctgaaaatcccacacagaaccggcaaacagagagagctggttattaaaactaaccactcatgactaccataattcttgaatttattactgctatt

SEQ ID NO: 91394 - DNA, 1232 bp, Oryza sativa
ttggcaccggaacagaggaaccttgagaggaccatagtcaagttcccatatgtcctcgatggcaccgtaatacgtggcagttgttccatcgtgtcctatggcatcgacacgaacagcgctgttttggttcgtgctcttcatgtcttgggctctcgtgtagaatgtgtacccattgatctcatatctctggaatgtcgcgatcgacccagacggtccccttgccaggaaggcaagtagttggttgatcgactcgttacccatgagatgttgtcgtagccacgtggggaaagtatcaatgtgatgccgtgtaatccatgcatcggacttaccgatgttcctggcgcgaactagagccaagtgctcctcgatgtaaagagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctatgcaaaattcgatgacctctctgttccataaccttggcgatgcttgcctttggacgagcacggttacgaacatacttcttcagaatgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctacgaaattgcgttcatgaatgcacatagctttgttgttgttgcccggacattgtctggaaggataccccttattacaactggtagcagttgtgtcatcaacacgtgacagtcatgagactttaggtttgtgaacttcttctccttcgtgcttattattggcttgatatttgtggagtatccagacggtacctttatgctctccaagcattcaaacatactttccttatctgccttgctaagagtgtagctggctggactcaagtaatggcttcctttctcctttggttccgggtgaaggtcgccgcattgttccatatgcttcagatcattacgtgcttccagtgtatctttcgactttccgtatacacctaggaagccaagaaggtttacgcaaaggttcttagtgaggtgc

SEQ ID NO: 91395 - DNA, 732 bp, Oryza sativa
gagccagcctggtttcccccatctagctcttggtctagttgagaaagttctcatcaagtagggtgccatggcaatagaagacaaattggacttgctgttgaggcggatagaggagtacgagctgaggcgagaggaggctgatcggagaactagagctgatatacggtctctcatagatgtggttgaagcatgcacaccggaagttgggaagaaggcaaaagacttgccagcgtcaattaagaaagagcagtcaaaggtgacgcccaccacatgtttgacgaaatgctctagtcccgacatcgagcccaaactcacactggttgcgatggtcaaatgtgccgccactgccatggcctccatgaagttggtagctgataatggtgcaaccagcaccaccaaaattcccaccactgactattccaaggagacgcacgccaagtgttcgatgttgggcttcgatgtcaagtgggacgccaacaaagccgacatcgcgttcctgaccaagacggttgtacttgagaccgttccagcatccattgcatcattgagcgccttctcaccaaggatgatcgccgacatcaagcattacacattgatgcccaccaggtattcagcgaaatgttctgggtctaacaactctcaagttgtgtcttatttgtccttcttaagcaccccagtgttagtggaatcagttgaaggacatttgttagttccatggcaactgctgttgca

SEQ ID NO: 91396 - DNA, 2985 bp, Oryza sativa
ctggatgtcattcttggaatggattggttgaccagaaacaagggagtgattgactgcgcaagccgcaccatcaccctaaccaacgacaaaggggagaagatcaccttccgttccccagcgtcgcagaagtccgtagcgagtctgaatcaggctgctattgagggtcagacagaaacagtggagaaaagtcccaggaagttggaggatattcctatagtacaagagtatcctgaggtgttcccagaagacctcactacaatgccaccgaagagagaaatcgagttccgaattgatctggcacccgggactgctccaatttacaagaggccgtacagaatggcagctaatgagctagcagaggtcaagaagcaggttgacgaacagctgcagaaagggtacatccgaccgagtacttcaccttggggtgctccggtgatctttgtggagaagaaagacaggaccaagaggatgtgcgtggattatcgcgcccttaatgaggtcacaatcaagaacaaatatccgttgcccagaattgatgacctgtttgatcagctaaaaggagctaaggtgttttccaagatagacctgcgatcaggctatcatcagttgagaattcgggaagaggatattcccaagacagccttcatcactcggtatgggttgtttgagtgcacggttatgtcatttggactcaccaatgcaccggctttcttcatgaacttgatgaacaaagtgtttatggagtttcttgacaagtttgtcgtggtattcattgacgacatacttatttattcaaaatcagaagaggaacatgagcaacatcttcgtctggtacttgagaaattgaaggagcaccagttatatgccaagtttagcaagtgtgacttctggttatcggaggtcaaatttctgggtcacgtcatttctgctcaaggcgtggtagtggatccatcaaatgtggaatcagttacaaagtggaccccaccaaagacagtttctcagatccagagttttcttggacttgcgggctattaccatcggttcatcgaaaatttctctaagattgccaggcccatgacacagttgctaaagaaagatgaaaaattcaaatggtcagctgagtgcaaccaaagttttgaagaactcaagaagaagttagtctccgcaccagttctaattctgccagatcagacaaaagacttccaagtctactgtgatgcatctcgccaagggttgggatgtgtgttgatgcaagaaggcagagtggtcgcatacgcttcgcgacagttgcgtccacacgagaccaattatcccactcatgaccttgagttggcagcagtggttcatgctctgaaaatctggcggcactatcttattggcaaccgctgtgaagtttacactgatcataagagcctgaagtacatcttcacccagcccgacttaaatctccggcaacgaagatggctggagttgattaaagattatgacatggggatacactatcatccaggcaaagcaaatgtggtagcagatgctttgagcagaaaaagctattgcaatgccttatgcaccgaaggcatgtgtgacaaattgcagcaagatcttgagcacctaaatttgggcatcgtggaacacgggtacgttgctgccctagaggcacggcctacgctcgtggatcaagtcagagcagctcaggtaaatgatcctgaaatagctgagctaaaaaagaatatgagggtcggaaaagcccgagagttccatgaagatgagcatggcacaatctggttgggagaaagattgtgtgtgcctgacgacaaagaactgaaggatctcatactcacagaagctcatcaaacccagtattcaattcatcccggcagtactaaaatgtaccaagacctcaaagagaaattctggtgggctagcatgagaagagaaatagccgaattcgtcgcactctgcgatgtttgtcagcgagtcaaagcagaacatcagaggcccgcaggactgctacaaccccttcagatcccggaatggaaatgggaagaaatcggaatggatttcataacaggtttgcccagaacatcgtcagggcacgattaatctgggtggtcgtggatcgactcaccaaagttgctcattttattccagtacacactacctatactgggaaaaggttggcagagctttatctttcaagaatcatgtgtttgcatggggtacctaagaagattgtatctgatcaaggaagtcaattcacttcaaagttttggcagaaactgcaagaagaattggggactcgtttgaatttcagcacggcttatcatccacaaacagatggtcagaccgagcgagtaaatcaaatcttggaagatatgttgagagcttgtgcacttgactttggtggagcctgggataaaagtctaccgtatgcggaattctcttacaacaacagctatcagtccagtttgcaaatggcaccgtttgaagcattgtacggacgaaagtgccgcacaccacttttctgggatcaaacaggtgagcgccaactgtttgggacagaagtgttaaccgaagcagaggagaaagtcaggaccgtcagggaaagactgcgaatcgcccagtctcggcaaaagagttatgctgataaccgccgaagagagcttactttcgaagcaggggattatgtgtaccttcgtgtcactccgcttcggggagtacaccgcttccaaaccaaaggcaaattggcaccacgctttgtgggaccatacaggatcttggaacgcagaggtgaagtcgcttaccagcttgagctcccatctaatatggttggaatccacgatgtgtttcatgtatctcaattgaagaagtgtttgagggtacctgaggaacaagctagctcagagcacattgacatccaggaagatctgacttatgtggagatgccgatttgtatcctcgagactagtgagagaaggaccagaa

SEQ ID NO: 91397 - DNA, 567 bp, Oryza sativa
gccggcggcggccatggcgctcatcaccccagctagcggcgggggcggcggcggaggagacaaagccccaccgtccgcctccgacccgagcctcgggttcctcactaagcgcgacacggaggtgaagctgccccggggcgacgcgggtgaagaacaagacccccgcctcggtccagatcaccgcagagcagatcctccgggaggcgcgggagcggcaggagcccgagatccgcccgcccaagcagaagatcaccgactcaatcgagctctccgagtaccgcctccgccgccgcaaagagttcgaggacgtcatccgccgcgtccgatggaacgtcaacgcctgggtcaagtacgccaagtgggaggagcagcaacgggacttcgcccgcgcgcgctccgtctacgagcgcgccctcgacgtcgcccaccgcgaccatacgctctggctcaagtacgcagagttcgagatgcgcaacaggttcgtcaatcatgcccgcaacgtctgggaccgcgccgtttctctcctaccccgggtggaccagctgtggtacaagtacatccacatgg

SEQ ID NO: 91398 - DNA, 574 bp, Oryza sativa
attataacaagaaagtggtgcccaagactttttcggaaggtgaacttgtatggaagttgattttgccgattggttctcgggataacaaatttggcaagtggtcaccgaactaggaaggaccgttccaaatctataaggttgtgtctaagggagcttacatgttgcaaggactcgatggagaagtctatggacgagcgctaaatggcaagtacctgaagaaatattacccaagtgtttgggttaatgcatgatcagctgatgttgccgatacatgatagccgatgtgtttgcatcgtcttgagatggctgatactgttatatcgcccttagttgtttttcatattgtaatcggttatggtttgccgatgtacaatggccgatattgttatatcgcccttagttgtttttcatattctaatcggttatggtttgccgatgtacaatggctgatattgctatatcgcccttagccatttttataattttatcaatgcttgtgacattgtaaaattaggagggcacatatatatgaaaaattacaaatttttgaatcggcataaagattggcgagatg

SEQ ID NO: 91399 - DNA, 4405 bp, Oryza sativa
ctatgtactccactttgaactatttatcattatagatgtacggatttgatcaccatttatatatttaatcaatattgtttagtttgaatcagtaatttttatctttgtgtcactttacaccacccttacttttttatccatctacatccaatttatcatatgtcaaacaaatagtctacatacaatttatcatatgtcaatttatccatctaccacccttagctcttttaactatttcgccctcaccgcgtgaacttgcgcggtaacgcgcgatttcgcacttccattatgtaaaaatagtatatttctataattttcttctaaacgtgtatatttatgtaaaaacagtaaaaaaaaagagtatattttttattttttttcctttattggatgggttcagaaaatctgatcttggttaggctcaggccctgttccaaataactaattgagcttaactacttctcattttctgttgatgcgctttttaaacagttaaactttatatttcatgaaaaaagttatatataaaatgttctttaaaaataaataaattaatttttaaaattttaataattaatactcacttagtcatatgctaatcgtatttctcattttatgggtagctaattagtaaaaacttatagacttaaaataacgcggtctttagttttatcggagaaataggaactagggtcccatcactagctactcgaggcacgttcacctccagccacggtccctcacgggctatgctcggggcacttctttcattaatcgcgcccccgtgggttgggctttcacacatccgctctcgggtgcggtccttcatgggctgtgcttggggcacttctctcctctggcgtggccctctatgggctatactcggggcaaccaactctcgcaagcttagagacatctaagacaaaatcaaaaatcacacagcctaccaatgacgtggcaggaatggcggcgcttgtagcgcacgtctccctagagaaaaaagacatgcaacgtggcaccctctcagtatgcattccatgtgccctcctttgccctcgaaggctggcagctaggccagtggacaactcagatgaagaaacctttgacttcttcgctccactcgtcaattgataggtgaaacagtcacctctatcccaatctcacatgtatgtattggcattttggactcccttggtatataaaaggaggatacataccaccaaaaaggggggttcaactagttcgaatagcttagctctcgttgaagcaagttagcttccacccttagactccactcattgtaactcattcccgatcatccatagtccatatacaagaatagggtgttacacatctgtgcccgatcctgtataatcccttatgtttatcactctcgtgatttggatcagggcttgactcgctacttggcccatggctgaatctccaagggcaagtactcacttcttgactagatgagttccgcactccgataagtttgaaacagattattgagctcattgttgctgcagattatctacttgattatatggtatattaaatattttaataaatagacttaacaaatataagaaagtcttttgaaaaagattaatttttccaaacatagaataaatcaacggtctagtaaataatccgaaaagaaccaagtgttccccttttttttaaaaaaaaagaaactaagccttgaaatgttggatagtgaaagcgaagggtaaggaaatgagaagacggagttggttgcatgttcaaactgaaatatcttggtatggacaaaattgaaatatccatttgaaaggtccccaaatgaaatatcagcactgacttcatgatgaaaatgatcggcaccgacgccgacgttactctgttcaatttggatcgacttgaacctgactggacgctagctggaccaaattgatggcgacacactgattttgtccactttgccgtttgatgccacagcccaattaagcgttcggaacgatggcacgtacagtagtactagtagtaaaaaagggaacggttcagatgagcgtctcagataaacttgcgggttttattcatataaaagcagtataactttgttaggtacgcaatcctcttcagagttaaatacctccatgttgatgctgactgtgtggaattctagagtgacgagtttttttttttcttttgggtccatgggaatgtgagatgcatgcaacagcaatgaggtggcactcacgttctctaagctgggatcttctgaaaccgggtggtcagcatgaagctaattagcgagagtaatcacatgaagctaagtcacacatccctcccccccccccttagtacgttgagactacttcatagaatgtttatcatttgtaaataaaattaatttttttagataatgagaatatgaattacctttctgcttgtttgtgaccatgcttgcttgatattccatccttgataacctgggatattaatttaactagcttgtatcacttgtattgacctagctagaattgtgatatgtttagccatgcttaattacctctggcttgtgcagatactccactggtggagaaatgctttttagtcacggttcgcaactccttgtaatcccggttttcaaaccgggactaccaatccgggactaaagatcgcccggttcaaatacccgggactaaaaatatctttattcccggttattaacactaaccgggactaaagagatggttgcggcagtgagatgatcccctttttcttttttttttcttttttattttctctcaaatcaagtggtatacatatcccaaatcaaacccccaatccacaaatcgaagtaacatatcaaatctacatgacaaatcaaagttacttatacacacaaataaatacatcacaatatcctaagaaattactcaaatacatcacagatccaaacaatgaatcacaaatttgtaacttctcagttaaatacactcagtgaatcatcacaaattaaaaaaaaaatgccgctgccgccgtcgatcgccacgaacgacgggcgcggccccgccgcccgccgcccgccgccgccgcggccccgccgcccaccacgcccgccgccgcgcgcggccctgccgccctccgtcgggcgccgtagcgcagggccccgccgccggccggcccgccggatgggaaggggaggccggccgggaaggggaggaggaaggggagagaagggggaggagaggaggaaggggaggagttggagaagagagttagagaggatagatctgaggagagggggtgagattcaatctgttaaattgtaactgtggaggagaggataagggatagggattatatactacgtgtttaattttagtcccggttggtagtaccaaccgtgattaaagtggtgatctttagtcccggttattgacaccaaccgggacaagatcctcgaccccctgacatacctctgacaggggatgaatcgggactaaagatcaaaatttttataaccgggactaaaaataatttttactcccggttctttttgatccgggactattgtggattttactggaccgaccaaagatggtttctccactagtgtctcggatgtcacttgtgtggaactgtgaacgaccagatactctacttacgcattctgttgatcaaagaatttttcctgccggtaaaagccgcaatactcttcctgcttgtgaccctcgatcggaagcagactccggagcgacgtaacaactgaaaataagagcaaatttcgcagccataagatcaccaatacatgcactcactgagttgtactgttatttggcaatcagtaatttgtcctagttcagcattgccgcttctgcactgtcagcaaaaatgcgaacggatgtcaggaccgataatcagtaacagtcagcaattggcaaaaaatgaagggacaaaaagatctccagtggacagaaatgaaaggaggcccatggtcatggatgatgaacttttgtaggggtaggaaaaagtccaatttcacaccctcaaatatagatcggatcgaagcaaaatcgggtagtaaccactactcaaagtattaaaaccgtgaaaaatgactctcaacaatattaatggtggtttcgctgacatgacacgttcacttggtccaaatgtactgacgtggcatctatatgattatataaaaaataactaaatacctacatgacctatatgtcagcaagtacatctcattgtctcggccatatcgtcgtcgtcctctccgacaggagttcagcaccgcttctgctagacactaggcggtggcaccagtgctgaaccggagctcagggaggccgggagtaggatgtaccctgactcctttgcgcgtgcatgagagtagtcatcgggggat

SEQ ID NO: 91400 - DNA, 2272 bp, Oryza sativa
cgtgggcggatcaggagcagaggaacggcgggggccgcggcggcggcggcggggaggcgaagcggtcggagatctacacgtacgaggccgggtggcacatctacggcatgaactggagcgtgcggcgcgacaagaagtaccggctcgccatcgccagcctgctcgagcagcacaacaaccacgtccaggtggtccagctcgacgagtcctccggcgacatcgcccccgtcctcaccttcgaccacccctaccctcccaccaagaccatgttcgtcccggacccgcactccgtccgccccgacctcctcgccacctccgccgaccacctccgcatctggcgcatcccctccccggacgaggccgccgccgccgccgccgccagctccaactccggctccgtccgctgcaacggcaccgcctcgcccgacgtcgagctgcgctgcgagctcaacggcaaccgcaacagcgactactgcggcccgctcacctccttcgactggaacgacgccgacccccgccgcatcgggacctcctccatcgacaccacctgcaccatctgggacgtcgagcgggaggccgtcgacacccagctcattgcccatgacaaggaggtctacgacatcgcctggggcggtgccggcgtctttgcatccgtctccgccgacggctccgttcgcgtgtttgatctccgggacaaggagcattccacaattatctacgagtccggttctggcggcagctccaattcggcaggtgcagatggcggcgctgcctcgccaacaccgctggttaggttagggtggaacaagcaggaccctaggtacatggcaaccatcatcatggatagccccaaggtggtcgtgcttgatatccgctacccaacactaccggtggtcgagctccaccgccaccattcgcccgtcaacgccatagcatgggcgccacactcctcttgtcacatttgcacagctggggatgactcgcaggcccttatatgggacctgtcatccatgggcactgggagcaacaatggtggcaatggaaatggcaatgctgcagctgctgcggcagctgagggcggtcttgatcccatattggcgtacactgctggggcagagattgagcagctccaatggtcagcgacccagcctgactgggtcgctattgcattctccactaaactgcagatcctcagggtctgatttctttgttccaaccctgttagtaaggggacatcgacaagaacaaagaaggccagcatggataatgaggttaggtgatcagaggacattgttacttcagtcttatttattttaagttgtgcacagatgatatgcgcgctgagttggttctagtgatataataaattgtttcctacctagaagctggaattggcaatgaactgagctgttagagtaattagctgctctaggtttagtattgatgttaatgtggattgtagttatgtttgttgcttgttctcgaatgtccagctccagtagggcgtaggttcacctcttgacttccatgttgtattttgcactcgccgtatatgcacttataagttataagcttgtgcgtgttattttgtttcagatctacggtgtttctcatgttgtgctgttgaagtagaactaaatgcatgaaacttgacatgctatcaaagccaagtgttctcgctatcaccctggatggcacacttttaagaagatccttgtcatgtggtgaacatattggtactttcaatttagtatgtgcaatcttcagagaccagtagttgcattgttatgtcttccattggttcacttcaattcatatcctatggcctcattgtttgtcgttttattaggtagagttttagccttttagggtccggtactatggtttgctggtgtgggtggtttgataatctactgtagcttgtaacagttattgatgccatgtggtcaaatagaatcggcctttttctggctttctgtaacagttgtagctgcagcaaatgaatagatgccctgagttatccttcaaaacataaaataaaatgaaaccttgtgtcttctgtgaatagtgccacaacaataaggccttggtgcttatgggtgcatctttattaagtatcatctttggctttgttttagttctcttctagtggtgtgtttctacttagttgtattctttcttttgtgaatatgatagttgcacatcttccattggacaagttggaaaacaactgagatgtgtgtgaagtcacttagagacaaaatgtttcccc

SEQ ID NO: 91401 - DNA, 2470 bp, Oryza sativa
ggggaggtgttcgtggatgtggataagagaggtcagtgcgggctactggccgtgccaaatttaccagttacggagtgattaattttgttaagaccaaccgttctccaattgagcagtaaatttttcgaccattagtaatgaccattaattgcaaagtgagctgcattaatttcaccattgtaatctcctgcaatttatgtctatgaaatgagcgttgcaaacttgatatagcaatatggcattatcttgcatttggattccttttatgggtgattaaggttgcactgatctgatcttactattatctgttgattgacaaataagtagatgatagtttaagattgctcagtagtgtggtaaactttggttctgggtttagtaatcatgattacactggccctgccttttgcaagattgggcacttaaacaagtatgctgcatttcttattttattttttatagcatattcactatgttaaatactgttcatcagaaactgaattgattctgaactaatcagattgtcataattccccccatacaggcttaggtagtgaaacgaggaacccttaattagtctgcatttgccattcttactgcaagcaagattatgaaaactagaattgttttatacttgacctggcaatgtcgcatttatttatttattttttctactgcacgttaaacattcaatacaataagcaggagttgtgaatatattgttgctagcttgctgttgcagggcaggatgctgaggaaccgcgggtagctagcgaacatgagaaagaaaaagcactgagtacagctaacagcatcttctctgcgttgaaccgctacagcaaactcactggtctagtggtctgcgggaagagatgtgattctgttggcatcccagcactcagttcttcattaaatctttctcttggtagaatcaaacaaagctttgtattgtgagttatttgcataatctgtttgtattgttgttgttttgacgtatatctcgtgttcaaaataaatatatgcatttcattccctctttattaattgagagcagttttattttgaaatgattcacaggactgacccccatttgcctgacatgccgatcatctatgctagtgatgcttttctatcactaacaggtacttgaattttgttttctagtatataatatgcattatacagatatttgtgatgtaatacatttcagtgccatgttctatgactaatactagtattgtactcccttctgttattgtgaactgtgatgcccttggctcagtgagtctgtgaagctgattgtgatatatttatatttttgtttttgctactacaaactcaaattcttcccatgtatgttgggatgtttgatcttacaagacaaaaaaaatttagttcctatgtaccagacttaatcatggcgtacccttgagttgagacgggcatgagtgaattagtgatgttatgcattggttaggaatcattgaatcctggtatgctcttcagttaagaggggcatgattgctaatatgcggatatgccaccacacctctctctctctctctgaatcttcatcttgaaaatattatttgtatttcgattgcatctccttttttatgctaatatcatttacattcaaggcttctgttctgaaaatttttatcatccaggttactcaagagaagaaatcttgggctgtaactgcagattcttgaatggtcctggcactagtgtggaggttttagaacaggtgcgcaccaggattatatagcttgtcagactgcatgtactttatgaaatattctcaatttctttacattccttattgatttgggtgtgtagataaatcaacatatttgttctgagcaagcttgcacggttcatctactaaactacaggttcgcatctacacaaaatagtgtatagcaatttgcaggtacaatttatgccttgaacataacagaacattgtgttattgatactttctaacaggaaaggtggaagctcgttccgtgatcttctacatatatctcctatacgaaatgcatcgggcaaggttcgttttcaagtctctctggtctttccttaaaggcactgggcttctgatgcatcttgttttcatttagtaatgatgaactagatatctgcaacataactatgtttgtagtaagcctgtgctatgctattctggttcttttgaacttcgaagttgaatggattcaaaaccattctcgtgatacagttaagttagcatgtgcatctttcttacatcttgcctgtgcaggtagcatttcacgtgtgggttcaccttgatgagggtgcaaagtatgattttaatgggctgacccccgaggtatggcagcttggtgctgttggtgcggtgagagtggcagtcagaagcttgtctgcgtcaggaagcctgttgagaccgtcccaatagcattatctagtttcttgccattttatgact

SEQ ID NO: 91402 - DNA, 1693 bp, Oryza sativa
agtaaagaaactgtcatgccccatgagcactttgcaccgatagaacacaatgatcaaacgcctgaggaaaatcctgaggaggacaacattgtagatactcgcaagagtaagagacaaagggttgcaaaatcctttggagatgactacattgtatacctcatgaatgacaccccaagaaccatagaagaggcatattcatctcctgacgctgactactggaaggaagcagtacgcagtgaaatggactcgattatgtctaatggtacttgggaagtcgttgagcgtccatatggatgtaagcccgtaggatgcaaatgggttttcaagaaaaagcttacgcctgatggtacaatcgaaaagtataaggcaaggcttgtggccaagggttatacccaaaaggaaggcgaggatttcttcgacacatattcaccagttgctcgcttgactacgattcgagtactacttgctctggcagcctctcatggtcttctcgtccatcagatggacgttaagacagctttcctaaacggagagctggaggaggagatctatatggatcaaccagacgggtatgtactagaaggtcaggagggaatggtgtgtaaactattgaaatccttgtatggcctcaagcaagcacctaagcaatggcatgagaagtttgacaccacgcgtacatctgcaggctttgtagtgaacgaagctgacaaatgtgtatactatcgctatggtgggggagaaggggtgatcttatgcttgtatgtcgatgacatactgatctttgggaccagccttaatgtgattgaggaggtcaaagactatctgtccaagagttttgaaatgaaggatttgggagaggctgatgttattcttaacatcaaactacaaagaggagatgagggtgggattacacttgtgcaatcccactatgtggacaaggttttgagtcgctttggatatagtgactgtaagccagctcctactccttatgatcccagcgtgctattaaggaaaaaccgaagaatagcaagggatcaactgagatactctcaaatcattggttcattgatgtacttggctagcgcaacgaggcctaacatctcatttgctgtaagcaagctgagccggtttgtctcaaatccgggagatgatcattggcaggctctggaaagagtaatgcgctatctaaagggcactatgagctatggaattcactataccgggtatccaaaagtactagaagggtatagtgactcaaactggatatctgatgctgatgagataaaagccacaagtggatatgcgttcacacttggaggtggcgctgtttcctggaagtcttgcaagcagaccatcttaacgaggtcaacaatggaagcagaacttacagcactagatactgcgacagttgaggctgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctggcagatcagtttaccaaggggctaccacgtaatgtgatagacagtgcatcgaaggaaa

SEQ ID NO: 91403 - DNA, 627 bp, Oryza sativa
tcttgtcggtgaagtagttgatgaggttgtcggcgaggatgccgacggtgatcatgagctggaagctgatgttcagcatgccccgcatcctcgccggcgccatctctgacaggtacagtggcacagcctgcacatagccatggttgtcacgtcacattcgaacgaaattaactccgaggagtgtgcagtgtactactgtaatttgcatgaagcgtgcatgcaagttatccgtaagatccggtcatgcagatcgtttaacgctcaatccggatttagtttcatgccattttcaaatgaattcttttaacaattttcgcgcacgcatgcatcgttatccaaaacttgaattgcgtgcatgatatgcctttttttttagaccaaatgcagaattggagagattgggtacgacgtggatgacctggttgctgaagccgacgccgatgccgaggaggatgcggccgatgatgagcatggcgacgtcggcggcggctccgttgaggatggcgccgacgaggaagatgacgccgccgccgagcatggtgatcctgcggccgaacttgcgggtgatgacggaagcgaagagcgaggcgatgagcgcggcgaggtagagcgacgaggtgaaggggc

SEQ ID NO: 91404 - DNA, 4600 bp, Oryza sativa
attcctgcagccctacatgggtcacaggagatttctcccaaggtatcacccgtataggaatatgagaaagaatttcaatggacacagagatacagccggacccccgacagagctaacagggacagaggtgcacaacttagtgatgggaataaccaacgaacatataaccatttggacatataaccattcatggagtgtgtactgctatatatgttgctagacctattgaattttgtggacttgcatttatactcctcctgctgctgttttatgtcaatcatgcaaattctgtacccttgctgctgctgttttttaaattttcatgattgattcagtggttatatacctctacacttgttctttttttatgcataagaacagattttgtgcactctctctttttttatgcataagaacagattttctgcacttgttcatttttttatctacaataatatatgcatgatttatataccactgctgttgttgcccctgtacttcttgttaaatggccaaggatgaattgcttaataacattctatctatacctgttcttttctttatggataagaacagattatctacacttgttgatttatatacccttgctgtctatgtgaatttccctctgctgttgctgtttatgtgaatttccaccctgctgttgctgtttatgtgaatttccaccctgctgttgctgtttatgtgaatctccccttgctgttgctgcccctgtggcatatatacccctactgctgttatatggccctgctactgctcttattgctgctattatatggccatgctgttgctactactctaatttcctgcacttgctcttttccttatggataagaacagatgaactacacttgttctattttattgataagaacagatgaactacacttgttctattttctttgggttgcttttttctcctagtagctgatttcctctttttatcccttcatgcaaatgattataattgatgcatatttctcagcaaaactgaggccatatctttcatagtataccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcagaattgccgcaggaacaacatacgtcgatgtcgggcgagacaagtgcaagtaggtctagtagaaatccgcggtcacaaaatatatggccgaccacagtgcaagttataagagaggttgacgctagtggtaggcccacggcgcccaggactgtcattggaagatggtctaactgctgcgggatagcggcacgtgagaacttcgggatcctccataaagatatcgggaaggtcacagaagccgagaaagagcgagcttggacggcaatggagaaatggttcacatttccagccgaagcaaaggataggctcaagcggaaggcattccaaaagatgggcaaagcttggaagaattggaagtcgaagctcttcaccgagtatgtcaacccgcccggcaatcatacgccgttcgatgaataccctcaaataaccgaagcggtgtgggaggaattctgctctctcaagaccacccaagagtttagggaatccagcgaggcacatcgcgtactgcaacagcggaatgagcacccgcatcggctgggcaccgcagggtacatcggcaaggaggcaatatgggcccaagaagatgcagccgctgcagcagcgaatgtccctgccccgttttcagacatccctgaacaaagagctcgcaactgggcgcgggcaaggggtaaggtcaacccggacggctctgtcacatttgagaacaaaagtgatgccgtcgtctatcaggaactggtgagttcactacttaacctaactaatttccgtccgtataaagtacaagttcgtataaacgactatcttcttttctagttgggcttggttgctgaacaagcttcacaaagcgaggttgagtccgcgccgaagaggcgcgaagatgacatcctcacaaaggcgctcggaaccaaagaacatcctggccgaactcggggaattggtagcgatgtgccctggaagcatggactccctcagtacagctcccaatacaggaaacggaaagtctccaaggaagagagggacgctcgtttgaaggccgaacttaaggttgaggtcattcaagaactagaagctagcatgaatgcaagggtggaagaaagggttaacaaggtgctcgccgacatgaatataccccgagtcacaacacctgctgtgcaaccaactcctcgtgtacaacacgacgcgagtccgtcacagcataggagtagttgtgcatccacagaggtgccggcccctggtctcccgatcgcaccactagctgcagtggaccacatcgaggtaattgttgttatccgatccatatctaataaaagacatttacacattccaatattaaattcaaactttcaccttatgcagggcgcagcacagtgtgtcctactagcgagagtccacccaactttcgctcctgaagtcgctgagggcatggctttcaagccctcggttacagacaaggtccacggcgcagacctgctagctgggtatgccaaggtgtccatcgatacagtaaaggacacgtggtcaggctatccgctgcccgtgcccccaaatgatgaaatcatgactttgggcgatgcgcgcaagacgttcatacaatggcctaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgaggcaaggggaaggtcggggagttggcgccggagccaaaaaggggcaaggctgcgacgtcgatgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaatacgtaaatattttaaggttgtgttggatcgagagtcgtcgccatggtaatcaggttgggttccttgatccatccatggtgaatgaggttaatttacaacagagctccactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggcccatatgtggaaaagggtggtaggcacaaggagggcaagaacgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctaccatggtattccaaacggtgttatttaccttttatttaattaaccaaaaagtaaaactggcttccagattttacccattcaccccccggtattaaaggcgaaatgtgcgcctttaattttgcaaaataattaaccagaaaggacgttttcatgcccaatagactcatgaacttggctagataatttattgtgatgtaaaaaaaaatgttttaataatttctgccgatgtaaaaaattatgtttttatagagtgcaatgtaatttactttcatatgtgcaatatttatggtactttactaaattgtcatcacatttgatcaactacgatttatgttgtacgtctcatctgttttctcctttttttttttccttattgacaggttgtgcaggtcgatgacatcatggctttaatccatttggtaagtatatatg

SEQ ID NO: 91405 - DNA, 717 bp, Oryza sativa
tgcgcttgcacaaaaggtgtatagcattttttatgataaagagaaacactttgattttatggcatggctccatgtttcaaataaattcgacgttgaacgcctaataaaagagttggtacagtcagttcacctttgtacagctgctgagttgagcagcatcagtagtttagatcaagctcagaggatacttaaggacaaactgaaaggtagcaggattttggtagtatttgatgatgtatggaatgaaatgagcagccagtgggagaatctgtgcaagcctctgcagtctaccagtaaaggcagcaaactaatagtaactactcgaagtcaaaatgttgcaaacattaacggggcaaccgagatagtgcatttagatggcctagaagatgaagactactgggaacactttttacagtgtgcctttcatgatgcaaatccatcccaatttccacaattggaaagtattggtcaagaattggtaaagaagttggctggttcacctttagcagctcagacagtagggaacttattaaagtttaaactagatgaaaaacactgggagacagtcaatggaagaaaattgtggcagatagaacagaaggaagatggtattatgccagcactgaggttgagctatgtgcgtcttcctgatcatttgaagcagtgcattatttattttgccttattccctaagaattaccaacttcgaggtgatgc

SEQ ID NO: 91406 - DNA, 3891 bp, Oryza sativa
tgcactgtctagttcttcttctgaatatcctgctatacagcagctactgcagcagtatagtaccctgccccctgatagggtgctgaatcattcaattaccttgttacctaattctgtgccagttaattcatgaccttacagatattctcctgctcagaaaggtgagattgagaaacaagttttcgaaatgttgaccgctggactcattactcccagttgtagcccttttgcatctcctgtgtcgctggttaaaaagaaggacaacagctggagattttgtgtggaataccgcaggttgagttctttaacaattaagaacaaattcctttgcccatagcggaggaacttttggatgagctagctagtactaagtttttctccaaacttgatcttaaaagtggatatcaccagattagaaagttggaggctgatgagtataaaactgctttcaaaacccatcatggtcatgtccaattcagggtgatgccatttgggttaactaatgcccctgcaacctttcagtgtctcatgaattctatctttgctcccttcttgagaaaatttgttttagtgttcatggatgacatattgatatgcaacaaatctttggaggagcatggtcaccacttagagctggtgttgtagttgttaccagggatgaaaacagtagcggtaattaccggccgaccgggctacctttttcgaatttgaccaatcggacgttccggaaacggtaaatatcgtaatcgaaaacggaaacggtaaaaaatacggaaacaatatcggaaatagtttggtaatttaccaaccgttttgtgtggttaccgtattataccagtaattaccgtttatatattccggtaaattatcctttttataaacatctggccggctggccccagttatttttctttggcccattttctcagcccaataataaccctaaatccctaaccctagagttggtcggctactcctggctccccaatccccgcgtcgacgcggctaggagagtccaaagtagatgggagatcgatagcaaggagcagcggaaggggttttgaaacagctgaccagggacagcgctgtcgtcatcattgtcatccccggccaccggcattcgtaggctgtcagcgtccccgaatccacccagcagcaacggcaggcgtgcatgggaagaggtggagcagccggagcaggggaagaggcggatctggagcgccggcggtggagactctggatcggcggtggagacgcgctggatcgactggagagtggagatagcgatgggaacgagatagggtcaatggggatcctcttccatcaatgggatgggtggataaatatctcctatcatcttctattttagcccctggactttgtaaatattacgagaacttcttcatttagttgatttcttccatataaaccctaagtttcatatttattttcatactagccctcaatgatccttctacttgatcaaatcaattttcctattttgtaattaataaatttcatatattagacgagtctctgaatcctaattttttatagttttccaagttggacacccaagttcgagttctagattgctagctaaatgtgcgatgttattgtttgatgtttccgacaggaattatcggcttccgatcgataccgacacatttccgattgaataattccattttcgatttagatatttccgatatcgtttccgctaccggcttaccgttatcgattatgtttccgaaaaataatatggttgcggtaatggtttagggtgttccccgattgtttccgactgttttcacccctagttgttacagcagcatcagttatgtgctaagttgtccacgtgttcatttgccacttctcaattggaatacatgggccacattatctttgctgaaggtgtagccacagatcctgagaaaactcaagctatggcttcttggcctattcctactaatgtcactcaactaagatggttttttgtctcactgggtattatagaaagtttgtgcaacactatggcattttggctaaacctctcaccatgttgcttcagaagaacactaagtttgtatggactcctcaagctcaggaagcttttgcagctctaaaaactgctatgtgtactacacctgtccttactctccctgacttttccaaaccttttgttctggaaatcgatgcttgtgctactggcattggagctgtgctatctcaagaagggcatcctgtggcttttacaggaaagcattgggcattgctaatcagaaattatcaatttatgagaaggaatttttggctattataatggttgtggataagtaaagatcttatttactcactagtccttttgttattaaaactgatcataaagccctttatcatttggatgatcagagtttagatactgacagcacgccgaactagtaatgggggcgactcgcagtacagatttgcagaagaaggccatgactaaactgattggtctgcagtacaaatttcagtataagaagggggtggataataagtctgctgatgctttctctagagtggggcatctttttcctatttcagttgttcaacctgcttgggttcaggaggtccctaattcatatgtggtagatctttttgctaaataattattgcaataattggccattacctctcctaattctcaaggttttaccttgtcgcatgggttgataaggaaagctgataaaatctggattggagttaattctgctttgcagaccaaactaattgcagccttccactcttttgcaataggacgtcactgtgggattcaagctacataccagcgagtgaagaaattgtttgtgtggaagggtttaaagaaatccatggaagaatttgtctagcaatgtgcagtgtgtcagcaagctaaacatgagcactgttcttatcctgggttgctgcaaccattaacaattccatatggtgcatggctagatatctcaatggactttgtggagggtttgcccacttctaaggggagcagtgttatcttggtggtggttgacagatacactaaatttgctcattttctgcctcttaaacatcccttttcagctttgtaggtggctgagttatttctgaacaatatggcttctctctatggtatgcccaagtccattgtttcagatcgcgataaggtgtttacaagtaatttctgggcagactttgtttaagaggtttgaagtgccattacatctctctactgcataccatccatagtctgatggccataccgaacgtgttaaacaatgcctgtagatgtctttgaggtgtgcggtctcctcttccccacattagtggtgtgcttggctccctttagcacagttttggtataatacaaattaccactttgccttacaatgctctccttaaaaatcactgttggcactgatccttcgtatggtcttcttcctgccatgtaggggcggatctacagtactaaggccagtgtcacgtgacaccgacgactttcggcaaaatctatagcaaaactacttatctatatgttataacactatgatctaagcataattagcatactatgacattgatagacatgttacgataccaactaatcgattttctggatccgccactgctgccatgtcagttaatgcctttgcatctactgactctgattctcctgtagctgatgctttgctcagagaacgtgctatgttttcttctttgctgaagcatcatctcacctgtgctcaaaataggatgaaaaaaacagctgatctgaagcgtactcgtcgctcatttcagattggtgatctggttctcctgaaacttcaaccgtctgcccagaagtctgttgtttctcaaccttttcctaag

SEQ ID NO: 91407 - DNA, 1115 bp, Oryza sativa
ctcgccgtcgaccgccggcgccggctcctccaccccgtcgcccggttcgacagctccgtcttctgcgtggaggaggcctcctgcgacggcatccttgtcctctggaggaagagggccatcggtgcccattccagtgtccgcttctcgatctgtaacccgaccacgcgtcagtccggtgacatcccgctgccgctgctcaccgggttcatgctcatgggcttgtactggcaccgccccaccggcgagtatcggcttctgctctacaggatagagctacctgcttcggagcggctcgttgatgttctgatccccggcgatagaaacgcctgctacgtctacacattgggctctggcgatttgccgaggtgcattgggtggccagaggcggaggcaaacggcgcatctgtgctgctgcatgggagcctgcattggtataagagaatcgaagatatgattttggcgtttgacattacagccgagtcgttccggtggatgcggtctccattcggcaaggcggtgtggagagcgtttcatggcctgtttgagattaattgtatgctcggcatgtactgctgtgacgatggtgcgacatttgtagatatctgggtgctggaggattatgagagagaggtctggtctctcaagtaccgggttgaattgccagttctagagatcaggagagagcttgatgtgaagcgtgatctttacagtgtgatggtttcttccgaggatggggatgtgcttgtgctggttaactgcaaacgagccatgctctacattggtactgatggcaagctgttggcgagtttgccacatgataatgacggcctcagtattactccagtgaagcttagagcaagccttgttccgcatgcattctttccatctctgctggactatgtcgtgaatgcttcgcctttcgtgtgatgcctgctgaatgaggtggttcctctttttaagacttctttctattgcccttgcctgcttctgaattatatatggtgcaatctctatgtattggatgaggtttaagcttacaaacttcttaattgcagtatgcattatgtatgcaattaaacttcttgcctgaaaactgatggtacatgaatttgtat

SEQ ID NO: 91408 - DNA, 1573 bp, Oryza sativa
acgcccaagtggaggccctgcgtgcggaacgagcggagctcgaggccgcatgggcgcgcgttgaggaggggcggcgctcggtggacgccatggtggaggtgggccgtaaggctcaccgccgccacatctcggagcttgaagcccgcaaggcggcgctggcggagatcgcccgagaggtggaggaggagcgagaggccgcccttatcgccaccaccgcgatgatcgaggcgcaagacaccctccgccttcaacacgcaatctgggaggcggagctgaagaaaaagctcgacgccgcccaaggggtccttgactccgccgctgcccgagagcggcgggtaacggagactgaagcgacgtctcggcggcgcgaggaggcccttgagtcccgtgccatggcgctggaagaacacgccggcaccgtggtgaggggcttgatggaccgcgaggccgccgctgctctccgggaggcgacgctggcggcgcacgaggccgcctgcgccgaggaggagtgcgcgctccgcctccgcgaggacgcactcgctgagcgggagcgggctctcgaggaggctgaggccacgaccaaacggctggcggacagcctgtcccttcgcgaggcggcgcaggaggagcaggcgcgccgcaatcttgaatgcgtccgcgccgagagagccgcactggaacagcgggctgctgacctcgaggcgcgggaaaaggagctggacgcgagggcgcctatcggcggggcggccgcgggcgaaagcgacttagccgcccgcctcgcagctgccgaacacaccgtcgcggaaatgcagcgagcgctggactcctccaccggggaggccgaggcccttcgcttggcgggcgagattgggcccgacatgctttgggatgcggtctcccgcatgaagcgcgccggtcggcaagcgggcctctggagaggccagacgtcggtgccccccaccaatctggaaggcctcgctccgcacctcaacaggatggcctgggttctcgaacaactccccgaggagcttgagaagaccatcaagtcatcctcgagggacctcgcgcagggagcggtcgaactcgtgctggcgagctaccaggcccgggaccccaacttctctccatggatggcgctggaggagttccctcccgggaccgaggacgacgcgcgcgcgcgcgtccgggatgccgccgaccacatcgtcaacggtttcgagggctcggcccctcggctcgcgttcgcccctagctccgacgaggagggcgatgccagtggtgaggacgacggtggcgacgaggccggcgacccgggcgcgtcggaatgagcccccgagcccccgtcaatctttgattttttctttttctttcttctaaggccttcatgcctcttttgtatagatcaacttaatcttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttctgggg

SEQ ID NO: 91409 - DNA, 1243 bp, Oryza sativa
tccttcctcccacttcctcgttcgctcagccaagtttttgactgcgcgacagtccgcgagatcgtggagggaggtgttgtggacggagcaccacctgccggcggggcgctccctgctgggagtaccagcctctttctttttgtcgcacgcaggcctcccctttcgagtggcccgcggagcgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatacaaggtatagtattgcggacttggcagaaacgctgaatgtacgagcgaagggattcatcatccccccgctgtactgcgtgcaagtccgcttcttcacctgggcgtggataagtgccttgaaagttcatggtgaactgctggcacagatcctcccaggagtggaccgacgcgggtggcaggttcattagccaaccccgtgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccgacaccaccagccgggggcacggagggctggtcctcacgtccatgtcgaggtgacactctggacgaggaggcgccctccgttgcacggggagtacgccggctattacgccggcgctcgatgttgaggcgggcatccggctcctcatgctgatcctcccgagtcgaaggtgtcgacgagggagtggcagccgaatgacgtgcagccgccgccgctcgccgcgccctccgccttgatgacacggaaccggtggtggcggcgccggaagtcttggtggtggcggaccgtccaccagcacccaggcgctgctgggccgtcacgaccaagttggccacgtcgtccagccatcgctgagctggagactcagggtcatggacgacgggtgggtga

SEQ ID NO: 91410 - DNA, 914 bp, Oryza sativa
ttttttgacggagggagtaacttccaactttccgtcacatcattctaatttcaatcaaacttttaactttgacgtgaactaaacacaccctaagtagtaaattagtatggagaattcgatgaagaatttatctggttaatttatcacctcttggtagccgatcttgaccgtcttttcctcgagcgcggagaggtcctcgacgccgatcttgctgagcagcgcgatgctggagatgctcgacatgggcatgaaggtgaggtcgtccatgacggtgtacgtcaccacgtcccgcacgaaccctttgccagtctgggcggcggcgaggcaggtcgaacagcggcagcccgtgtccgacgacatccccgcgccgaagggcgggaacgccgccttcagagacggcagagacggggtcgtcggccggatggtcgaacactggtaggccgggtggcccggcggcggcggtggaggaggaggaggagcaacgtacggcgcctggacgcgcgggggctggacgagggacgggaagccaccggcggtggcggcgaggcaggggtgcgccggcgccgggttcagcagcgcgtcgcgcgcctccgcgctctgcatgtacgcggcgtccatcctcctcacgctggcgtacacgttcgcgacgccgccgagcgcgttctcgcccgcgagcagcttcaccacggcgccgaccggcatggcgaggagcccgacgaggaagtcgacgacgtccttgccggcctcggcgaagagcacgacctgggcctccttggcgatgagcagcttgatggtcggcgtcgtcgacggcgccgcgtccgccgaagcgcacgacgacggcacggcggcggcgttgcccatgttgttgcctgcttcaaccagcgccgcgtacgtaaaaccctcgcaggatcaga

SEQ ID NO: 91411 - DNA, 601 bp, Oryza sativa
ttcctgcagcccgaggcgacgcgtcgggcgcggtggtcggaggtggccctcacctttgatcagaccgaccacccaccgtgcgttgcccggggagggcagattgcgatggtggtttcccccactatctgcaatgtgaagttggggcgtgtcctcatagatggaggagcggctctcaacatccttcccccgcggcctttgatgctatcaaggccctggggatggtgctccgaccgtcccagccaattatcggtgtgacgccggggcacacgtggccattaggtcacatcgacctaccggtcaccttcggtggacccgccaacttccgcacggagcgggtgagcttcgatgtggcggacctcagtctgccctacaacgcggtcctagggaggcccgcgttggtgaagttcatggcggcggtccactacgcctacctccagatgaagatgccgggccccggtggccccatctctgtccgtggcgaccttaaagtcgcgctcgcttgcatggagcagcgcgcggaccacctcgctgctgcgaccaagcccgagggtggtgacgagaggcttggcacctccgcccccaccgccccgaggggcagcgg

SEQ ID NO: 91412 - DNA, 734 bp, Oryza sativa
cgaaagtcgaggcggaccaggtatctgaggacgtctccgctcggcgaggtcaacgtgacccccgccccggcgccctgaagagacagggagccgtcgaactacatcacccagtaggcggtgtgaggcagctgcgaggggcccgagtggcctcgggggcggagacgggctcgggagctggggtccattccgccacaaagtcggcgagggcctggctcttgatcgcgtggcgtggttcaaagcgcaaatcgaattcagagagttcgattgcccatttcaccacccgtccagtaccctctcggttatgcaagatttggcggggttgacgcttccgtcgtatttttcggtgatggtgggccggaaccttgggggccaacggacgttccgaaggctcgccacaaaggctcgatagccggcaccgccaaccggggacacggggggccggcccccgtgcccggaccgaagtggcgctccggacgaggaagcgccctccgttgcatgggcggcgcgacgaacgtcgcgccggcgctcgatatcgaggcgggcatccggccccccacgcacatcttcttgggtcggaggcgttaacgagggaatggcggacgaacggcgggcaacggccgccgctcgccgcgccctccgcctcgacgacatggagccggcggcggcagtgccagaggcctcggtggcggaggtccgcccgccggcgcctaggcgctgctgcgccgtcatgacca

SEQ ID NO: 91413 - DNA, 7459 bp, Oryza sativa
aattcctgcagcccattgtcctctgtttcttgtggatattggtcgagcattgcgacgtttactctccgagggtcgatgaatccagtatcgaaaaccctccgccgtcaggccctttgaatctccattctacaacgataaaatggagtatattattttctatagtctacttatatacaaggacctaattaattaaaggagacgtatagtaagaaatctaactgaacgatatacttacaaaatccagcaactcataatagagacgtcgagggcgtccagctggtatagttcggagattcccttgaaattgatccagagaatgtcatctccttgcaagaagtccgtgtccctgatcctcgctccgatcatctctctaccagtggcgctcatctccatgtacagctgatggaacttgtacatttgtgtgggtagggactgcagcagctcaggcttgacaagcggtttaccgagttcgtacatgtatttcacttccaccttttcgattggtgcgactcctagcaattgatccgtattagaccggtgtcagtaataaatttttctatcgtcatttctttaccggtcaccaacggctcgatctcctggtttggttgctctccaagctgagggactggtttggactttccagaagatgctttcttcagcgttcgctcatagtctgatagcttgattgcctgcttgacagatgcagacatacccctgaagaagtttctgacactagggtctataggaatcttcttttctggacttcgaggcttgaattgtctctggacttctgatgcaacgtaagcgtcaagctcctcttgcgtacaatcgtaccccgggtccttgttcttggcggcgtcaactttcgccttcttcgttgcccttgtgtgggcaggcggtggagctggggggcccttgactttgaaggtgccggaagaggagcttgcggaggagtaggtgtaggagcccgaggaggagtcggtgcaggatcctgaggaggagtcggtgctggagcctgacgtggagatggtgctggcagatcatgaggaggagacagtgcaggatcctgatgaggagatggctgagccggaggagatggtgcactatacaccgcttgtcgcccagggaggatgatgtaccgcctgcaccatagaataatggcatggcttgtgtctcgtagatgcgtctcaccgtctccttcatggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatctaaaatatataaactacgagcttacctttattgataagttcttgtaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgctgagttcgtagctcgatacccggaactctagatctgcaatcttcgcctcggtatctctcttactcctcatccgattcctgtacgtgtggatgtcctccttgaaaccaatcttccaagaaatcacccctttccctcgtgttcgtcctggatgctctggagtctgcagggcgagtgtcagctcgtccctatctctgtccggtcagaacgtgccctgagaggaggcttccactgcatctgttagtcgtcgcgcagcctctcgtatctgatcgccgaagaccagtgagccatcagctgggttaagcgttccaccgtgagcatagtaccagaacttcgatcgttccggccaattggcggttgccggttcgatacccctctcaatcaagctagcctccatctcctcccacttcggcatcgcgacgctatagcctcctaaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcaggatatatttcttgtacagctctcccttgaagctctgaaactgttctgccattttcttcagagtccaccttttcactttgtcctctgtacccgcgggaagggtgaatgtctcgagcattgtggtccacagcatctctttctccgaatctgggacaaagctctcatgatctccacgtgcccttgttcttcgccagtacaccgtactgataggcacgttatcccgcacaacccaaccgctgtgacgtacatagttcttggcggcttcggccggggcactaggacgtccatcttcttccacttctgttatgatgtgccgaccctcaagcttcttcgctgcacctcgttgcccgtgtaccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatgctaagtgtttcatgtgtatatgctaagtctaattaagactacaatagtcaattgctaggagtcgcacaaattccgtagtcaataattacatactaagtctaatttgcaataaaataatcttatattaaaactcaaataatattagaacactacacaatcttatatgctaagtctaattacaagtctaatattcttaattgcattacaaatataacaatcatttatattattacgtcacttgcctgcacgaattccttctagggctagctcttccactccggcttgagggacgactccgacaacacgtcttttctgcaagatacaaaaaatatgtattaggataaatgcgaagtaacatatatatatatatattgcatttcacgttcacgttcgttcgctcgttctcattcacgttcgttctcgttcacgttcgttgtcgttctcgttcacgttaattcgttcgatcgttctcgttctcgctcttgttcgttcgatcgttctcgttctcgttcacgttctcgcggcaacgtacgttgacgtgttcgttctcgctctcgttcgtttgatcgttctcgttctcgttcacgttctcgcggtaacgtacgttgacgtgttcgttctcgttcatgtgttcgttaacggtggtgtggcggcatcgggccggcgcttggcgcggcggcggcgtggcgacggcggcggcggcggcgacggcgtggcgacggcggcggcagcggcgtggcgttgcatgcggcggcggcattacgcggcggcgaaggcggcggcgtggcgtggtggcggcggcgttgcacgtgcggcggcaaaggtggcggcgtggcatgccggcggcggcgtggcgcggcgtcagcgtggcgcggcgtcgtcgtggcgaggcgtcgtcgtggcgtggcgtctcgtggcgggcggcgcgatagagagagagatcgagatcggagatcgatgaagggagaggcggcggcggctcttaccccagagatgcggcggcggcggaggaggcggaggcggcggcgaggacgacgagctcgagacgacggcgagatacggcggcgtcggcgcggggatttgccctaggcagtggcggcgaaggagagaggccgagagagatcgatcggccgaaaacgttaagtgttggtggagaagacgagggcgcgcatcgggaatatatatagccctcgatctttactcccggttgatgagaataaccaggagtaaaaaaaagatctttaatcccggttgttctcaacaaccgggactaaagatatctttagtcccggttgtcctcatcaaccgggagtaaagatgttttcccgctatttccaaattattttttaacccggttagggttaagaaccgggactaaagattatagcactgcatattattttcgcttacatatgtgtttctaaaatagaagttaatgcattaacattatttaaagtacaaagattaatgacaattacttcgaaaaattatttttgtctgtaataaattaagtggataaatcgtaataagcaaatatatgacttaaaattaataaaaattccaataatcatacatacttagcatatgaatgatattattaaattggtaaaaactctaattaagatatgtatgtacatactgcatgatttaaaattaataaaaattgtaatcatcatatatacttagcgtaggaattatattaaattaaatgttaaaaactctaattaacatatgtaaatgccacatgcatgatttagaccttttaaaaattcgaatagtcatatataagtagcatatgaaagatagtaaattaaattgtgaaaaactctaattaacatctgtaaatgccacatgaatgatttaatacttttaaaaattctctagtcagttataattagcatatgaatgatagtcaattaaatgtagcatatgaatgatagtaaattatgccatacatcaattgatttatatggataatcaatacatccaaaataatttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaacttcgacgatttttcttttgcctgggagaaccacttgacgcttaggctcgtgaggccctctgcccttctttcctttgctagacatgtccttcacaaaaaagacttgcgttacatcattggcaaggacaaaaggttcgtccgagtatccaaccttgttaaggtcaacagttgtcatacaactatcatcaatcattacgcctccaccagtcaacctaacccattggcaccggaacagaggaaccttgagaggaccatagtcaagttcccatatatcctcgatggcaccgtaatacgtggcaattgttccatcgtgtcccatggcatcgacacgaacagcgctgttttggttcgtgctcttcatgtcttgagctctcgtgtagaatgtgtacccattgatctcatatccctggaatgtcgcgatcgacccagacggtcccctcgccaggaaggcaagttgttggttgatcgactcgttacccatgagatgttgtcgtagccatgtgggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtaattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacacaagcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctagaaggataccccttattacaactggtagcagttgtgtcatcaacacgtgacagtcatgagactttaggtttgtgaacttcttctccttcatgcttattattcgcttgatattcgtggagtatccagacggtacctttatgctctccaagcattcaaacattctttccttctctgccttgctaagagtgtagctggctggactcaagtaatggcttcatttctcctttggttccgggtgaaggtcgccgcattgttccatatgcttcagatcattacgtgcttccagtgtatctttcgactttccgtatacacctaggaagccaagaaggtttacacaaaggttcttagtgaggtgcatcacgtcgattgcgtggcgtacgtccaagaattcccaatatggtaactcccaaaatatagagttctttttccacatcgccgcgtgaccatcttcgctctctataggctggcttccaggcccctttccgaacactactttaagatctttaaccatagcaaacactgttttcccactgcgatgtttaggcttcgtatggtggtcggccttatgttcgaagtgcttgcctttcttccataccgggtggtttgctgcaaggaatcgacgatgacccatgtatacaaccttcctacagtgcttaagatacgtactttctgtttcatccatacagtgagtgcaagcctcgtaccccttgttggactgtccggataggttgctaagtgcaggccaatcgttgatggttacgaacagcagcgctcgtaggttaaattcctcctgtttgtcctcgtcccacatggggacaccttccttcttccacaactgtttaagatcttcgaccagtggtcttaggtacacatcgatgtcgttaccaggttgcttggggccttgaataataatcggcatcattatgtactttctcttcatgcatagccagggggaggttgtagatacacatcgtaacgggccaagtgctatggccgttgctcatctctccaaaaggattcatgccatccgtactca

SEQ ID NO: 91414 - DNA, 665 bp, Oryza sativa
tgaaatttgtcaccttattatgcttatcgtttactagtttatgataataaatgttcatagtctggcttcttctgtggctttcatacagttccggtacaacacacggaaagcccaagttcattccattcaatgatgaattacttgagaccacacttaaatataccgtacatcttacgcgtttaggaaccggtaaggatctctgatttattattatttatgctcaagtaatgctgctttttctgaatgttcaacaaactttgatgatcaggttcaacatgagttattgtttttatacactgttttgcatgctattaacttgttgcttctttgtgtattttttactctgcatcccagaatattagaataaccttctgttttgtgtttacagtgaataccctattggccaaggaaaagcactgcagtttgtttatggtagcaagcaagtcataacgaaaggtggcattcttgcaacaactgcgacaacaaacttgtataggagacagcgctataaggaaggcatgaaggatatccagtcgcagtgttgcagtcctgatgaagttatctttggccctgatttccaccaatccttgtactgtcacttgctgtgtgggttaatatactcagacgaggtccattcagtgttctcaacatttgctcacagccta

SEQ ID NO: 91415 - DNA, 661 bp, Oryza sativa
ttcctgcagccccgtcaaccttgccggccagctgctctggtcgacgtgcctgtcagcgcaccgcatcatcccctacagctccaacgtatataaggtcgcggatcagaccggagccgggttttaatctcaaccaaatcaacggcttggaatattggatccactgagttaaataaaaattaagggatggattttattaacgccacatgtcagtttgagagtgttttgaggattgccacatggcagcgttatatcgttttaagaaagtttaatggacttttagtataggaaaatgtacgaattacccccgtatcaatcgcggtcgtccgaattacccccctgaaccacaaaaccggatattcttcacccccaactatataaaccggacgaattacccccctcgaccacatccgaggtggttttgctctacgtgacatacgcgtggcagtccagtcagcattctatatatatataaaatgtgggacccacctgtcatacgctcactctctctcactcttcctctctctcttctgtctctcactctcgtcactcttcctctctctctcacggtcaaaggcaggcgggagcagcggctgagggcggcgggcggcggaggcgacaccggcggcgggcggcgggcgggggcggaagcggctgggggcgg

SEQ ID NO: 91416 - DNA, 737 bp, Oryza sativa
tcctgcagcccccaatgagcaattaaagctatttgaggaataacaattcaacaaagcatatatatatagagcatttataaatcaaaccatatgctagcatcaacattgcatattttcttaattcaagtatagaatttaagtgtcatgcatcatctcccttaaaagcaaaatctaaatctcatgaaagactagaatacatacaagctatgctagagacaaataaaccttcaaagtattgctagcatgcacaagaaaataccatttgcataaacaaagctctattttctcaatttttctcattgtcatattatcgcttgataaaaccatgaggtacaaactccccctcaaaccatgccaaaaggatgaactatgcccaattcaccacgaagaaaagcaaagcgattagaatccaaaggcttagtgaaaatatcagcaagttgcaactttgtgtccaaaaactgcaattcaacatatcccttctcaacatgatctctcaaaaagtgaaagcgaatatcaatgtgctttgtgcgtgagtgttgaacaggattcttagcaatgttagtagcacttgtgttataaaaaaagagaggtactttctcaaaagtaagaccataatatttcaaagtagataaaagccaaagaatctgtgaacaacaactagcagcagcaacacattcaaattcagcagttgattgagcaacactagattgtttcctagaagaccatgcatcaatgat

SEQ ID NO: 91417 - DNA, 736 bp, Oryza sativa
ttcctgcagcccgtttatgtgtgtgaaagtctggtttgcacttgaaagtgaggaacccgaaagaataagaacctcaagggatggaattgtgttcaccacaagaggtgatcaatatatcatttactgcgcttaggtttacgctgctcatgtcaaggtacttaagttgatgtagattggttaaccatgaatatctactgagtacatatcagtatccatgaaaccgaggttaaggtgttgtagatttgaaaggttaccaagctgaggaggcactctaccaaacaatatggatgtttcagacacatcaagatatcttatgttcttcattgaaccaaagtactctgggacatggctggcttcaactggatagccaaacttgttaatagagacatcaagctccacaagttttgcgaggtttcgttgtgtcaatgactgagttttgcctggaagcgaggagcaagaaatatggagggccaccaaagatacccaagtatcacaatggtggagcgacaaggaatcagggtagtacaacctacacgaattagtgcgactactgggtaggtccgtcggtttggcacgcaaaccgaggccaagcaagttaacgtgtgattctaataaagcaagttgcaaacaaaataataatgattttctaattataggggcaattggtcaaagggtgacttgccttgctcaaggtcttcacgaagcttcacgaatcttcgagaaatccacgattgac

SEQ ID NO: 91418 - DNA, 714 bp, Oryza sativa
agccgtatagcgtattagctaaaaaattaataatttataggtaaaacttttatatatatgtcattagtgatgtaaaagtatatctaaaaataaaaattaataaaaaaacttcaaaatcaatttcaaaatctagttttaaaatttgaattttaacggcggctaattttatataggcaaacgataagaaccttattggttggcaagatgtactgataattaatctaacatacataccgacagacatatctttccccattgcggaacaagggtggcgccaccatgtgatatgatccaggcgtgtcctctagctaattgctcattgcttggctcctcgccgataagtctcagggtgacatagtttaagcatgtggcaaacatcgtgcttgatcccaagattagcatgccccatcccccgtcctcgttctgcacatgtaaatataaaaaatgcaatgtttctgtacaacaatatttaattattactccttccaattataaatatttaatattaataagatctggtcgaactgactacaataatttctcaaatacttagtttaaaaaaaattatatgagtagattgacctagaaaattataccacaatatcataaatttattatattttataaactcattttaacataaaactggtagtcaaattaagtttcaaaagtttttgatcgaaacttgtcctatgcgtcaaacatttatgccta

SEQ ID NO: 91419 - DNA, 604 bp, Oryza sativa
ggtcgaatcggatcggcttttctctctccgagcccgacctttccttctcgtcgccggtcgtcgtgggccttcgccgccgcctccgagcccctttaaaagcttccccggtgtctcctctacccgccgccaccctcgccttcgcctttcgtcgccggaagagccctagcgccgtgtgccctagcgccgccgtgccgccgtcgctccagccgtgcgccgccgccgttccaaacgtcgccgtcgctcgggaagaccgccgtcgtggtcgccaagtcaccgccgtcctcgtccgccccttcgccgtcgccgaagatcaccggagcaccgtcgccgccgtcgacccgatctccgccgccgtttcaatctcgtcgccgtcgccgtccgttcctcttccgccgtcgctttggtcaccggtgagttcgccgcgtcgcgctctacccgatggtgccttccgttcgcgccgccgtgccgtcgttcgccggcgagcatgcaagcccgagccgcccgagccgccgccgccggtgatgacgtcaccgctgacgtcatcgtcgccctctcccgtgagccggtcgtggaccgatcgatctcggccggccgttttggatgg

SEQ ID NO: 91420 - DNA, 689 bp, Oryza sativa
agaaatgtcagtgtgagattgagattgaggtggaggaggagggaggcctctttgctatagtaaaagagaagaggctttggctattctgaggctgcttattaattagcacccgcttaggcctttgctttctcccataggtccagtagacataaataagttatcatggagttgggcattttttttttctgcattgttgtagccttggtttaaaatttggcaaggcaatttaaggattatattgtagaacagcagggaggtggtgtcttgtaacttttgttgttacattgtaaccccccgaatcaggccacatgggccggaggagtttgtgggggagcaccggagcactcttgtgcttttgggaccatgaactatgctagtttatgggtctatgtatatgatatgtttgtgatttgattatactttcttttgtcgccttatcaagtaccaatcattattaagtactgtacgtagtctctgagtgataattttgaaatctttgtgagcgcatattttaatcgaagttgaaggctatttttgttcgccattttttgttggattgtcaggatgatttgtaggcaaaagttcacaagagaatttatatgttgcttcttcaaagttcaaaacgattcatgagtgagaagaaaatgatttgtgacaaagctttgtgcctttgtctgttttcagttcga

SEQ ID NO: 91421 - DNA, 1668 bp, Oryza sativa
tgtgcaagggattagttcccaactcattccaacgaacgcaacctcgcattctcatcttttcgattatacttatcaaccaaaatttaaatttttcaaccttaaatttgaagttgattttgggaatttttcatcatagtttattttccagcctttgcttttggattgttgaaaacatgtatataaaagttttattcacaattattttttatttgcaaatatgccgttccgttttttcctcaagtatgccaaacgatggggctgcccttgatttcaaggggttttagtttggtatttttatcgctattatttatcaaaagcaaaagaagtctatcaaatcaacccacccaatagcattggaaaataatgcctctatcaggtaatctaatacggtataaattcgatgtagataagattgtatatgtggaatttttttcaccaaatccaacgaaattcattagagatggctcatgtaaattttagagaaaagttagcaacagcttcaatatttttggacacatgaaacaaataatccacaaacaatatctagtgaaatagctgaaaagaacatggaccttaatattcgatgatagccagcaacaaaatttagaattcaatagtccattgggacgaggaatcaaatgcaagcataaaaaatttgcttaaggacaagcattgcccagaggcacttataaacattactatgaaaatagtaaataataatgttaagaaactaatcctttgttttccaaaaaataaagaagttaagctttcatttaacctattttcatctctctattttgatatactctgcttccgactaaaaataaacaacaaaacaaaaatctccggtaggtcaaaccaaaataaaccagcctacttatgtcaactactataaacaatactattatagcagatccccaagtcttgctactgattacagcaaaattccgttgtcagctcggcattgagcgtctgctcacacaaaaacttgcttctgcaacaaaattgtctaaagcctgcatgaaaaacagaatacctgatatcaaagcatgacgagcttaatttgaagcaagggatagatgcaacggtgaatcacaaacctataaagaattccagaaataccaccgggccagtggtatctgcactcaaaggaaactatctacatatcagcatgcccaaatggtgcacgaacaaatagttggccatgaagcgtgacaacggcggatgtttgatgaggatcgatcctcaatggcagattgaccacctgagaaagagtaatcacttcatgttatctgaagagaatgcaaacgtgctcaaattagtattcaaattgctgctatcaccttcttgaatggagtgatcccccaaggattatcaggctgctctgggtccccagttataaccagacgcccagcaggatctgactgaacatgcacctgcaccatttagaacaaaattcaacaattcatttcttctcgcaggtagtgcctcagttcaagaagtggaagctttttgtttgttacgcacaaattaagtcaggtatttattttaggaaaatggaacagtttgaagtgatgcgttcaacattaaagatattttttcacctcttcgcgtagaagtccaggaaccccagcatagatttcgaaacaatctttctgcaggaaagaa

SEQ ID NO: 91422 - DNA, 1640 bp, Oryza sativa
aataaaggagacaagagacaaggaattttcaccgaggttcataaacttgccggtagcctagtccccgttgaggcgagcccaactccaccgctcaaccacgaagccatcgcacgcccccttcatcaaagggtggcaaggcgggagccggcccacggagaggactaccaaagcctcgatcactagggtagttcttccttcactccgaaggtggtgaactccaaaccactcacaactggcgccaggcctcctccacaatctcctcggagaggtcaccgggcaacacctccacaagccgtctaggaggcggcaacctccaagagtaacaagtctaggatgcttgccgcggatgatcaagtaccacactagctataacaatgaaacaatgcacttggattggcttaactcactctctaacacctcactagataaactaagtgcccaagggtgtgagagctcttgcaagggttcaagataatgtaatggagtgccaaaacctcgcccttgctgctggggagtgggtatatatacccccaaccaccaaaactagccgttggaaccgaaatccccaactctgtgctccgccgatcagaccgctgttgtgaggccggtcagaccggactactttgtaacggctagaaaactagtcattgagcccactcaacctggccggtctgaccgcagtgtagtggccggtcagaccgtccacggctcggtcagaccgtcatcggctcggactgaccggttgcggctctggtggctctgtatcaccaccataaaccagaccagtgcaacagaccattgaagccggtcagaccggccttatcacgccggtcagaccggctaacaggcccggtcagaccgtcctaaggcccacggtcagaccgcaggtcacttttcagcacaaccaaccgttagtaaaacggcgatatttcttgacacgggtttcggaatttggcgttcttggactctatggaaagcttattcaaagggatatccaatccatgaacaatccatccaagaaacacaacttttctcagggagaaagggctcacactccaaaggatactccaccggacataaccacatgaggctacccaaacctataggatttgcccacatatctctttgtttaggacttgataatactcaccacacttggctagacaagcccaccaaatacacctacatgcatatgaactaatatggcgcaagatcatccacatgctcgcttcatagacccctcttaatagtacgacgtctatctagcaaatccggtctacaccaaacaccaagaccgggaaaagactaagaaaacattcgtagctccattatacctttgccttgcgccatccaacttggggtcaatgcttaagccaaaatcaacacttgtgaccatccggttgaaccatgtttatgccgaggtctttaccatcctttgtcaagactttattcccatcacaagtttgacttcattcttgccaacatgacgatgtccttggcttggtgaccattaacccatggtgtcattcaatagccttatcgtagtgggacctattccttttcacatctcaacaaatcggatgtagtataagatattttagataactgtgtgtccagattcatagcaaaaagttgctata

SEQ ID NO: 91423 - DNA, 784 bp, Oryza sativa
aggaaggaaatctgggaagtgggaacctcaccgcactgcttgcaagaacctttatctttggtaatggcatgaatccaacaagctccaaaaggaccccaagggcaatgggcaaaacagaatgcggctcataaccaaacactgcaagcacagcacaatataatcaccaacccagtggacagtgccctctatataaaagactccatacttttctatatattactactcctttacttagcttttagaaataggccaaaagggtttgatactttaaagattaaaaagattcaagtatcacaatatcatctttagtagttgtttctgtttagctttaggaatcaactgaaaagcctcggtatcaatcatcaatgtgattcaagaattaatcaagattccagagatggaatgagataaagaggaagctcaccgtaagctctattgggatcaaaagccttgtagtcctcgacatgtaatgtgacggggaagtacccaatcacgcacttgctgatgaacctgaggatgcgtcgtcctccaaaatgtaagatccaacaatgcggtcaggtaaaaaaacgttggcagccgaggaaatcgaggagacgaacctggcgatcttgcgccccaacctgctcatatcattgaccggcgcgaacatgaagaagagctgcgtggcgagcaccctggataatacagcgcggagaggcgagagtgagacccaagtacccaacccgtcaacggcgagcagagcgcgaggtagggaaaagaagctggaggagagatttgggtaaga

SEQ ID NO: 91424 - DNA, 2068 bp, Oryza sativa
gcttcctgcgctcactctcttctggaagagcttattcccggcgcgaccatggcgatggcggcgctgcgtgaggcctcccgccgtctggtctccaggagggagtccccggcggcctacgcgcgccccttcctcctcacgcactcccggggcatcacctacaggctcttcatcggaggtaaacctcaccccccgtctccgtctcctcccgtttcctgactcgcgcatgccgcttgtgtaacatctccaccatggcgtcatcacagcgctgcagatctttgctcgctcgccgtctctcgtgcgtgcagatctgtgtgattggcggctcggcaagtcggcaagcctgtgcatgcatagtgttcgacgaaatgcccgagagacgcattcaccctgagtttctatccttttacagggctgtcccaattcgcgaccgaggatagcctggcagaagctttctctcagtatggccaggtactagaaggtacatttacttgtaacttaccagagccgagcctagagcacactttggtttatacttcttgtcattactagtaagttggaaactgttcttgttcaaatgcagcaacaattgtcaccgataagatgaccaacagaccaaaaggattcggctttgtgaaatttgcctccgaagaagccgccaataaagcaaaggaagagatgaacggcaaggcaagctttttgaaacagtgtatttttagttcagcctaggccttgtttggaatgttggattaccacatgaacttcacaggaaaccccaaaatccagtttaagggttggttgtttctttcctagcaagttcatgtagaatatcagtcttgcaaacaaggccttagaagttagaagcacactctgtttttcctacttgatttgattaacgcaaacttgcaacaggtattgaacggccgagttatctatgtcgacattgcgaaggccaaaatgaatcgtactacagattccagtccaagagcgacaggtcctcctaagccacctgaccgctgttgatagcatgcgtgtcatcttcatactttcctttttatctgctgcacgagtagtctattgttagattgggagtacctaaaaccatagagagtaatatgaacgatattacaaagcttagaatgttgaatgtccagttttaaagttcaggtgctaatggattttcatccaaagtttatggggaggttattgggacttcttcctattattattgagaagttcatgcgtaataatactggatttccagttttgcaataaaagaagatgtgcccgatcaacagctcagattatgatataacatcacatgctcttgccgatcaaatactgtgccctttccttctttgtcatggacagtatctataatgctgtcgccatgaaatgatctgaaaagtgctgttcatatagttgcatatgctcttgatgaagctgtggtagaacagtgtccttcctccatgtctgtccagtgttctgtatggaactaataatgaattggtgttttcaagtactcctaacttaaacttcatttgatttccctaaaactgtggaacagtaccttgattatacggaaaacatgaattgtaatgcgatggacagacggcacatttttttctgcattcttgtattatttgaagggaaaacattactctttctttttcaaattgaaacgtaaaaaagcactactacatgagattggaacatgcgaacaatgtcaattctactaggcttaatgtcacatcctaggatcagctcaggtgttttatctcctattttaaatggatgataagcacctggccaatttttatagtttaagaataatgtaactgcggtggaagaaaaatacacgcgagttctctgctcgatttgtacactgatgaagagaaggccacattttgtcctctctttttcctaaccgcagccgccgatcaccggagcaccacggcgacgacgaagctcagcacggccatggcgctgccggcgaagcagcacaggtcgatgagcgcctcgcgtcgcgccttgctctccttcctccccttcctgctcttcacgaactcgt

SEQ ID NO: 91425 - DNA, 878 bp, Oryza sativa
cagtggaagacgatgtcatgatcgccaatgtctcggtcacagatgacatagcgctcagcgctgccttgagaacatcctgcgagcacccaggcttcacgatgcttttcacctgcgcagcaacaacagttagaatagacaccaacatgtgccatttgtccacaggaattcagattgttcgatacgaagatcgatcaattattgggattatggaaagtaccttctccaagtattcctggagtttcttgatcctgcccatatagtcttgatcttccacgcacagtgaaataggctttgaatcagcacctgctccttcgaattggagtggtcctgggtttctgtagatgtcgtcgattaagaagctggtagaattgttcctcaatagcctgtaaacacaagtttgttattgtcaatgagattatgcatcttctttagaccaatgacagcaactgtacagcgatcgaatataagatgggattaatagattgtgtacacacttactcgaatgctttgcctttcaagtcgacagtagccatatggacagcaggtttccctatttgagtagccgcaggaccacgtgaccatctcttcacggtcatcatagactaaagggaaaagaattgtgggttaggtgttcccttcattcatatcatactcatctaattttgccaaaagggggtgcacagtagtaatctcaccgaaatcggagccgcaccacatcgccatttgttcgcaggactcttaagatttgtcacagtagccatgtaaccattcaaaccagcagctaagatgtggtagcacacgtgcccaagaacctgaagccaaacaacatacatataattaatcaacagcaaaataaaattgctttgtccaagtagaaa

SEQ ID NO: 91426 - DNA, 1070 bp, Oryza sativa
ttatctttacttttcgaattaaaaaatggttcattataagatttcagaatcaataatttcgaattaaaaaatggttcattataagatttcagaagcaatctgttgaagaaagaggtgcaatactttttatttttcagcaatgggatgtgcatggtaatatgatttgacacgagggaaggaaagtagacttattctaggatgggcccatagacatagtgccagcaataataggtgaaaaaatgcgggagatttgacacgagggagggaaagtagacttattctaggaggggcccattagcccataggcatagtgctagcaataataggggaaaaaatgcgggagaggaaggtgggaatcgaaccctgctcgccgggatgaaaactttcgatgttaaccatgtaggcagattactatatgtgctacgagattacatggaacttacatatagtatataaacctcggttttggagtagattgaaaactgtccgatccgtctattaatcagattaaaacggatttagctacacgtgtgggacagacgaaaaaaacgcccagaatccttacatattttttaattaggtatatagattttataaggatataacaaataatggcggtaggagtttgattgctaattttaagttgttgaaagaatagctcaatccgatcttggatatcttgaaggcaactccaaaagcttgctgcttcttcgttatcagctacaagataacaattataagaattattttgcatccattgcattgtaaaatctatgctaagcatgatgtatgaataaaacagcatatgtacctcgatacttgttttgcagccaatcttgtgagcacattaaggcctccaagagttctgaagtaagccggctacgatgctcactaagaacccttccacttgtgctaaatgcagattcagatgcaacagtgctaacaggaatagcaaatatatctcgtgctaccttcctcaatgtaggaaagcttgtcccaaccactttccaccaatcaagaatcttaaagttttctgtattaattgaaaccaactcatcctctaggtacct

SEQ ID NO: 91427 - DNA, 886 bp, Oryza sativa
gagatgtctcctgaatcaacaaatattgattaaaggcccgtaataggatgttgtatgcattgtctttttccctatatgctaaaatcttataagcactacagaccacacaatattacaggaaagaggagacagttcacttgctgaaatgccaaactgtaccatttgattatatagttttcagtgaactacatgtgtggaacatagaggtttcaatgaattgtatcattttagcctttattagatgcaagaagagacagttcgcttgctgttgctgaaatgccaaactgcatcatgtgataatagagcccacaatgaactgtacgatgtacagaacatttgctttgtgagctctacattgtgcttctcaacaatgggtgtgtttagttcgcgctaaaattgaaagtttggttgaaattggaacgatgcgacggaaaagttggaagtttatgtgtgtaggaaagttttgatgtgatggaaaagttggaagtttgaagaaaaagtttggaactaaacaaggccaatataagaaactaaagcctaaagcctaacaattaaaaatgattgtcccatagtccataagagaatttctggagatgtaaatcctagcaagtttcttgtgctacattgctcattatatgatagttcacaatatcaactaggaaagaggttaatctagtttttacgtaaccttttcgccgctgtcattgccgacaacccggatttccagaccaacagatgctgcttcaggtgctagcgggatctcatcatacttaaggaacttgatagcacctggatcatagcgaaaaaaaccaaaatcatgtacctgtttcgagaagagggggaaaaattttggattaacattatgccattagcacagggagaacaa

SEQ ID NO: 91428 - DNA, 1932 bp, Oryza sativa
ttgatggtactaatgacattttattctcctctcgtacgggaggcgcgggcacacacgtacgcatcaggccggccgccctagtttatcctgcacaaagaaagaaattaaatttgtctgtaaaaattttctacttcgtttaatgagagtatgagagtgtttatgcgtgcacgtacgcgttgcagttgacgctggtgctgatcttgtaagggagggagacgttgcacttggaggggagcgcggcggcgcgggtgatgtaggggcccccggaggcgccgttggcgacgttcttgaggcagccgcagatggtgcggcgatcgggggtgttgttggcggcggcgagcaggctctgaatgccgccgcagcacgccctgggcaccgtgccccccgcctgcacgtacggcaggcacggcatcagcgtgttgtacaccgccgagcacgagatagccgcgcgcaccgccgtcggcggcgccaccacggccgccaccagcaccaccaccaccgccagcgtcgcgcaccttggagccatgtcagctaagctagctagtctcagtctttgctgctgtgtacgtacgttgttgtgctctctacaacctacgtgaacactgaagacagctgaaacgtgtggatggaatggggcttcctgggggtgtttatatagcggaggaagcttagcttggatttactaaggttgttgagtgcatttaggggaggagttaagaacgcgagctggtagcagatggccgtgtgtgtggtcagaatttgactgaaataggaggagggttttttgggggatgcatttttaccagacgtttgatcgttctgataattctggactctgtgatggtgtagtctgcaagatgcacttgctgtttgagctttttaacgtatgccatgctcgatttgacaattcggtaggattaaccatacaacttttgacggtgaagcgatgattaattcattttttttatgaatgtgacaaggaattacacgtcattctattagaataagcaaaagcaagtttttacacgacacggcagccggacaaccatcgcccgggattcgggaacaggaaaagaaagagaaactagaaacgctggctaagaaaccaataagctccagcaaaaggaagagaagcaaaaacagcaagcgagaactcactatatgtaagattaaatcacaagaactaaaccaaccagagaggagtgaatggttggtatacccaaaaacaaaaaaaatttagcgaaaataaaagttatcctcgaaatcgatggatcgcggtctgaccgaagtagtagcgccggtctgaccgcctggatatcgtcggtctgaccgaggttgtaacaccggtcgaaccgccgagatcaatcgccagctcctgtcgccgccgccggtctgaccgcctcgccttagccggtctgaccgccagtaggtcgccggtctgaccgccggtgagatgccggttagaccgccgaaacctggtgaaacacaaatcgaagaactctcaaagtagatgacaactttattgcttctctctgtgtttacaaagtgcaacaacagcattccttacaaaaatcttgactaaactcgaaaccctaactaaactatcaactccacgctttgaaaagcgataaaaaagcgataccggaaagcctcacgctccccctctatttatacatgaggtaggcagcctaaagccacgaaccaaactcatactaagagtcctaaacaccttacgaaaccctctagtacaagaaagaaactcaacataaccaatcgtaccaaatttggactccttccaaattcgactccgcatcccatacgcacacaatacctccatcgtatgccatatggaatcttcaccaaccacgtgcatcaactctagtcttagtatctcgtatgatatctaaccaccacggatatcgtcttaccact

SEQ ID NO: 91429 - DNA, 1412 bp, Oryza sativa
gagctcatgttaagtttgacatccgctagtttgaacagctcctgctagaaagcactagtaaaaatcctgtctctgacagaaatgataacctgaggcatcccaaagacatcatacacctgctggataaatgcctaagcaactgtataagcagtaaaagggtgtgcaagagggataaatttagcaaacttggaaaatttgtccacgactaccatgattgtgtcatatttgcctgacttaggcagtccctctatgaagtccatactgacagtcatccaagcttgcatagggactggcaatggttgcaacagacctggagacttgcagtgttcaactttggcctgctgacaagtagtacactgagcaacatattgctgcacatccttttgcaaccctgtccatgcaaacagatttttgattctctgataggtagctgtaacaccagaatgcccaccaaccccactgttgtgtaatgcaagcaaaactgcctgttgtgcttccttatgatgcccaagccatattcttcctttgtatcgaattaccccattaaccaactggaagtggtcacatcctttaggctgaaggggcagaatttccaagagctgtttagtttttggatcatgctcattgacggagcgtggggctcctcaccgggagaccgcgctggcccccctttgccggttcggccggggactctgggtgagactctaagctcccaatctgtggaaggttcgcgagacaggaagcacacaagacgccggcgatgtatacaggttcgggccgctcagaagcgtaataccctactcctgtgttttggtggatttgtgtatgaaggaactacaaagtatgagccagcctctccctcgttctaggttcccaatctggaaaagtctcctcctccctctaagtggggaagatcctccttttttatcttaaggggataccacatgcacccttttcataaatggacggagatttgtatagttgccatccgagtcaccttctgatgggacggtccacaactacctccactttcgccgggagcagatgcgacgtggaatcgtggctgtctactgacgacatgaccggtgtcagaccagtcacgtcggtcattcttgtccaccacgtgtcagcttagcaatctatatgttcgtccttcttcacacaacatcttgcctgtaatggttaggatgaagcctggcatatatctgaccagggctaacgtgccatctctgggaggtaacacgctagctccagctggggacaagcgcctagaagccctcgtcctgacgggatggggcgaggcgtgcgtcagatcgcctgtcgccacctaacccgcgatctgaccggtctgtgactggtcacagaccggataaatgagtgcactgcactgcgttacatgcagcgtgacacgc

SEQ ID NO: 91430 - DNA, 1205 bp, Oryza sativa
aggccatcctggggcaatgctgcgagatgcccgtcgggtacgtgcagctccccgtgggggtcgccggcccgctgctcctggacggccgcgagtaccatgtccccatggctaccaccgagggatgcctcgtcgccagcgtcaaccgcgggtgcagggccatctccgcttccggcggcgccttcagcgttctgctccgggacgccatgtcccgcgctcctgctgtcaagctgccttccgcaatgcgggcagcggagctcaaggcgtttgctgaggcgcctgcgaattttgagttgctggctgctgtcttcaataggtacactccacatcatccactaatctagtttgttgatttgtgtgcttgctcaaagtgttataagactttgcgctccattggcaggcccagagttcattaatgggggaacaatgtgctctttcagtgcatcttagggtagtcgtcttatgtctgagtaaatggactgatgttcatagctagctctgaatggtattttaagatcaaggtgatttcccacaacggaaagcccttctatcatgtgattgctgacagggtagagcccacagtgtgtaagctagcacatgcactggaggtactggacaatgcattatcaatactatgtttacttgttctaagagctaccagctaaatgcagataatgccagctcatagataatacctttctgaagtgttcaccttgaattgcctttttatgttcgcttaaataataccgaatgtgaatgaatcattggtttgtgctctccaaacttgagaatatgtggatttaagatctcaacctctagtgtgtatctttgcaccttcagatgttcagggactcagggtacacacatctactgacagtttacggtgttagaattttcagattaatgtcatttgtcttttggagtttttctgtgttactgactagtaactgtcgctctgtagtcagtatccttagaggatctattgtctctctctttttttttaaatgtacgatatgttgttttgttttattttgttgtctggaacctttacgtaattgtaggctcatgttcaaaagctttggttactgtcattaagtacactttagataacagtaggcttgtgttccaataagttattgttggttttcatgtttctaattaatgtatctttcttacattgttttctgtcatttgagagtactgagaaa

SEQ ID NO: 91431 - DNA, 889 bp, Oryza sativa
tgaaatgggatgcgtaaagtaattccgggacagcgaagtcaagtccacgtcggtgtcaagtcgtgcgtgcatggctttgcctacagccgacacggacagatcgtggacaaaccaaatctgccgggtggcccacctacacatggcctgatcagccgattggggatcggcccatcgaagccgacacaccgcacggggggcccatggcttcaagttgcaaacagtttgccactcactcgtgacccattgacccaagtagagctcaccttctgtaggagacgggcacgatgccggcgcggtacacgccgatctggaggaaggccggctcggccatgtcgaagtgggggcgcggcgggttgcaccagccgccgtcgtcgttggggagcgcgtagttcggcgggcacaggttggtggcggtgacggtgacgctgcccggcaggcaccactgcccatcgttgtcgcaccgcagctcgtagcacgacccgcacgccgcgccgtcgttgaacagcaccgtgctcagcgccgccgtgttggtgccgtacccggtgctgtacaggttcccatacccacacgccccgccttttcatgtacacaaacaacacgacacgagtcagattactcccggttttgtcaatgcgtccaaaaaaaaaaaaacaaagtgttacgaggagcagtgcacacgtacccatcgtgccggacgcatcgccgccgccgtagaacgtggcgtgggcgctctgccaggagccgtagtcggcggcggctcgccgggcgaggaagcagaaggccgagaagaggaggagcagggcactactgcgtgaggccattgttgcaaaacagggagaagatcacactaccaacaatgtcctgctagctacttcactcggcttaagct

SEQ ID NO: 91432 - DNA, 4218 bp, Oryza sativa
acactttatcttgtcttccaccaccatcatgtcaggcatcaatagacccccccttaggaacctctgtgcttggttcaccactgtacttgagatcaacatttccaatctgtcccccctcaatgactatctgctttccctccctctgattactcttttctggaaaatctgattgcatctatgttttcccctgtagatcatccaaaacctgatcactaaaccaaccttgttcagtgtaacgccctgattttcgttcgggaataaaaatcaattaataatacattttctagaaattaaataaaagttaaatcaacttaatcaagtgaattatagaggaaattaaaatttcctttaaaaattattggccgggaatattttgtaatattctttgtgccctaatgtactctccggaattttccgtgaattttcggagcttgagaaatagttttaatagcacaaagatcattgcatcaattaaaataaaaagaaaacaaataaaatcctccttcctctctttgggcccttttcggcccaagtcttccttccctcccacggcctgcgcgccccttttctctccctctcgggccagcctcctccctcggcccgctcggctctctctctccctcaagtctgctttacctccctcgcccgttttcccttctctctctccccgacaggtgggacccgaggccccacctgtcatcttcttccccaacctcccgtcgccccaaccgccgccatggccaccccgtgctccccacgtcgccgccttcctcgcgtggttccctctcccgcgcatgcgtggacgcggtcgccgcccacgtccgcgccgtttcccccacgccctgcgaaaaccgttgccatcccgagctccacttcgccaccccacgtcgccagccgatcccgcctctcccgggcacgatctccatccccgagccctatataaagcaccctcgtgctcccctctttcgtttcccactccatcccgagctccctgcgcttttccccgctctccccacgccggtccccattgccgccgctcgccagcgttctccagccgcgtgcctcagccaccaccgccgtctccgcgctgcgccgccgccaccgccagctttgccgccgcccgggcaagctcggccaccgctccatttcccctctccacctccgtagcgccgtagccacgcgaaccacctctctccgccgccgccgccgactccagccgcgtcgcgccgccgcttcggtcgacgctgacccgcgccgttgcctccctcagctccgcaaggacgaggaggacctcggtcgccgcccctctttgccggaaatccgccggagctcctccttcctcggtcgtcggtgagatccttctcatattgtcgcggtcggccgtcgttaccggtcaccccgcatcggtcctcccctcccgaactccctcttctccttctgaaggtcaagggcgaccccgtccgccctccgtcctcgcaagccgccatcgggcaatcgtcgtcgccgtcatcttcctccgcgccggccgccgcttccggtgaggacctctcctcccttcctttttttttcccgtccccctttcttgccgatctccgcctcttggggtgcgtcgccgtccccgtgcgcgccgctgtcctccggccgcccgccgccgttccacgtcgccggctgctgccgccggtggccgcatgccgccgccgccgcgccttggctcggccgggccggcttcgtgccgcgcctgtgcccctggctgccgctcccctcggccgcccgatcggctcaggtcgatctgggccgtccacgtggtggaggcgcacccgaggccacgtgtggaccatgtccaccgtgcgccctccccctttgactcgctgacgtgtggggcccgcatgtcggcgccggccgccccttgctgacgtcagcgaggtccttttcctttgtaaaaataaataataattgcgcaataattcgtgaataattctagaaattcatataaatggctcaaaacttctaaaattcatatctaattcattcgaactccgaattgagccattcaacttgcaaaattcatctaaaattgagctctacatgtttgtttactttttatatactgtttccttggtttttattagattttttcctcgttttgcgtgcctacgtgtagaatccgtcgtttcggaagatcacggtcgcaaggataggagttcggaagattgtttgaagaagcaaggcaagtcacacattccctttgagcatgttgatcccaatttacaaatgttttactgtttgcaaataaatatgcatgttttgctaatcacatggggtcagggttttacctatctgctcgcttgtgccatgtttacttgatatctgtcctttgtcaaccatgggtaataaatcgcctagcttgtgttactttgatgacttagctagaactatatgcttagccatgcttaattaccactagctcagttgatgggataattacagtattagacctttttagtatcagagtgagctgcgtgctcgagacatctggccatgcttcatggtcgtaattattcaactaaaatgcgactgaatggtgggctatgggtgcatggttttgctggtcgcacccatggcagttaaggaccggttcgcgagatgccctggaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgagggtgaaacctgaggtgtggtgtgcttggctagagggggttatgcgaagggtcctgtcacggcctctttccggtatgtcgtggtggcatgtcggcgtacggaaacgtgtcgtggggctgtgtctcgtgggtacagttgtacacctctgatcagagtaaaactattcgaatagccgtgcccgcggttatgggcggtcgaccagattcaccgtgattagtcccatcttaataaatcgacccaatacactgtagttcaggtgggttggttgggcctgttcaacgtggtgtagcgttgatcagtggagatttaatgttactttaattactcaacagttttactgttttgctcaataaaatgttttacaactgcctttatgcaaatagccacaaacccctccttgtatccccttgcacatctgcatcgttggagtaagagtaagagtccggtcaaaaaaaaaaagtaagaaagcgaggcaagcaatattttcatggatcctgcaccgcctacttatgtggttctcattcttcgccaccatcttcagcaagctcttcgtctacgtatgtaaaatgaagtagtgacttagattttatgtgttaataatattggtggtttgtgatattatatgtgtgaaagattagtttcttgttatgagatttcggagtataatagatgattggttttgtgaaataacggttgttgtttaccggccgggtgtggctggttagactgtgggttatgtggcagtcagaccggccagcgatgtaggatctcttattatgatcgagttttttgttgcaagatttaatttcatcctcatgtgaattcacgcgtgttttatggttttggtgcagcgaatctgatcattcatgtacttcacacgattctctagctagatatttgcattcactgaattagttgtatgtgcagaggaattcatggcaaccttatcttctgctgcttgcaaattaatccatgaacacttctaacgccaaaccgttgagaattctttagaattgtgcgctgggttagttcatcgatttcgctatgatgaagtggacgaatagggaaataggcacgatcagaaagtttgattttctgtttcatgttattctgacgaaatgtttttgaatctagctaaatgtttgcttagctttattgagcacaatgcattggattaacggggacgctactgagccttgattaagaatagtctgagttttggatcacgttaggagtttatttaggatcatcaatttttgacagtatagcttctgtaaccacaccttagaacataccgtatgagtatgtgatttgaaaccaattgtttcagcacataaacttgtagtatccattagaattatgacatgttgtcatgctgat

SEQ ID NO: 91433 - DNA, 645 bp, Oryza sativa
atatgtgcagataagagatatctcaaatactgtgcaaaatcattacgtctattagtatatcagactttgtttcttaaatctgcagtaacagataaaggaaatcgttccgatcatgatatactaattacactatcaattaagcactagatataatagttaagaggcggggatcaggtaccctgcggcggaagcgttccggaggcctgcggtccctccggttctcacgggagcggacacggacgatgtgagcatggattgcacaggacacacagtgatgcaccttggcgtaaagcttggggagaacgtatcctgcaacgagatagttgtattgtatgccatcaattcaacaatatcaagatagaataaaaatttccagcagtatgcaaatcgccagtgtgttatcggcgatcacaaatccaacctctactacgatttcgcatcacatacaaattcagcaaaagaaaccaaaagcgggggagaggaaacgcaccatcgtgcacgcacgcctcctggacgtccctgatggcggcctgctccacgatgttcctcacctgaaacctcttgatcgccttgtcctgtcccgcacccaaagcaaagattcccaaatcaacacagagatccagtgggtgcctcgcgcgcaacgag

SEQ ID NO: 91434 - DNA, 1163 bp, Oryza sativa
ccctcacctccatctccgccaccgagctgcggtcgcgaagggacgcgatgcggcgggtgatggcgtcgaccttcgggccgacgaagggacgtgaagctatgggacgatgacgccaagagcttcggggacgatgacggacggtcgggccgccgccggatccgtcggcgcagccctccctatcgtcggatccgccgccgccgccttccccaccacaggatccggtgccgccgagcccctcaacgccgccgctgccgagcttgtctccaccgtcgccgccgagcctgccgccgtcgcccgagccgtcttccgtcggcgcagccctccccatcgttggatccgccgccgtggagccttccgccgtcgcccgagccatcttccgccgcccgagccctccccatcgttagatccagcgccgccgatttccccaccacaagatccggtgttaccgagcctgtggcttaccgccgccgtggagcctgccgctgtcacctgagcctgtcgccaccgctgctgccgagcctgttgccgccgccgtcgatgagcccgccgccgtctcctgagggcgagcagggcaagtgcgcgagcagcgtcgtcacgccgttcgctcgtcccagtccgccagttttggccggatgagttggtcccggatctgagagaaatattcctctctagggaccaacccatcccacctcatcccagcaaccaaacactacctaaaattggtctcaatcgttcggatagcgcgtgctctccaggtaagtcaggcgatctctttgttatcccggctgggtttcgttcgaacgctgcaatgctgcgtacctgtcgtccactcgtcccgtgccggtcgccgtggcgtcacgctcggcgcgcatgcggacgcagtcccgatcgtgtcaagcaacagagcgcggcgacgcctggtcggcccgtgcacgcgcgcgtcgcgcgtcgcgagatctctggcacggaccgacggacggtgacagaaactccgcccgtacgcgtaccacccagtaccgttacatcagcatgcggcaagaaccgatctgtcgcgcccaggtgatcgaaacgtgaggctggccaccggccggtcgtcggccaagaccaacccaccgcgggaacatcagcttcgccgtgaatggaactactcgtggaagtgacgg

SEQ ID NO: 91435 - DNA, 660 bp, Oryza sativa
ttatggattgagtgatagctgggtgcaggtaatttcacgttggccttgcctttagtcttttctgaagttgctctgcttggtcggacagctatgattcgtttcctgatggactgtcaacctgaatgttctatgtaattacgcgagtgcaatatttattgttctggagaaatattcatgccattcacttgaagtgttcgctgacagataaatgctgcagtttgtaaggaagaggagtaaaggacctcgcttgattggttttggacttgtctaatatgctagtgttatgagcaagtggagaggttttggatgcatgaaatatttactgttcaatatgattatccttgcaggctctagctaagaaggaccctgtgcgaagacaagttttgcgggtcaaaggttgtttggctggatccaaacagaaaatctccttgaacagggagacatgatccttgctatcaataaggagccaattacatgcttcctagatatcgagaatgcttgccagaaattggacaatctgttgattcagatggagtccttaacatgacaatattccgtcaggtgaggactggttgtaagaaaccaaccatttttttttgacgaaactgtatgaatctaaatatctatgtgttcaaccgtgtcaacatttaacagggaaaa

SEQ ID NO: 91436 - DNA, 717 bp, Oryza sativa
aaactgatttcccaaaatttgatggagacaacccaaagctatggaaaactaatagtgagaagtatttcagtatgtaccaggttccttatgaaacttggtcatcctttgccacactccactttgtagggaatgcagcgttatggttacaaacctatgaggagttgcactgtgtagagagctggccagaattgtgtgtagtagtgcatgggaagtttggtaaggacaagtaccaacaacatttagaggagttagaagggttgagtcaagttgggggagttgatgagtattatactaaatttgaggagttgatgcatagggtcttagtttacaacaagagatatgatgagacattttttgttactagattcatggggggtttaaaaactgagatcaaaacaactataaagttacacaaaccaagaacggttgatctgacattatctttggcaaaaacgcaggaggaattattgctggagagtagcaggaagaactactccaaagaaggatacaaggatgcttacaagccggtgattaaacctgtttatcaaggcaaagggattctgggagcatcaccagaggaggctaagaagcctgaggagaaacccaagtgggaggaaagatttgacacactgaaggcagcaaggagagctaggggagagtgcttcaagtgtggagaaaagtatggcctagggcacaagtgtcctaagtctgtacaat

SEQ ID NO: 91437 - DNA, 660 bp, Oryza sativa
ccagcaggcctggagccactgggcggggtccccggagacctgatcggcccggaacatcgcggcgacggcggcgggcactcgggtgcggtgcttgaggagccagtccttcttcaggatcccggcgggggcctgcggcggcgcgagcgggtcgcgggccttggcggtgcgagcgaggatggaggccttggagaagtccgggagggcgagcaagttcatgggcggctgcctggagctcagcgccgccgagatcgcggggtgcagctccgggcaccccacgatggacaccagcgacagcggcggcgtccgcagctcctccgggtagtcctccatggccgccccacccgcggcgccgcggcgaggcgaggcgaacggtcgggaggcgctaggtccggtcgccgccggggtggtggccggggaggacggggagctcggatctgtggtgactgtttggttcgtttggaagaactgggtgggggcgaggacgacgacgcgcaaggagtggaaacacgtatcgctatgtgagatgtaataatgaatatagtcagggtgttttctatgaagtctgaaggaccttgttataaaatttcagaattctgacagtcatcaggttaaatgaacaaatcaataaactacgtagtagcttgtactccctccatactc

SEQ ID NO: 91438 - DNA, 672 bp, Oryza sativa
gaggatgatgatgaggaggatgacgatgacgactccacccccgatgcgtcgccgagggcggaggcgaaggcggagggcgagagctccaccgtgatggcgggctgcgccaaccagcccgctgagcccgaccccttcctcgacggtgacgactctggaacggaggaggagcaggcggcgttcatggtggagctggagcgcttccacagggagcacggcctcgagttcaagcctcccaagttctatggcaaaggtctcaactgcctcaagtgcgtgtctttctacacctctcgtttctgttagctcctcaacccgagtacacccatctcttctcgtctaagcttgctctgttccttttccaatccaggttatggaggcaggttgcccacctgggaggccatgagcaggtatggtcctcgactccttgtcactagcttgctcgctgctgctactgtagagtaaaatattttcggtgacatatgtccgggtggatcacgatcaaataagttcaacagtgattagtgagctgcaaggactagttatatttattctagttaaatattttgcttgttcaggtaacaatttgtaaactatggcgtcaagttggagagactttcaggccgccaaagtaagcctctaattttcacagaacatgttattcgcacaaaaaaaaag

SEQ ID NO: 91439 - DNA, 657 bp, Oryza sativa
ctgcaccccgcattgtggttttgatctggtccctctcctgaatccatgcaagaaaccctaaaaaccttcttcggccctttccaatttccgccagggaaagactcgatgagatcggcaagaagatcaagcgagagccggacaccgccggcgtcgtagtcgccgccgtcgcaggcaccggcaccggtacagccacgccgatcgagcaccgcgtcccccatcgcctcggcctcggcggcgccgtgaacaccgtgaccccgtgcgccgcgtgcaagctcctccgccggcgctgcgcgcaggagtgccccttcgccccctacttctcgccgcacgagccccacaagttcgccgccgtccacaaggtcttcggcgccagcaacgtctccaagatgctcctggtacgataccattacaggtcaaagcattccttaaattgtacctttcgctagcttgtgcattaatggcttcgtcggtgcaatgcggtttcaggaggtcggcgaggcggagagagccgacgcggcgagcagcctggtgtacgaggcgaatctgcggctgcgcgaccccgtgtacggctgcatgggcgccatctcgatgctgcagcagcaggtgaacgcgctggaggccgagctggaagcggtcagggccgagatcttcaagcgc

SEQ ID NO: 91440 - DNA, 733 bp, Oryza sativa
ctgcaccccagttttggtggatgccacagaccggcacgctcgacgaacaacggcgacgaggtagtcgagcagggcagcagcagccacaccggcacgcgcagcccgctgaaccgctcctggcagagcagcaagcagaggacggcacagccggagcacagcgtccggtccgcgcccgcagccgccgcgcagttatgccgtggtgaactcgagcgccgccgtattccgctacgcgacccacgtctcgccgtcggagttgaagatgccgtcgccgagcaggtcacggaagacggtgtgccagaaggggggtggccgccgccgctcgccgtcaaccgaagcaacccagccgcgcccgccgtcaacctaagcaaccctggggaagtgaggaagaggggtggccgcagccgctcgcctgcgccgccctgccccgccgcttgcctccccgcgttccctgcctccgccgtcgcctcgccttgcctcgccgcctccgctctcctccccgcgctcgctgcctccgccgccgcactcgctacctccgccgttgccgggaggagagagtgtgtgtgagagatagaagagatagaagagagagagagtatgacatctggtcccacattttttaataaacagaacgctgactgactgccacgtgtatgccacgtaatttaaaaccaccgcggattggatcgaggggggtaattcgtccggtttgcatagttggggatgaagaatatcc

SEQ ID NO: 91441 - DNA, 1404 bp, Oryza sativa
aacgaaaaaaggaccagagcgctaatgttattgtccatcggcctcgtgttgcagacgggcttaagaagagtcaaagtaggtaggagtagagcttaatctccgttccaattttgtgcacgtacaaaaaaaagatctccggaagagaaacacaacatggaaacataaaattttgatgttaccctgtgcaaccctgcaacgcggcgctcgacccaggccccccggtcgcacgcatccgcgccccgtgcgcgcggctctcacgccatcgcgccgacgatttcgttccgcgaggcaacgacgtcggcgcggcacaccgggcacgtcgtccccctctgcagccacaggccgatgcactccgcgtggtagacgtgcccacacggccgcagccgccggcacggctgtcccccgccgtccgcgaccgcgaccgcgagcctccccttgcagatcgcgcagagcgccacgtcgtcgcccctcgcctccgtggcggcggcgacgtcgatgatgacgacctcctccttgttcagcaacccttggcgctccccgttgggatcgccggtggcgacctcgaaccgccggccgattaagcatcgcacggtccaggagatggcacagatcgcggcgatgagcgcgacgacggcgaggaatatctcgaggcctgacagatcaaccatcggcgagagttcgttttcgtagctaggtacgtgttgctggctcgatcgtcttggcgagtggtggaaccctgcacgcacgcgtacgtattaacgtataccagtacgtgctccggctccaggtacgtttgttactcctacttgtttcctatactgatttgtatttcgaaaaggtttgtttttttcccagatattactgcggagataattaaacagttcgtatcagaggagaaaatcgttgtggctgatctccacgtctttgttactcccacaaaaatatgaacaaattatggctcgcatggatgctagtagtatttctgcttgctttttgctcatggaaattattaaaggactaggcaactgggcatttaaggagtggcaactgacaagtatgggctaactcaaaggcgcagacataatcaattggaagagtgcttaaccacgagcatcagttagttttacactgaggcattggggacatggcattacttatctccaatcgtgtggtgttcatcagaaagaaactttggttaaagctttgctcatagggggttgtttattgtgcaaacacacaagtaggctatttgatggtgcaaaatattgtaagtgtatgtggatgggcagagctaattattccctccgagaaatctcagttatcattcaagattgaccctgaggaccactagatagcagtagaaacataaaatctgaacaacactgagcgccattcagcactgta

SEQ ID NO: 91442 - DNA, 659 bp, Oryza sativa
aagccgacagctgtaaactggatagaaggccgggggaaatctgttgtttgtgaggctattattaaaggagatgttgtgcagaaagttcttaagacgactgtagaaaaacttgttgagcttaacattatcaaaaatcttgctggatcagctgtagctggggctcttgggggttttaatgcccatgcgagtaatattgttactgcattattcattgctacaggacaggatcctgcacaaaatgttgaaagctcacaatgcatcaccatgttggaagaagtaaatgatggagatgatcttcatatctctgtcaccatgccgtccattgaggtgattatttattcgttttactttccgttcctacctgcattatgtagattatagcataacctgctagccttaaatggagctgcaaaatctatagcatagagatcttcttgtattaactgaagtaatattttgttttagcatgcagtttgatcgtgagagcaatatccgcatcgatttttatttatttaatttcttcatgttagtaaaatggttcattttttctctcaggtaggtacaatcggaggtggtacatgtctggcctcacaggcggcttgtttgaacctgcttggtgtcaagggttcaaatcatggctcacctggtgcaaatgctaa

SEQ ID NO: 91443 - DNA, 6454 bp, Oryza sativa
atcaattttatacatttggtaaaaccatgttactgcatgtataggcccttgttactgcaagttacacattctgttactgcatgtggaggattaaagttcaaaatgccaatttttgaaaagcaatatctcacaaggtatgtattattttttaaaaccgttttcacaatgatactatagtgcatgtgtaggtttaaacttcaaaatgcatttacatattctcctcctcaagaaatcgttcttcctccctcttcttaagaaaaccggtctcctccctccaatatagtgttattgcatgcatgtatatgacattactgcacttttgacagtaatattgttgtgaattacagtaaaccaggaattgaaataaaaatatatgggttcaaagtcttagatgctaaccatatacttgttactgcacaaaaataaaagtgttactgcacggcatatacacgttaccacctgacagttacacattaccgcatgtttacgtagtaacactatccaagaactgcagtaaaacactttgttactgtagaacatatagaacgttactgcacctttggcagtaacatcgtggtgaaattgtagtaaaccagaaatcaaaagaaaaatatgggttaaaagtctcacatgctaaatatacatgttaccgcacaaagtggaagtgttactacatggcaggtacacgttaccacatgtttatgcagtaacactattcataaattacagtaagatgcattgttactacaaaacttatgggttttactacacacttacagtgatgttgtgatgggattcactacaagaaatatgaccttctgtgacgaattcctcgtgacatcggagctattcgtgattagcacatttcattttatgacgattagtatgagatggggtggcctagtgacgaaaaaaatgtgttcgtcgttaataccgactagaaatcgtcataaagtatttcaatgggacattgtgacgaatattaatttgtcataagcggcaaaaaaacaaacgtcacagatttatataatgcatttctagaaaaatatattaaaaggtgaagcaatttaatcgagtgaattaatgagtaaactaaaattttcttttaaaaatcatgggcgaaattattttgtaatattctacatgtttgaaattattctctaaaattttccgtgaattttttttaagctcaataactaattttaataccacaaagtttatttaacctattaaaataaatggaaaactaattaaaattgctccctctacttgggccttattcggcccaagtgttactccctccttagcccacacagcctctctctccctcctcgggccggcttccccttcccctactccctctttgggccgccggcccaatctatttgctcctccctcactgagaagtctattttatcaattcaaataaattttcgagtagtaaataatttcaaatgaaaaaaattctcaacaacaaagttgtataacttatcaagatctataacttttgttttggttattttgctatatgactttgtttcaataatttgaatttgaatttcaaattatgacaacttcaaacaacattttcaaatactaaatgatttcaactgaaaaagtcatcaacatcaaaattgtataactcatcaatatctataacttttattttggtcatttcttcatccgataaagtaatagtaatattgttaacaaaatttatatatccctcttatagtttataaataaagtatataaaagatatatacattttgtgaacaatgttacaaatcactttgtcggatgaagaaatgacccaaataaaagttatagatattgatgagttataccactttattgttgatgacttgttcagttgaaatcatttagtacttgtaaatgttgtttgatattgtcataatttgaaattcaaattcaaattcaaactgttcaaacaaagtcatatagaaaaatgaccaaaacaaaagttgaagatattgataatttatacaactttgttgttgacaacttttccatttgaaatcatttacaacccgaaaaattatttaaatttcttatattttaaaattcaaattttatatagttcaatcaaactcggatggagaaatgaccaaaagaaaattggtagatctcaataaaagttctacaactttatttttaacaacttttttacatgagttcatttagtataataaaattcgatttgaatttttaatattttgaaattaatttttttccctccaaattttttcatctcctcttctctctcctcctgatattttctcctctcctctcctctcctctcagcctctcttctcactctttcctcctctcctctctctctcaccgactggaggttgggagcgggcgggagtggcggccccggcagcggcgggcacggcaacgacggtggcgggtggcgggcacggcgacagcctgcggcggcggatccggcggcgccgtcctcggaagggcagcctcgatctccgctggtccttcgtcgggaaggctgtccgacacccaagcggctgaaggatcaaggattcaaggccctgaggtggtatggcgagccaggagaagcccacgccgcctcggcatccgcctccgcacccaccggcgccggaggtcgcgcctcttgtgtgcgggttcggagggggtccaccgggccgcggcggcagcggctcggcctcccacccaactccagcgccgccgcccggccaccctcgccccctccttccctcccccgtcgccgccgtcctccctcccctattctttccccttggtacctcctctgatcgaagctgacttgacctgttgagattgcccccatgtcaccgccgtggtcacctctgggatgggaagcacgggtcacgacgcggaggtcacctgggccgacttcgacggctcgtctttggcgtcgccttcttcgtttctcagataaatgaagattttcacagaaaacaaagattttttttatgatctgggttcattatgttcttggtgcccattgatttaataattaggtaatgttaaaaagtttgtgctctcaggacatctaagatggaagcagtggataaagaagttgcagttcattatcaatatacaaggtaacaacaatttgcagttctttgctatttggatgtacaatttactggtctgtggttggtccagatgcactccaatgaaatcaaacatgtcaggcagcaaggtgaggagaataccaacccatttacttaatggatgctcatttggtaactacaataatccatgaaccataagcaaactgaaatctttaacttgtacctagttatttctcaaagtagtattgaagtaggcagcattagcaatcagtaatgactctgcgcaaggttgaagcattcaaactgcatatatttactgcaagaacttgtgcatagtacacaacttgttataaacgcaaacctgtcaattcttcatgtttgtgtgctactagtgggagagttcagaggacatgaagagttgctgcaactctgctcatttgcttgaattggtggtccagcatttctggaaaataactgcaaaacttttggatcaagcaaaatcttgcaattaggcgtcaactaatatcatccaaactgaattaaaaattaggataggtactgctctaagattacctcaaacttacttgatctagcagcgtgtgttgggctcctcaaagggtcacgttaatgggccacctgcgtcaggaaatatggggagaagtagatgcccaaataacgaccgtataccacataattttaacaaggactaatatggtggtcgtcagttttggtttaactagctggaattaactgtaagtctgtaacgaccaggactgtttactcttcatcgttaataattgaatgtctagtagtgctctttgcctcaggaagctttgatgaaattgctattgtcgctggtgggtgtgataagaatggacaggtgctgaaatctgccgagctgtacaattcagagactggtcattgggaaactttggcagacatgaacttggcgaggaggctctcatccagtttcttcttggatggtttctacaggtttgtgttgtctttgttttactaatgacaaacatgattaatagctgcgttaattacatgttcttggaactaattttgagtattgactaagcagggtaatgtataggctgcctagagtaagaattgcatttttttcgagatggagtatacaggtatatcgtagagtaagaattacattgttggtctaaagaaaaactcattcgacacgttctttgtactttgacttaacgatgttaagctttttttatatacgacaagtgtgccttgcatgctctctacaattatatgactgtaacaaactagagaagatgtttggggtttgcctgttgtgttcactggaataattttgtagttgaaacttgaaagcaagttttaagagcagcaactgtttcttgctccctcctgtgattttgttctccgggtactttctgattgcaggagctcagctcttgctcctcaatttagtttgtagtatttgacagatttttagcttactactgaaaagaagttatttattctatctccttaggattatattatttccatcaaacttggattaaattgggattcttcactcttctgtgttttatcatttccaggtcagcccatacactattctgggcatgcataaaaaatacattgatatattatagttagaatttagttaacatactgtctccaagaataacctataagtgcaaacgtaattacttatttacatctcttgctaaagtgtcgatgtaaatatcctgaagcaacaattgctttatggataagaaaactttacaatgattgcttgttgtatataacccattaactctgcatacaaaaaatctttcagagtgtgatggcatgttttgtttacaaatttttgcatcttgtatttacaaattgtttgcatgtaatttcagatgtaaggtttgtccatcctcttcgtgtcgccttgatgattcatgatgagacggcagtggtattttggttggtgtgatttcgacacatggttttgtgtttggtaagtgaacctgagattgtatttggacgtggttgggttggtacatatgtattttgacatgtgattatgtgttaagtcagtactaatgtactgcacctgattatgtgccgatgtattttgttttggctagttaatctgtaatgtattcatggtcagtgaacttgtgactgtgattgtatttgaatatgtgactgggttggcacatatgtatttgcactgtattagatgaccattggtttttattggctattataagggctgtaattttgtgctatatgatttattgggcttgtatagtcttttgaaatgggcttggcccacttggtatctggtactggtattgctagtctgctacaaatggattagcaaactgggctgaaatagtgtataaattgctacgtaattggatttggcccataatcaggttgcttacgacattgctctaaacaggccagtagtatgtaaattgctattttttagatgggctaggcctaaagctgacaagatttacaattgggcttagcccacgagaactacatggttcttgacagcccataataaagtttatgacgttttataggctagataatgacgaatatgagcgtcacaaagttatgacgatggaaggatcgtcactagattaatgacgaaaaaaataaggtttcgtcatagaacgtcattagagacgcatgataggtgacgaatgaattttcgtcatgcgagcgtcacagattacgaaatgtgacaaaattttatgtgtttgtgacgtaaatgaaacgtcacctatcataagatctcttgtagtgattgtagtaacgcattacagatagtagtaacaagtagtaatgctatagtattactacttgtggagagttaagataaaaaaaaaacccaagcttcgaataacaatatctctcatgtgatgtataattttttaaaaccgtttgtaccatgatgttacaaaaaaaatgcttatcaaaagtagatccgtcatgactatattttaactaaatttgaatgttgttactgcacataagacacagttttactgcacaatggatgtcgcgttactgcactgtttcacaagacgagagctgagaagaggtgggtggtgggggagttagtaggcagtttgaccgggttttgaccgacgtgggggtgctttgactgacctttgactgaggtggaaggtgggttttgagcccttaaaaaggaggggaggtgggtttggcccttgggagggaggggggtatagaatagctattctatatccgggtgtagtgtatatatatatatatatatatatatatatatatatatatatatatatatatatatatatatatatata

SEQ ID NO: 91444 - DNA, 1109 bp, Oryza sativa
agcccgaggacgacctttccgctgcgatgctggagaaggagacggcaacgtcggctggctcaccgacgaggaacagtagccacccggaggaggggaggtactggacgccgacgaggagaccactccggcgagcttcgggtgaggaggaggtgaggccagagatgaggacgacgtcgcagagccgagggaggtggtggcgacatcggccgatgctctggcatggcaaccggggcggctggaggcagtgcagtggcggcaatgccactggacgctggcggggatgcacatccggtggtctccgcgcgaaacggaggacacgccggggaagaggaggcggctacgacgccgaggatggcgatggaatggcctaccggcacacgggcgaggcggcaaagatggctggaggtggccggcggcacaggagagagacgagggcgacggggagaggtggtgcggccacggggagaaacgggaggaggctaaaacgaaagaacagaggaaggggattccattttatagcggaggggaacgagccggccacgggaggagcggggaacggcggcaggattggcggccggtggccatggaaggtggctaggaatggcgcggtgtcacgtcctgataaattcatcccgaattaaaaatcattctctaaaaggaataatagaattaattaaaattcgaaaagaaattggcaaacactaaaatacgtacaagaaaaattcgaatgtggcccggagaatttttgttaaattctccttggtctaaaaggagccctcaaattttacttgaattttcagagcaccggaaataattattaagcaacaaaaacaattatcaaagtttattaaaaagaaaacctaaaaataatcctcttcctcctttgggccaagcccagcccaaagtctccctctcctccctctctttctctccctctccttctctccctcctcctcttgggcctcctcccctcccggcccagctccctcccctcccctctctctcccgggcctcctctccctcctctcctcctcttctgggccgcccctccctctctctttcccggcccaccttcccccgccttctccagcctgggccgccgccggccc

SEQ ID NO: 91445 - DNA, 629 bp, Oryza sativa
tctgagcagggggttgtcctgtcatcaaaggaaacaaatggtcatcaaccaagtggatgcatgtccgtgagtacaaagcttgagctttctgaagtcgtgattaccaaaggtatctagtgttcctatggatctgtactgagtaagatgtaaagctggcgatattactgcatattgctttcttaactagttttggtcctcttcaaagtgacttccactcattcaccctagcaccagaaacccaggaagcaatatggctttgaggttatctagcacctttagctttgcattcttctcttttcgtgattactcctaggataggagtcatgcattcagatagtgttctatgtaaattttcagctgaggatggttaacgtttgcttgtagtagcttgatatctgccactttgtgagatctttactatctgaagaaataatttgctcaaaacttgttttataaactgatgtgctgtatctttctttggcagatggaccctatataaagcattgactggggcactttccaggatggcagttatgtaggctttagagatccacaccggtggtattctttgctctctgagaatatatagtagaggcactaagcaagggggtttacttgtccataccgtg

SEQ ID NO: 91446 - DNA, 684 bp, Oryza sativa
  unsure (1)..(684): unsure at all n locations
ccgtagtaagtatatctttcttggttttttatagagagatattatattttcgttacgcgctaatacccaaaaaaaaaggaaaaaacccggggggggtttttcctttnccttttctttctcccccccccccccccggaaaaaggaaatgattnatgattagtcttggcgggtgttccatcactaattgtgttgctaacctagttgcaatttgaataatgcagtttgtcaatggacggctggacatatttagggacttattttagattgagcatatgcctttgttcaaatggcaatactatacttacctgctgcctttatcagtttcaattttggtgtcatgattctaatgatgtgttgtaacagcttggctgccctctgctgctgctgtctcctggacgcctgcttctgaggatagaggcgacgggtgcaagagagctgaagagatttgtttcatggagctgatcaaaccgaactgctatgagaaaatgctgctagatttcgtgttcggcattattacctgttattcgccttgtttatgaacctctctgaacctgatttatttgatcagtgtttgatggatggctaaaactatatagttgtgtactactgttgattccaatcttgctggtggaattcaacccgggttgcggagtgcaagttgaattcgttcttgttatgtcgggc

SEQ ID NO: 91447 - DNA, 643 bp, Oryza sativa
tcaccaagtcggtgagccgtatccgcatccgcaccacgtccaacttcacctccgagttctcccaccacaccaacgtttagttgtcctgcggcaacatcgcgtcgcttcctatcccgttccacgaccacatcccaccgcctccggaggcgaaattgcttgaagtagagcacatgtgcggccatctgcatgggcagccgctcgttccgtgccgcgtgcaaatcccgtgccgttgccctgatgacgggtcggccccacaagattacttggcgggttggaccatgtcaaagtgccacgccagcgaaactgcgttctaaaacagttaaggaagacaaattacaccggttttaatagattaggagccaaggtatccggtattacggtttagtgataggaatcaaattagagtcaaagtgaacttgcatagcaatgtgtgggctgctaggcagatcgggcacagacagaacactgcccaagaaatgttctaacgaatttcaggcaacacgtgcgaaacaaaccatgattctaagtagcttatgaaagtatggcttgtcttctaaaagtacagtttctctaaaaacttcctacatcagcatccattagataaaactttttccaaattacttgtcagggaatgtatcctatg

SEQ ID NO: 91448 - DNA, 579 bp, Oryza sativa
attcctgcagcccaggagtaggccctccccaattaataccgtcactggtaatacccatttgacctccagttccagatggtgcaaaagaactcatgtttgtggggttgtttgggtagttcagattttcattaccccaaacattccttgacattgaactcaatagtgatcctgaatcatcattaagaccaacataaccaataggactacctaatctgtttgaactaccattgtagaatgaacctatctgccgcccattggagttattgacaaaactagaattggcgccaaaattcgcattcatcccagattcagaattcatgcccattccataaccagggccaaatgaagagaatccattccgtgcgcctgtaagcagaccataccttccatcaaccctcatgccataacctccaatagggtttgggttataaccctggttgaaaccattcaagaagctatggaccctgctcatagcatagttctgccctcccgcaggtgaacgtgcagcaggtccaggtgattgctcctttggaacagctctcttgacctcaaccatcttaccattcagctcatggaagt

SEQ ID NO: 91449 - DNA, 932 bp, Oryza sativa
ccacttgtttacaagaaggtcgctggtatttcgcatccgaaagtactgagcaatacttacagagaaaagcggcttatgaacgacaatgtcgtgaacaacagagcgactggcgggtgctaactacggcactccctccatgggaagcccgtccaagatacaggtgtggtgatcgttgtcaggttcttcgttccataaatcctacaacattgggtcgaaggttctttgtttgtccaaatattcttgacgacgatttcatggtaagaatattttgattacatgattccttattttctcacaacatttactaactttgcttgctttacatctattctttcctcccaggaaccaccaaggagatgtcaatacagagaatggatagacaccagaagggttctaactccacctagccgtgttgtgcagcttgaactaccagagcaatacagggttactaaagcgcggtttgagagaggagagggatcctcacgtaggggttagctattatcggacaacttggcatattgaaatttctactgtcatgcttccttgtcccattattacatcgtcgttgtgttcaactattgcactacctccctcctagttcgaatctaatatcatctatgtaactgcaatgcaaatagttgtatcatgttcaaattgtactactatttcttcatgttacataattctccttgtttaagtccatataatgtttctatgacctagactgcgatatgcctatataaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaaatcttttggccgtacttttttcatctgggtccc

SEQ ID NO: 91450 - DNA, 963 bp, Oryza sativa
gcagcgtcaagaccatggcgcacgtcgcgccctgcggcgtcgccctcggcgccggcggcggcggtggctacgagatcgaaggctcgtacctgcggcggagctgcgcggtgtacgacgcgcggcggcgcgcggtggtggcggaggtgcaggcgaaggaggcggtggggacggacgtgttccggctggtggtgcggccggggatggaggtgtcggtggccatggccgtcgtgctggcgctggagcagatgttcggcaagccctccctgctcaggagctggtcctcctaataattagcctgtttctttctttctctttttttttcttttttttttggccttgaatttccaacattgtttgggcctgagagcagaagagttgctcttggctgcctctttctctctgatcctgaaatgaaacctcaaattgggtgtcactgtacactgaaaagaaaatccctcttggtgagtatggttttgggtcttttttttagcagaaaaccagagggatgaaagtgtaaatatttctaagaagaagaagaagaaaagggggttaattaaagcaggaaattcttccctgtctatctttctcctccatttcttgttctaagctaccagccttccactgttgcgaggcaaaattcccccccccccccaattaatactagaattaactaacaatatattgtacaaattcatccaagatccacatgcccaaaacatggaaaccattttaatcgctactactatgtactccctccgtctaaaaaaaaactcaacctaagaggagttcggggttccttctagtacaataaatctggactatttttatccagatttattgtcttaggagggagatttctcttaggttgaagttttttttggacggaaggagtacatttctgcatcttcttcacacagcgtctgaaaccacaaactgcatgtctgaattgtgaacatcaaaact

SEQ ID NO: 91451 - DNA, 4222 bp, Oryza sativa
caatctagactggaacaaggagaagaagctaaagctgctttgcttgagaggatagaacatctaacagaactaattctggtttccgcaaaggcaagtcggactactaaatcgtctcactgcccaaggcgaagacattcttttggtgaagaggaggtctgattactcaaataattttactaaatgttataattcgaatgaacttgtattgatattttgaatacagtgccatatttattatatttagtacctcaagttctttaaagtttgtgagctgcttataactgcagcttgcatatctcccatatgaaaggcaagacatcatactggataatgaaagcaatatgttgtttgttcctatcgaaggattcggtgaaaaatttaaaagctcccccaaggaggagacggaaaatcagaaaggacaccttaactggctgaatctacgggtatgcacatgaatgatgtttaatccactgcattttaaacactttctatcatagtgaagagttgtaccattttttttcatgtatcacttatattaagctatgaaggtttcagaggaatggttacctttaaggaatacaggggactgcgaatcacatattcacatccttactaatgttgctaacttccattatgacaatcctatactatgatagtgtaaccttgcatgtaatactcatattccgtggccatatgacatcatttgtttctaaatgattatgcaagttgaattcttcaaatgttctttgcagatttgtacttagattatggaaccaaaatataatgattgagtttgcttttgtttgttaggattcttcctcttactgacctttttgtgatttgactgcatgcagaagtgtgatagtggttctactaatctgacaagttcggatggtgaaaaccctagttcgaccaaatcattacctgccctttccacacctctggggatcggattttttaatgtcacatcagaacaaaggatgtcagattatatgcttgctgagaatgtaccggctaatctgttatgtgttggccatagagaatttccttctgacagccttcctgtccaggaaacacctttggtacaaaatttgtgctcaatgatttttcaatttgttgcttgacacctaatgttaatttctcattagctggacagaatttctatgccaaaaatatttataatctggtactgatgttcctctctagaacattttattttcaactaaacactgattattttttctcaaaaatttgccttttatctcacactagggaaggaataagtgaaccaacattgtgtaccgcctatttccaatcagagtaggactaaactgaaaattgtaaaggttgctatcaaacattcatagaagacattccacaattttgttagatttttttagaacattcattttttttttttgttaacaacaagcgtagatgtgttttctgtatatacaaatcagaaagaatggttaaagtttgagttcaagggagattgggagaaagagaaggctgagtaggagtaatggaacagcatggcagcaatagtctgggactcggattaattatttgatagatgtacattctattataaatgtctgagcagatatctgtaaaaaatagtgatggcatgatcttttatgtcaaataataacaggttagtagaaagacttcagatcatgtggacatattgagagagcaattcaatattttatcaggggaggttgcactccatcaaagtgttctaaagcgcctatcagaggaagctggaaaaaatgcaatgaatgaacagattgaggtaatctttctactgtccactggtgtgctctatgatatattattataagcgctcttgttttctaaaatgtgtttctgtctatgttaagatggaaatgaaggtggtcaatgatgaggttaagctcaataagcagaaaatagcatctttagaaaggcggatttctaattcaatgtcaaatagtcgaggcatgcatgataatttagaactctcactggtaatgtttacctgcacccaagtgtgatttccaactttgtgttcttctaactatatacatatcatattgttacattggttttggcgttgtgcagccttacattgaaatacctgagcaactcaatgagaaagcgtttcaacatgaggtgaaccaattgctctattatgcgtctgttctttggcagtgagcttcatgctcctggctggtaacattaaagcattgtgttctcctcttaatggaaagatacatcattctaaaaaaaagtattagatggaatgggaactgaagataaggttcttgtgggacaaaatggtaatacaattatacaagtactccaaggatctgcattgatgaaaataatagcatttcaaatttccatagtaacatcatgctagggcctttccatttaaagtggtacaatgttgtcgtactcctacaccatgcagtatctacaggaggatatggtattattggcatgaaagcacaaaaggtagaattttcagtgttccaaacagtgattgtagtgatgtactgatgttttcgcaaacagaatcttattttccttcaacaagatgatagcagtcacaaatctggctgttaatgctgtgaacattggttggttgtgggtttgaggactgagggtagggtagttgccttatggcgctttcgcaaccaaggctgcaaactctggtagatactctctttaaaatatatatctgcttgacctgtaagagatgcggttgaacgttttgactactaagaaacctatctctgttatcaagtagatatcctaatactcttatttcgagttggttaaaggcctaagaaaattgtaactaacagcataatttttgccggctgtttcttatttcttgccacccagcccacctttggaggctgcagtttccagtgcttacatctgctgcagtgcaccgcttgcgacaagccaaaaggcaaaagcctgtagcagctaaagattgaaaatttcattttctcatgtagatctttgatagcctgcaaatttgtgcaaagaagttttgctatagattacttcctccgttctaaagtataagcattttttgtatgtatctggacatcccttcatccaggtacatagccagaaatgcttatattttggaacgcaaggagtatttgtttccgtgttgttgactgtgttgcagagtcattttatgtctccattttgaacatcacttttttctttaattactgctggtaaaaacagcagacggcagattaatgaaagacgagcaaaagatgattagtaaaattcgtggagcaagacaaaagcttgtagtattacttatagttttccctgtttgctatcaggcaagtgagtgccaagagtttttgttgtcagaaagaaccacatttcagcacaacacaggcattgtccaagaaacaggatctcaagctcacaaaggaaagccattgcccagtgatgtatctgatgaatttctgaaaaaggcgtcacaggtttgccttttctctgcactctaggcctgctgtcctgcttccttccattctaacttcaagccagtgatatgtactccctccgtttcataatgtaatactttctagcattgcccacattcatatatatactaatgaatctagacacatatatatctagattcattagcatctatatgaatatgggcaatgctagaaagtcttacattatgaaatggaggaagtatattgtgattctcagggataaaatcgaaattaaactgttcctccagccatttattggctcatattagtcatatatcttgtttcttttctactgctttgcttcataagattgagtgattgaccaatgagaagcttgtagccaggtgattggtgctctgtacttaaaccatgctgtcctgtcatgatgatgtacacttgtgctgataattagtagtgttagtattcctatgggatgacatgggaattagtgcttcaaaacaaaggcaccggaagttgacatttgtgggaaggttttatcatgaaatgtgttagcatctaatactacctcccttttttaatagatggtgccgttgacttttaacatactgtttgatcatttgtcctattcaaaaattaaatgtaaatatgcaaaaaaaaaaaagtcaagcttaaagtttcttgttggataatgctacttgtattacctagaatggtgctcttatgttacacatttt

SEQ ID NO: 91452 - DNA, 1280 bp, Oryza sativa
ctgtttccagggattcggtacccattattttgctcacatcgaatacgtccttgttgtcaagactgtttccaaggattcggtattcatttttttttcatattttttattctctttttcacaatgagcaattaaagatatttgaggagtaacaattcaataaagcatatatagagagcatttataaatcaaaccatatgctagcatcaacattgcatatttgctcaattcaagtagaatttaagtgtcatgcatcatctcccttaaaagcaaaatctaaatctcatgaaaagactagaatacatacaagctatgctagagacaaataaaccttcaaagtattgctagcatgtacaagaaaataccatatgtataaataaagctctcttttctcaattttttcattgtcatattattgcttgataaaaccatgaggtacaaactccccctcaaattatgccaaaaggatgaattattcccaattcaccacgaagaaaagcaaaacgattaaaatccaaaggtttagtgaaaatatcagcaagttgcaactttgtgtccaaaaactgcaattcaacatctcccttctcaacatgatccctcaaaaaacgaaaacgaatatcaatgtgctttgtgcgtgagtgttgaacaggattcttagcaatgttaatagcactagtattatcacaaaagagaggtactttctcaaaagtaagaccataatctttcaaagtagataaaagccaaagaatctgtgaacagcaactacagcagcaacatattcagattcagcagttgattgagcaacactagattgtttcctagaagaccatgcaatcaatgatgtaccaagaaaatgacatgttccactagtacttttcctatcaattctacaaccaccaaaatcagcatcggaatatccacttaagcatatagaagatgaagtagaataccaaattctaaactcaagtgtatgattcaaatacctcattattcgcttgaccgcttgacaatgtgaagcacaagaagaagcttgaaagcgtgcacacaaacacacagcaaattgtatgtctggcctagaagcagttagatacaacaaagatccaatcatacttctatattccttttgatcaacagcttcaccatcttcattaggatccaacacagctgtagaaccaattggtgttaaaattggcttgcaattctccatcttaaaccgtctcaaaagatccttcgtgtacttcgtttgatgcacaaaagtaccttgaggtgtttgcttaatttgc

SEQ ID NO: 91453 - DNA, 1843 bp, Oryza sativa
cgcgttacatttttaaccagtagtatccagctgtatatggaaaggaggaaaggttccaacctccttcctaaatatctactcccttttttacccaaagcaatgggccactgttgtacttctggtccagctttttatcttttatatgcctttactgaccttactatcttttttattttcttcaattatctgatgcagcaaattagtacattagctggcaatttgatcccaagttactttgtatgggaagtaatattcactatggctattattggactggggttgttgcttttcgcattactcatagggtccatgcagaattttctccaagctcttggaaaaaggtgtgcagttgtaccacaagtttatcctatatgaagtgtactgatgagatgccaatgggtttagtatatatacatgtaaatgatgttacacatatgcacagaattgaagagaacacaaatagcaacaacaatcagtttgaataatagaaactgtgcggcactctggtagtgccttttcctaatgaagtctgataactaatgttccaaagggtatatgttttttttttgttttttttgcaggagactagagatgcaattaagaaggcgtgatgttgaacagtggatgagccataggcggctgccagaagatctgagaaggtcttatatcttccaaatcaaataactgagatatgaggaaactgacctttttttttaattttctttcctttcacattattaaagaagtaaacatcatattacctgaaaaggatataaatgttctcctagatctgtttacctagtgaaatgtccggtttcaggccttcagtggggtaaatgaacttcaatccaatttaaaatgtgactaagaatcgaaatggagaaaactgctaccatcatgttgttttagtaacaatttcgaacaagggggaatggatgagtattagagataaatgctggaattatatgcatacatatcttgataatgtaaaatggctaatatttcaagcagaagatataaatggttaataaatctgacttttattcatgagtgaagatagtaccattttttcttcgtgttagtactagtaaaatgttttgttatcaacaagctgtagtaagtagtaacacatcagtaacaaaccccaaatttctatgctgcaaggtgagaatgcctaaagctttgtgggtgtgcaggagggttagatctgccgagaggttcagctgggtagctactagaggagtgaatgaagaagagcttttgagcaatttgccagaagatattcaaaggggcatacgccgccatttctttgggttccttaagaaggtttgttgattgtgtctttgcaactgttttttcctctccatcttcaattagttgacacttgacactgggtaggtgcatattttaattattaatgcaagttttcctgatagcctggacatatccccgttcgcaattgcttcttgtctttcagataattattcatgtagtaacaactttactaggtaccggtatgagttcctgttactggtactggtttttttttttgaatgaatactggtagtggttttactcagtagatccttacacaggaaaggactgaaaacaaacttcctgtagaccaagttaatccaggtggtacaggtgtaaaatttcggttctgtgcggatgtcttcttttgaattttgctttatgaaaggaaacagcaagttttgcgatgtgtatatgcttaatgatttcctctgttttgccttcctttttcttgcgagaactctgtttttcttttaagaataatgatatgcgactctgtttttcttttaagaataatgatacgccacca

SEQ ID NO: 91454 - DNA, 684 bp, Oryza sativa
agcacgtggatgcagcatattgtagaaggattttattgggagtattggtagtaacatcatatagagagcaactatagttaggtttgtgtcctagatatacctttttaaagtagatgggttagaactaatacatttttcagaatatctacagatatgaacatgattgttcgatataactacactcaattgtgtgatttgttttatcgaaagtaaaacaagcatgaagtgccagaaattttgaggaacaattaccaaatgtgtgaacttttcaaaagagtacatctcatggacacttgtcttttgaacaaaggcacgtattgttactttccctgtttccacgtagagagcggctgacctcttggtatggaatacataatttttaatgggatcggtgtagtgctgcaaaagacaatgtgaaaaacccatgtacattcaaagtgaataataatgattaactgcaatcacatacgcggtctcttctaattttgccggtatttgtttttctaaagaccacttctttcacccatccttgtggcagcccttcagggttaaattccagaattgcaagaatctacaaatcaatcaatgataatgtcattcatgaaactacccaaacattagttctgcaaagtgagaaatcatctaatagacactccctttatcccaagatatatcaacttagta

SEQ ID NO: 91455 - DNA, 2071 bp, Oryza sativa
cccagatatctacaaatgtcgcaccatcgtcacagcagtacatgccgagcatacaattaatctcaaacaggccatgaaacgctctccacaccgccttgccgaatggagaccgcatccaccggaacgactcggctgtaatgtcaaacgccaaaatcatatcttcgattctcttataccaatgcaggctcccatgcagcagcacagatgcgccgtttgcctccgcctctggccacccaatgcacctcggcaaatcgccagagcccaatgtgtagacgtagcaggcgtttctatcgccggggatcagaacatcaacgagccgctccgaagcaggtagctctatcctgtagagcagaagccgatactcgccggtggggcggtgccagtacaagcccatgagcatgaacccggtgagcagcggcagcgggatgtcaccggactgacgcgtggtcgggttacagatcgagaagcggacactggaatgggcaccgatggccctcttcctccagaggacaaggatgccgtcgcaggaggcctcctccacgcagaagacggagctgtcgaaccgggcgacggggtggaggagccggcgccggcggtcgacggcgaggacgtcgccgtttctgcagccggtgacgagggggagggagggctggtggcggtggtgggcgaggaggaagtcgcgggtggaggtgaggcggcgccatgcgcggcacaccaggcggcagcggaggaggggtttggggggaagccgtaccaggatgtcccagacgacgaggacctccgggagggcgacgccggagctgagcggcggcgggagtcctgtcgccgccgccgccgccgccagtggagtgaagtgacgaggccagagacgggctgacggcggagatacccttttgggcctttggctttttctttcttttttttttttttttgaaaattcgatcagcagcacagagaaaccccgttaacagagaaacccttttggcctttggtaccgttttctttgctgtgctatgatcgaattttctccacagagaaacccgttaacaaatttctcacttcgattggaagcacatatcatcggttttcctactatacataacactttcatcacattttgagctaacggtgttagattaaagtagaaaaatttatcctgtaataactaattttgagttaacggaagtgctatatattgaaggaaaatcgatgacatgtgcttctagtcaaagtgaaaaattccttgtgctattttttcgtactggtttttttttcctatggatcgaactctctcttttttgggccggtagagccacgactcattaaacgttcattttcatcttgaacatcagagacaatttcttacgttcaaggcattaaatttcaatcaccttaaaatttcaatttcatttctaaaatttcttctaactgaaatgtgacttcatacatctccttatcatcatcctccttttgccttttccctgtactttactattgaaccatttttttaactcaaatgtgacttcatacataagcatttcaggggtagtcaaaacaaatattaagggtagagcaatggggttcataacgcccactttgatcctcaccatatttggagttgtgacaaacagtccctcaatattcaatatcttgtacagccccaaacatgacccaacttcataaaatgccaaatgattcttcatttcaaggcagaccaatcatgcacatccacccgcacaatgtgtaatttgccggcagcagcagccccttgagtccatttcttgataaaaaaaattctcatttcagctcctttaagcttaaaatcctcaaaatctgctagtgcacctaggttccctttgataggaagtcccattggattgtgctttggctttccaattccaattcgatttgaattgcatattaaggctgtgttcgagaggaggggttgtctcccggcacgcaaaacgaagcatatattattgcatgattaattaagtattgttttttttgaaaattggattaatatgattttttaaaacaactttcgtattgaaattttttgtaaaaaaca

SEQ ID NO: 91456 - DNA, 984 bp, Oryza sativa
tacactcttagcaaggcagagaaggaaagtatgtttgaatgcttggagagcatcaaggtaccgtctagatactccacgaatataaagcgaataataagcacgaaggagaagaagttcgcaaatctaaagtctcatgactgtcacgtgttgatgacacagctgttaccagttgtaatctatcatcgatcctgatagattagaagccctgcagaatgatgtggtgcaatgtcttgtcagctttgagttgatatttccaccttcatttttcaatataatgacgcatctgctttgtcaccttgtcaaagagatcggtattctcggtactgtgtacctacacaacatgtttcctttcgagaggtacatgggcgttctgaagaggtatgttcgtaaccgtgctcgtccagaggcatgcatcgccaatgggtatggaacagaggaggtcattgaattctgcgtagaatttatcgaagaccttcgcccaatcggggtacctgaatcacgccatgaagggagactacggggaaaggggagtctcggaaggaaagcaataatgatggtagacaacaatttattctgtaaagcccatttcacggttctgcaacaatcttcattggtggctccctacatcgaggagcacttggctttagttcgcgccagaaacatcggtaagtccgatgcatgggtaacgagacgattaaccaacaactagccttcctggcgaggggaccatctggcttgatcgcggcattccagggatatgaaatcaatgggtacacattctacacgagggcccaagaaatgaagagcatgaaccagaacagtgctgttagtatcgatgccatgggacactgatggtacaactggcacgtattacggtgccatcgaggacatatgggaactgtgactatggaccttttaaggtccctctgttccggtgccaatgggttaggttgactggtggagacataacgattgatgacagtg

SEQ ID NO: 91457 - DNA, 1669 bp, Oryza sativa
ccgctgggtcatatcgacctcccggtcaccttcggggttccgccaacttctgcacggagcgggtggacttcgatgtggcggacctcagtctgccctacaacgcggtcctggggaggcccgcgttggtgaagttcatggcggcggtccactacgcctatctccagatgaagatgccgggccccggtggccccatcaccgtccatggcgacctcaaagtcacgcttgcttgtatggagcagcgcgcggaccaccttgccgcggcgtacaagcccgcgggtggcgacgagaggctcagcacctccgtcccggccgccccaaggcagcggatggtcacgtgcgatgaggtctcggtcaaggaggttgccctgggcgacggcccgtccaagaccacacgaatcggtggtcttttggacgacaaataggaagacgcgctcgtctccttactgcgggcaaacaccgacgtcttcgcctggagaccggcggacatgcccgaggtccccagggaggtgattgagcaccgtctcgccgtgcagctgggcgcaaggccggtccggcagaaagtgcggcggcaggccccggaacgtcaagccttcatccgcgaggaggtggcgcgacttctggaggccggattcatccgtgaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctagttatcatcagattcgcatggctagggaggatgaggaaaaaactgcattcattacccctataggaacttattgttatacgacaatgcctttcgggttaaagaatgcaggtcctacttttcaacgtactactcgaatttctttgggtagccagataggacgcaatgttgaggcctatgttgatgacttggttgtgaagacgcgcaaccaagagaccttactctcggatctagcggaaactttcaaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcacccccccagcatgcttagggatgtgcagtgcgtcaccggctgcatggccgccctaagtcggttcatatcgaggctgggagagaaggcactacccctatttaagctcctcaaacgctccgggccgtttacctggacggaggaggctgagcgggccttcactcagttgaaggcgtacctcagttctcccccagtcctggtcgccccggagccagatgagccgttgctactctacctggcggcaaccccgcaggtggtcagcgcggcgttggtcgtggagcgcgacaaggacaaccctcactccgcgcatccccaccctgtgtcgactcgacccgggagagagcagggaggagaggcccccgagccgaacggcggcccaggccctcgacggccggagctggccctccgcctgcttgtccgacggtgccaggtgcccccgacccccaggatggcccc

SEQ ID NO: 91458 - DNA, 12342 bp, Oryza sativa
tgaactctctctctcgctctccggcactctgtattccttcacgccacagatccaccagaacacaggagtagggtgttacgcttctcagcggcccgaacctgtctacgtcgcccgtgtcttgtgcactttctctctcgctgacgttcctcagatcgagggcgaagaacctcacttagcgcccccggccgaaccggcaaaggggggcctgcgcagtctcccggtgaggagccccacgctccgtcaatataaatacttgtaatacaggcagttggtttattattggttattactttgtacatcaacttaaggaaaattttgctagagaacatggccaaaactaacttttggaggaaaacactctataatcatagtattttgctagtggacaccgcgccaactaaaataataagagagaaatcgcgtcgcgtgaaatgtcaaaaatacccctaggcccacatgtcagctctcctatcttatatatgttgggggccacatggcagcgttttgaaccgccgacgccggcgataagctcgccgaccgccgctgcctctactcctcctcgcgctgagtcactgccatgtagaccccacatatacaagatagaagagctgatatatgggcccaagagcatttttaacatttcacgcgattgctttctcctcttcaactggaattattattttagttggcaatgtatcccctagtaaaataccacgatttatgaagtgtccctccccccccccaaaaaaaaaaaagttagttttgacggtgtcctaggattaaaaccacacaatagcaaatgttctgtagcaaaatttccctcgacttaaaagtagcagtacaaaacatcaagcccaacaaggcaacaggcctttgagacgggctcatatctccaccctatctccaggcctagtaaacccgaagtccgtatgaggcgaaagcaagtttagaccagaagactgtttcaagtatgggcttgtagcggttgctggcaattctaactcccacggcccaacttcgccccgctccttcgcaatcgcaagttcgcaactgcaccacgcggctaaacccgtggaggatgtctacccttgtgaatttgtgaacgaagccgcccccgcgctatagtttgcgacgtgtgaggcacaggcgacactcggagaccgttgtcccggcttttgcgatcacaatctagacgagccatttcgctatccatgtgtcgcttggactttttttcgtctgctttttacagaaaatttttgtttgtcacaatctagaggaaactatttttcctagccctccctgtttctcatggtttgtcaatgtgttttggaagcttgcgcataagaacccctggcctgacgggaacattggtccctatcgcaattgaagcgtccattttcgcatcattggacttcgatgtgcacaccgcgatctgtgtacacgcaatcaaacacatgcgctcttatttttccagcgacgagcatagggacaacgtactttcttgatgatcaagacatcaattttctttgaacagttttgcgtacgtcgaccatctagatgcatgccactctacgtgtacgtcggtaggatttgaaagggctgcagcccagggtttttatctttccgttttaagtaaaaaaacactcttagctgtttatccaaaaccgaaaaaaaccgacgactttcgatcaatgccgtttgaaaagcgtcttaaaccgagaagttttcacaaaccaatatctagcggtttcataaaaaccgaacagtttttgtttttttgaacccggctgtggccacaactcttttgaccatggtgtttgtttggttgcactatatagagctgcaatgcagccatctcctgcatagctgtcgcgcagctgaatagcccccgtactagttacatgttgcaatggaatgaaaagattaaaatgttatttggtttctttctattttttttcatgatcgatcatgtttatgagccttttagagtggttttctaaaagaggaaggagtggagttttctgggaaggatggatcattttaaataatactccctttgtttcatactataagtcactctgaattttttctagtcaaactttttaactttgactaaatttatagaaataattagcaacattttaaataccaaattagtttcattaaatctagcattgaatatattttgataacataaaacgtacacatgttttactgaaataaatgtcaaaacgacttataatgtgaaaccgagagagtataagatacatggactactgattgaatcgtcaatgagaaaaacatttcgttttataccaacagatttcgtccaaagtgcacagcaataccagaaaggcagaaacagatgtactcctaacaagaaaaggttttgtgatctttccatggagatccatgatgggcattctaaaggtgagaagggaggtggtgtgaaaatgtgaatagggacaagggatccattcatatgctccgtactactactcgcaactgttcgccgaaagcgagatacgatcatcatcctgtcatctctctcgcaatagcatttcatcctttcatggcctcgcgatggatacgagaccctgttgccttgccaacgcgtcgatacgatcatcactgtcaccgtcacacagactcgtccgtgtaaactcgatttgcaccagaacgatacatgaattctccgtccgctgaacggtggaagcgtagggtttcgtcacgaatgtgtggccggctggccgagctcgcagaagatcaacgtgcagccgtcgcgaggaccggcccggacgagtagacgacgacctctgcggaaagggcaaaagggcggggcgccacgctgccacacgaaaggcagtggcgcccggagacagtctcgcgagtggccaccggtctccttccgtttcgtcgagccctctggctgacgagacagggtgctgcaggctgcagcctgcagctgcaacggaacggggggacaggctgcagcctgcctgatgaggtgaactgaaaacaaactacccctgctagtaacgtctcagggctgtaataagatcctatgaatccaattagccctaaaaactaaattcaccatccttatagcaaggctaataatacagctgacctgctagctataaggttctttaagctttctctcagcctactcatataatagctagctcttcacagttaatacagtgctcactggtctctctcacagagtttcttggttcttgacttcttgtgtccaagccggctgtaaatttacagcctgcttctcctctctctcctctcttctttcctccaactcagcatttagccggcttatagcctactattatacttgctcttactccgtaaaaaaactttgtttttttaagtctatcttacacatttacgccagattttttttaatacaaagaagctcaagtgacgatttggagatgcacttgatactgcagtgttaataggtgtgtggtttgcaatcccgaggtcctgtgtttaatcctcaatttcaaacctaggaaaaaaaggaaaagtaattattaagtcaggtagagcttgccacttaataaaagagcgaaatacatggccagtctttaaacttatggggtggtgtcatgtaggtccgtgaacttgaaaattacacgtttagatccgtgaacttggtttaatgtaccaccccggtccaatcgccctttgaccatgtttgaccgccaacgtggcatgccacgtaggcaacacttttgtgctcagccccctccacatatatcttcgcacataacttgccataactagtgcattttaacccaaatctcccaaaatatccctaaatcggctagggtttcgacaatgaggttaacataaggaggctgagaggtagcggctgtggcggcctcggcggtgagattagtggtaggaggcatcgtaatgcagcgggttagtggtggcacagtgcggccggattagcggcgggagatagtgtaattgcaattgctaatcgggaccgtattttctatacatgcaagaagaaaaaatgaaagggaagaccaatttaaggattttttttaggggattctggtgtcacaatatagctaaaaggagatgacgtgttgtgatgtggagggggctgagagcaaaagtgtggcctacgtagcatgccacgttggcggtcaaacactgtcaaaggacatttggaccggggtggtacattgaaccaagttcacggatctaaacgtgcaattttcaagtttacggaccggccatgtatttcactccttaataaaaagaaaaaatagcattgccaaagtcaaggatcaaacccattaaggccttatttagttggggaaaatttttagatttggttgtcacatcggatatacggacacacattttaagtattagacatagtctaataacaaaacaaattacagattacaccagaaaattgcaagatgaatttattaagcctaattaataaattaattaggcttaataaatattgtttttattaggaatcactctccgacaacatacaatctatgtaattagtttttattgtctatatttaatactccatgcatgtatccaaatattcgatgtgactgggtaaaaaatttttgcgtgagaactaaacagggatttatttgaacttctgcttcctcgaatcatatttagggcatgtttagttcaaaaaaaattttacaatatcacatcgaatgtttggacacatgcatggagtattaaatatagaaaaaacaaattacacagttcgctagtaaattgcgagataaatcttttaagcctaattactccatgatttgacaatgtgatgctacagtaaacttttgctaatgacggattaattaggcttaataaattcgtctcatggtttactgacggattctgtaattaggtttttttattgtgccaaatatcttatgtgactcctgtataacacgtccaacctttacccctgaatttaaatacccctaaatatttttatggagggtgtaaggttgagccggttttacgcctcctacttctcaccagtcaggtcaccgcctcaccggcacagagaagcccggatacacggggtggtcacactcacggggcacctacccgagccaacccccgcacacacgccatctccagttctccacagtgtgggactagcagcagcacggcgcctttttgcgatttgactccgccgcgccgtgtcccctccgagaggaaaaatacaaggggtccgagcggaacaacggcgaaaagcgacgacgggactggacgagacgaggcgaagcggggcggctacgaaaacaatccagacaagcggccaagcccgacgcacgaagccgcgcagggttcgcgatggattggactgacggacgggacgtgatcccctcgccgcttgcgcgtgccctccccccgtagcgctagcgtcgtgtccgtgtcgtgtgtgcgaccgactggtggatggaagggagtggagcggtgggtgtggtcgtgccgtgccaaaacgccatgcgagaaaaacccccacgcaaccgaacaaaacatacacccccgccccattgaccggcccacccgcccgtgtgtccacaccgatccatccacaattccacattcttctcctgcgctgctgctgctgctttgactctcccttcttcccggctactccatacacttggcaaaacacctgaaccaatccaacccgcccgtttttcttcttttcttttctttgtttttttttaaaaatacaggaatacaggaagaggagcggagtggccgagtgggtagatggtgcaagggcggttctactagtattctcctacctcagtggtgtttggatcacggactaaagttttgatcaggacggttctactagagtctgattcctgtaacatcggatgtttagacgctaatttgaagtattaaatataaactaattacataaatgagagataattcgtgagataaattttttaaacctaattaatccataattagcatatgtttactgtagcaacacataagttaatcatggattaattagacttaatagattcatctcgcgaattagtccagagttatgtaatgggttttgttattagtctacgtttaatacttctagttagtgtccaaacatccgatgtgacaggactagtccctccaaccaaacggcccttcagtctagcaagtttttttaggccatgtttaaatcccaccataaaattttgtaccctgtcacatcgaatatttgaatacctgcatgaagtattaaatataggctaaaaaataactaatttcacatattgcgactaatttgcgagacgaatcttttaagcctaattgctctatgatttgataatgttgtgctacagtaaacaatgttaatgacagataaattaggcttaataaatttgtcttgtgatttactgacggattctataattagtttttttattagtatccagacaccccataagacactttatataatactctctccatttacttttgataaccatattttattttgacacacagattaaggataaacaattttacttatcattcatttaaaaagtgatccattaatatttacatttctctatgcccatgtaaccaatcttgtgtggaagaataaagagtcacacatcattaagatgttggattgaaatatgcctatcaaaaataaaatttccagatttggaaatatgactatcaaaagtagatggaggggtaactgatatgacacgccaaaactttaccaccctatccaaaacacctctttggcctggtttagtttctaactttttcttcaaacttctaaccttttcatcacatcaaaacttttctatatacataaactttcaattttttccttcaaacttacaattttaatgtggaactaaacacaccttttttttttttgttgggcttgtgacttgtggggtgtgcagaaagaaggctaggcagatccaggcagagtagctctttttgtttttgttgggacctaatagtactggcagtacagtagtaaaaaaatacaaaccctggtttccgtgtccaatgtttgaccatccgtcttatttaaaaaaattatgaaaaaaattaaaaagataagtcatgcataaaatattaatcatgttttatcatctaacaacaatgaaaatacgaattataaaataattttatataagacagacaattaaagttggacacggaaacccaggtttgcttttttttttttggacggctcgcgaaggaaggaaggaaggtggagccaggctagttaatagcgcgacatacccgagacgcacgcacgcactgctgctgctgctcgctctcgctttgcttcccctaatcttctcccgggccaggggggaagaggggcggaattcgggcacgagctttggagttggagatcacttcggcgacggcgtggtccccgccggcatgcagttcccgttctccggcgctggcccgggcgtcttcacgtcatcgccggcgctctccctcgcgctggtacgcgcgccttcttcgctgacgtgttggggggtttttgtttcttttttttttttggtggtgatacggtcgagtgattcggaaaggcgcgtcttttctttggttggttcggtttgtcgcaggcggacgcggtggcaggccggaacagcggcggcggtgggaagatggttaccgcggcccatggcggcgtcggcggaggaggaggaggaggacgcgcgaaggcgagggacgcgttggaggtggagaacgagatgagccggtccgggagcgaccacctcgacgtcgtctcttgcggcgacgcgggcggcggcggcggcgacgacgacgatgacgaggacgccgagcacggcaacccgcccaagcgcaagaagcggtaccaccgccacacgccgcagcagatccaagagctggaagcgtaagcgcgcccccacccacgaacaacgattcgttgcattctcctgtgcttggctgcttgctttggctcatgcatggatactggctcatcggtgcaggatgttcaaggaatgcccccacccagacgagaagcagcgcgccgagctgagcaagcggctcggcctcgaaccccggcaggtcaagttctggttccagaatcggcgaacgcagatgaaggtaagcgatcgaaacgaacagcaaaccatctttgcactccgatcgatggtgcagtgcagttcttgacactgtgtgtgtgtgtgtctctctctccctgtggtgattgaattggcaaagatgcaactggagcgacacgagaactcgctgctgaagcaggagaacgataagctgcggtccgagaacctgtcaatccgggaggccacgagcaacgcggtgtgcgttggctgcggcggcccggcgatgctcggggaggtgtccctggaggagcaccaccttcgcgtcgagaacgcgaggctcaaggacgagctcagccgagtgtgcgcgctcgccgccaagttccttggcaagtccatctctgtcatggcgccaccgcagatgcatcagcctcatcctgtgccaggctcgtcgctggagcttgcggttgggggtatcggttcgatgccatcagccacgatgcccatctcgacgatcactgattttgctggcgccatgtccagttcaatgggcacggtgatcacgcccatgaagtctgaggctgaaccatcggcaatggctggcattgacaagtccttgttcttggagctagcaatgagtgcaatggatgagctagtcaagatggctcagatgggggatccgctatggattccaggtgcctccgtaccttcctcgccggcaaaggagagtctaaacttcgaggagtacctaaacaccttcccaccttgcatcggggtgaagcctgaagggtatgtatcagaggcatctagagaatctggcattgtcatcattgacgatggcgccgcgcttgtggagaccctcatggatgaggttgtgcttgtgccaccttaccccctttcatgtttctgttgcttgtttgtttggactcacctgtagtttgaattcttgcgacagcgacggtggtccgatatgttctcatgcatgattgccaaggcatcaaccactgaggagatttctactggtgttgctgggagtagaaatggtgcattgcttcttgtgagtgatgaacattctgttgtggccatcccatgagtttcatgtggttaatcatactagcataacccctgaatggtaaatttcgatcattgcaacagatgcaggcagagctacaggtgctttctcctcttgtgcctattagagaggtgaagtttctcaggttctccaaacagctggctgatggtgtatgggctgtagtggacgtttcggctgatgaattgatgagggatcagggcattacttctgcatcctcgactgcaaacatgaactgccgaaggctgccttctggttgtgtgctgcaggacactccaaatgggtttgttaaggtactgagactgattatctttgttagctcctgctccttagatattcttaggtaaatgtcttaaaccgtgatatccttgactagttcacttcagggtagtatgtggttttacatctattaattcacactagtcagcatgctatcggttgacgtgaaactcatctaccttgcaaagtcgcagctcggtagtacccacgacgctgccactagaagtctgtcaaaaccagccatattagttgcaaagcttgttagctctactcatatgataatcatacatatggagagtgctttattagttcaggctctctgcaactaacatgacactcatggaaaagagtattcgtgtattctttcgtaatgtttcaaataatgtatgttagtttaatgtgtcatctggtgatcaccatgcaatattttgttcgtattcacaagtcatggcgtaggctcatgtctcctatagatatgttgtggttatgagtccataatccgaagtaaagtattgtattggtcagcggggaggggagtaaataaatgatttaggaatacttaagtggttctgagatccaacacttttccccaagtacgctcccttgcttttgtttagtcctgagttcagttctcctaggggattagatacttcttctactcctgggatggtgccccttgggtaacttcttgtccgcagtttaatcgatgcgtctcctcgttgaaatcttgactgcttcctctattgttttgtctcaatgtaaaagtcctcttcaccttgggttttgtaccagagttttatatagccttgatccaaattgctctggggcgcacacatgcacgaacgattctattcaaaattctaaattggacatctgaatgggacaaatatatctagtctacaatggtagaaacatgatttgatgagttataacgtctcattactatagattacactgtataagttaatctgatgtaaacccacaggttgaaagcaggaagtggttctttattttaagggttcaggaacacaatattttggaacactagtggtgtgccattcttggggcataccataagtcaaaataattaacgatgaagatactgtgatcagaaccatgctttataaaatgtaaacaaagtcaatctcagacagatcagctaatcctagatcaaactagagatactgtcgtctctcaagatttctacttttcttctgtaatttcatttatgtgcttttggtgcttttacagtatttagttcaaatatcagtattttctgaagtctataatctctctattgatcagtttctggatctgcctcctgctttcatggtacttctatggtttattctatgcaaaacagaatagacaaatgtgtaactattatccattagtcctatggcctatggttctcttacaaagtactagttacaatgctggggccccactatgggctaatatttcgaggtagcctctattttaaaacattgtgttgatgtcctttttatgttccattgattgggcaaaaagaaattaaaaaaaaacttagatggaaaaataatattaattgtaccattcagcttgtgtagtagttgcgtactccaggaaaactgcacctcaggcctcttttggtgtattacctctcaagacatttgcattttgtgcgtgcatttaagtctaacagcagatcttgaatggacgctgtaggtcacatgggttgaacatacagaatatgatgaggcatctgtgcacccgctctaccggcctcttctccggtctggtcttgcccttggtgcagggcgatggatcgcgacattacagcggcagtgcgaatgcttggcccttctcatgtcttctattgcattgccagagaacgactcatcaggtaaagaaattcaatactactgctaactttcaattggatccacccttctaataaagtgctacatttgcaacagctatccatcctgaaggtaaacggagcatgttgaagttggcaaggaggatgacggacaacttctgtgcaggggtgagcacatcatctacccgtgaatggagcaaactggttggattgacaggcaacattggggaggatgtgcatgtaatggcgcggaagagtgtggatgaacctggaacgccgccaggtgtggtgcttagtgctgctacatctgtgtggatgcctgtgatgcctgaacggctcttcaacttcttgcacaacaaggggctgcgtgctgaatgggatatcctcagcaatggtggccctatgcaggaggtgacaagcattgccaaggggcaacagaatggcaataccgtatgtctactgaaggctagtgtgagtattagctaacagtctgccacagttctgttcatagcttgctacttactaaacagcatcattaactgacttgtgggggagactgccatttcaaaattgttgcaaacctaaacacaacattttagaatttgttgggggcaccacatcactaaacactctaaacaatcacatgcttgtctgaaaccagtttaatgtgaaataatttagaatttgtgaaaagagtacccttgcttggccatcttaggtattttatattgctaaaagaaaggaaatgaagccaaggaagtactgcattagctggtggggaaaggataagaactatgtctattcacaactggaattttgtgagtcttaattctgtaacggttgtaccagtgatgatatagttgtacaaatacaaaactatatgtttagtcacacatttggcaattgcctaacaaatacaactctactataatatataagcatgtatagaaattccgctaggtcaatagagattaatggaggttagaaagatg

SEQ ID NO: 91459 - DNA, 4374 bp, Oryza sativa
atcgagtaccggatgcgccgggggcagcgtgacagggccccggcgtctgccgacgaggaaaggggaagtgacgggtcgtcttcatctagcgatgatgatgtcacggaggacgatcgccgtggtagctgcaccgattgcgtcaggtaaatggaaggatctggctagtaagcgtgtttcctagtccgtgttactcacgagcggagcagctcagatttacgatacagtaatagggaaatgtttcttctgtttgcccttacgcaagttcttaccacggtataatgagccttctattagtatgaagaaagaggggtgagtagaaaaggctagataagtattatactcagttttaacatgccaagttttatgcatggtttgctgttctatgatgtcctagaaatatttatgttgagcatatcaatcaggctaatgtcagtaagacaaagtggctctgtcatacataggatactgattacagtcatgaagctcactccagtcagtcatgcccagaatttctagcctagtattctcttctaagtgggtttcaattacttaagaggtcaaataatctagcgttgcttgttctcatgacatagcaacagtgttgtgctttgaaattggtatatgcgcaccataagaagctaagagtggatcctcctaaataagctataaattcaattaggatagtataagattgtacctgcaaaatcatttcgttcaacataaactagacaaaatgaataacctcattgatgttcttttgtagctgtatatgtgtgttatgcttcaatatgctaaaagaaatgtggtctaatttatgggataaggcatctaatggatccaacgttacctggaaaatgacatttgaatgagtggcacataacctgtttaggtttctttttaagacacaaattatacgctatttggtattcagtgaagagacccagtatctgattggaaaggtcaactgaagacttttgtgacctcaaaacctgattcttttttatgttttaatacacatttctgcagtctcattctattgactatttgactgttctatttttttaggcaacacataagtttataactgttattatatgagtttcttagtgatgaggatgattgaggaaacatgcttcttacgctgctagataatattcaactgcatagacaattgataaaaacatcttccaaataaaacattggtctgttccttcccttttgttttctctatattgaattatactgcagatgtctgtctctgttatgtcataacatggtttgctgtttcctcatattcataatgcggcttgcttctgtcttctactttaatttagtttctgaatgctatcgcactatctagatgtgctgctatggaaaattcattctctctattaactattgtatcatgtgattttatttaacaatattgatattgaacacatgacctctcctatatgtcttgtgccttattatttttttattgttaactctggcagtattgcaaagcacctggagtcagctaatacaatgttctccttcatatggtggataattggattttattggatatctgctgggggtgaggatgttatccgtgatgcacctcagctttactggtatgcatctttaaattaacagtcggcttttcataatgtcgtcatttcattatattcttttggcacggtaaacatgtttctgtatgactcactttgcaggctttgcatagtctttctggcatttgacgtgttctttgttgtattctgtgttgctctggcttgcatcattggtattgctgtatgttgctgcctaccttgcattatagctattctctatgcggtttctgatcaggtatggcttttcaagtagagataaattggttatgtacatgcagaagatgtacataattttatatgacattcatgcaatagataaccttttgcaagatcttattggaatcaggaaggagcgtcagaagatgatattcgccaaattccaagatacaaatttcggagaacagatgaacctgaaaaacaaactgctgatgagacaggaccttttggtggaataatgacagagtgtggcaccaatcaacctattgagaaagtactcgcacctgaagatgcggtaagtttttataaatttgtgatacatgtatctctgaccataacaatgcccgaggtgctaaaactcaaaaccttttccaattttattttagacagactcacatcgtatcgcccattcatcatgactgttgtactctgtctagtaaattcgatagtgtgaaggcaagggatactgaaacaatgattatgtgtttgccgtagctcatacatcataaaatattttcaacttttggtgaatgtatttgtttgtaaaaaatcgtaatgaaccatttattcaacatacaagttaaaataggaatgattcttacccaattaaccctgaccatgttttgaccaaaccgtttattccagccaatactgccatgtgccaagctatgcaaaatccagaggatgcacaggataattatcatgtccatgctgaatctctatgctatatgaaactttagattcattcttcacttgactactgcaggagtgttgcatttgcctttcggcatatgatgatggtgcagagctgcgtgaacttccttgtgggcaccatttccactgtgcctgcattgataaatggctgcatatcaacgcaacatgccccctgtgcaagttcaatatccggaaaagtggcagtagcagtggaagtgaagaagtatgattgtgtgaatatcctccggtcgagaacaccgatccatttcaacttcacacctgtctctgctaatgcaaccacaggacctgaccagtgtaaattttgtatccaaaatgtgtgattagcgtcatatatgtacttgaagtgactcaagactgctgttcatatccacatacatggttgtccaatgtgtcttttactgtccggaatacatgcttagttgccccgtgagttgtaattcttcgagtgatcctcacatttcctgcttgtgttagcatggtttgtgcttatgctcctgccttggtcattggttcagcacaaaaactgttgtaaatgggctatcggtcctgttgaattgtcaggtacaaacgaaatgcgtcctgcttatgattcatctcttgtactctcgaagtcctacagccagttcttccgaactgaagcattttaccgagctgggagtcataaaagatgtttttgatcggtctgttgttgaactgataaggtaataaaatatttgaaatctgagttggatgtgcgcatgtagccgttctgtaatcttgcatcagatgaggaccattatggtaccgttcatcaaatccggtccagcagctttcaatacacaaaggaagcagaaatttcgaggcctgtgtttagttccacgctaaaattgaaagtttgaagaaattagaacgatgtgacggaaaagttgaaagtttgtgtgtaggaaagttcgatgtaacaaaaatttgaacgtttgaagaaaaaaaagttgaaatctaaacagggccctggtacttgtttgtgtaaagacacagcaaaccttctccttccgtcccataaaaaacgaaacgaatctagaaccagatatgatatattctatatgatgaatctgaatatatgtatgtccagattcgtagtattataataatgtgttacatctagtaccaagttggttttttataagatggagagagtagttggcaaacgagtgaagtgaagtgcgcatgaattatctcgtcagcaaaatcccatcgccgccgcaaaaagatttcaaaagaaagacggccgtacccggtacgcgtctcgtgtcgtgtctgctgctttgaaatgttcactgcgccttgggccccacgccctgttcctgttctgtgtcctgttcaatgttcatgcgtgcggccgtgttcaacgcctcccaaaacctccccccattcattcccctttcttcctctctcagctgctttcgctgtgcactccgcactcgcagtcgcggccccgcagctttccctcccggcctgattccctcttccggtctccgcttccttcctcctccctcccccgcgagttcccgaaaccctcgtaggtaggggagccgccgcgcgcgagggcgaggctgcggagcagccatggactcggcggcgctactagaggtgtaccgccgcgatcgccgcgccctcctcggattcatcctctcttccgccggcggccgcgccgtcgacctctcccgcgtggacctcgacgccgtcagcgccgactacgccctcggctgcgtcgcctccggtgagccactgtcctcgactaagtgcttgctcgtctgtgttgaggcggaggcct

SEQ ID NO: 91460 - DNA, 753 bp, Oryza sativa
cccgcggttatgggcggtcaaccagattcaccgtgattagtctcaccttagtgtaatcttttaatttggatagtttaggtggatggttgggcctgtcgcaacatgggttagcgttggacagtggatagttgatgttaattaattattacaactgtttaaatctttcaatttctgtttataaatgctcgctttatgcaaatgaaccacttcagctcttctttgatgattccctgcatcatacccctattccggtatgacttgctgagtacagtgggtagtactcagtcttgctctacttttcccaacctcagagttcgagttcgggtcagatgaaggtttctccgaggagtaggctttgtccgtgccgtcgaggatgcctgtggagtggtgttcccgctgcagttcaagtcgaggcttagctcctgttgtctttctttctttccgctgcatttatgtaagacttttaagatgtttgtaagacgtggatctgaatgtcaacattgtcgtttgtgtaccccggctggtcctggacggagattttaatgcacattctgcttggaattctattcgggaatttctaggtgtgacaaccatcatcgaaaaatacgacggaagcgtcaaccccgccgagtttctccagatctacacgaccgggatcgaggccgccgggggtgacgacagggtcatggcgaatttcttccccatggccctgaagggtcaggcgcggggttggctaatgaacttgccacccgc

SEQ ID NO: 91461 - DNA, 548 bp, Oryza sativa
caacaccataccgtgcatccccgcacacgcggtgatctaccgttcagggggggcgtgcggcacaaccgcatgctcgagaagatcgcctccaaggagccccagaccaccgcgcagctttttgagctcgcggaccgtgtggctcgaaggaggaggcctggacctggaactcctccggttctggtgtggcagctccggccgcccccgggtccgccgctcggtcagggcggcgggacaggaggaggaagaagggctcggcccgttccgacgacgagagtcatgtcctcgccgtcgagggcgcttcgcgggccccccgaaaggggaggcctgcgagcaacaaaaagaaggaggccggcgctcccagcagggagcgcccgaccggcaagtggtgtaccgtgcacaacacctccctccacgacctcgcggactgccgcgcggtcaaaagtttggctgagcggacgagaaagtgggaggaggagaagaggcaggagcgtcgtgagggcaagaccccggcggctcccgcccgcaaccggcgaggtgaggccaagcag

SEQ ID NO: 91462 - DNA, 738 bp, Oryza sativa
actaatgaagtagcttagtgagattaaatcaacagaacaggtgcgcctaaatcaataaacatgaaaagcatccggaggaaagcacatacccatgccgagtgccgagagctccacttcgttatgcagctgcatgtacctctgcaacaaagcaaacatcaagcaccaaattagctatctccgtttcaaatccagccaaatccgcagccatgagccctaccgcaagcggggtttatctagggtttagataaaccccacggagagcagagcaaaaacccattccaaatatacaccctcataagccaagaaacgcaacaaatcaaaatccccacgaaacaaggcgcttttcttctcgcctctcgattaatctttctcccccacttaccttggcgaggttgacgtagaagaagagcggcttcttggtgttggagacctggatgcggttcttcttgtgcgcctccgccgcgccgccgcccgccccggcggcttctcccgcggctatggtgaggttgccgaccgcctccgtcacctcctccatggccgccgcccgacgagtccccgcggagcaccgtgcgcgagtgaaacggagagcgcgaggcggcgaagaagatgtggaggatttcggcggcgacggaggtaagagggaggggggagagccctatcgcccgcgtgtgtgggattttatacggggtagggttacggtttggaggctttcggtttttccccatttctgttttcgga

SEQ ID NO: 91463 - DNA, 686 bp, Oryza sativa
tgaaagcagatgttgctaaatcggtaattgaggattatgctgcttgcttggagttccgctttgatgatttccaggccatagagaacacaaaagatgacgttggtgtcctaatactacaggtcgttatttcagctttagtgtttcttttatgtagtgtacttaatatgcctatcttctaactgtaataaccattttgtcatgcagctacttatcgacaatatttgtcgtccagctcccaacattacacatctactcctaagattcgatgtcaatggatccatagaacggacagttttaaaaccaaagtcacactacaggttagctcgaggctctttgttttttgtatagccataaggtttgtttgacgaattatcatattgtgccacagttgtttaaagacaattcttgacaatcttgaaaaggtgacaaagccagatataaatgctttactgcatgaattcggttttcaggtttgttttctcagggatagaacccacctccttattttaatcctttagtgtcaaaatgtacgtttgactcattttaattcagcttctctacgagttatgccttgaccctttaacttgtgggcctgtcatggatctcctgagcacaacaaaataccagttcttttctaaggtacacattcttgttttgttcttttaaattaaaatagctaaatgttg

SEQ ID NO: 91464 - DNA, 685 bp, Oryza sativa
cagcaacttctctatcataaggaaggaagctcaagcagttattgatttggtatgtcattcttctatttatgtaaaaaatagttgaaatgttttgcacaatgcttatgtttatagcagcggtgttgcatgtctatgtgaatatacttgagggtacaacataaattgcaacataagagtaattatcctaaaatttaaaattgagtatatgatcagagacagattatccagctacttatgcacttgtgcaaacatttagtcaaaacaaaatgcaaaaagttttcctcaaatcttaaatttgtatatgaacattagatcaattatccacctacacgtgcaaggctcaaaacacgccattgaaaaatatgaaattgcaatggtgtgatttgatctcatgttaccccataaacctagatctaatatgaattttgaaatggagattattgctttctatgaaattgctacagttataactcaaacatgagatcaattttgtttccatcacaggttgccaaggatgcgatccatggaagtgaagcagggaaagcaatttcattctacgttcttgattcactgattagtattgaccatgacaagtattttttgaaccaaattcagagtcgaggaattctcagatcatgtctaagtgatgttaacaactacttgtctaaggtctagacttcatttc

SEQ ID NO: 91465 - DNA, 1844 bp, Oryza sativa
gctcttttgggtgaaggtcaggtaatcagcctcgttgtttggctcacgcaagattgacaatgatgtttccacacaatctttctctctgtgtgtggcaactggcaaggacttccttgtgcacattggctatcgttccatccagagcgaggctttctagcttttaccgaacggctggcctttgcttagctaggctataactgtgctagccacctagctgttttaagaaaaagatgtagcctactatcttaagaacacatctttttcattcagttggttactcctctagtcctcttaaagccctagactaaaatatgccatatgcctttccatatattttctttggcacaatttagaatcttctagccttcaaaaactctgctggtaacaggttgcaacctttgtttgatatcttagcgtgataattttttaggggacgtctccaatagtttgatcaaacacatcttttggtcattttattgcattcagtatgcttagtctggttggactcatttaacctatgaactttatacaggtcctaaaaaaagggcaattcaaccttgtagcaaggtgaacacgggggaaggatcttcagtcattgatgtagcatcatccactatgggtgaggtcaaaatgtcactgaaatgcagtgttgacccaaagttccgcatgccttccttagaagcagttttcaagatggtggaggataaatatcttcactcatacaagattctgcctcctgagttttccattggtagcctcatgaatgagatatgccaatgtgttgtacaactgggtagtgatcatattgcagaacataatacagaatcagatgttgctggcaatgggagatgctcacaaaatgagccaatgacaggtagcattccatttgtgaagccaatagcatgcgaggatggtggaaataggaaatgtaaatctgcaggagaatcatttattgtggaagactcagaaaattcaagtgttgctaaacagcagactcatttggcacttgccaacttgaagcctatccatgatgtaactgatatatccaagggagaagagagagtgaggatatcggtggccaatgaatttgcaagtgagaaatgtcctccttccttttattatatacgaggaaaccttgttttccaaaatgcttatgtcaacatctccgttgcaagaattggtgatgaagattgttgtgctgattgctttggcaactgcttgtctgcacctataccatgtgcttgcacaagagaaaccgggggcgaatatgtgtatacaccagaaggtctggttaggacaccattccttgatgaatgtgtttctatgaatcgtttcccagaaaaatgtcacaagttcttctgtaaatcatcctgcccactcgagagatctaggaatgaagcttcaccagagccttgcagaggacatcttgctaggaaatttatcaaggaatgctggagtaaatgtggttgtaacatgcaatgtggtaaccgtgtggttcaacgtggcatcacatgcaatctgcaggtaatatttaatgcctttgacttgtattggtatttatgctatatttgtcattggcagtgtgcagattatactaatgccgaatgtttgaattactgtcaattcgaacgtccaggtatttttcacaggagaagggaagggttggggtcttcgcactcttgatgaactgccaaaaggagcctttgtttgtgaatatgttggggaagtactaactagtacagaactgcatgaaaggacacttcaaaacatgaacaatggtaggcatacctaccctgttctcttggatgctgattggggttctgaaggtgtgttgaaagatgaag

SEQ ID NO: 91466 - DNA, 688 bp, Oryza sativa
tttcttttctgaaatcctagagacgatactgccatatcatatccgtcagaaaatgacagagaatgtgtctgaatcttctgacaggacggtgctgttcggggagtacaactgcaaagggccaggggcgagcacgaagcagagggtgccgtggtcgcggacgctcacctacgacgaggcgcggccgttcatcggccggagcttcatcaacggcgagcagtggctccggctgtagatcatcgccgattcttcacaagttcagaaagttcagactgctgctggttccttctccactgcagtctgcagatagaacatgtacctagtagatataatagctgacatgtaacgatgtaccatgtaacaaactttgacatacatccatatgtagtgagatgagcagccccatcatttcacttatctttatgcttattcgtatcgcctattattagcaaacaaaaagtaatttataggtaaaatttaatgatacaaaagcaaaatgttgtaaaataaaccacgatgaaaccataaaatcaacttcaaagattgagttttatagaattcaaagtttgcgatataatgggaccggagatttgttagaccagccaatcatagcagatgagagtttgcatgtgtaaaggaactaggtaatgcatcatatgaatgtgacatgctgtgccagggacatcagggg

SEQ ID NO: 91467 - DNA, 2828 bp, Oryza sativa
gtatttaaacattgttcagaagattctcctaatctgccgcaaaacatcttgtgttatataatattgttgagaagattctcttaatctgcagcataacatctagtgttatataatatgagacatcaaaagttcgttttcctactgaaaattaaccaataagaccaagttgcaaaaggcaaattaaatttgtttcaaagggtcatcacaaagagcatcacaatgagcgatttagattttctcttgggtacatcatgatggatccctatgagcaattgacgccctctgtttatagcactaagcaagacaagttgcattgttgtgtcaggattctaagtttaatgtcttttatatctttctgtccttttctgccggataactaaatatctgaatggttttcataattatccgagatacaaatgaatgaattaattataataaaatttgacaaaggatttaaaacaacattctaagaaaaatatatagaaaattttctataaaaatcataaaagctcaaaaagcgtttatttggctatgctgaaatatagataggttgaaggtaaagaacaccgacagtgtctagcctctcgagaaccaaaggatctttcagttttcgtagtctgcgtatgtttcggtgaaaagaatcttgccactatagacgatccaaaacacgttccagtactatcagatttgggccacacgcaagccaggtcaacaacgaacagttttgagtacagtaattaactagccaaaaaaatggatttacagttgcatagttttaagggattagatcaataaagtattggtacatagttcagggcctcaaaatcctcccgtgtgcaattctctatctgatataaaccactccaattgtagagaacaattgatcaaggcatttttgaatcaaaggccaattttcaaaaccgccttatcctacttgtttgatacataaaaaaaatctgtctttaaacttaaggaagcaatgctacaaaattgcctgacgggacttcctctacagaatacatctcaattcttcagctcaaatggtctgtaacaccccctccaaattcccattgcttgtgaaggtaacccgttcagcctcttgtatcgaatttcatcggtgggaatggttgcaaaaaaatgcaaggtggaagggatttgtcctttgtgtgacttaacaacatttaaggggtttttcggcatcaaccatctactactaccctacaagtcctcgctctcttcttttagtcggattggatggattacaactccattttgagctgatcggacacggccccatcttccaagacgaggctcctggtaataaaagatatatcagtataaaatttaggattttgaaacgaaactaaaaagagtactgtgttgcaacagtatagaagactatggaatggattaacataaatggtatctggtccacttgtagtgctaggattacaaggcagtagtattcctattcatcggctaatgaacaagagaatgcgatgatgaatctgcaattctgcaatctgcattcacttttgaggctgtcatggagtttcaaaacgtagcaggatagggtgctctacttctattaataaaatgttgtaagttgtgtacagtgggaattttagttcaatcagttaagtgtttagccagaaagataagttcaatatagttgctgcttcccagtctttatttgctgaatagtatctcgtaataagctttttagtcaaggcgatattttccattgtaatcaatgaaaatggatagggtttccatgctctaaaaaagtttcaagaacttaatgtcaatgattaaaccggaaaattaagtttttccatccctgttgcattctcaagataatcttgggaacatactgatatcaaaggttaaaaaaaactgaacttttctgtaacaattaacaaaggggatttaatatactgacctggcccacaccagcaacaataaagcgtccagatttcgggatggcgagagaattaacaaatccatcctgataatggtagaacaaaatgtatcaattatttgcaaccaacagtaaaaatatgtagactcagttttttctagcattggcagtacaataaccttgtcatctgaaacgattgccccttttcttggaaagtgccattttcactgtttatttattgggggaaagcaagatgcatgatttgcaatgttttcattttctacccaattcaattaattgcataaaagaagctgagcagctgtactattgtagtatggcatttagtaggtgcacagttatttcatattaattcttagatctggtgtcttgatctaagacccatggtggtcctgataaatgctgtaaaaccgagggagtataattatcaggccaaagtatacgctcctatgaagtacaacaatcagaaaatgttagtgaacgtaactaatatgattatacaatcaactaaaaatcccaaaggacctagaactgagacaataaattccagtaatgccaagtcaaaacagtcagaggtgtcttgggaccttggtagcttatctatggtgcattttattttcataataacatccaaaggggtatcatggagtagctagtgtagcttaccagtctcaaactaaataatggccgaatgcccttagaatcaggttcaatagcccaaagacgaactgaaccatttgctgctcctgatgcagcaagatcagaacctcttcttgcagcaatagcactaacccatgattgggctgatgagacactttcaggtttatgtatgccattttctgcatttgaggtgcaaagcaatagataagaaacacatatacacacagaa

SEQ ID NO: 91468 - DNA, 671 bp, Oryza sativa
aagcagcaacactccaatgatgcagtagcaggagcacggaacagtagttgtgattcttctggtatctgtccacacaagagttttcaactttcaggttaaatactgagtcacacaccagagtcaagccagtctaagcgtcatatccttaaattcatgtggtccaatcagttttaccttggtcagcatcatcatggttatttagatttcccatttgaaaatgatacaatacaagtagatttttttaagagacatacttccataatattataacattattagggattcacaaacaatatgtgaattttggttagtcacgcaccataatgaacaatgggaaaataatatttctatgtatcttaatcctagaacaatgtttaactaaacagtttctttcagttataatatgtaaataatcttagtgcatgtgcatacacacacttttaaggaaagatgtaccttccaaagatgcattgttcggtcccgtgctacagtcaaaagcctatctttactaagtgcatccattgtcaagacttcgttctgatggccaaataggcagttcatgtacgttctgtcttctgcattccactgcattattttacggtcaaaagaaccagagaatagctccgatgagtctggtccaaaggaaagacaagatattgctcctcgatgac

SEQ ID NO: 91469 - DNA, 2216 bp, Oryza sativa
ttgtcggtgcttcacgagcatcttaaagccatcctcaagatctggttgtaatatcctgcaatagttttgcaaattttagtcatatctatttcaacctcaccatttatgtgatcagtatttcaagaacacttatattatcttattgcaccttttagttagagatttttttaaaaaaaagatggattcaattaaaaggttatcatatttatatagcttttaacagctgtagacagttaccacacccagataactgatgtcatatacaagtgacttgtggatagcaccttcagtaatcatgatgacaaatgcattcccgagccatctaaatgtgtatagttcttccgctcacgtttcattccgtttcagcatgctagttttggaacattatccaaatagatcacgcatgaattgagaatacaacctaagtaaaaagtaaatggatggggatggcaaatgagaaattattggaagaagctccacatgcaaacacatctaattttgtagataaaataaatgccatatggttcaggtgttgagggcatatataatcatgtagcaagcaatatttcctaatattttaaccgccccagtttgtgaactactgtctataagcagagtagcagattctgcgtaaattaacattatgccaaagtgtacaggttgcaaaaaaaaccaatagcaagcggaagaggaggggtagatgtgaactccaactttcttcttccattatggcacatcccactacttgtgactataaacgattttcctctcatgtttggttctaacagaaacatttgaatatacagttgtttggatgtcccaattcagtaccaccaatgcacttgctggagccataaaaggacaactgcttgaatcccaagaggccaagagtgcatcattcacaacaagaacttcacatgtatttcgaaactaactcctatgttgcaagtaagatcagtgtaatacaaatatatgacaaaaagttgaaagcagaaaattacaagataacaagaatcaagaataaatacgaggttttagaaagtttagaggatccaggacagttttaggcaaccaggctgttttaatggttggtttcaggacatctctagtttgttgttaactctatattttcccctcgatgcattttgttcggttggtcttatataagcaataagccaataacataagatcttggcgaagttaacatgaaaataaatactctttccacatagtataacctactggttcaagccagtgtattcctttatttctctccatgattatagccctttatttccctccatgaggatatatcattgtaccaccacactcagataaccatatattagcaggaatgttgtccatattccacccctaaaagcacccacctatgtacctaagcaaaaccccaaacgcatacatgtaacctgacccgtgtgcttgtcagctcgcaaaacgcaaagggctattaatttggaactaatcaattagtacagacaatggaacctcactctgatccaaattgctaccctaaaacatcagagatacatgtcctcttcatttcaggttatgaactgtgaccattgacgaaattgtcgtgtaaatttcgttgactctgaccactgacgaaattgtcgtgtaaaattcgttgcaattgagggcgcaaacattcagagctactgtccacatttagggggctgcaagttggaatttgcaaacaattcccaccgacatttagggggggggggaagaagatctcacctgtcggcgagctccatccgcttcctgccactctcctcgaattgcctcttgaggaggatatcggcgacccgcctccggccggcttcctcgccctcgtcctcgtcctcgtcatcctccctcctcctcctcgccgcgtccgtcaccttcttgagaagctccttcgcgatccgcatcttcttctcccccgccgtctcctgctcctcctcctcctcctcctcctcctccccatcgtcgccgacgccaccagcagcagccgctgccacgccctccaggtcgctgtcctcgctctcgatgtcctcgtcgcggccgcccccgcggcgccgcttgggctcggactcgaagaaggggtcctcatccccgccgccgcggccgcgggaggtggcgcgtggcttgggccgcgagacccgcttccgcggacgaggcgccatggccgggggagggatggggggagggga

SEQ ID NO: 91470 - DNA, 672 bp, Oryza sativa
gatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggcacctatttcgcacggtactgctcagcccagaggtttcttaagttttgtttatgtttttgtacgaaaacatcaccccgtcgtaacttgatgttccatcctcgcaggacctcgtttgccttcgagcgcccctagcttcagagcagtgcgacctacagcaccggtttcgcacggtacagttcaacccagagattagttcatttttttttcagcttttgcacgaatatgtcaccatgttttaactgcacgtttcctcatcgcaggacctcgtctgccttcgagcgcgttcgcaggcacgaccggcgcttccgcgagctccgcaggggcgttcgccacctcttcgggcgcgttcggcagctctttctcttacggagcgtcgatccctcgcccacacggtactttactttttattaatactattaaaatacatgtatgaaactga

SEQ ID NO: 91471 - DNA, 698 bp, Oryza sativa
cttatgaatagtaggatcactaggattgctgaatatatgctttgttgtacataattctttaagaaagtgtgtataaatttcatttctttgtgggacactaagcagcatttgtttttttttaagcaaatctgcgtttgcttattatgagttaattcgtacttcttctcaactgcaagtttcagataactatgacttggtactattttgcagatctatattcttttgtacaaggaagtttctcttgcattgaaaattaacagcatgtacagcaaacagaggcttttaaacattcatgagaatgttaaagttctgcgataccctgatcatttctcaactggcatatacttatggtacggtgagaactttacactcatttacactatttctgcagttaattagatccttatggttggctattgccttgaaggtcacatcatgagaaaatcgttattgttgataatcaagtatgctatattggaggccttgatttatgctttggtcgttatgatactcctgagcataaagttgtggatgttcctccttcaatatggccaggaaaagattactacaatcctaggtaatgttttgtgctctcatcatatttttatctcaagatttataggatagtgtttcctaatttaccgaacacgattaatgtttcctaatgattctaaaacctttttttttgcctatctaat

SEQ ID NO: 91472 - DNA, 1916 bp, Oryza sativa
atcaggcggcgtgtcgcctgacaccccctgtcacgtcgtgatgatgagaggctgcttagcctcttatcacaaccggagacgacttgcctaacccggtcagggtagggttcccgtttcccggcgcaggtgaggacccgaaagtcttcactcattatgacgtgcgtgtcccccgtgtcagccggacagatttggcaagccccacgctgcagcaaggcgtgcaagagacttccaaggcaagtaacaagacatgcatttaatgtggttatcctccctgaataggctaggtgggcccatgtggtatcccttgagatataaaaggagttccaggcctacttaggaaggagatgggcccttttcactagaggagtctcctgcccctcaccatcaacaccttctactccaactaggagattttgtaattcctcactcaatcagctaagcacgggagtaaggtattacgcttttcaacagcccaaacctgtataaaccccttttgtctcatcattcttgaggggcccgaccccctctacaccgcctttctcaccgagtcctcgaatctcacccacttttcccggccaaaccaataagggggacctcactgccctccacttgcggagttcaccctccgacacggcctcacccaagggtagccgtcaaccggaacacagggattttaccagccggatcgagagaatatgagaacaatgcaaccacgaacagcctgaatctgataccactgtaacaagtcgccgccgccttcgcctctgatttaccagattcgatccagattgagaaatgaggaagagagtttggggaagaagacagcacgagacagaggtagaagaagaagacagaaatagagtagttgaggaagagacgtattcttgatttcagctattcgataacgtttacaatactccttcccacattatagtctctcttagatgggctcacaggccagactttcatgggctcgcaggcccagcacatcgacaacctcttgcgctcactgtaacccgtcacacaggcgtgacaagttctacagtagctacctactatggataaaacccaccgtatggaaaacgcatggtacacgttgataactgattaataaagtacaaaggggtatcaagacaaggataccaggcttccagcggctagaacatgcattgctttatgacttcacacaaggaaaccagcagtgcacgctagactgtgccggaataaaacagggacactttcttttttttttcttttgtctaaaatgagtggttgacaaatctttaacaatccattaattctatatcatgtcaatatatgtgagttaaaacaagtgtctccgttacaatgtgatcttgctccgtgcctggacttcaagagcctgatgggaacacgggatggaatgctcactacactactataaacacaatttgtatataaacacctgatgaataataattacacgtatcacctattatcatacacgaacacatatacagatcttacagaaagatacagacacctattgcgattttttcctctccttaatttgtaggtctagtgtcaactgaaagcaaaaacatcagcaagtaaaaaatgcacaagccatgcacaaaaaattccttacgcattcgtggtaaacagaactactgctcttctgcagcaaagttgggttctgctggtttttgtaacaaccttgcaggcacactttccttcaaccgagccttgcgggtggcatttctcctcaagatccgcatcatgttgccagcgaaacgcgaagcatatatcgctgccctgaagctgagagttgtagcaccgtcattaacgattgcgaactgcaacctcttctccttctcgcgtagagagtcttcgatcttctttctgcagtacctatgccaggctgcttgtatgaaaca

SEQ ID NO: 91473 - DNA, 9655 bp, Oryza sativa
caggatcgccgaggaaggtgtcaggtcggcgctgcggcgggcaccgtcgatgcccgtcacgttgtccgcgacggtggcgcgacgacgacgccagccgcgaggatacagtgccggtggccaccgggtccacgacgccgggcatgtccaggctcaagcacgcccacagcacgctggagagacactgccgctcgcacgcgcccaccccaaacgccattgaccgccatggcaatcgatctcgacatggatgatgaattgatgattgatctgagtttaacccattgatccatgcagactgaccggacgccgagaacgtcggacgatggccatcgaaggcagccgcctccgccgggaactcatcctggccgctgggaactcattgagagagaagcaagaagacagaacagagaagagagagaatgagagagaaaagaacaaagaaaaagaaaagaattcaaagggtagaaccgtatttacatggttgtttctctctcttttccttcaaaaataataaaataatgccatgagtgtacaacagctaattaccagttttttacaatgccctacagtaaatacacgtttttacggtgtcctccagctaattacatgttttttggatgtcctgtagcaaattttgccttttttttaactaggttcctaggcacccccctagctatatgtagctccgccctgagtttgagggtgactacgagattaagtccccataacattatgttgtgctaattcagcgaaattttgctatgcgaaaccaagacacgcacagccttgttaaaagagatttggtggagcacatatgggcaaggttcggtcatcagtatactgaataaatacttcactactaacaatttatgttgtgctaattcatcgagattttgctaagtgaaaccaaggcacgcacaaccttgttaaaagagatttggtggagcacataatgggcaagtttcggtcatcagtatactgaataaatacttcactactaacaattatgttttccaaataggttcagggatgcatggggccaacttgctctccacattgccctgcgaaaatattttcgcaagtgacccttaagaggtgtgcctgtgataatgcatcttttatcgcacgagggcatcttaagaggccggatgcaaagatagattttcaaatgtggcccttaaactatattttttatgcatgggcaactatggtccaactacaattcagagggggtcttatccgaaaaaaatctattatatagtagtgtacaaaatataaccactagaaaatagattcgaatatgaatataataattatttcataaaaactatactgtaataaagtatatcttatattctacgtgacagtgcaacaagccgactcatttatatgccattatgtaagagcccctcgagcgtgaccacttccaaatgctcctatgttcatcaacattattctagctgaacatgtatgtaaattaagaggaagcaatgaaggtaattgagtgatacatgcatggacaggtgcgcacgatatacctcgggtttacagcaatgctagctccttctcattattatgtctctcatctttgatattacttgtattaactctctttcgagcctggcctgcatgccttaatttcacacacattcttaaattcatactccatttgcacgctgccatacagacgtgtactgcagcaaattaaactagatagtaaatctctcatttaaggcagactgcatatgaattattagtacttaaacatgacattccttttgctctacagatactataaggttgagccactgatgctaatctctttatttgcacaaaaatctgatctagccttccgagccacccctcccccccccccccccccaaaaaaaaagagaccagtataaaaaagctgtttacacacaatgaactgcaaaaatcaaacaagatggaattcatcctaggcttgttcaacaaattaattagttaaactcaatttaatttataaagttgtgttctagcaccttatgcatgtctctttgtgtgtgtcctattgctttcaatttgtttctcatgatctagtggaccaccactctaaaagatgcacattagccctcctgtacgtacgttcgtacgtgagattgatgagctgctagcttgcaagaagataaagacaacgaatgcatgcacatgcatatgagtcgaagataagtggcatatgctacaaatattttgttgattaatccatattcttcgatttgttctccattaaagttgcatattgcatattgcccaatgtaatattccgcacctttgcctaattgcctcaatcatgtatgtctctatctttgttgcaaaccggtacaacgacgacacatttactctcactatcatttcggcatttccaactcgcccaccactttacgtgtgattatcttgtcaccggtacacactgagacttcaaccacatcgattacggtaccctatgcatggccaccctaattaccaattatatatgcccttcatttttggttatcttgactgttgtcatttcagctctggactctagtctaagtatccatatttgtttgcgtgcttagactaatgatgatgccagaatatatggttggtagttaaaaaggatattaggattggattgctaagttttgaaatcgtctcttatataaaccgcatacctatgctcaatacaacatcaacatatatacacaataaatctcatatctctcttacatgtttttacccagatcttgtgaaagtgcttgtatacctgttgacgaaaaaatcgaacacactggcctgggagatctgtttagctcctgtgcaggtccaaatcttgatgggatgcgggcgtgtcagtcagtttgatcctgcaactgacaagatatgcaaatagtagatcaaaacagctgatcggctgacaagccgatagagtagtttcagccgatagccaataatagccgaagccgataccagccgatagcgatagggtttaagcaatcagctatatgtccaatgtagatgatgatataaaggcaatcggctgatgatgatgtaataaaataacaatataatccagtataaaccaatcggaaaataatgatatgataactaagtatcgatccaaaggttaaagcacacatcggttggaggtctgatgtcattaaatccacaagattagattaaacagtgaaacctttgttgtcatcagctaaatccaacttatatgtatatgcaatccttatgagccgatgcaatgtacagataactcaccggctaaaaccccaatgaaacccttattggcaatcaagaagcaggctagagattatggttctaaacacgacttagtagatcaaacttaactgatgcagcactaagtatgaaaagaaacataatatctagacaatcaagccgttgactaagttttcagggtggtagatgtctaaactaatctaatctagcaacgcgatttagccgatatcggcagaaaccctaaaacgagaatcagccgatagagctaaattgatatgctaagactagattaacaaagacatatgataaataggtaggcaaatatatcatccaaaccatagcaatcatggaggtcgaatgtactgatgcagccttgaacgacgccgacgtaaacgatacagttactcgggccggcggaacattggacttaccccttagccggagatcgaacaccgatgcagccccgcgttaggtgccaagtcccgccggacgataaaataaagtagaaaaggtaaaaggtggcgatgcgccgaattgtattgatcgtgaagatagattacatagaccccgggtgtacatatttatacccatgggttaatacaagttcttgttggacaagaaagaaactttcctaaagataaaatgaaaagataaagtccttataggacactaaacacactttcctaaaaatgaaaagaaactaacaaactattcctaattaatagataacttgccatgccgcattctctttgaactcggtctcttctggataagcttcctttagtagatcaatttccttaaccgaatatagcaagaatccgacaactgacgacttgacaactctcatcggctaatctcaggacttcgaagccgatgctgactctaagtcgatgactactccgggcttaccaaattttactgttaacaataccctagctagctacctcatgtgtgcatgcatgcttttgtttcataggtttctccgtatagtaagaaaaacaaaagagaagcactaacaacatatcttatggggtaatctacttctcaagtactgactaaattttccttgtgcatgtatcaaatcactagctttttttaactctactagatcagccataatatctaacaaaagactcatcactttccaatccattggatgacaacctaacacatcagatcagtcttgctcatcccttggatgcatgccgacctaactatactcatcactctggccctctcgtccctaattcaaatcttagaaaaaattttctttgacaaaaagttaaacaacatattcttctaacctagataaagacttgaaaattttgaataaaatattcaaatttagatccagaaaaggtaaatgcactgtaattttaggtctagaaatttattttctaacgtaaataaaaaaaaataaaaatttaaaataaaaaaaaataaaaatttatgtatatgaaatatatcacacgagctaaaaatttgcaataagtcacactacaccccttaactatcttctataaaagaacatggtctctcgacaatatatgaaaccagatattttaaacccctcaattatatatgaaaataggacaaaataccccctaaggcaatacaaccggacttcaaatttctttctatgattttaaaatacactctaaacagtgtttttacttgtgtatataagccacctattaactgtaggatcgaacaacaagtactaagcctaccagataggggtgaatggtagaaacataaaaagccgaaaacttttagcagaactaaaagttaccctcgaagctgatggagatcagtctgacctacatcagatctctggtctttccgctgtagatgtgccagtccaaccatcttggagccggttgcagtcggtttgatcgctcgtatccctaacgtaactgtcgaacccgagcaaacaaaaattgtagatccattgaaagtagattgaactatattgcttctattcgtgtttacaaagtgcaacaacaatagtcctctcacaaaattcaacttatctcgaaaccctaattttctaaactctacccacacaaaatcgataccgggaggcctcaacccctccccccccttctctatttacacccgaggtaggcagcctaaaaccacgaatccaacttgtaacagaagtcctagtccactaggtaaccttccggtaccaagaaacaaacttatcttatcacaactcaaactataatcttttcaaatttggactccatgaaaatttgacacctcatctcatatacacacaatctcccatcgtatgctgcatggaattttcaccaaccacgtgtgttgttctttagcgtaagcattccgcatgatatactgaccatctggatctcatctcctcccaagttgacttccgatccatcatcggcaactctctcccgaggcatcaagaaacacctacacatgaatcaaacaagaaaccatatcccaacttgactcaacattagcacctagcagtattacatacgtatagaaatcatttaaaagtcataatcacaagtatcaaaataaacaatctgaaactaataccgacacagaatcagtcgatcagaccgtcgggctagccggtctgaccggccttcaccacccaatctgactggtcccacaaagacaacaaaaccaccactttgccaaaataatctccaaatatcaaaccaattttctatcatgccaattgtgctcatcataaattaataaataaaacacactttgatttcatatcaacatgagatgcaaggaatatagttgaatacaatgtaagtaaaaatcatattttttggatgcaaaaataatgaaaaccgctatgtgttactcatggagggtattttgtcaagcttcaatagtttagggagaaccattgcgcggaagtattagttatttaggggtgtaataaaaaaccatttaattttgagagaatccactcagtaccactgagttttccccacttctacaatataccactgactttgtcaagttgaataatatgccatcgagttttccttaacctccactgcgtgccatcgccgtccacgagccattagttggcctccgtttgctgtattgatttttctctaaatgactaaaataccctagcacatcatccacaccaaatcgatctgctgctgttttagtcatttagagaaaaatcaagttcatgtgtcggtataggcactgtgattttactatggctggttttgccgatgcttctgttcatgcttctgttggaattaaaatcacagtgcctagcacatcatccacaccaaattgatctgctgtttctgctgcttcactgacatcctcctcagagacaagttcatgtgtatgttcagtttgttctggtggtgtgattgacacttactcacctgttgctagattgaccacaattcgtgtgctactttccctagcagcctcacatggtcttctcgttcatcaaatggacgttaagacagcttttcttaatggagagctggatgaggagatctatatggatcaacctcatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattacactcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctcaaatccgggagatgatcactggcgtgcgcttgagcgagtaatgcgctatctgaaaggtactgtggaattggggcttcactatactgggtatcctgtggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggctacgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactataggagagtaccaatatatataccctctccaagtgaagatgcatatactctcgtgagctgcaaggcaggttggctatgccttaatgagttctgttggctttaattagcaaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttgaaaaatcacaaaagcccacctcatgggatggcatgcatgtggagtttagtaccaccttgcttattctaggagagggggacctccttaaaaggaaggatgccctcctagccacttgaagcatgtgtggtggagagaagaggggaaacacacgcgcgcgctcgctcgcctcgccgggccgggccggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacttgccgtcttcacgcaacacttgcgagatcaatctagggtttgtctcctactctgtactgcgccgtcgctcgtagactactccatcccgctcgccggcgtgcaccggcgatcgggagagcaggtctccggaacctctgtcttcgacgttctgcaccgggagaaggcggcaataaggtttttgggaagcgcttcgcgcgactgctccctgttcgttcgcgacggctcgccttcctcttcgctcgcgtgtttcgtgccttcgtagacacttgcgaaaagtttcgaccaagcagccggtctttccgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacagtttctcctccccgtgagcggcgctgactccccatcgatggaacgccgaccgctcggctccccaacgacgcgccggcggccgtttgcctacctgacgacgcgcagccggctggcttcccatctacgcgcggcaggtcactggcctcttcatcgacgcgcggcggatcgccgggcttcccatcgacacgcg

SEQ ID NO: 91474 - DNA, 1379 bp, Oryza sativa
cgcgcggttcatgttgcctccaccacccacttgtaaagctcaattataagctaagctctctcctccttatcctcttttggcgggaaagagagaaaaagggaaagctataaagagagatcgatcggttcgatggcgagagacgtcgtcgaggccgcggcggcagcggatggtcgtcatcatcacaaggcggttgttgcggcggacggcggcggcggcggcggcgcggggacggcggcgctggtgtgggactgcggcagcgcgctctacgactcgtacgagctcacctccttccgccgccagctcgacgccgccgtgctctcctgcggcggcaggtcgctgtccatgccgcacctgctgtcgtcgtcgtcgacgcagcagcagcagatgccggcggggcggaagaagaaggaggaggcggcggctgccggcgatgctccggaggctgttcgggaaggtgctgctccggctgaggttccccgtggcgtcgagggcggcgaggggtggctggtacgactacggcgcccacggcgacggccgcccggggtcgccgtggtccggcgcgctgacgtcgatcccggaggagagcgccagcccggagaacgggccgtcgtcgtccccgctggtcgacgacgacgggccgagcgcgctccgcaaggcgcagtcggagcgcttcgtcggcagcaagacggcatcgtccatggtgcagttcgatgtcgtcttgtagccgacgctgctctagctagtctctgcacgacacactacttacgctgtactatatagtactgttcatgtcacacctgtaaattaaattagcacgaagtaaaaattagtatcaaaatcagtcgctgatttagttgttatggaaagtagctgcaggcttgagggtcttcaagcagtgcaaacaatgggggattattgagacattgtttgttgtggtttgaacaattggatacaggaatacaggtgtggaattttgggagaggttcaaaattctgggtggaaaatttctgatttcttttatgtcggtcaagaagattttcgggacaactgtaatttgccaagtttccatgcgtgaatgatatatctgcaaaatattattgccttcatatatatgaatactatccatgacatgtataaaaacaataaaattataatatatgtaattagtactaggagcttcccaagacaaacgaaattttggaatatgttgttaggtttaaaaatttgcttgaaattttcattcaaaagttttggaatttggttatcctcttctgcacctaccacccagccccccaaaaaatggtagtctagggtgcatgatgtgaaaatatgaaggcgatggagatagagacggcacaggccaaatgggtcacaaaatg

SEQ ID NO: 91475 - DNA, 700 bp, Oryza sativa
ttcctcacccccaactatgcaaaccggacgaattacccctctcgacacaatccgcggtggttttggtctacgtggcgtacgcgtggcagtccggtcagcattctattcattaaaaaaaatgtgggacccactctcttctctctcttactctcactctcactctatgtcatctctctctcacgcgcacagcggcgaggacgaggggccggaggcggaccggagtatcgtactttttcctcttttttttgtttacgagcagttggtttgatagccagaccggagtatcaattcatcatttcattgttgaatcgggccgttcaattcctctattggaattagaaggatgatctgggctattttgattataggaattctataagaaattataggatttcaattttcataggatttattccatctcttccaaaataaatcaaaatttttatataagaatctagagggagagattaagtaccacacttgaaatagcggaacaggggacagaaaatagaaaatcgaaggaatacttccatggatctaccaacatactccatccatccataagagttagacttatttcatattttagtgtttccaaataaattatttctagtctctatacatccatgacataaattgaggggtaaattaaatgttagattagaacccgaacccgaggagctatattaatacttattgg

SEQ ID NO: 91476 - DNA, 616 bp, Oryza sativa
tgcatgtgttgtgccaatgactccattgtacagccgttcacagaactcttccctaaatttcatgctgtagttttttgtcataagcttaatttcctcttgtttaaagatttttagattgccaaattgctgtgctgatgacttcacattctttgaaggaattgagttgcttggtgcacttatgttctgctgaatcagatttccctcttcttcctctagagctttcctaatcattcttagactagttgctacttcaaccatttcaggacgcacttcaacctccctcctcaagcatttaactgctaacttgccaatatcttcgaggaagttcatgttttttgtattgttgatgtcctcgtcaaacaaatgcatcaccttcttcccttgttcaacagcctcagtgaaacgctgagcaagggtgatggtcccatccactgctttttttctggtgatgatttccagcaaaaccactccaaagctgtaaacatcactctttggggttagaattccattcatgcagaatgcaggatcaacataacctatagatcccatgatattggtagtatgttgagccccattagcacaaagcaatcttgctattccaaaataagatagcttt

SEQ ID NO: 91477 - DNA, 601 bp, Oryza sativa
ctataggcgaattcgagctcggtacccggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattatatcaccttcctcatcggatgatgcg

SEQ ID NO: 91478 - DNA, 2239 bp, Oryza sativa
ccattctgcctcaacagtaccagtatttagtgccgtcagttttgcttccatggttgacctcgtcaaaatggtctgtttgcaagaccttcacgaaacagcaccaccacccagtgtgaagacatatccactagtggctttgatctcatccacatcagagatccagttagaatcactataaccctccaataccgcaggataccaatatagtgaagccccaattccatagtacctttcagatagcgcattactcgctcaagcgcacgccagtgatcatctcccggattagaggtaaaccggctcaacttgctcacagcaaaggagatatcaagcctagttgcactagccaggtacatcagcgagccaatgatttgtgagtattccagttgattcctagcaattctcttgttcttgcgaagcaacaagctaggatcataaggtgttggagagggcttactatcaatgtagccaaaacgattcaaaatcttctccacataatgggactgcaagagtgtaattccattctcacctctaattagcttaatgtttaagataacatcaactactcccaaatccttcatatcaaaattttgagacaagaatgatttaacctcatttatcacctcaaggtttgtcccaaatatcagtacgtcatcaacatacaagcacagaataactccctcacccccaccatggcgatagtacacacatttatctgcctcattgactgcaaagcctgcagatgtcaatgttttgtcaaatttctcatgccattgcttaggagcttgtttcagaccatataaagacttcaacaatttgcacactttgccttcttgaccttcaactacaaacccattaggttgatccatatagatctcctcatccagctctccattaagaaaagctgtcttaacgtccatttgatgaacgagaagaccatgtgaggctgctagggaaagtagcacacgaattgtggtcaatccagcaataggtgagtaagtgtcaaagaaatcttcgccttctttctgagtatagcctttagcaacaagccgagccttgtactttttaatagtaccgtcaggcctaagcttctttttgaacacccacttgcaccccacaggtttacacccacagggtcgctctgtcacctcccaagtcccgttagtgataatggaatccatttcactacggacagcctccttccagtagtctgcatcaggagatgcatatgcttctgaaattgacttaggagtgtcatccatgaggtacacagtgaaatcatcaccaaaggacttagccgtcctttgtctcttactccttcgaggagcttcactgacatcctcgtcaatgacatgttcatgtgtatgttcagtttgttctggtggtgtattgaactgggaattacttcagagggttggctcgaactactatgtatatccttcattgggaaaaagctctcaaagaaggtagcatcacgagactccataattgtaccaatatgcatgttaggtacctcaaatttaactattaaaaatctataggcaatgctgtgatgagcatatcccagaaagacacaatccacagtcttaggtcccagtttgcgcttcttcgttattggtacattgactttcgccaagcacccccatgtgcgcaaatacgaaagtgatgttttctcccaatccatatctcatatggtgttttatccttatttctgttaggaactctgtttaacacatgattcgaggtcaacaatgcctccccccaccatgccttaggtagtcccgcggtgtccaacatggcattcaccaagtcagtcagtgtgcggttcttcctttcagcaatcccattagactcgggagaatagagagacgtcctctcatgtatgataccatgttcctcacagaataagtcaaactcgtttgagaaaaactctccaccacgatcagacctaagcctttttatctttctatcaagttgattttcaacttctgccttataaattttaaaatagtctagagcctcgtcttttgatttcaacaagtacacagagcaaaatctagtagcatcatcaatcaacgtcatgaaatatcgttttccacccttcgtaaacaccccattcatttcacaaagatctgaatgtaggagttctagtggtgccaagtttctctccttggcagccttgtgaggtttgcgaggttgcttcgattgcacacaactatggcacttagaacctttcacaatg

SEQ ID NO: 91479 - DNA, 607 bp, Oryza sativa
aaaaaaaattccacatgccgattccgattattatttgcatttattaactagggaattagctcttggttaattaagataatttcttcgggcaatttatttaaccaatttttaaagcaagcaaaggggggaaaacttcagggcgtgacaggacacttcctagccagatgaccaggttgcccacacacaaagcaagtcctctcatcctggttaggattgttgttgttcttcttctgcttcttgaagttggtggtctgttgagctttgtatttccccttgctcttgttctgggccttgtgcacaacattggcactagactgcccaccatcgcccttagacgcggcgtatttttcccgagttttctcctcaacatcaagagacgctatcaacccctcaacggagtattcctgtctcttgtgtttgagtgcagtaccgaaacttctccatgatggaggtagtttcgcaataatgcacccgtccacaaatttgtcgggtaagacacacttaaggagttcgagtttcttagccatggtttgtatctcatgagcctgttcgactacagaatgggtgtcagccatcttgtagtcatgaaactgctccatgatataca

SEQ ID NO: 91480 - DNA, 3370 bp, Oryza sativa
tgaaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtctgggtcgtagaaacattatatggacttaaacaagaagaattatgtaacatgaagaaatagtagtacaatttaaacatgatacgactatttgcattgcggttacatagatgatattagattcgaactaggagggaggtagtgcaatagttgaacacaacgacgatgtagtaatgggacaaggaagcatgacagtagaaatttcaatatgacaagttgtccgataatagctaacccctacgtgaggatccctctcctctctcaaaccgcgctttagtaactctgtattgctctggtagttcaagctgcacaacacggctaggtgaagttagaacccttctggtgtctatccattctctgtattgacatctccttggtggttcctgggaggaaagaattgatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaacgaagaacctggcaacgatcaccacacctgcatcttggacgggcttcccatggagggagtgccgtagttaacacccgccagtcgctctgttgttcacgacattgtcgttcataagccgcttttctctgtaagtattgctcagtactttcggatgcgaaataccagcgaccttcttgtaaacaagtggttaggtcgagaacgggattttctgtatcgacccactcgatgtatgcgcaagacgtagtgcgggtctgccgaatagagtagtgttacgaagaataaagcgattgcccatacggaatgaataagcatatgcagataataaaatacctcacggttataggtagggcacctaaaaaagcgccttcctcgaatatcaggattcctcgaagccattagttggcatcgatcaccacataggcagagaggacgctggcaccaaggtggtagtaggtatacacaaggatcgctacgccagtttggatcctcaacaccccggcgtctagccattgacgaaagccggtcggatttgtaatgaagcaagtggggaagagagtactgaatatgactgagttctgaaagattgggaggcctcactcgttaaggcgacttatataggcgcaaaaaatcgagtgatacccctgacatgtgaacgtggtggggtatggtgggtacgcctgattggcgccgaaagatacatgcatgatcggcgcccaaagttacattggtcgtatgcgccaaatggcgggcaaatactcgtatcacacgcgaataaaggaggctacatggtgcggaagaaagtagtcgtgcatgcgccgaaaggtatcgtgtatgcgccgaaaggtatcgtgcacatataacaataacgtagtcattacacaagcatacagtactggaaagtgaagcaagtaaacaaagagaagactgctctactggccctgccccgcgccgcgaccacgcttggtcctccgggcctgtgctcgcacgtggtcctgggagtaggtgaaacgatccggtggcacagcacgggtagcacgagtgtcccgcggaggagtggcctgcgcctggtcctgcgtctgcaccggcgatgcgcctcccagctgtgaggggccaatgacgtcctctgtcgagcctgaagcgaagtcgaagtcagtgatgtccaagagcaaggtggaaggcagcaagcggtccgacgaggtcccagcatggtctagtggtggaccctgactcgacgtgccggctgcctgtgacgaagtcccggtgtactgccagaactgcgctgagtgcgaggtcgacacagctgcctgagacgctgaccctgcagcctgggagaagtgggcggcgtgcgtcatagcgaactgggcgaaacctacacatcgacaacgggacccttgtaagctaagacataaaatgtatgtaaattgattgtcaaagtaatgttgtttttttaagtacctgtggggggcacaacagaaggcctagccaaggaaggcggggtgctgaacggtgcacgaaaccctgaagcaatcggcaagtgaaacggctcacttatatatgtgcgaggtatgtacagaaatagtaataaaaatacttacctccgtgcggagggggagtcggcctaggaacgtgcgcagctggacggggaccagtcggtacgggtggccgctgtacagctgcgtctgcccgagcaacgttgtctgcacgacaggtgagcactcggagaatcgagcgcatcgactccaccatccgcgtgtacgtcgtcaggtgatcctctacgggtaccggaatccccgcgcctaaacgttggatcgtcgttgaaccgtcaacgacgacccggttgatgtcgtcgacctacatggttaatttgttcgtaaatattcgtaaaatttgacgaagagaaagatatgaaaacataaaggaatggtgcgatgcagggtactcacagcacaagcgaagtcctggtcgcggtgcttggcatagaggtctctagtgctcgcaacgtggggctgctgctccaagggagcgaaggtgaccctagtacaggtgcgtggctggtaccagcgtaggtaggcctggtacgactcctcagtgtgtggctctccctcgtggtccacgacctcctcggttgcgagcaaccagtcctcaataaaagtcgccaacttggcgggccagtcgccagctgagtactgacccttgcgcgagtacctgcgaattaatgtgtaatattagtgtgaaacgacagatgttacaaattattgtgaacaggcagattttaatgcaacaacggaaagcgtagtgcaagatcttaccggtgaacagcagctgggacggtgctcggaaacggtactggaaagggctgacggaagccgaactgccgcatcacgcggaaaggggcgtgaggctcaacgcagatgtcgaagaccatcggaaccgtagtcatccagtacgcctggtccctggtgcagagtgtggacagacccaacggcgcacgagcctgggtagccgctgcactgtagggctcccacacgacgtcagtcggcagaaggcggtcgaactccatacaaactcaggatacgaccgcctaacctggacgtgagcccatcggcgctgcaatacgagacgatcgatgtgatgt

SEQ ID NO: 91481 - DNA, 2249 bp, Oryza sativa
gtaggagtactcgtcggcctccgcctgtagctgctcaccctgcaagccgtcgataaaatgttaggcaccttaactgcggactaaatatgtaatacgattgtcatttcggtacaaaaacactcacggtgaactgaagcagccacctcttcgtaggtccggtgttgcggtggtgtgccaacggctagagcgggaggtgcggtgcgcgctgtactagtgcgaaacgtgccgtcagatcgtcctgccagtccacagccgtggtcactggcccaacagcgtctcccgcgagcggtagccccaacaagtacgatacgtcctgtagggtaggggctacctcaccgcacggcaagtgaaaagtgtgtgtctctggcctccatcgatcgaccaaagctgctaggagggacctgtccacagtccatcgtctggccgggtccgcgtcgccggccgcagcctccaccagccgacacatcagtaggaggccggcctcacgtagcctgcaataacaaattaatatgtcattataaaaaatattacagtgcaactaacttgtagtagaacactgttcgtacctctcgacaaaggagtcgtgaaccgtgagtagctcaccgcacgtccgtgcccggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaaatagtaatgtaaaacaaaagataacttgcaaaattataaaatagtaataaaatcatgagattaattatgtacaacaagagtacaggctatttaaatatagcaaacgttactaatggtacataacgatgacgtgcaatttaacatatatgtagagttcaataatataacataacattacgtgtcgaagtccgacatacatcagcatacctaaagacgttaggcgccttagtctgacgttacatcacgagacctaaagacatgacatgccgaagtctgacattacacgacgaaacataaacacatcgataagttcgaaccgaattgcaagcaaatccccatgccgacatagaacataagaactacgccacgtagccagacgtggcacgacgacgcctaggacgtggtcgagtggaggtagtgccttcacctgtagggcgagctccatctgctgctgatcctgatagtcctgcctccgccgcacttggtttctccttgtctttaggacaatgcttgtaggtgtgcccatgttcatcacatttgctgcaacgcttcaccctgccagcctccgactcgtccatatcgttgtggatgcgacgagtcctcctccttccagccttgcctcggagcttcgatgggtcaagaatattaagtacttcatcgttagtctctgtgaactccccagctatgccgaacctataaatctcgccgctccatgtatgatatattgtttgcttactgaagtactgtgacacatatactgcatctggtatgccacactccgctgcagcagcaatgacatgggtgcatggcctgtggagcagcttcggctttgcacaagagcaatgacatgtgccgtcgactttgagaacacactcctgcttcactctcttgcggtagatacccctgcctgccttatcttgatatagtatctcaaacctgtgctgttgggtaccttgcactacagctcgatgtttcatggcctttttacgcaactcctctagctttttctgcatgaaagctccaaacaaaatgctgttgttcggcatagagggaagaactgcctggaaccgatccctaaaatacctgcatgtcccatgtaaaatgaactccactatgccaactagtggcagtccacggacaccgcgtatcacccagttgtaaacttctgccaaatttgttgtcattattccatatctagcactacctgtgtcatacgccttggcccatttctcttttggttcatgcagaatccactgagaaaatttccgaatctccaatccagtttttctaaccaatgttggactatccattgggagaggtccaagagcttgagaagggtcagcaaccgcggtcgatggagccgctgcacgctgatcacttgttttggctgtcaactcatctaatctcttccaaagctcaattgaatttttttcttcctgggtctgattgcacagcctctttgaacatgttcatgaactcttttgttcttg

SEQ ID NO: 91482 - DNA, 660 bp, Oryza sativa
gtagtccagaaatgggagtgttacacaagttattgtttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtgtcagttgtagtgagtcgtgcaacagaaggttatttttgggaactaatgccgatggacagcactgatgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggctatgggcatggcggatgaggggaagagagtcggtataattgttgatgaaatggagagggaagattcggataatgaggaagtggacgacgacgcatcatccgatgaggaaggtgatataatggccactgattgggcaaatgaggacttctctggacttggtata

SEQ ID NO: 91483 - DNA, 631 bp, Oryza sativa
tgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattatatcacctttctcatcggatgatgcgtcgtcgtccactttctcattatccgaatcttccctctccatttcattaacaattataccgacttttttcccttattcgcatgcccatagcctgctccttccttggttgattttcctcattttgcatcgatggtccaacaacattccc

SEQ ID NO: 91484 - DNA, 1113 bp, Oryza sativa
aggtcttttaattccttgttttcgggtacacacaatctttcccccatccagattgttccttgttcatcctcaacaaaacctcgggcttttccaactctcatgttctttttgagctctgctatttcaggatcacttgcctgagctatgcgaacctgctccaccagtgtgggctgtgcctctagggcagccacgaatccgtgctcaactataccaaggttcaaatgttccaaatcacgttgaacctcacaacatagttgctctacccatgcaacattgcagtagctcttcctgctcaaggcatccgcaaccacattagccttgccgggatgataatgtattcccatatcataatccttgatcagctccaaccatcttcgctgtctgagattcaaatcaggttgagtaaagatgtactttagacttttgtgatctgtatatacctcacaacggttaccgatgagatagtgccgccaaatctttaaagcatgaacaactgcggctaattccagatcatgcgtcgggtagttgccttcatgaggacgcaactgccgtgaagcataagaaaccactttgccatcctgcatcaacacacatcctagcccctggcgagatgcatcacaatagacctgaaaatctttcgtctgatcaggcaggattaagactggtgcagacaccaaccgtcgtttgagttcttcaaaactcctattgcattcagcagaccagatgaacttttcttccttcttcaatagctgtgtcatcggcttagcaattttagagaagttctcaatgaaccggcggtaatagcccgcaagccctaagaaactccgaacctgagtgactgtccttggtggggtccacttggtaaccgactccacatttgctggatccaccgctactccttgagcattcacgatgtgaccgagaaactgaacttccttaagccagaagtcacacttgctgaacttggcatatagctgatgctcctttaacttttcaagtaccagtcgaagatgctgctcatgttcttcctcggacttggagtagataagtatgtcatcaatgaaaaccacgacaaacttgtctagaaattccataaacaccttgttcatcaaa

SEQ ID NO: 91485 - DNA, 1991 bp, Oryza sativa
atattgtgacatgtggaacccaaaaaaaaattccacatgccgattccgattattatttgcatttattaactagggaattagctctaggttaattaagataatttcttcgggcaatttatttaaccaatttttaaagcaagcaaaggggggaaaacttcagggcgtgacaaacctaccccccttaaacggaatctcgaccccgagattcggaagagctggcgaagaggtgcgggtgggtggccttcaactcatcttctctttcccaagtggcctcttcctctgagtggtggctccactgaaccttgcagatcttattactttgtttcttgtccttctctcgctggtttcgaggatacgagtcggcttctccacatacgtcagatcttcctgaatttcgatgtgatccggacttgcctgttcctcaggaactctcaaacatttcttcaactgagagacgtggaacacgttgtggatgccaagcatgttggagggaagctcgagctggtaagcaacttcacctctacgttccaagatcctgtatggtcccacaaagcgtggtgccaactttcctttggtttggaagtgatgtactcccctgagcggagtgacacggagatacacataatcccctgtttcgaaagcgagctcccttcggcggttgtctgcatagcttttctgccgagactgcgcgattctcaatctttccctaacagctctgactttctcttctgcctcatttaaaacttctgtaccaaacaattggcgttcccctgtctgatcccagaagagcggagtacgacaccttcgtccatacagtgcttcaaatggtgccatctgcagactagcttggtaacctgtggtgtacgagaactcagcatacggtaagcttttgtcccatgctccaccaaagttaagcgcacatgctctcaacatatcctctagtatttgattgactcggtcagtccggccatctgtctgtggatggtaagcagcgctgaaattcaaaccgggtcccaattcttcttgtaatttctgccagaactttgaagtgaatcggcttcctcgatcagactcgatcttattaggtacaccatgtaacacataattcttgccagatagagttctgctaatttcttccctgagtaggtagtgtgcaccggaatgaagtgagccactttggtgagtcggtcaacgactacccaaatagaatcatgccccgatgatgtcctgggcaaaccggtgatgaaatccattccgatttcttcccacttccattctggaatctgaagtggctgtagcaaacctgctggcctttggtgttctgcctttactcgttgacagacgtcacatagtgctacgaactcagctatttcccttctcatgctgacccaccaaaacttctctttgaggtcttggtacattttggtactgccgggatgaatggaatattgagtttgatgagcctcggttagtatcaggtcttttaattccttgttttcgggtacacacaatctttctcccatccagattgttccttgttcatcctcaacaaaacctcgggcttttccaactctcatgttctttttgagctctgctatttcaggatcacttgcctgagctatgcgaacctgctccaccagtgtgggctgtgcctctagggcagccacgaatccgtgctcaactataccaaggttcaaatgttccaaatcacgttgaacctcacaacatagttgctctacccatgcaacattgcagtagctcttcctgctcaaggcatccgcaaccacattagccttgccgggatgataatgtattcccatatcataatccttgatcagctccaaccatcttcgctgtctgagattcaaatcaggttgagtaaagatgtactttagacttttgtgatctgtatatacctcacaacggttaccgatgagatagtgccggcaaatttttaaagcatgaacaactgcggctaatttcagatcatg

SEQ ID NO: 91486 - DNA, 2006 bp, Oryza sativa
tggcatgtttaatttgatttctctgtacccttttactttgcgcaggtctctgaatggatgaatgccaagggacatgtaaaatttctgccaaaggatcacgctgttcacctggatttgattggtgaaattcatggaagcagtgcagccgagacttacttcaacaacctgccagataaagataagacagaaaaaccctatggtgcacttcttaactgctacacacgggaactcctggttgaaaaatcgttggctcattttcagaagatgaaagagttgggttttgtgttttccacactcccctacaacaacatcatgggtctgtatacgaacctagggcagcatgaaaaggttccttcagtaattgcagagatgaaaagcaatggtatcgttcctgacaatttcagctacagaatatgcattaactcttatggcacaagggctgattttttcgggatggaaaacacccttgaagagatggagtgtgaacctaaaatcgttgttgattggaacacgtatgctgtcgtggcaagcaactacattaagggcaacataagggagaaagcattctctgccttaaagaaagcagaagcaaaaataaatataaaagattcagattcctataaccacctgatttccttgtatggacatctgggggacaaatcagaggtcaataggctgtgggcgctccaaatgtcgaactgcaataggcatattaataaggattacactacaatgcttgcagtgctcgtgaaacttaatgagattgaagaagctgaagtgttgctgaaagagtgggagtcgagcggaaatgcatttgacttccaagttccaaatgtcctgctcactggataccgccagaaggacttgctggacaaggctgaggcacttctggatgatttcttgaagaagggaaagatgcctccttcaaccagctgggcaattgtggcagctggctatgcggagaaaggtgatgctgcgaaagcatatgagctgacaaagaatgccctatgtgtatatgctccaaatactggttggatccctaggcctgggatgattgagatgatacttaagtatcttggagatgaaggtgatgtcgaggaggttgaaattttcgttgatctgctgaaagttgctgtgccactgaactcagatatgactgacgctttgtcaagggctcgaatgagagaagaaaagaaggttaaagatgcagtgtaagcactatgatgaagaagataatgtttcacgagctctcaaggctgctctttggtctgcactgacactttgttcttgctgcatttcttcttctcgtttttttttcttttttaagagaatgtgggtgggggatggtaaccaaaatgagatattatctgacatacagtagttctggtaacattgtctgtacctgagtacctgagtgaacttgttatcactcgattggtcactttaagtatgttgctgggattctcagcaatagttatattgcttgagttataacgatcgtagagccaaaatcactcaaaatgtagatgattttgatcttgattttgcacgtatgcataacaaacgctcatctcacaatcgtttgggagttggagtgaagcaaaaacttccactaaacccatgttttcacatgatatttcgccaaccttcttcgggctttttttgcgtttccactgaacagcatatccatgtatcgattcatccatctatccatccattcaagatccaaccactttctcctaactcataggtgtgttgttgcgtaagctaagctccgatggatttgcatccaaatccaaaaaccggttgcatggatgcatgagaaacagctcatccctattaactctgcacctaataacaaatccaaatctcgccaaaatcttatcccttttcaaaatctctcttttatatacatgtagctctccatctcatttcacaccatcactggacgagcagtaagtaaacactctgtggaacaatggccgccgtccttcccttgctcgccg

SEQ ID NO: 91487 - DNA, 2676 bp, Oryza sativa
taagagccaaaagcacgcaaaaattatgcacacactttacctcctcctttatatacaggcactatatgatctgcgtgccaagcattaccctcatttggctcatgtacaagcttatctagcctgtggtaaaatatagtgaaaaaaacagtgtcaccatcaatctacaaattaggagaactactcatattcattaatattttgtgagttcagaccacaatagtgtccccaatagcctgtaagttgcctaaataggcaaagagaagttaacataagcacaaaacattgaaaagcataatatcaaagtatggcacttacaatttcaatctacttgcaatatttggagcaacattcctaatgtattcttctctctttttcttgcataatggtctgatattcttgacaagctcgtgacagtcaagtttacacttggagcatataccatgttcaatttcaaatagtgcctattcatcaggcaagcattgctttagtacatataacttccatattttcacatatagctggcataccagctttattcataaataatgcaacttaacactttgtttatgaatgctaattgcagaagattaaagaaaaatctcacctgccgtgcaaacctgccactagttctcgatctgaacacctcgaagcaaggcagaccacagaacaggtcttcaaaatattcaggtgactttgcaagccttccactgatcacaaataacaacattgttattttttttcaaaaaaaaaacacagatggctactggaaataaagtgcacaaatgagacatattacttgcaaggtccttgacataatttgcagagaggttcatcgtgaacagtccagccttgagtgtactctctctctctacttgtaccattatgcaaaaccacctttctccattcagcattttctggcaaaggattactaatatcacaccatggtgttacacgcctcttacttcctcctttaagcaacccctatgaagtagagcacaattgacaaaaaataaacatgattaaaccaaggaatgccaagacatattttttttcatttcatgttcttagtttggtacaaaatcagatcctttaaactgtatttcaaatgaaaaattaatacatcgggatgatatgatagcagctcacaagcaaacccttagctacaatgagatgcctagggtagtgtggcactgtggtgggcctagcagcttaaaagctgcagttttattttgctttttttttgtatatgccaaatcaccaattgaatcctccattagagtaatatcctccattagagtaaaagtcaaacattgcaatatcctctattagagtaaatcctgatagaggggatcctctagagtcataagaaaaacttgcataaagaatgatatagatagaacatagatatgcttaatatcatggaagcgttgcttttgcatattttctgcaatatttggaattaaaccaatattcaaattgatcactcaaaatcaagaggaacgtacttttgtgctgtggttgttggtatctttcaggtagcacaactcaaggctcaagggaagctgtaagggctttcccagtagtctcttctgctcaattggtctaagcgccaaccattccttcacgaacgctttgaacgtattgcaaaatgcaggatccctcttcaagagacgattacttgttttcatggtattatcagaacataaaggtgactctacttcttctggcaggaagttttcaaaaagtggtctgggtcttgaatcatgccctggaacacatatgtacaaatgaattcggcctgtgtgctggctaacctgtaaaatacgaagataaatcaaatgaattcaaagaatgaagaccggaatggaatgtaaaatgaaattaacttcacattaatgagacaagtcatgagaacagaatatgaacagagaggacagttaaacctcaaatcgcagaaacttctcttcaatattgcagtctgtagttgcttgaaggcctaaagtctgaaaaatttcagaaagcctccgacgagcctgcgatatttgaggtgatgttgcataggatatagtgcaaaacattgtataatacaagcaagaactttttattacctttactgatttagcgcttgacattgaagggcaaataactgaagcttgagagatagaagaactatcaaaagctatctcttcatgtgctgttggagatggacaattttgcattaccgtatgaaggctatcatcctgaggaggcatagaaaaagaatcagttgaaggatttcataggactactgactgataagtagcaactagcaagtagtaaacatgtaccaaaatttgcaaggaacgcctcttttctacctcaaagtgaagaggaattgtcctaatactgaagaaatctgactcaaaattcatatcgttgaggccaggaaaattctcaatggacatatcatcactttctacattctctcctggtccatgcccacaatctgcatgaggttcaaaaaattcagcctttcatttcacttacaagcatgtaataatgattggtaccaatgcatgaattctctgttaacgatgttcagatgttttaccagcattatgattctccaaaggaagaaatccaagctgtgattttccctcagatttactgctttcctcaaggtggtaaacttgatca

SEQ ID NO: 91488 - DNA, 3463 bp, Oryza sativa
  unsure (1)..(3463): unsure at all n locations
agtgcccatcctaacctccctaaggaacagtataaaatcaaaaattacatgaccctatggcctacctcaatctctcttatagcatctttctttccattcatcaatgatgagacacggaacagactctggttcaaatgaagccaatgtgactcatctaatgtgttctgtgaccaagacaaaacagaacaatttatagttataatttgacaaaattacaaagtacgctacaggaaaaaaaaaaggaactaacccttgcacagaatatatatatgttgacagcatttgtttgacctcgcctatgagctctatcctcagcctatcatcaacaatcaaatgtaccaaacagttagaaacacaataaacaaacactaacagtagggtgcaccatgcatgcgtccaagagagcacacacattaagtgtgcgaaagcatgaaaactcatgcgcatgaaccatgaaatgtagcaatttactgtgcattattgatttgtttcatttaccagataatcttagtccacatcgggataaagaccatgcagaattgcatttgaagcaggcaatagacagattgggtaagaggcgtaaagggatcaaaagagagcaaataggaataagtgtttttaagcaaatagaggagaaacatttcttcttgctcgactgataggggatgacttgacctgatccctatggaaaacatatctgtaaagaaacttacatatatataaagaaataaacccaacaataaaactaattattcttatctctgaattccaattaaagctacaccaccaggcccagtgaataatactgcagttgctacagtacatataaataatatcatagtgcgaattgtgaatggtgggctacacaacaggatggtgaaaaaaaactcaaaagtcttcttgtaccctatggatgaggaaaatgtatgtgcaagagagaaggctaaggacctgaagcaactctgaagctgactttgggagctccacgaaaacaacattctgagcagatgagaaatctaaaccaacaccgccagcagtaattccaataattgcaaccattacctatttggtagaaaataaaagaactagtaaaatagtaaataatggataggcagtttgagaataaaacttgagagcttaacatggaataccaagtatgaatcgaaccgaatggaagggaagggacaacctctggatttaaacggaaagaatcgacagcatctttcctttccctaggagatgtgcttccgtcaatgcggacatacttgatcctctgctctgtgacaaacacctacgtacgaagaaaaacttcagtcaaaagtattggcaaatgtttttcataaagttagatggtatagtttaatatgatataatgctatctaactattataaagtgaaagtgtgcacccgaatatccgattgatcataagtctgatttttcncatgtattcaactgattaatggactatcttgaacatggcggcaatgggatgattgtcttcaatggagtatctccaagtttatcaaccgacttgatgttagcaagtgaggaagctggcctatgtaatttggcggggctaaggggctctccctaattatggaccccagctagggcattttattttagttttagttccttttggtcatgtaaccgcctttgcaatgggttgttttgcggtggtgaggtcttgtacttcttgctgttctttggcgtgtttggactcctattaatgcaatgatatgcatcttgcgtattcgacaaaaaaaacttccaaaccattacgagaacatctacagtcccacagaaagagtattatatgctagagaatgccagaatgctggacatggtactggtggcttctaaaaaacggtgccaatgacatgtacatggccagaccaattttacacatacaccagtgtttctattcatatgagatcctatagtccagcttcttgacacatcatttattttgtttcatttactctaaagatgaaacttctatttcattaggaggaagtgaagcttacaagatatatagaactacaaatagttgaaatgatacttgcaaaatcaaaattacataaagtaacatagttgtgattataaatcttttcttactgttcaagattctattgtcaatcgtgagaaacatagcatgataaactcgcaaaaaaaatacagaaaagaaacctcagaatttacctgaactccatctaggacctttaaatgatgggcgaaaattattgttttctggcaattagactgagagtccagactaccattatcagctggttctttcatgatgaaatgatttaagaaccactcgctgaacccaggtattttcacaataccaatttcttgtgtagtgagattccttggagatttcttgcaaccatcagctgtgggcaaatgaaaaggaaatacaaggaaatgagcacaatgtttataaggagcagacagaccaatcttactaatcttgaaccctgaaatagtagaaaacatgtgctttatcccaagtgttaataccagtgttacatttaacattgttacattaataattgtttatgagaaagaaacatgttacataaggataaaaagaggaaggttgtctcctttaaagtggcacgctactcttaaaaagaggtggttgcctggttgtttgtcaaaaagaaacataatgttttgatcatggtagttcatgtttaacatatcagaatttttttaaaaaaaaataagtacaatgattggaaatggcaagtaatgttcttcacctgtaaaagtacaacaggatattgcacagttgcaccaacatttctacttgatatacatagtgttcttcagaacagaaatcaacaaaaatgctggttatctttttcttgacaaatgttctctgttactatagataagaaaatggctctttttgaaaagaagttgtaaataaatttcgattcagacagtgtcaagtacaataccatactgcgccatattgcattgcttatgtcataaccaactgccaatatgcaaagctgtaaacccatacatgtttggcattgcatatgccacaaatgccaagcaagcttcaacaaaattacagttccatataagttgttgcattttgttatagttctgaaatctaacaatatcaaacattcaaatgcaacaaggtgtgtattatatatttcagcataacaaaggcacataaaattataactgatacaaggaggtctcattatcatatctgccattagctcaatgagtgttaccttcttccatgttcacctcctcagagtcattgctattgtctggcgaggcaattgtaggaatctcatcactagtgttcacccctttgatacaagatatagctgtcttgatatctgatgcattcagcttcaaccaaataatctgtcgacgtttgggaggtagttcattcaacaaatgcttctttcagcgcctaatctacag

SEQ ID NO: 91489 - DNA, 3149 bp, Oryza sativa
ggggcctgaaaagccagggaagtgtgatcagaaaagtttgataagactaacacaatacaatggcattcaccttttccttaccatagcatatttatctgatgatagatgtcaaaaggtctattgtctcctaggagaaaacaaactgtgagatagatctgacaagcaaaatagaagtctccaatcaaggctatcataagtaaaccatacataagtaccaagaaatcagattaatcaagtaaagaaggaaacatataggaatgacaaaaatgtacttgagtgctctaaatctctacggtacaaacagccagacttcgagccaaatatggaaaaaggaagatattgcaagtaacaagtaatgaccagtaaccaatgaacatagtgcagagaatgcatttgaaaataatatgggtaagtacaaatacactagatgaacaaaaaatggttgaaagagtaatagacaaaaaaaaaaactttctgtaaaatttcagaaaattgggccatgataaagttttcatcattcccttttctcaattacaaggcgcaggtagcttggatattgctatccacacccacctctggaattttaaaaccgtttagatgatgtacacaaaatatgtcatatatcatagcagctatctgcatgattggagatccagatatcaaggagtaaaatagcacaatagcataaggagctttaagagaaattcaaccaatatctttaaagttacaaccttgacaaagagggtgtcccagagagcagcacaatgcgactgacatttggcgctagttccagtacagcctgtgtctgtcatgaggtcataaaatagtaccaacggtcacttaccattagtgaaatcaaatgcaatattgatacacaaggtgactgaagtagttggaataaatagtttgagataatttcaacatttgtgcattgcaatattttagaaagcagggagaaatgctgaaaaatataaccagatcaataaaatcaactgggagaattttattttaaaaaaaagtgaggcgtttctagcacaataaaatatgatctaccaaatttacaaagcaccaaatcaccatcatggtctcatggattggagaattcaagagctgaatactttatgttaattgtattgatacataagattgttgcatgacaagctaataatttaaacacctcatttttttcgtgttttttctttgtgcagcgtatgttgtgtgattcatcgataatcatcagtgcccatctcctattcatcatgcttttgcgaagacggcttagcatctgatatgaaatgaccactgcctttgggcaagctcctaaacgttcaagactgtcttggtgaccaaacactgaaaattatacagtgacaaccgaactgttaaaattgtgctcctaattaaaaaaataagtatataacaaaactgaaaggctaaataaagtagtaatatacaattgaaggacaagtgacaagaaatatgatattagccatacttttttaaacagtatcttcagttcttcactagtatagaagaatcaaattattatattgcatatgtgactcagccaaaagttaaaggcactatttaaacctcaagcgcactggtaaacttgagtaaaatacttatgttacctaagtttagggctgaagttcacaattttcaactcaggtcaatacaatcaatctttggttactgcattataattcctttcatactgttcatgaaagcatttcatttttagctagtgcaactttactacaagatttacaaaacctctagctgatcctaggaaacaatgagttcagtaaaatctcaagttaattcaactaaacaaaaaaaaagtagagtgaatcaatcaacaaatagaagcaggtcatctaatctgtaatgttactctatattgaagcatttcaactggattgacgcaatgaatgtagctttctcaatgtccaccattcagaattttcaatacatcaaatataaaatatgcaacatttattaaaaataatacaatctacagtctttggagaaatagaatgtatatgctttttaattgaaaagtgaaaaatactatacttttcatttaaaaactatatttactggaatcaaactagagtaaagagaaagcattgaagaccctaaatgattacagtaatgaaaatgcgggcaaagataaaatcagcacttcacaactatcaaaggcaaaatgagttttatacaccagagctttacaataatcataataccagatttcacatcaacaaactgtaaagactattagaggttgaatgattaccaagatgaatatcttttggcagaaatgaaggatcccatcgttccaattcctctgcccatgtataacgcaaaacagctggacacactattaacactgggccctcatccttgtagcaacaagctattgcaattgcctgcatttaaatgaatgagaatgtgctgctttcacagggaaaaaaggacgctcaaaagcctattcattcaattattcatatgctctaaaaaacatttttttattaagaattgtttggaaatgaaactaaaatggaagttgctatttcatataagctgtgtttctcaaaaacgcaagagagctgtgcttctttgtattatcgaaagaagaagaaaaaaagaccccttacaatgcctcaggcagtttaatattcatataagtctaatttattagtgttgtaaacagtaacatgctttaacagtgtgcccaaacttcagcattatgtaggctccaaaaccttgttttcaacaataatactttattcatgtgcacaatagtcatacagaatagcaatggttgcatgctctcatgtaaaatgctcacctggagagtcttaccaagccccatctcatctgcaataaggcagcgcccatgccttcgaagcccaaacttcacaccttcaagttgaaagggtaggagtgcatctcgtaagtgttgtggcaacttcatgagaagcccgtcaacttctttatcagaagcgcagctttcggcaaagaacttagggagattcttgataacattccttgttttgtaaggtatatcttgcacagcaactccaggcaacttcttcaggcattttaacacgggctcatagtccatgagcttaaatacggagaaa

SEQ ID NO: 91490 - DNA, 2195 bp, Oryza sativa
aaaactccgcaagcaatattctactttcttcaggcaagagatcaccatgatgaccctatcattaaaaaaaaaaaaacttctggtaagatagtattcgttatacattttttacaaagaacttttaagcagaatatgcacttggcagtgcccttgtttgaaggaatatttggacagaatgaacagagaagtgaatttataaagacacatttcttaaaagaaagtaagttcagaccattccaaaatccatcagtgagctgaaactgaaactaacaagtgatgattcaagccatttggatatattaactgcaaatcgtcaggataaaaaactgacaaaatgcttcactggttgttatacatttccataatttatatatgagtttggagacaagttcaacccactagcagaaactgaatttggtgtttattcttcctgctggtatatttagtagtaatgcttgagacacttacgatgcgggaaattcgatcacagacagcatggtgcataaggattccagctgcaacagatacattaaaagaatccaccatgcctttcataggaacactgcagtgcaagtctgacaactttaaagcatcatcacttatgcccctgccatagaagtagaatggctagttaatatacaagtagctccacaagtatactgaaaaataaattcccctaagttagtgtgatatactgagtactctctttactttccaaggtataaatccatataaaattcacagtggactatttggaacttctgtagtaaaaacaaacatggcatttctagtttcgaataggaaaacttttaagcgaaccattttgtacaacatacatcaagatgattaagcagatttcttgcaagaggagatgtcagattagttaccccaaagtgattaaaaaagatgtagaaaagtaatgataaagtgcaacatacatgaagtagaaaagaggacatcgtatctgatcattccatttaaatacttttgagactcattataacatgattgcaagagaagatgtgcatctggagaagaggaagagccctacataagttcattgcccacaacaatagcggtaggttgcgaccaatccatgtcgtacacacaaacctacagatccattacgagcatagttattccttgaactgtattacttagatcagtaaatgataaagcatctttcaatgcaatacagagcggaaaaaaagtatattgagaaaatgacagtgtagtattacattgttgcaaaatcccacaaaaggctgaagttaccaattcactaaagaatgtgtatttgggacagataaatatatctttcattctaacctaaacggtcactaatatactctcaaataggagatgacaataatcattctgcaatcagtgatcaacaacattggtggtggcaacgaccacacaccaatctatttcaaggcttttctagcctaattttacaacaaatgtttttatcttgtctatgtaagtcactgaaaatgttcttacttgaaaagaaaaaaaaagagttgtctttcactgcggataacaaatgacaatgcatgtaatgatcacaatcactcttttttggcttactgttcaaaatacgagcgaaaactaaaaaggtgagcaacaacaaattaccgaatcatttcccaaataagtagttgcaatgcgataaccacgcttttttaaagcatcaaagcattctgcagttgagctccataattcgatatcaagccatttctcagcacccatgctcacatgcctattgtctctatacctgcaatagttaagaagtatattcattcaatggtcttgcaagttgagaaatatatacaaattttaaaggatgcaatacgtatataatttcattcagataatcagatatcagaatttatgtataaaaaaactaataagaaagaaaaatgttctgtgttcttcagtaccaatccagtggtctaattaggaaaaaatttagcataaggaatcactctctttgtgttggatattagaactacatgactagatgagggatcatttccttccggtcagtatttctgccatttttgtacaaactactgaatggacaaataaaatgcacaggtcacaaaaaatatttctcatttattttgcacctcaatgaaaaaaagaataataccatgcagtattgaggtaatcaggtattgcagattcag

SEQ ID NO: 91491 - DNA, 1475 bp, Oryza sativa
atggtggcggtggaggaggaggcgcgcacgggctgccgttcctggtgctcgcgcgtacggcgttcggggtgcgcagcacgcacttgctggcggtcatcagcgtgctcatcggttgcgggtggttcggcatcgaatcctggatcggtggccgcgccgtgttcctcctcctgccgtccaggctcaagtcgtaccagccgctgctcgcgccagtgccaggcctggggctgcgccgctggagttcgcgtgcttcctcgctttctgggccgcgcagctcggcgtcatcatgcacggcatggagggcatcagcaagctcgagaagtacttggaccatcacgaccaacattcccgccaacgtggtggtgccggcaaacgcgctcgtcagcttgagcccgcggaagttcacgttcgccaaggtggcgctggtcactgcgttgcttcgcatcgccttccagccatggcggctgttcggctccagcgagagcttcatctacacatgcccggtcgagctctcctcaggcaccagcggccgctgggctccccggcgacctataactctgacgcccatgagggcaaggtcgtgcacctgcatcgtcgaggacggcggcggcggcagctcccgagaccgagctcatcgtcgagcacggcggcgtcgccatgtgcgacggtggcgacgccacgttgcgccggccgggcacgtagcagctgcggcgcgacgggggtgggtggatgtcggccaccacgaagtcaccgtcctcgtcatcgtcgtggatctccagggggaggaactccctcctcgtcgccatcgtcgtcgttgtctccggcgagctcgaaggtggcttacggctggcgttggccgtcgggcgcgacttccactcctagacgctctcttgccgcggtggagcacgaggagcaagcccgggggaggaggcagccggcggcgtcggcctcctcgccgaagaagaggaacgaatggtcggccggcggatgggaggccgttgaagctcccggcggatgcggaggccgaccaggaagccgccgcgcgctcccgcacctccgcgacctcctccgctccctcctccactcccccgcgggcgtcgccgtacgtcttcctctctgacctcctcagccctcgagcgctcgctgtggccgccgagttcgcaggaagaaagaagagggaaataacgtgatatgacgccacatctgacgggggaaacgagacggcgtgagataggagatggaaaaaggaacggcagtggcatggttccaattttataaattttcagtggcatgtagccgatatgatgaatagtagtggtattttttaaatttagcaaagttgcagtggcatggatccaattaacccttcttttaaatgccattagaaccatgaatgctctttattaaaccatagtttgaggaactttcatattcaaaatgatccatgaagtgggatgatcttatccatgtcagcaatc

SEQ ID NO: 91492 - DNA, 733 bp, Oryza sativa
tccagttcagccgcgctgtgggcgccacctcgtacggcgaggccatgggcgacgccttcggtgctttcggcagggggatcctctagctctgcgtcgtcgtcaacaactgaacaacgtcggcgtgatggtcagattcactgaacatttcattgtgactctaatggcttgtgttctttttccctgggatgagttcagatccactgaaatacacgccggccgtgtcggttgctctggccatcgtgttcgtggtgatcaatgtcggaatcgccaccatcaagctgatgagagggcagattccgatgcctaagctgttccctgatgttcatgactggagctccacctggagacttcacactgcagctccagttcttgtgagttgtgaccgcctacatttgccattacaacggtacattttaattaccagctaagtttgcatttttctgtgggaatgtgattaacttgccactgcattcagtgcacacaattcacaacgagctcaaggaccactcccagatcaggccaatagtgcgggcgtcactgctgctctgcttggtcgtgtacaccaccaccagcttcttcgacttcctcctcttcggcgaggcgacgctggacgacatgctcgtcttccccatcgtgttccacgcgctgcgattcaacatggacgggctcctcttcccctcagcgaggcccctctcctgcgaggctgcgacaaccggaggttcggcgcgatcac

SEQ ID NO: 91493 - DNA, 552 bp, Oryza sativa
cccttccatcctccccacccgcctccctccatccctccgtctgcctcctcacctccgtccgccttcccgcgcgggagagaaagagagagaagggagagagagaggaggaagaaggaaggaggactgacatgtgggccccacatgtcagtgggcccacatttctttttgtgtgaatgactaatgggtcccacgcatattttttagttctaccgccacgtaggtgccacgtcatcgccacgtggaacgaagactcggtcaatattgccacgtaggcgccatgtggcaccacgtcagcaaaaccgcctcccaaaaccgcccagggagtcaaattgcaccggttttgtaagtttggggagtcaagatttctggtattgcggttgagggatacgatttagattcggtggtcaattgagggagtcaaggtgatcttattccggtgtatgacgacgtcgtggtttgggaaaaagtctactttacatccctcatcggtctaaactgcaaaaaattacagatttttccccggtttccgttaacatgcttttcaaactatta

SEQ ID NO: 91494 - DNA, 1240 bp, Oryza sativa
actccaggaggatggcgctcttcctggccgtggaaccatggagagggaagtatttggttctaatcctcagcccatcttgggtcgcatggttgcgatcgaagattatgttctctgcggttttctccctccaccttctgaatttcttctcctggttttgaatttctatggtctttctcttctccatttgaaccccaattccatcgccttccttagcatctttgtgcatctttgcgaggcctacatcggggtagagcctttccttgatctttttcgcttttactatgaactgcgttggatggaatccaacagggtatctggttgcgtcgggttccgacttcgggatggcctgaagttgcgttacgttcccttccagtgcccttcttctcgcagcaagtggaggaataggtggttttatcttgagatcaagaactcgaaccctgtcttcgtggttcctgaagatcaaccggacaagattccgtcttggaccgcaaagccccccttgaccccctctcttcaatcgtttatcgacatcatcgacgatctccgagtacggggtttgtcgggatatgaagtcgttgcagacttcgttggtaggcggatccagccgcttcaggctcgggcccatccagcttataactattccaggccagaggacgcgacccgggtttctcctcggggtatctttctcgcatttatcttgacatacttgtgctcgcattcctcttgacttatcgaaggttggttctcgattaacaggtttgagcggcgaaaccgtggagcgccgcgtcggccaagtgatgatcagtggcccgaccacggcgagtgacatccctatgcccctttgtgaaaagggggcggcggaacgtgatgaagccatcaatgtaagtatatttgatgaacatcccgcattctcctttcgaaatcactttatgacttgattgagcgtaagcccttcctttgactgatatcatcggaccgctcgcggaccatcaggtggcgtcatctctgaaagttaaggtcgtcaaggaggtgtctgatgctgccaccactagcggtggcagtgttccgacaaagccgaggaaattctcgtctgtaagaaaatggaccgtcatcttctatccatgcaaattctaccatccaaacatacctctcactgactcactcatttaacgctcctccacttactcgctcggcttcgttttatgaatttttaaagtcttataaaacgtgtcaacttact

SEQ ID NO: 91495 - DNA, 1081 bp, Oryza sativa
aacaccaagtcaaaaacacattccagaatatttaagacatgcttattgaagtagaatccccttaaaaatcacaattcaaatctgatagttagaagtacagaaaattatttgtcgtaaaaaagatggtactgagattaagaagggatcagcatcccccactaattgtagctaagaattttgatgtaaataatactactgcataaaaataggagatcagtttctcctaatttgcagctttcttccagtaggaccgatataaggcccatctggcacatgatggtagagaccaacaccaaatgcattgtccatatatactggtggctgtgtggatgttgttggaatatcatcttttgaactagaactaataggctgggaattgctcctcttcttcctcctagttatttgtgttttacactgagagaaacagacaacaaattgtgagaagtagcaaagtacaatgtctttatatgataaattagtagtgtactcacattttgagatgaagaactttggttgtcttttccatgctttctgctgttatgaccaaactctttgcagacgctacatctaattgttgtctttgcaaccgaccttccttgaaccctaggttcatcagatgctctagttctctttgtttttggcctccctggttgtgtcctagccacaggtgggtctacatctggaaatggagttttttcccactgtgtctcatcaggaacgggataaatcatcccacaatatgtcctcgcatatgcatcctttgtcaatatgtcatcaacatagctctctggcctttgcttgaaaccttgaatagctgaaacaacatgcaaacatgggattccagttaaatcccattttctacacccacaagtgtgcttgttcaaatccactacatattgattaccaaatgcggacacttgccaaatgcccctaccagcacacacagatttgcaatatcttgcctctctcttctctgcctcaagcttctttaatatatttggtgggatttgccaattgtccctttctacaccttccctcttattattgaaatcagggtaccgagctcgaattcgccctatag

SEQ ID NO: 91496 - DNA, 1305 bp, Oryza sativa
actaacggctatttgaccgttcaaatttgaaaataaccgttgggaggctaaaatattcataaaaatttcgaaaaaattctaaaaaatctcaaatttcgccccgaacggcccgtgggccgcaggcgtgccgtgccggcacgggcacggcccggccatccacgggccgtgcttgggccggcggctcggcacgtgggccggcacggcacggcccgtttcatcagccgtgcctaacgggccgtgccgaaacgggccgtgccggacccgtgcccgtgccgggccgggccgtgccgcccgtttggacacctataagtaatggcgatgaccagatggtgtctatctatctacaatgacacatacgcatcgctagttgttcatgggtaggctagtgtaagccgacaatattcattggagatagaatggcgtgatatatggtaacatcgcatacatcgtcttataataaagtagtggatatttgtctctttgctgccagctgataaattcatccactggacctctttttatgattattgcagattatattgcaggcttttttctgagtggtaggaaagaatttagagctttttcattattgtttggatacatttaattattcataacactattagtttaccactgagttttacctatcgtttggcctacaactaataagttgttttacgatttatcggtaaaataaataacttatgagtaatatttttatacgtgtgcttagtgacttctaaaatctatgtttaaaaaacaaactataacgaaaaaaacctaatatcaactttaagcttaagttttaaagtttaaaatttgatagtggcttataaactgaagagatttgctccgatacctcacagtaccaatcatttcctatcgttggatcttaatgggcattattagatccaacgatcgaaaacgatttgataccgagaggtactggtaccttgagatactttttgttggaccggagcaaatctataaactgcaaggtaaacaatagaagctaccacgtagtttaccagtgaggtctggtagatataccaaatgattattttctaaaatatggtgctggactatgtagcaattgcatgcgtatccatcgttttcttgtaccttgtacccaataataatgaattagtaatgtacagtacgctattaccgcacagtgacacggcaatataacgcatacatatgtgttttatatggatgatctcctggatagttgcaaatgttatggcgtgcgagtgacagcttatttacacttaattctttcttaatcagtctagctgcttataa

SEQ ID NO: 91497 - DNA, 2329 bp, Oryza sativa
ttctctttctgtgtgtagtgtgtgcaactagaaggcttgttccatactagtttgctaggtcatggaaaagagcgagattttcgtaggagcacactcatatgcagctatatgtgcttttacactcatcataggatggttagctcactgggtatacagatggataaatcctccatgcaatgggaggcttcctccgggctcaatgggcttccctattgttggtgagaccttccaatttttcagaacaagtccatcaatagacatgccaatttactacaagcgaagactggagaggttaggattcaaatagttaataattaactttttttggaatcagtatgctatatatagttaaactttaggagaaagaacattgttgatatgaagacactattgctctaaatatgaacaacacacacaataaatctaagttcggtgtactgaactatcaggtatggacctatattcaaaactaacataggaggccagcacgtggtcatatcccttgatcccgaggtgaaccagttcatatttcaacaagaggggaagttgttccaatcctggtttccagaaaccacactaaacatctttggaaagaagacactcaccacgtataatagaactgctcacaagttgatccggagcttcgtatgcaagctctatggccctgaaaacgtgaaaaaatcactcctgccagaactagagaactccatgagggaaagcttggcgtcatggataggaaaacctagtgtcgaggtgaatgatggcgtgtcaaatgtaagttaacatctgcatttctacataagtattcacaattgcacagtgctcataaaatcatcatgatgttttactatgattaatttctattgtgcagatgatcttcggcctagctgccaaacatttgattggcctcgacatcaccaattcaggagaattgaaaaagaactttcaggaaatatttcaagtgatggtttccatcccattcccaatatattttccagggacctcgttttaccgatgcatgcaggtaggtctttatatcatccaaatagctttatgaaaatacatattttaagaatattaataagctctctaaagttataaaaattgtgattcagttaccttgattttttttttcattcctaatgaagggtaggagaaatgtatggaccacactaacaaatgtaatgaaaaagaggctaagtgcacctggaaacaaattcggcgaccttgtcgatctgatagttgaagagctacggagtgaaaatccaacaattgatgaaagttttgctatagacactctatctgggctcttgtttgctagctttgcaccgctatcgtgcaccttgactacaacttttaagttcctcaacgacaatcctgaagtttttgacaagctcaaggtatgtatagttctttaggagtgaatattttacatgtatattgaataattaaagaggatcaaacattgaaattttgggctgatcctaaacaaaaaaattcgttgcatctaccattccaggaggagcacgaaatgatactgaagaaacgagagggtgcgaattctgggttcacatgggaggaatacaagtccttgaaattcagtactcaggtgatttcaagttaatgtatgcttggattgaagcatcattggtgccaccctgatgcatttggcaatggcttttaaattgagcttgtttcaactgcaggttgtgaatgaaattaatcgaatcactacggttatacctggtggtttcaggaaagcactaacagacgtgcaagtaaacggtaaaaacttttttttacaaaaacaataaggaaaatgttgtgcatgtaggtcatgcaattgattattagagtatttgcttttgcacacaggatatacaattccgtctgggtggctagtcatgattagccccatgggagtgcatctaaacccaaaattgttcgaggatccactcaaatttgatccatggagatggacggtaagtgggaatattacattctaatcttctcaatgggatttattaaatcggtctacgcttaggttatatcataacttatattaaaactaatcacaaatacaggaggagaagagaatctcgatgcaaaggaatttcatgccatttggaggaggaatcaggatgtgtcctgcgggagagtttaacaagctttttatcacactctttctccacatcgtggtgaccgagtataggtacatacacaagctcgcattcctttgttgtacattatattatgctcacttttcagcaaacacgcaagaaagttgcacaatttttattaaggaagaacattgaataggctgggaatg

SEQ ID NO: 91498 - DNA, 673 bp, Oryza sativa
caccggtgcatgcactcggcgagctgcgtttgcatcaagggacacctcagcgaggacgcgctgttcctggtctttcgtcacatgaactggaaccccaggctgatcgccgtgctctcgtgcgtgtgcaagtggttcgacgaggtcgcgaagcaggtgctctggaaggagttctgccacgccagggcgccgaagatgatgctggatttgcattcgggtggcagtcacattgtcgacgggaactggaaggcgctcgggaagcttctcatctactgcaatggctgcacaaaagggggcctctttaacaacattcatgtccctgggcactttgtgttcaggacacgcttttcgaggaccgcgggcaagagtttcctgccccagcagtgtaggaatgatgtcttatatgtctcagatccatgcgagcatcttgatcaaggggatgaaggtgacttgggtttcttccgtggtatcttcatgtcgttcgccacctcaaaggttaagaagatgttgattgagaagcgggcaaggttccatccaagcgagtcatgtccctactgtaaggctaagctgtggagcatgttggaagcaaatatgtcgccggggagtttttctgccaggcttggtgcttacgaggattctgtggagtattttggatgcctggaccgacatgtcattg

SEQ ID NO: 91499 - DNA, 676 bp, Oryza sativa
ccggctgatgaggcatctgcgataccccagatttccgatctaccgagtgagacagtgtggatctgtttgggaggctcgggtcgaggttcacacacgagttccttcagagtcagactaccgcttcccgacccgccaccgtcacgacttaccggagaccgcgatgcaggatgcagcccgggaggccttcctccgacttagctctatccaccgagctgagttggtgagtactgagtttgctcaccacctgtttcgagaggagagcaactccgtctgcacagttcaggacacaccttgctgctacaacccgatagtgaccctactgtcacgatgggctgaggcagtagacgacttttacgaggaggctctgttagagatcgacgaccagcagaggcatatgggagagttagagaccgaggtgactgacctcacagtgcagcagcttcagctggaagaggagcaccaggcttggggcagtgagatagactcactaaaggcacagctccaggtccacggcgaccagttccagcagttatctgaccagtacaacgacagccgcgggatgatggatacacttgaggagcagctgagagagagtcaggagcacgtcagctagctggaggagcagcttcgagcagccacggtcagcaccataggagcttctacttccacaacagta

SEQ ID NO: 91500 - DNA, 687 bp, Oryza sativa
ccctcgtttttataacaggaatcaatcgtgtaaacagtactatttccctggatcaagtagtctggtacacacgagttcatagcctggtgctcctcttccagctgaagctgctgcactgtgaggtcagtcacctcagtctctaactctcccacacgcctctgctggtcgtcgatctccaacagagcctcctcgtaaaagtcgtctactgcctcagcccatcgtgacagtcgggtcactatcgggttgtagcagcaaggtgtgtcctgaactgtgcagacggagttgctctcctctcgaaacaggtggtgagcaaactcagtactcgccaactcagctcggtggatagagctaagtcggaggaatgcctcccgggctgcatcctgcatcgcagtctccggtaagtcgcgacggtggcgggtcgggaagcggtagtctgactctgaaggaactcgtgtgtgaacctcgacccgagcctcccaaacagatccacactgtctcactcggtagatcggaaatctggggtatcgcagacgcctcatcagccggtgtagctcaatgacgtatccctctgagcggggtacgcccatctcccaggtagcggatgaatcctgatctgccatctaattttaaaaaacccaaggtcagctaagagtaaaactcgttttgtgaagaaaatagttaagagta

SEQ ID NO: 91501 - DNA, 1613 bp, Oryza sativa
ggttaggtgcgacccgcgagcgttcctcctgcggtagtgcgctggtggcgtccggcgcatccgtgcgggcgcggtgctgccaccagctgcctcgcctccttcgtcatcgcgctccccttgccgccgctcgcgcccccccccctgtgccgccctgcctcgccgcccagccactgcttgcgcccaccccctgcgccgccctgccttgctgctgctgctgcctcgtctcctccgccgccgcgctattgagccggagggggggtatttgtccggtttgcaaagttggaggtgaattcggttttgtggttcaggagggtaattcggtcgaccgcgatagttcggtgcggtaattcgtacgttttccttttcttttttgtggagggtgttgcttttaacagtctcccatcagcttcgtcaacctcttgtctctcgtcgaagagaggttttcttttttttttctttttattatataaacaactcaacaacctggtactgaatggcacaataacacaagttgtttacatatatgcgacttaattaacaagaaacacattgcgcaatcatgcattcctctcgcgggacaaatgcaaacataaattatcaatagcgtgcaaaaaatgaaggacagcaaaactgcaaaattaacagatcgagaagcacaataatgtacttccggtttataggacttccactacgcataagttataaaaatttcttagagtggtaatatatgccgcgatgtaattcatttgctaaatcaacctacgtaatatagctgcatccatgtagtaccctacacaatttacagctagttttttcttcctatatatagatcgaataacatttaattcgtctaaatgtttttagactgaaaaaattcattatatttttttaaaaaatagaattatttaaatatgatcaataaagcgataggtgttcaccgatccgcgacaaattaaggctacggcattatgaaattaaatgctatcaatggcaccgtggggtctccaaggagcaccccgatgacgacacgcatcaacatcacaagcacctcgcacacgcgcctcaccagcttactcttactgctcccgccgccgccgccgccgccgccggcgcgctcttgtagccgggcgatcacacgattcacacggtcggcgccctcgccgtcagcgtcggcgccgccgcggcaggagccagcagccatgatctcatgatgatgcattttactgcagccctcgccgttgttgccgccgccgccgccgccgtggcccaagccagccatgatctccttgatgcacttgacgtgcaggtacatgcgttggtcagtgttcttggagctcgaaggtggtggcgccgccctcctgcagcgtgatggacagcggcatcttggcgcagcccgggtgcaggtccaggccgccggtggagctgtggtagtggaacccgcgcccgcgcacggcgccgtagcaggcgtcacagaggacggcgtcacggccggtgggtgccgcagcgtgggtgccgcgagggcgcagtgcgtgtgtagcacgaggtcgccgaaggtgtaccgcgtgccttcgccgggctccctgcacccgtcgcaaacgaagttggtggcggtg

SEQ ID NO: 91502 - DNA, 3442 bp, Oryza sativa
aaccatgcatcagctccaactcagcggcaaggcgcttgatcagtgttgggagctcgagacaatagactgctcggcaacggtgctcgagctcacccgtaaatcggcggaatctgacggagttcatctaagtcaaggtggggaatttttattttgttgtactaatagtagatcatccgcatggagagaaaggaattaataatgtatatgataccttctgttgggggagggaagggatatgttacgccgttgtgggaaaaaagaacggagacgttgacgccgtttaagtgaaagagaagcgcatgcgtactggcctaccagaaaaaactcggcgaatgagaagatgacacgtcgccaggaacaagcgtatcgggacagggaagccgcacccatatcaaatactagaaaatttcactttatctttggaattttttcagtataatagaatgaatgtattttcttaatatttagtaaagcagcctaactgtaatcacgcgaaaccctcaaactgatcgcacgctttaatttgcatgtatgcagaagttcttttggtcctcaaactatttaggcgcatatgcatgcgcattaatttgttttttcctggattaactggtcaatagccgtggtaattaaacatcaaaatataattatcggcgtgcaggctgaaagtgtactcgcggcagtagaaattaacatgcgaatgcgcctacgttatagggatagatggattgaccagatcgatccagtcgattatcccggctgctgaaaagggccgctcctgcattctcattagatagccgatcctccctataaatataggtacatccacactcattagcatcacaaagtagctagatttcattcctagctagagtgcatttagggttatatcgatctaatcatttctcccttgccaattaagtctccatcgatcggtaaatcagctatggaagcgagaaaagccagtgttgtttgctgcatcttactgcttgtgttagcacttggaggtcctgcttctgccacaggttcatcttaattctccctcaacccatttgatttcatctttcgaagaaactgcatgcgttctatatgctctgaattttatttgttttcttgagcggttctctatagatatctgtcagtgatgagattataggggacagtttacaattaatgtttcatgtgatttaataaatgataagctagattattttataagctagcatctaatgagttctttctctttgtagattattgctacaaagccattggcaagctgatcgtctgcgtgggtcctacgtgcaagttggactgttggcttgaggcgaaatacaataaaggcagagtcaagcgtcacaagtgcatgaaacatggcatatttgccaaatgttactgcgaaatctgtgttacattttgagggaatcgatcgacaatttgtaaaagtctttagttgatttagtctcgtgtaataatctagtacgttgtttgctagctagtttcttttataattgattagttttgggagttgcttttgtttggatataggatatgtgattatttaatttcttcctccaatgtatcagttatcactgtactctcattcaagattttttttaaaataaagtataagtgataattgcattataattttaattaactaagatatcctcatcgtttggcatattcatatgcttatcagccaaaatttgaattttcaacgttaaatttggagctgattttggggttttttcatcaaagtttatttttcagcctttgcttttagatcactaagaacacaatataaaagttttattcacaaattacttttcgtttgcaaatatgccatttggcttattccaccaatataccaaacgatggcaccctaacattctatgaaatgtaattttgtgagacatatatatgcctcttaacaaatgtagcatatatagcgtttgtcaacacaagtaaactgaattacaattattcttcttcccttacgtttgacatacctctatttcacagtattacaatattaacatcggcctttatcacgatcattaaaagtttgtgaaatgtaatcctgtaaattgtaccttacatttgacataacactaattttgttgatctcattgatcatgcctcgtagccacacaaacagtgtgcagatttgcagtgtagtgataaaattgctcgctactgatcgaaatttgcaacatgataggctaaagttgtaacaaaattacggttttaacgaaatggctacatttgtatgaaatttcactgagaaaaagaatctcaatggactgcgcttatactctcaaacctgtggtgagtgattgctttttctcttggtggtaaagcacgataatttaattagttattcgaaataaaaagtataacaatgcaagggccagattgcgattgttgtgctatcctgtgattatttttttcatctgccacggaagaagtagttgtggaacttaatcagtaactctgtctggcagatcacattaaaatctaacaaggtaaggcgaggaaggttaagaacaactacatctgcatgcatgcaaagcctgttgaccaaagtgattttaaatgtgaattttaccgatctttacaaacatcaagtcagatagtcaaacggtaaaatactacgactaaaaagtggtttcaccaccaggattgttcaccggaatactaaacatgccttgatagagatgaaagagcgagagatgataataaaattattatttttgttattttaattcatggcaatgaatttttgtccgtagtgcgccatacgaacgtgtcagaattataatacctccgttctgtaattgaaatactagaagcttattatgaacagtatctcaaagaatttgatattaaagggagttaccatggtaaccgtataaaaccgtgtaaaatccgtcttcaaatatttgaattcaaaaatcaacggtttcagcgtggtttctcgcggtaaccgcaatatttgcgcagttatcgtcaagtgtctagcaaaaaattgaaaaatcacttaaatgtgtctagaaattgggtataaataaaagaatatataggatatttgtaaacctaacttttaggtgtaaaatacaaaaattcagcataacattttctatattatggatttcgaagcaattcaacaacaatctaatgtactttcggtttcgctctcaaatttgaacttatcttactccttttcaaaacatttcttcaccatctaccactacaaatcaagaactatatccataatttttttcggaattttgaatttgggtataatttatcaaaccctactgccggtaacccttacggtacccctgatcacgatcaatacaattaacaaagaaattaatagcatgttcaaacacaaatacactgcgtatattcgataaactggtggcgctgggctctagctagc

SEQ ID NO: 91503 - DNA, 986 bp, Oryza sativa
aaatttggtgaagaaggtgtgacaaatgatgctataatgcaaaatttgacacagactgaattgttagtgaaagagaagaaagatgaaaagaatagaaaactgcgtgaatggcgagcaaagaggaaggctcagtctaattctgttgatggtggaggagcatcagccactgtcatgcagaatttgacgcatgctcagttgttagctaaagaaaagagagagaagagcagaaagcaatgtgaatggcacgagaaaagcgcaaagaggaaggcagagtcaaacaatgttccagatgaagtaacatcatacaaaacaattcatacaccgacctcttgccactcgcaagtgactgaaagtcaaaaggtcaatcattctaaaatgttgagcatagacaaaaagagtgaaaatgagatgtcgagtatagacaagaggagggaacagaagacgaaatatcagcgtgaatggcgtgcacgaaagaaggctaagttgaacaatgttgacggctggagtgctacatcaagcacccctgctattggtaagattaatgccttccgctaatttctccgtctttaatccaatattctgatattgttttgatatctaaggtgctttctccaccattaatgaaggatcgctttatggaacagtatgttccaccattctaaatgatgcgcaggtggccgacaaggagaatcatgatccagatgatccaaatgattggttacacagaaatgatgtctacaaacctcgattcaatgtaagaaaagcttcaaaccttgaacagacaggagccggtttagtcataggtgagaacattagatacaagtatgtgcattgctctctatttatagtgttaaccaatattaatccaaacatatacgttgtaaccaatggagttacacaaagtcaaactatacagaaaccaattgttcatcatgccattccacaaaccaactacgtcgaattcgatagtgcattattcgagcctg

SEQ ID NO: 91504 - DNA, 963 bp, Oryza sativa
tgataatgacgatagtagtaaatctggcaaagggaaaaaggacaagtttgtcacagcgagggagtactattgcttcaggctgcaggttagaaggggacttctaaacatcatttgttcggaggatgacttttccaacaatgagccgttgacatgtacatcaaaatcgagtatatgagactcgattggtactcaaaacctgagaaccaaaaaaagattcgggctgagctataccaggtaaatggtataacatatttctacaactattgatattgtctcccatctgtgattcaacataccagttatttgatcatggtgttatttaataattgcagggcgtggttgacgtgctttcttctggagagacaagcggttcggcagttggtaagaggattgtgctacctcgatcttttccgggaggtgatcgcgacatgcaacgaaggtttctcaatgcgatggctcttgtccaatgttttgggaggccagattacttcatcacaatgacgtgcaacccatactgggatgagataacagaacatcttgaacccggccagcaacctcaagatcgaccagaccttgtcgcaagagttttcagggctaagctgcgagatgtgttggatcttattgtgaagaaaaaatattttggggaggttcaggcttacgcgcacgtcactgagtttcagaaaaggggactaccacatgaacacatcctgttgatcatgaagtcaagcagtaaattgacaaccccagatgagtacgataaagtgatttgcacggagataccagacaaggccaaataccctgagctacatcgtcttgtcatcaagcatatgctgcatggaccatgtggcacactgaataggaattgtgcttgtatggtggatggagagtatcgcttcaactttcctcgatagttcaatcaagcaacacaacaagggaaggactcgtaccctttgtacaggagaa

SEQ ID NO: 91505 - DNA, 574 bp, Oryza sativa
tttaggaaagtttcttttttgtccgacaagaacttgtatcaacccatgggtataaatatgtacacccggggtctatgtaatctatcgctacaatcaatacaattcagcgcatcgccaccttttaccttttctactttattttatcgtccggcgggacttggcacctgacgcggggctgcatcggtgttcgatctccggctaaggggtaagtccgatgttccgccggcctgggcaattgtatcgtttacgtcggcgtcgttcaaggctgcatcagtacattcgacctcttggattgctctggtttggatgatatatttgcctacttatttatcatatgtctctgttaatatagtcttagcatatcaatttagctctatcggctacttctcgttttagggtttctgccggtatcggctaaatcgcgttgctagattatattagcttagacatctaccaccctgaaaactcagtcaatggcttgattgtctagatattatgttttttttcatacttagtgctgcatcagttaaattttatctactaagtcgtgcttagaaccataatctctagccta

SEQ ID NO: 91506 - DNA, 5097 bp, Oryza sativa
  unsure (1)..(5097): unsure at all n locations
gctacttcaccaaccacgacgactacaagagtttcgacatcttggcatgcgtcaccaaatatgatgccttattattttactacaacaagtggtgttccaatcttcaatatttctactcggacatcctcaacacatatcttcactcaagcaatgactactcgacgacaagaagctacagttctcgactctatgttcagttgtttaccaactaaccaaagagtcaggggctacacaaatacaagactctcaaaatttgacagatgttatctcaacatgaaacaatcaattaaccagccaatgagtcattttcttcgtctttgcttcggagcagacgttctacttcagcaacttcaattatttcaccaaaattttggcttcttcatgccgccacaatttacttcaaatttctcaagtatcaagtttgagatttaatctacatattcgggaggttggagttatcaaccaattaactcagattcaacgagttggacaacagtttctactttccttcaagtgaagcatctgcaacatctacaactctaagttctactgccatctttataaatcaaagggtgttgcatcagtcttcattatgcacacgctcgcatcaaggaaactactcgagtttcaatatcttctcaacaatttgatggattattgtcactgacataatcaccagcacctctgcttcatcggccctgacttattatttcgccttcacggctgacctactacacaaacgctgatgagcatcatttttattatcattggctgctacactgctattgactggatcaatgacattgtcatcttcatcaacatcttgccaagcctcttcaacatagcctactcttctgctattgattggcaacttcatcttcacagcttatcatctctgttgctgctaatcgtcattatctcggcttgcctccaccgccgcccatggagtcttcactttcacggctggcttattatgcctctactgataggcgtcttcgtcttcttcaccaggtgcctcgtctgttatcgactgattattttgctgtcatggctgcgcaactctgtcgccattgctgggtgcttcgtcttcactgctggttgaattgtttgctgccgactggtttcttcgccttcatggctatgcgacttcatcacctttgaattgtgtcattgtctttaccactaccaacatcttcgtcagctttgatgggtgatatcatcttcatgttggtcatttcgtctccatgccgaccacgtcagccactatcaatggacaattgtgactacaacagaaggataagctacatgcttaggggctcatcaatacaagcgcgaggattatatcttcaatttggacttgttccgaatacattcaacatgaatttatggtcgtgagtcgatttcttatgctcaacgtctggactattcgttattccccgtaagggctatcaaccgaatacttgcaccagtcgggattcaacttttatatctattttgaagtatcccataagggataatcactcagatcagaagctattcatatgagctatacttggtctatatcactcggaagatttattactcgggagcatattacatgcgtcatcctttaaagggtgtcgaaggcatattttttggctaggcctaatatgtctacagcccatattttcaggtgtggcctgtcacgttcttttagggacttaggcactttttgcttaggccaaagtgcgcgtgatcaagtgcccaataccttaaaatccttttataccacagttactcaactttttaggagttggtacaatgtattttaaaaggtgcccaatagtgaagttttttatagctgccctgctgacttttttatatatagtcaaggcgctgtttgggtttatacagcaattgattggatacaatatcattgctttttgccacgtaagtgtgctttttattgaccaatattatggcttaggctgattatatatttggtcattttccaggcggttggtaaatcctttatgagtttatttacttggattttacaccacgtatgccatatatttccgggtgtggtgaaacggtgtgtcttttagagacttaagcacatttgttaaaccagtgtgcgcatggtgtatgcccaatactttagaaatttctttattcaccgcatataagcttcttctatagctgttttgctatgtgaatttttcatgatgtacacaactttaggttgctcgcatcgtattttacaaagcagttggtatatcactcggatcatgttattcggagactcacaccgcatatgctgtatattgatatcaagtcactcggttgactataattatcaaaaccactcagttggttggattatttactccttgactatatgcttagtttgttcaactaaccacatagtcgggggctacacctattaggtgcatctagtcgatgcacctaagtttacatttaattatttttcagccctccacagtcttcagatttggtaaaagtactcaggagaccatggcaaagatgattgaagcactcggctttggagtaatctggtttgagagaagattatctttcgactgtgaaggtcttaggggctactgtagagattatgggtaccccatacccacacggcatggttatccgactggttataggggatagcttatacctatcaaatatgtaacggatcatgacttgggtattatgtttccttgtatattatgaaacagcctaaagtcctggtttgataatattgtaaattagatttaggaaaccgatgccatattggttaaggtttctatcttgtaatcctgcccccatcgtatataaggtgggcaggaggccctctagggggcctgacacaacctgatcgtcagatctatactacacccggcggattcaaatccctaaacaggagtagggtattacctctcattgagaggggctgaacctgtctaaatccttgtctccgcatccatccacttttagatctcgtgtggttccccttttattattggtgaattcatgtttcgatatttttgtttttctttttcctgtaacaaggctctgtgtgtttcttttttggctttcttctaaaagccgggtaatataatgtttgcctaatgtcaaaaataattatgttacataacatatgtacaaggtcccaagtttaaaacatgaaacgttttcgtatattaatatagtaaatgtgtgcactttatcatcttatcgcttgatgtattttcatcggtacgactaagtgagcaatacgcttgattgtcaagaccgcgctaagaatactaacatcccaacataactacatgcaagaatattttaaaagcatcaagaggccccacatgttatggaggccaataccaatcatgattcttatgttcttttatcaaacctatgctttaaaccatatgttagttttaagaaccatttgaattaccatagtccattttaaatatataaaaatgagtttaatattgaatatattcatacctttaaaactacccctcatcctcttgcatctacgcgtttgcaccgcatgtcacgccacctgcacgagcccagcctagatagggagagaactcaacttgagccttttttagggcctagctatagaggccatttctcacatgaggttctaggccccaatggttgtgcaggcaaccaaacancctcttaggtatccgcacatgcgagcaatcttccaactaaccaaacacgccctatgccctatgcctcccaagccaatttatattatattgaaagatgattcaatataattatgctattgtttccttatatctctcttgcaatattttcgtaccggaatagatccagttgatcggtattcggtcctactagttcttcctgctatgtacttatgttttttttaataatttgtctcttcccagttacaactaacaccaattattgttatacattgcatttttgcactaaaggcaaatactttactgcagtacgtacaaacctccgacttcttttacggtacaatatatatgctggtagtataatgtcaatttagaaatttatcacaaaattttaaaaatggtactttagtactttcgtgcgcttagtccttccattgtaatggttggtggcggcgtacgtgaactcatgatggctagcagcgccttgccgtggtgaaggataacaagaataaggaatgggattgagaggagaaaatatacagaattgccatcaccaaatactagcatggaaagataattttacctgtacatttacatcaggagacaaattaattaatcctaataccgattacactactacgagaaagatttttgcgtgcggtcaaaatcagttttcgcgtgcgagtgggtggcccgcacgcacccaggggtatgaaaaatcacgatttttggcacctgcacacgaaagtcggattttcgcgtgcgggtgcttatatcgcccacacggaaaaacaaaaatctgaaaaaattcaaaaaagttgaaagtcctagaatcggcagcgccaacgccgctcccagccgctgcctcctcctcgtcggccgacgacgtcgctcccgccctcgttgtcatcgtcagccgaggatgctgctcccaccctcgtcgtcatcagcggctgcctccgcgacacccaccacccgatccgtgctcccgccggcctccatgccggccaccgcccgatccgcgctcccctccggccgcaccgccgccaacgcccctcccctccgccggatctaggagggaaggaaggggaggggaggggagctagatcccgcgtggggggagggcggctgcccgccggatccgtgcgggggttggccgccgcccgctggatcccgcgcctcggccgccgccgcgtggaggaggccgccgcgcgccatcgcctacacccaccgccgccgcgttgccactgtcgtcgtgcgcaaccatcgcctatgcccgccgccgctgtcgggaggagaggagaggagggaggagtgaggagatgagagacaccgtgcgggggaaggggagtgaggagaaaaagagatagagaggagaggaaagaaataggagaagatttaaagtgggaaa

SEQ ID NO: 91507 - DNA, 1091 bp, Oryza sativa
atttgaactcagcacgttgggatgctactcaagtcactagcacccaatacgctacatgccctcgccccacattgtttagtatagcaaaaatttgagtaaaagggtaggcagttcacttacattcttgaatactacatttgaaccacatcttcaccagcacttgaataaaagagagctaacttttattttctcgtaaccattcaacaaaattgtccaaaataagaggccaggcaaggtctgaatcataattgtcaaatgatgggaagtttatctgcagtaaaaaaggataacatatcagcagtgatgaaaaagaaatgtgtaaatttggtatgagcacttcaaaagcatgttttagcctcctggaaaatgaaataagcagggaacaaaataagatggtatgaaacatgacctcattgcagaaacgaagaaagcccatccactggtccatgtttatcaccttgtattcactttggtgctacacagtttcaaaacggtaagctgttaaccattaaaagtcccacagaagaaagggacctacctaatgaaccaaaagtataatcaatcaataccttgaggtagttaacaagtttgtcaacctgggggcgaaactgcaaccccaatactagattcagcagctcacaagcaactggtatttctatacacttcttcttatcctctggccaaacataaccaaagataagttttctatgaaatgaaaatcagtaaagtgagtaaaatatatcaagcaataatacctgtcaggcagtaacgaaaggcatatggatagaaatcctggaaatttgatggccttgtaacctagatttgtaaagcagattacattcaattacaatataaccaaactcatcatcacttataatgacaaaattattttaatacaatcacaagttgcaacattggttatcgcataggacagtattccctagcaatagcatgataaacttgcaagccttgctactgagatcctatcctagaaaactctatataggactaaccaccggtaaaatatagcatcttccaaatatatttcagtatccattaatatatttgaagtgaaaaaactcacttcttgc

SEQ ID NO: 91508 - DNA, 705 bp, Oryza sativa
gtataaatatattcaccaaggtatgtatataataggaatcaaaggtatgacaagaaagaaattaggaggtaaagttttaataactctgttagataaaaggtgggacacaatagataaagcagcattaggatttttagaaggtgatatgaatgagaatatgttgataacatatatagccccagatctaatgatgcctataaaagaatttatagataaaatgagttttggttttcaaataaagggatacgaagaatttaaaggaacaaatttgctagtaagcatagaatttataggaagattaactaatagaagtgcctccaaatacaaaataaatgtaaatgatgtgattgaaaatatgcactttaagagaataactttcatgagccctttaaaaataagttctgaagaaagggcaggagaagaatggaaaattagtgatttaattgaaagcaaaactttgagtcggcctgaaaattatataagttatcaaaacagtaaaggaaatagcagcattagatttataaattacaaacccagaaccacagatgacttagaaacagaagcatctgatagaaatataatagataatagaagacatagtgtttcagagtttatggaaaaattagatcaagaaagtgagataaaatattacgaaaataaattaaaggaaataaatgaagaatataataactctatgaagagtga

SEQ ID NO: 91509 - DNA, 1075 bp, Oryza sativa
  unsure (1)..(1075): unsure at all n locations
caaaaatacaaaaaagctaaaggaaagaagactccagaaatacccattaaaacgactataaaagaagaagggtattctaaaaaacccacatacaaggaatgcctaacaaaaggagtggatccattagatggggaatatattgattggaaaataatagaaaaatttgaagaagcctccccacaattaaagaacgaattaaaggaagaaatacttaaagaattaaaacaagaaatggatcagaaatttgaacaaataaaaaaggcagtagatgagaaattagaagtttctttttctgatctggacactatggatcttggtggtcatgggcaaccagatgaatagaattctttaagctaaatatgtttttcaatatatattgataatagaatatcaacaatttgggcgtggaagaagaataaacgaagatttcagaagactactcaagaaggaatccagaagaaggaatccagaaggacaccctataaagcataaaggaacaatatagggtgcggtgaatgacatatccctgtgaagattataattttcggcaactttcggcagtgaatgacatatccctgtgaagaataaaactttcggcaggaaaggcctcaactttagcctgctctcgtgaatccacagtagcgaagagataagcaggaggcacaggcgacgccacccctcacctttataaaaggaggggcctgcccagctgaggagaacacaacaacaaaaaaagacaccattcagagcanagcttccaagcgcgctctcaccctccattccaccgttcttagtagtagtgactttagcctaccttgcatagtatattgaagcaagaagttgtgttataacgctgtgtaaggtaagaacagcttgcttgtacctaccttcggatttcccgaaagggaaaaccgtaagtaagcttatctgtttaatatgaagtaattttccttaagtattcctgcacgtttgttatagacaagtgtttatgctaaggaccctataggagaaacatcttcggtttgttctcgtttttagcctgcatcttgcataggcgtctggagaatcggtatcc

SEQ ID NO: 91510 - DNA, 732 bp, Oryza sativa
atatgataacctacttagaaacatttttaggtgaatctgctaaggttctatgggaacaatgggttgaaaagaatcctaataattatgaagaattgaaaagagctggtagcaatccgtataatttttcaaatgttatatctaacattattatagctgaagattcggaattaggttatacaactttgcagaatgaaaggttaaaagaaatagaaaaattaacgttaacaagtttgaaaggcataaaagaattctcccaacattatttatataatgctacaactgctaaacaaggatataacaggggaatagttgaacgttatttcaataaattacctgacccactaggaagtatgatatttgaagaatataaaaaggaaactgaaggagctgaaatcaacatctcgcaagccataacttttgtgtttaagcaactaaaaaaaatatgcacgggtatccaagcccaaagatctatgaaacactctgattacaatttttgcaataaaatagttcaaatacccttgacatatggagaagacaagcctagaagtaaaaggatttataaacatcaaaatagaaacaacaataatattagaacaaagaaaaggtatttcttaagaagatcagataatagagcacccttcttacataaaagaaatgtaagaagatataatccaaagaaaacctatgacaaaacatgcagatgttttatatgcaactcgccagatcatttaa

SEQ ID NO: 91511 - DNA, 611 bp, Oryza sativa
ttggcccgagcccgaaacctgacacccgatccccctttaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgtgcctgtgccgtggagagggacctggcggatcgcgaggccgccgttgccatccgggaggcaacgctgactgcgcacgaggccgcctgcgccgaagaggagtccgcgctccgcctccgcgaggacgcgctcaccgagcgggagcgagctctcgaggaggccgaggccgcggcgcaacggctggcggacagcctgtccctccgcgaggcagtgcgggaggagcaggcgcgccgtaatctagaaggtgcccgcgccgagagggccgtgctgaatcagcgggccgctgagctcgaggcgcgggagagggagctggacgcgagggcgcacagcggcgaggcggccgcgggcgaaagcgacttaaccg

SEQ ID NO: 91512 - DNA, 611 bp, Oryza sativa
agcacggagccgtcggggaggacgagcttcttgagcagctcgaagttgtggttacccggcttgtcactgaaatttcagcgagacgaacagatcagatgagatcggcgtcaaaattcagaagtcacacgacgcaattctggctcaagattgcctctgcttcaggcaagccggcgtatgcgcgtgtgccgatggtgatgaccagtcaggatggcggcgatgagccaatgtttgtcacatcggtgacagactgcgcgctggttggcatgccatgaagcaccggcaatcattccagatttccgtccatggagggatcatccaccggcgaccccggcgccgcgtcgtggacgcgcgtcttcttggtgatccggcaccagccggcgccctggcagttgaacacgcccaccacgccggtgcacttgttcacgttccatatcttgagcaagctgcaccaaattccccgctggccacatcacatcaaatcctcacctcacccggcttgaatgctcgatcgccatggcagaacggatgctgctcgcgagcttaccttgcgccgtcgcgggccgggtcgacaaagaggcagtcgcgggtggggcggccggggagccgtgccc

SEQ ID NO: 91513 - DNA, 1377 bp, Oryza sativa
gcccgaagacagcggatagtcacatgcgacgaggtcccggtcaaggaggttgccctgggcgacggcccgtccaagaccacacggatcggtggtcttctggacggcaaataggaagacgcgctcgtctctttcctgcgggcaaacgctgacgtcttcgcatggagaccggcggatatgcccggggtccccagggaggtgattgagcaccgtctcgccgtgcggtcgggcgcaaggccggtccggcagaaagtacggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccacagcggggtgcgaccttttgtgttttctagatgcatactctggttaccatcagattcgcatggctagggaggatgaggaaaaaactgcattcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagaccttactctcggatcaagcggaaacttttgagagtctccgctccgcccgcataaaactgaaccccgataagtgcgtgttcggtgtacctgcgggcaagcttctcgggtttttggtctctgcccgaggcatcgaggccaaccccgagaagatacgagctatagagcggatgcgccccccagcaagcttagggatgtgcaatgcgtcaccagttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgccccggagccaaatgaacccttgctactctacttagcggcgaccccgcaagtggttagtgcggcgttggttgtggagcgcgatgaggacaatcctcattccgcgcacccccaccctatgctggcttggcccgggagagagcagggaggagaggcccccgagccgaacggtggcccaaggcccccgacgaccggagttggccctttgcccgcttgtcagacgacgccaggagcccccgacccccaggacggccccgaggccactgtgggaaggc

SEQ ID NO: 91514 - DNA, 1168 bp, Oryza sativa
tcgccagcgctctcggagatagccgggacttcaacggcttcccgaggagctcgagaggacgattaagtcatcctcgagggacctcgcccgaggagcggtggagctcgtactggcaagttaccaagccagggatcccgacttctccccatggacggcgctggacgagttccctcccgggaccgaggacggcgcgcgcgcgcaggtccgggacgccgccgaccatatcgtccacagcttcgagggttcggccccttggctcgcgttcgccctcaattccgacgaggaggacgatgacggcggagtgggcgacaatggcgacgaggctggcgacccgggtgcatcggagtgagcccctaggcccccgccaatctttaaatagtttcttcttttcttcttccgaggccttcgggcccccttcttgtatagactaatttaatctgcaatcaaataaagaggaaaattttttgtgtcaattctatttgttgtgtgtatgagacgaggatggtctgtgccgcggtccttttgtgtcttggcttgaacaagggctcgtgcccaggtcctagtcctcaaatggctcgggtcggggctagtgcctggggagatccacatgtcgagactggccaggccgggagcgtgatgaccgagggttatgggtgacccgattgtgggtttttgccgattcccccccggagttcaccacgccccggggcacggctcggttctgggccccgtttggcgattttagccgacccgagcccccgaggcaggattgaacacgagtgacctatttcaagtcaagatccttcaaaaggaaacaacagcacagatacagcctttaggaaatcgaaaatgcttttattgaaatacagatataagagaaataagaatatgcatatgtggtagtccccggccaaccctgcacgcccgaggggggtgcggggttggcccgagcccgaaacctgacacccgatccccctttaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcaga

SEQ ID NO: 91515 - DNA, 536 bp, Oryza sativa
ttccttgtccgctcagccaaacttttgaccgcgcggcagtccgcgaggtcgtggagggaggtgttgtgcacggcgcaccacttgccggtcgggcgccccctgctgggagcgccggcctccttctttttgtcgctcgcaggcctcccctttcgggtggcccgcgaagcgccctcgacggcgaggacgtgaccctcgtcgtcggaatgggccgacctctttttcctcctcctatcccgccgccctgaccgagcggcggatccgggggcggccgaagctgccacaccagaaccggtggagttccaggtccaggcctcctccttgcgagccacacggtccgcgagctgaaaaagctctgcggtggtctggggctccttggaggcgatctttttgagcatgcggttgtgccgcacgccccccctgaacgcgtagattaccgcgtgtgcggggatgcatggtatggtgttgcggacttgacaaaaccgctgaatgtacgagcgaagagactcatcgtcccttcgctgtaccgcatgcaagtc

SEQ ID NO: 91516 - DNA, 719 bp, Oryza sativa
ttcgccgcttgcgccctaactccttgtttcctgtgccctaccttcgccacacgcgctcgctcttaaacatctcttcctccggcgtcatggcacggggctccgctttgcttgatggtagcgtgctgccgccttcccgcatcgtgagcgagaggcaggccgggctgccgcgccgcttcatgccggaatctgccaccggccgggagatagttacgctgggcgagggacgcccggcgccatgctacccggggcggtccgtcttcttcctcccttttgcaatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgttccggtggttcttcaccgtacagtcggtgtcgccgccgtcggtggttggtggctgctacttccagccgcgggggctggtgttgaaccgctacattccctgcgtcctccgcaagaagtgggatgactggaagagcgactggttctacacccccctcgccgacgaagcgcgcctccgacttccgagccagcccccggcgcaggcctccagctggcgggcgccggtagatctgggagatggctatgacgccgtcctcgaccgcctggcgggcctgcgatccctgggg

SEQ ID NO: 91517 - DNA, 592 bp, Oryza sativa
cattaactatgcagtacttttgcaaaaccctgctatataacttaagatccatgctaaggagtgaaaattagctgaataggattgaaccaaaactatctctctgtttgaaaaatatccccaggattacatgaaattcatcaataaattatccttggtttgttttttgtaaccattctctaacatatgttcttctttcagggcaaagaagatgttttttggtttttccgtttctcttatcctcatcaacctagcttccataatggagcgggctgatgagaatctccttccggcagtttacaaggaagtcagtgctgctttcaacgctggtcctactgatctggggtatcttacgtttctaatgaactttctcaagtcaatagcatctcccttggcaggtgtccttgcacttcaatatgatcgccctgcagttcttgctatagggacagtcttctgggctgtatcaacaggggctgttggtgtcagccagtattttcagcaggttgcattctggagagctgtgaatggtcttggactagccattgtaataccggcacttcaatccttcattgctgatagctacaaagatggtaca

SEQ ID NO: 91518 - DNA, 978 bp, Oryza sativa
ttgaaatcctcaaaggtcagctggccattcttgctcacatccattttatcaaacatgtcctttatgtcagctgcttcctctgcagacaaatgctcagcaatgacctgcaattaagcacaaataagctaactacaagaaaaggagaaaaatccttatgcacatctcgtgtttagaatttaggaagcaaattatatgtgatctctatgtagaagtttttattcaataagaataataatctattttggtgctaacatattataaatgctaccttaagggctttcttctttaacttgttcatcgcagcaaattgctgcagtctagctcggacagcatcaccaagaggaatgtcaggcatctttttagaatcatgtaaccatggatgttctgtacatgcaacgaaaatcagagaaaaacaatgagaaaaaaatgtctgagccatgaaaaatgttaatcatggtgccattaaaaaacattctggataaaaacacagtaaaaaaaagggtacagctagccatttttcggagaacttttctgagattagccctgcatgatggtccctgaataataaatagccctgggctaattttatatcttcttataataatgtgagttcattactcatcaatcacatcatagataatatatagtacagacatatccttcatatattccactaaagtaggagtgagatagcattatgtatgctgctacgcgttaggacaggtgattggcgatgcttaccaagtacttgttctgcagtaagccttgtcatgggatttgggtccaacatccgataaacaagatctttagctggctcagataccctgggccatggttctcttttgaaatctaccacagagcgtataattgcctgcgctactccctgctcggtttctgcatggcaccacaataatatgataagaatggtgttctataacttccccgcaacacatgcagtctagtcaagagaaagaacac

SEQ ID NO: 91519 - DNA, 607 bp, Oryza sativa
ataagagtgaatccttgggtacattactgacctgactttattattccagaaatcatcccaaaacagacaagtctttccatccccaaccttacaggtggacaatcccctgaaaatgtctgcaaattgtagaacatctttccaccaaaaagaccctctagggcgatcagcatgaggaactttgttaatataataagtggaccagatcaagctaacccaaggtattgagagcctattataaaatttgtgcagatttttcattaaaagagcattattatgcagcctcaggttaatgactcctagacctcctctacttttaggttgacaaaccctttcccaaagaaccaaagatttcctgctagaattaatatcagttcctctccataaacaatttcttctagctctatcaatgttttcaattattgactttggaagggaaagagagtacatatagtaagttgggagggaagataaaactgaattgaccatagttaatctatctccataagacagaagagcagaagtagcagacaatcttctctcaaccctatcaactaagggggcaaaatcaattatctttggcctagttgttcccaaaggcagacctaaa

SEQ ID NO: 91520 - DNA, 657 bp, Oryza sativa
acgccgctgtattatggtacgtacaaaactacaaacaattgtaccaataattctggtctagtaaactgtaagcacaccatctgcttccccatcccgccctcttttgggtacatacatatctgccgcctgactgacaaatataatcgctgctggtaagcacaaaaccacaaatgctatctatacaaagccactaagttactgtgtgaaaaaataatgtaacagccagcacacagcaaagaaaaaacgtaagcgtagtttttttctctgtccagtctattgcgtgtcgtcactgatggatccgtccttttgaagcttcagactgaggttactgaacctttgtcttgagtactgcctagatgccttcctccagtcagtgccggccttcatcatgacggcaaactcgtcgtagcttattttcccatcctgagaaaagaataaatgaaaagaaaacattgcattgttgttaggatgaccatatcgacaagttcaatcacacggaatttgaacaggtcatactttgctaatgttactttcaactaacaattgcactagaatcatctccagtaagcctaccccagttgtttgtttgttatgtcatttgttttatgtcgtctaattagactatccttgtccatccggttacaacttattatatga

SEQ ID NO: 91521 - DNA, 534 bp, Oryza sativa
cccgggcatgtccgccggtctccaggcgaagacatcggcgtttgcccgcaggaaggagacaagcgcgtcttcctatttgccgtccagaagaccaccgattcgtgtagtcttggacgggccgtcgcccagggcaacctccttgaccgggacctcgtcgcacgtgatcatccgctgcctcggggcggctgggacggaggtgctgagcctctcgttgccaccctcgggcttggacgcggcggcgaggtggttcgcgcactgctccatacatgcaagcgcgactttgaggttgccatggacagagatggggccaccggggcccggcatcttcatctggaggtaggcgtagtggaccgccgccatgaacttcaccaacgcgggcctccccaggaccgcgttgtagggcagactgaggtccgccacatcgaagttcacccgctccgtgcggaagttggcggatccaccgaaggtgaccgggaggtcgatatgacctagcggccaagtgtgccccggcgtcacaccgataatcagctggga

SEQ ID NO: 91522 - DNA, 2292 bp, Oryza sativa
ccacacgtacacgtacttcaccccgtgctccttcttcgcctcctccaccaacgccttcagccccgccgccgacgccgccgtctcgccgccatccgccattgccgtcgtcgtcgtcttctggaacttggtgttctccttgatcccgatcaacctgctcgcgaacctgcaacccatcgatccacacttgttactgcacattgcaaacaggaaacagcatttgctgccaaaatcacgtactgggcgccttcttggacgacggcattgccggcatcctccttgttctcgctgccgatctgctgccacccgtcgtcgatgatcaagaaccgcggcggcgtgccgccttccgccagctgcacaccaaacacatcccaaattcagaccaaaaccaattcaaatttcatcaaatgaaccgaagcgaacctttggaggccttgcttgacgccatcggcggtgacgtcggtgtagaaggcgtcccatgtgcaccacccgaaccagtccaagaacgacggcaactgcatgcgtagcgcacacaccaatcaatcaatcaatcaatcaatcaatcaaattcattcacatcccgccgcgcgacgcaaccgcaacgcaacggaaagcgaaagacagcgccggcgccggcgccggcgcgccgccgcaatggtgtcgctgtcgcgtcaatcaacaccggaagaattagaaaaatatctcacctttttcttctcccggtggtggaacgtctgcagatgcctctccaccaccctgcaatttctcaccgtcgtcgtcagagaaacaatcaaatttcacctggatctcaaccaaattttactactccctccatttcaaattataatttgtttaaacttttttctaagtcaaacttttataaatatgtccgagtctacagaaagatttaccagcacttacaataccaaattaatttcattaaatctaacatcgaataaaattttgattatatgcttgttttgagtttaaaatgctaagatatttttctctaaactttatcaaagcttaatactccctccatttcatgttataagacgttttgattttggttaaagtcaaacgatttcaggtttgactaagtttatagacaaatataataatatttataatgctaaataagtttcattaaatcaataattgaatatattttcataataaatttatcttggattgaaaatgttactactttcttctacaaatttaatcaaatttaaagcagtttgactttgaccaaagtcaaaacgtatttgttctaaacaaagggagtagtatatttgattagaaaaagaattcagtgaaggtgagacacgcacttgacggcttgggtgatggtgtcgaagggattggccccggcgtgcacgtacaccatgtacgtcccctgcgccgtctgcaccgccttgtcacctgctcgccgcggcgtcgcgtcgcagccacacgcatcacatcagaacggagacggagacgacgagaccgtctcgtgcgcaagcaaaagcagcacaggatttgggcagtatggcttaccgctctcgatgcagatctcgagctcgtcgcggtcgttgccctgcagcgccgcccggaactgcccctccagcagcggcagcatcacgacgtacaccgcctcgccgccgccgccgccgtcgcggctctcgaggagcatgaactgtgtctccagcgggacgtcgcggccggacgtgcccatccgctgggtcatccaccatagcttgaaccggaagcagcacatgaacctcaaatccctggtaaaaaaaaattcagccaattcaatcaattttttcttgaaaattttgttaaccccaacagtaaaaaaagagagaagagagcagcataacacaaaacactttgttattaatgaacaaataaaacagtaaacaaatgtctaatcaattttacgaaattgatattcaaattattcttttacgaaatagaaattcgaaatggagcttgaagacgcaattctggctcaagattgcctctgcttcaggcaagccggcgtatgcgcgtgtgccgatggtgatgaccagtcaggatggcggcgatgagccaatgtttgtcacatcggtgacagactgcgcgctggttggcatgccatgaagcaccggcaatcattccagatttccgtccatggagggatcatccaccggcgacggcgaatgaatgcgagttttgagcctcacctgacgtagatcgggcagccgccgatcgcccgcgccgcgccgtggtactccgccgccgggtgcaagctctgcaagttcatga

SEQ ID NO: 91523 - DNA, 1156 bp, Oryza sativa
gattcagcggtgtaaagttttagcatgtcacatcggatattatatagggaatcacatatggtgttcgggtactaataaaaaaataattacagaatacgtcggtaaaccgcgagacgaatatattaagtctaattaatccgtcattagcacatgtttactgtagcactacattgtcacttatagattcgtctcgcaaattagttgtgacggagcgtggggctcctcaccgggagaccgcgcaggcccccctttgccggttcggccgggggccctgggtgagattctaagctcctagtctgtgtgtggaaggttcgcgagaatggaaacacacaagacacgggcgatgtatacaggttcgggccgctgagaagcgtaataccctactcctgtgtttttgtggatctatgtatgaagaagctacaaaatagctggagaaccagagagctcttactctctccctctctgatcgttctggatccgaaaatcaatcctcccccttctaagtgggcaaggtcctccttttatacctcaaggggataccacatgcaccatctctctcttttttgtggggacttatcctctcttttcataaacagacggagacttgtatggttgtcgtccgaatgaccttctgatgggacagcccatacctacctccacttccgccggaagcaggcgcgacgtgggaacatggctgtctgctgacgacatgatcagtgtcagaccggtcacaaatcggtcattcttgtccaccacgcgtcagtttatcaatctgcatgttcgcccctcttcatacaatgtcttgcttgtaatggttaggatgaagcctggtatatatctgaccgggaccaacgtgccatctccaggagctaacacgccggctccggctagggacgagtgcttggaggctctcatcctgacgggatggggcgaggcgtgcgtcagaccgcctgtcgccacctaacccacgatctgatcggtctgtgactggtcacagaccggataaacgagcgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgag

SEQ ID NO: 91524 - DNA, 541 bp, Oryza sativa
tgtttgctcctttgcagcgacgggctatgggatgttattagcgctaacagggcagcgcagcttgtccttgaggtaactcatcgatcggcttcaacctcatggttattaagtcgtggtgtgctgatcttttatctcatttttcagggtaagcagaagtacagcgagcagaaaacttcagcagataaagtagcacatcatgtgttaagtgaagctaggaaattgcgaaccaaggacaacacatcagtaatatttgtagacctggacactctgagaagtgatccctgatcctgaatccccaattgcttttgtcaggtccggagatcgtcctacctgctgctcgaacagttgaacaacactatttcttttgtttcactggtagttaatatcctttgtcaaagttgagccaggtgctccggtgttgcagaggatgaatgctacagttctccttgtatgcaaatacccagggagccccttgtgcggttatgcctgtaaattgtgagtgaattggttaaaagaaatgtttatgaactttaaattctgg

SEQ ID NO: 91525 - DNA, 506 bp, Oryza sativa
atcccggtcgtgtagacctggagaaactcggcggggttgacgctcccgtcatatttttcggcgatggtgggccggaaccttggggaccaacggacgttccgaaggctcgccacaaaggctctacagccgacaccaccaaccgggggcacggagggctgatccccgcgtccgtgttgatgtgacactccggacgaggaggcgccctccgttgcgtgggcagcacgtcggccattacgccggcgctcgatactgatgcgggcatccggccccccacgcagatcttcctgggtcggaggcgctgacgaaggagtagcggccgaatggcgagcaacagccgccgctcgccgcgccctccgccttgacgacacggagccggtggtagcagcgccagaggtcttggtggcggaggaccacccaccagcacctaggcgctgccgtgccgtcatgaccaagttggccacgtcgtccagccaacgttgggctggagactccgggtcagggacaat

SEQ ID NO: 91526 - DNA, 799 bp, Oryza sativa
tttgctgggcaagggcagcgattttctttgctgtggcttcaggttctagcccagtcctgagagcctcaacaactatagcactgatctcattgctgtacaaattgtcgaaaagcccatctgtgccagcaataataacgtcgccaggagcaactggaaagtggaatgtctacataaccaaatatgagacatcaataatattattgatgataaagaacgtaggagtcattcaacgaagattcaaagatgtttgctcaaaccagacagttcaaaatttcaagaagggtgattactcacctgagcagaactaggaagatcactgccacccccactctctagctgataagtgaaattaaaatcatgctgttgtacaggtgatctgagaacagttcgaccatctctgactatgatgaagccactatctccaaggtttacagcatggataccctgcatgtttaaatacatctgcttcgttattttccagaaatcagaactgtgaacttctagttctgttgaaacattgtgctacactagacagaaagatacatgaaagaattatccagttattgtggtttccgtggatgagatgttctctagaatcatattcatagaatcatagactcaagatgtacattcaagaataacttcaacgtgattttagtgaagaactcagttgcaattttgtgtgcactactgttcaccagtcataaaaatggcaatggaaggggactacactaagcatcagacaaaggaaagctggttaacctgctctttaagagggacgatgcaacagggctgcagg

SEQ ID NO: 91527 - DNA, 694 bp, Oryza sativa
acgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggtccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaagggacaggcacggggttggctaatgaacttgccacccgcgtccatccactcttgggaggatttgtgccaacagttcaccatgaactttcaaggcacatatccgcgcccaggtgaagaagcagacttacatgcagtccagcgaagggatgatgagtcacttcgctcatacattcagcggttctgtcaagtccgcaacaccataccatgcatccctgcacacgcggtgatctacgcgttcagggggggagtgcggcacaaccgcatgctcgaaaaaatcgcctccaaagagccccagactaccgcggagctttttcagctcgcggaccgagtggctcgaaaggaagaggcatggacctggaacccctccggttccggtgtggcagcttcggccgcccccggatccgctgctcgg

SEQ ID NO: 91528 - DNA, 680 bp, Oryza sativa
atcatctccattacttgtaagccgaacaataaagcattgtattcggcttgattatttgtgcaataatattccaaacgaaccgatgcctcataacacatgccattaggtgaaatcaaaactacccctatgccttgaccttctttgcaagaagaaccatcaaaataaatcttccaaggtataacttcaactaagcaaacctctccctcataagcaacatctatatgatggtccactataaaatcacatacaatttggccttttatagttttcaatggttcataagccaaatcatattctatcaaagcatatgcccacttgccaattctcccacttagaattggcctttgcaacatgtgtttaataacatcggcttgacaagtaactatgtatgtactacataacaaataatacatcaatttggtacaagcatagtataagcatagacaaagtctctctataaaaacatacctcgtttcggcatccaaaagacggcggctcaaatatgtaatgatatattccttgccatcttcctcttgcgtcaaaacggcaccaatgactttgtcttcggaggcaatatataaccgaaaaggctttccggctttaggcgctcacacaacgggtggagtagacaagtatcttttcaactcttcaaacgcctcttgattgttttgccccccaag

SEQ ID NO: 91529 - DNA, 628 bp, Oryza sativa
cacggctccccggccgccccacccgcgactgcctctttgtcgacccggcccgcgacggcgcaaggtaagctcgcgagcagcatccgttctgccatggcgatcgagcattcaagccgggtgaggtgaggatttgatgtgatgtggccattggggaatttggtgcagcttgctcaagatatggaacgtgaacaagtgcaccggcgtggtgggcgtgttcaactgccagggcgccggctggtgccggatcaccaagaagacgcgcgtccacgacgcggcgccggggacgctcaccgggtcagtccgcgccgacgacgtcgacgccatcgccgacgtcgccggcacgggctggaccggcgacgccgtcgtgtacgcccacagatcaggtcagtgccctctgccagccacagaacatgtcctcgccgccatcgtcgagctctgacgacgtgccatactgccatgatttttgcttcaggtgagctgatcaggttgcccaagggagcgacgctgccggtgacgctcaaggtgctggagttcgagctgttccatgtctgccccgtcatgacggtggcgccgggcggcggcggcggcggcgttacgttcgcgccgatcggcctctcgacatgttcaa

SEQ ID NO: 91530 - DNA, 774 bp, Oryza sativa
gttgttgggcgcctacgtcttcaccgaccggcttgccttcgtccccgccgatcgatgtcctcgcctgcacggctggcctttatcccgccgttgttgggcgtctacgtcttcaccgaccggcttgccttcgccgccgccgactggtgtttccgcctgcacggctggcctattatgccgccgttgttgggcgtctacgtcttcaccgaccggcttgccttcgtcgccgccgactggtgtccccgcctgcacggctggcctttatgccgccgttgttgggcgtctacgtcttcaccgaccggcttgccttcgccgccgccgactggtgtttccgcttgcacggctggcctttatgccgccgtagttgggcgtctacgtcttcaccgaccggcttgccttcgtcgccgccgactggtgtcctcgcctgcatggctggcctattatgccgccgttgttgggcgcctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgcctactggtgtttccgcctgcacggctggcctttatgccgccgttgttgggcgtctacgtcttcaccgaccggccgcctcgaccggggatcctctagagtcg

SEQ ID NO: 91531 - DNA, 719 bp, Oryza sativa
caaaaggagagggattagagagagaggaaagagcgtgggagggcgagagcgccggccgaaggcggcggccatggtgccacttgccggcacacgacggggatgggtctccggcggcgaacctcgacggggaaggggcggccgaggtagatctcgaccccgcgaagctaacggcggcgacggcgcgagacggcgacgagcctagcggcggctagcggcggccggagtagcaaaagcggcggcggcgggtggttgcacggcgtggaggcgatggggagctcgggagagatcggcgaaatggggaaaaagcgagagagggggacggcgatgcttaaaaagggggagagggagccggacgtggccgggagcggcgggattcgacggccgacgtgggggagtggggaggagagagaggcgggattcggttttcgaatcccggccatctcgggcgcgggcgcgaacgggagggagaggggaaagggcgcgggagacgcggcgcacgcgcgggcgtggccgacgtggcccgggagagacggaggcgtgggcgcggcggcggtttcggcgcggcggcgcgccgggatcggcgggaggtgggggaaggacccgacaggtgggccccacctgtcggcgaccccgagagaggaggcgggcggcggctgccaggctgggccctcggcctgcggccggcccagcaaggaggagggggaggaaggaggggaatg

SEQ ID NO: 91532 - DNA, 1007 bp, Oryza sativa
tactaagtgcaggccaatcattaatggtaataaatagcaacgctcgtaggttaaattgctcctatttgtccttatcccacacgaggacgccctctttcctgcacaacactttcagatcttcaaccaatggtctaaggtacacatcaatgtcgttaccaggttgtttcaggccttgaataataatcgacattatgatgtactttcgcttcatgcatagccaaagtgggagatagtagatgcacacagtgaccggccaagggctatggccgctgctcatctctccaaacggattcattccttccgtacttaaaccgaacctcacgtttcatgcattctctccgaagtcgttaaatgttctgtcgatatttagccactgcgacccgtcgacggggtgtctcagcatcccgtcttgtttacattcttctacgtgccaccgcatcattctagcatgtgatttatacccaaaaaaccgcttcagccatggtattatagggaaataccacatcaccttagcagaaactctcttcttcaaaggctgtccttcaacatcgcctcgatcatctcgtctaatcttgtatcgtagtgctttgcaaacagggcatgctttcaggttttcgtgcacctcaccgcgatagaggatacaatcgttcggacatgtgtatcttctgaacttccagtcctagagggcagatggccttcatagcttcgtacgttgtttcgggcaattcgttcccctccggaagaatgttctttacgagctccaataactcagaaaatgccttgtcactcataccatttttagccttccattgcaagaattacagcgtggtacccaaatttttgtggccctgctcacaacctgggtacaacgacgttctgtggtccgctaacatgagctctagttattgcacctccttttcactttcgcagtcctcaggtatgtcccgcaacatttgaccaagatcatctgcaccgtcattatcttcaacatctacgtctgcctcgcc

SEQ ID NO: 91533 - DNA, 6430 bp, Oryza sativa
gtaaatcaagaaaaatgtgtagaatccattaaaaatggttttgttctctgtttcagtagtcttatagcctgtttgcaatgtttgctttgtatgtcgctagattccgatccctccgacgctccggtgtacttcgagatagtcgccgaggtccctccagcagcagagcaaggcaagtcatgcctgtcacttgaacatgttgatcctatattgcaaatgctctactgttttctttcaaatattgcattgttttataatatcactatgggatggatacctattgttacagccatgcttttggatatcatgctcctttgttagcttgggttataacatgattagactttggactaggaattgcttagccatgcttagttcaactagcacacattggggatctcatttaaaacctagactataggtttatatgataatgttggtttaataccaccgctctggtgttggttaaataaaatgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaatttggatagtttaggtggatggttgggcctgtcgcaacgtgggttagcgttggacagcggatgtttaatactgcttaattattacaactgttttcgcattcaattcctgtttataaatgccagtatttatgcaaatgaacctgcttagctatcccttgttaaatccctgcatcatacctctattccggtatgacttgctgagtacagtgggtagtactcagtcttgctctacttttcccccccaacctcagagctcgagtatgtgtccgatggcgggttctccgaggagtaggcttcgtccgtgccgtcgaggatgcctgtggagtggtgttcccgctgcagttcaagtcaaggcttagctccagttatcttttgttttccgctgcatttctgtaagacctttataatgtttgtaagacgtggatctgtatgtcaacattgtcgtttgtgtaccccggctggtcctggacgggggttttaatacacattctgcttggaattctattcgggaatttctgggcgtgacaagttggtatcagagccgaccttgaccgtaggacaagccaaatggaaagacctaagagccctctgaatccttttcattgcatatgttctttgcaattggattttgttccgggaaaatggggatctgttcttatggttcaagggaaaaatcttggtcgctcgtttaaagtgagtttttcaaaacgagtcagtctagggttttagtaaaattattgggatttattcgtcagtcagttgggatttgatgggtgaaatgcactcggtcctagctcggtatcatgggttgcaaggtatttatgctttgttcgttattattaatatgtatctaatttctcattattttatcgttatgtgagtctgtcttatttattcgcgctcatgtaaaatgatctatgcataaaattttgctcttatttgattcctttatttgagtctttattgctttatttaaatttggatttgagcatgcattgatcctactcctttgtcttctctagatggccggtcacccacccaaccaccgcggagaaggcatgattgatttcgtggcagagttggcacgcatgaccctggtggtgggctaccccgacgcgccggagtacacgacgattccgccgctcagtggcgagcttcctcaccgtgtccgcttggaggtccatggttacgtggggacttgcctcgctaacatggcggtcgaggcatctggaggcacagcagatcacgcctgtcaggaggcagcctacttgatgatggccagactacgggagcgccacgactacatcttccacgacacggcgtaccgctaccacccccgtcgagcccatggtgatggcgtcagctccttccgtccgacagctggcgagaacgacaccaccttcggtcacatgtgtgctgtgatgaggggattggaccggatgcactcggacctgcacaaggcgaccaaggccttgaatgatgggaagctcatgaggatcgtcgctctgaaggacgagatagcgcgcctgaagaaggagaatgctcagttgaagggtcttccagcaccaggaggagtccggatccgcactacgccccgtaagaggacgactgcacccgtgcgcatccagcttgcgcccaggaacccaccttcaccagcagctcccgcagcacctccagttccgcccgcagctccggcagttcccgcagttcctccagctccagctccagctcccgcgttcactctctccttcgctccagcatcagccgccagaggtccagccagtggtaccggaggttggttgtccgctactcccagtggcagcggcgagactgatctgtcaggctccaggagtcgttcagagggaccaggtgacgagcaggaggacgctttcgactccaccgaccgcaggagccgttccgagcattaggctcgttttcccattagtttatcgattgtctagtttctgcttgttagtttgtgtgtttaggttgcttgtttggggtcagtcgacggtcgatatcatgtgcctatgatatggctgtcttaataaggatttttgtttgctctttttaagtgttttaattcagatcagaacaattgcagttttaattcctatataataaagcttagttcttgagcatctgtttttctccttttccccccgtctgcttttccctccagatggtctacaccaggactggcaaccgcacgacaggcgagggcagcaacggcgaagaacgcgtggatggtgtgcaccccaacagtgattctggcaatggtccgccaccacttcccgagaatccgacgcttgcccaagttatggcacaccagactcagatgatggcagccatgatgcagcagatgcaacagcagcaccagcagatgcaccagaggatgatgcagcacgccgaacagcagcaccagcagtttggtccccctccccctcagtccaagttgccggagtttctacgtgtcaggccacccaccttctccagcaccaccaaccccatggaggcaaatgactggatccatgcgatagagaagaagctgaatctcctgcagtgcaatgaacaggagaaggtcgctttcgccacacaccagcttcagggtcctgcgtcagcttggtgggacaaccacatggccacccgcccaccgggtactgaagttacatgggcagagttctgccgtagcttcaggaaggcacaggtgccagacggggtcgtggcacaaaagaagagggaattccgggcgctccatcagggcaacaggactgtgacagagtacctccatgagttcaatcgcctcgcgcgatatgcaccagaggatgtccgcaccgacgccgagaagcaggagaagttcatggcgggtctggatgacgagctgaccaaccaactgatatctggggactacgccgactttgagaggctggttgacaaggcaatccgtcaggaggatcagcgcaacaaaatggacaggaaaagaaaggcggcgcagttccggtccaaccaaggtagtcagcaccgaccgcgcctcactcccggacagcagggtggacctaccaccatgattgttcgtcaacaccgcccattcaaccccagcaacttccaccagggcactagtggcagtcagaaccaccatggaagtcagcccaaccgcggtacagctccacgcccaccgatggcaccggcacagtcaggccagcccgcacaagccaagaaggagacgggagcaaaaccagggtcctgcttcaactgtggcgagcttggccacttcgctgacaaatgcccgaagcccaggcgtgccggaccaaggtttatccaggctcgtgtcaaccacgcatctgcggaggaggcacaagcagcaccagaggtcgtactgggtacgtttcctgttaactcaatccctgcaacagtactttttgattctggtgcaacgcattctttcatctccaagaaatttgtcgggatgcatgggttaataagagaggaacttagcacaccgatgcgggttcataccccagggaatagctccacttcggttcaattcagcccttctataacaatagaaattcaaaggtcaccgtttctagccaacctcattcttctcgaatccaaagacctagatgtcattcttgggatggattggctgaccaagtttaagggggtcattgattgtgcgaatcgcacagtcaccctgaccaatgagaaaggagaaaccgtggtgtacaaatctctagtctcgccaaagaaaggagcctcgttgaatcagattgagacggaaatcccaatggacgccgaagagaagaacttgagaaaattggaggacatacccatagtctgcgagtatccagaggtgttccccgaagacctcaccaccatgccacccaagagggagattgaattccggattgatttggcaccaggaaccgctccaatctataagagaccgtacagaatggcggccaacgaattagcggaggtcaagaagcaagttgatgaacagctgcagaaagggtacatacgaccaagcacttcaccttggggcgctccggtcatttttgtggagaaaaaggataagacaaagaggatgtgcgtcgattatcgcgcacttaacgaggtcacaatcaagaataaatatcctttgccgcgaatcgacgatttatttgatcaactgaaaggagctaaagtgttctctaagatagacctgcgatcaggctaccaccagttgagaatccgggaagaggatattccgaagacggccttcaccactcggtacgggctatatgagtgcacggttatgtccttcggacttactaacgcacccgcattctttatgaatctgatgaacaaagtgttcatggaatttctggacaagtttgttgtggtattcatcgacgacattcttatctattcaaagtccgaggaagaacatgaacaacatctccgtctagtactcgagaagttgaaggagcaccagctatacgccaagttcagcaagtgtgacttctggttgacggaagttaaatttctgggccatgtcattacagctcagggtgtagcagttgatccatcgaacgtggagtcagttaccaagtggaccccaccgaagacagtgtcgcagattcgaagttttctaggactggctggttattaccgtcgtttcatcgaaaacttctcaagaatcgcccgacccatgactcagttgcttaagaaagacgagaagtttaaatggacagctgagtgcgacaagagctttgaggagctcaaaaggaaattagtatccgcaccggttttgatcctgcccgaccagacgaaagacttccaagtctattgcgatgcatcccgtcacggacttggatgtgtcctaatgcaagagggcagagtggttgcatatgcctcgcggcagttgcgtccacacgaaggaaattatccaactcatgacttggaattggcagcagtggtccatgctttgaagatctggaggcactatctgatcggcaaccgctgcgaagtatatacggaccataaaagtctgaaatacatcttcacccaaccagacctaaaccttcgacaacgaagatggttggaactaatcaaagactatgacatgagtattcactaccacccgggtaaagccaatgtggtggcagacgcattaagccggaaaagttactgcactgctctatgcatcgagggcatgtgtgaggaattgcgacaggagcttgaacatctcaacatgggaattgttgaacacgggttcgtagccgctctggaggcacggcctacgctcgtggatcaagttagagccgctcaagtaaatgatccggaaatagcagaactgaaaaagaacatgagagtcggaaaggctcgggatttccttgaggatgagcatggcacaatctggatgggagaaagattgtgtgtaccggacgacaaggaattgaagga

SEQ ID NO: 91534 - DNA, 1499 bp, Oryza sativa
agactcttttttatccattgagtcacatacgttgacggtgcaggccgacaggtcgaagagtaaaagcacccagtggaatctgcaatgtgcgtgggatgcattacatatgaaacacttagcaagttcgtacgggaatgaaatttggtatgtaggaagacagtaaaattgaactaactctgtgttgtacggcaacagtatgaacgtcttgtaatgctgcgccttcaggagatggacgagattgtcctctatttcttgtggatattggtcgagcattgcgacgtttactctccgagggtcgatgaatccagtatcgaaaaccctccgccgtcgggccctttgaatctccattctacaacgataaaagggagtattttattttatatagtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattggtccgtagttagaccggtgtcagtaataaattgttctatcgtcatttctttaccggtcaccaatggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcgatggagctgggggggccttgactttgaaggtgccggaagaggagcttgcggaggagtaggtgtaggagcccgaggaggagtcggtgcaggatcctgaggaggagtcggtgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcttgtgtctcgtagatgcgtctcgccgtctcctacagggtaatccagctcgaggtcctcgtatgcgccttcgaccaactcaacttcgaccttcgagtatcctgctggaa

SEQ ID NO: 91535 - DNA, 3621 bp, Oryza sativa
ggcgaattcgagctcggtacccctaaagatatctttagtcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgataattacttcgaaaaattatttttgtctgtaataaattaagtggataaatcgtaataagcaaatatatgacttataattaataaaaattccatatatatatatatacttagcatatatatgaatgatattattatattggtaaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactctgacgatttttcttttgcctgcgagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgaaaggaccatagtcaagttcccatatgtcctcgatggcaccgtaatacgtggcagttgttccatcgtgtcccatggcatcgacacgaacagcgctgttttggttcgtgctcttcatgtcttgggctcttgtgtagaatgtgtacccattgatctcatatcccaggaatgtcgcgatcgacccagacggtcccctcgccaggaaggcaagttgttggttgattgactcgttacccatgagatattgtcgtagccacgcggggaaagtatcaatgtgatgccgtgtaatccatgcatcggacataccgatgttcctagcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacagatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagatgtgtcatcaacacgtgacagtcatgagactttaggtttgtgaacttcttctccttcgtgcttattattcgcttgatattcgtggagtatccagacggatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcattacgtcgattgcgtggcgtacgtccaagaattcccaatatggtaactcccaaaatatagagttctttttccacatcgccgcgtgaccatcttcgctctctatatgctggcttccaggcccttttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactgtcacgtcctgataaattcatcccgaaataaaaatcattttctaaaaggaataatagaattaattaaaattcggaaagaaattggcaaacactaaaatacgtacaagaaaaattcgaatgtggcccggagaatttttgttaaattctccttggtctaaaaagagccctcaaattttacttgaattttcagagcaccggaaataattattaagcaacaaaaacaattatcaaagtttattaaaaagaaaaacctaaaaaataatcctcttctctttgggcca

SEQ ID NO: 91536 - DNA, 647 bp, Oryza sativa
atatgttgagagcttgcgctcttgattttggtggagcctgggacaaaagcttaccatatgcggaattctcgtacaacaacagctaccaggccagtctacagatggcaccgtttaaagctctatacggccggaagtgccgcacacctcttttctgggatcagacaggcgaacgtcaactgttcggaacagaagtattagcggaagcagaagagaaagtcagaatcatcagggagagattgagggttgctcagtctcgacagaagagctacgcggataaccgtcgaagggagctaacttttgaggtcggagactacgtgtatcttcgtgtcactccgctccggggagtacaccgtttccagacgaaaggcaagttggcaccacgcttcgtgggaccatacaaaattttggaacgaaggggagaagttgcttatcagctagaacttccatccaatatgatcggcatccatgacgtgttccacgtttcccagttaaagaagtgcttaagggtacctgaagagcaggctgattcggaacacatcgatatccaggaggacctgacatatgtggagaagccggttcgcatacttgataccagtgaaaggagaaccagaaacaaggtcacccggttttgccgagttcagtggagt

SEQ ID NO: 91537 - DNA, 6405 bp, Oryza sativa
ttgtttcgaaagggggtaatcgctactatatcatttttatagatgatttttctcatcatacttggatttatttcatgtctcatcgcaccgaggttttggctatttacaaatcatttgctcgcatggttcatactcattttgatacacccatcctaacgtttcgtgctgattcggctggtgagcacctttctcgtgagctgcgtagttttctttctgagtagggtacacttccacagctctcttgccctggtgctcatgcacagtatggtgtggtggaacgtaagcatcgtcatctccttgagactgctcgagctcttatgattgcttcttctgttcctcctcatttttgggctgaggctgtttccacagctacatacttgacaacatccaaccttcttctgctctttagggtaggcttcctcttgagcatctttgtggtcaacctcctgactactctaatttgcgtatgtttcggagttcttgctatgtgcttcttgcaccccgtgagcatacgaaattgactgctcagtctgttgagtgtgtgtttcttggctaaagtgcggaacatacgggttatcattattgggatcctgtagggcgtcggatgttgatttctcgggatgttacgtttgatgagtcttgtcctttcttttcgcgtcctagttccacatcttctcatgagacctctctctcattcctcacttgtcctgatgcccctatttgtactagcatccctctttcagtatcttcctctccagtggagcctcttccagtggacccttctaatgagactcttgcatcttcctatgtgcctcctcttactcaagtctatagtcgtcgccctcgtgttatggagccttatgttgatgcttctcctattgctcctccgagatacaatcttcgggatcgtaatttagttacgatttgtccagaggatcgctatggtcgctatgcttatgttgctactattctcgctgaacctagttctcatcaagatgttgatattcatcaagaatggcaacatgtgatggcagaagagcttgctgcacttgagcgtactggtacttgggatcttgtaccattgccatctcatgttcgtcctatcacttgtaaatggatctataaggtcaagactcgctctgatggaactcttgaacgctataaagttcatcttgtagcgcgtggttttcaacaagagcatggtcatcatgagacttttgctcctgtggctcacatgaccattgttcgaactcttcttgcagtagcctctgctcgtcattggaatatctcctagcttgatattaaaaatgcttttctcaatgaggaattgcatgaggaggtttacatgcgaccacccctaggatattcggttcctaagggtatggtttgtcgtcttcgccgctctctttatgggctcaagcaagctcctcgtgcttggtttcaacggtttccttctgtagtcagtgcagctggtttctcggccagtgcttatgatcctgcactttttgtccatacttcgcctcgtggtcgtaccattctttttctctatgttgatgatatgattatcactggcgataatgctgattttattgctttggttaaggcacgtctcaatgctcaattttctgatgtatgatcttggttctcttcgctattttctagggattgaggtttcctctacccctaagggtttttatctttcctaagcgaagtatattcaggatcttctggatagggcttctcttactgaccaacgcacggttgacactcctatggaacttaatcttcatctttctgccactactggtgtgccattagctgatcccactcgctatcgccatttcgtagggagtcttgtttatcttgctgtcactcgtcctgatatttcctatgctgtgcatattctgagtcagtttgtttatgctcccacccaacttcactatagtcatcttcttcgtgttcttcgttatcttcgtgggactatctctcgttgtcttttctttactcggtccacatctttacaacttcaagtgtattatgatgctgcatgggctagtgattcctttaatcgcaaatctctttctgcttattgtgtttttcttggtggttccctcattgcttggaagactaagaaacaaacaacagtttctcattctagtgcagaggctgagttacgagctatagcccagcagatgttacttggttacattggttacttgaggatcttggtgtttctgtgacttcctcgacctctttgttgtcggacagtacaggtgctaattagtattgctcatgatcctatcaagcatgagcttaataagcatattggtgtggatgcttcttacacacgcacctaggtacatgatcaggtgattgctcttcagtatgtgccttccgagttgcagatagctgatttctttaccaaggcacaaactagagctcaacacacgttctatctttccaaactcagtgttgttgattcaccataagtttgagagggggtgtgttagatgtatatttagattttatattcctttatttgtaaagggtttttctgcatatttgtgtattcttgtacctgtatatatttaggcgttttgccctgaggtgaatacaagtgttgttcataacaattcctaatgcatgaagatttcatcgcatttgactgcacccatccacgatgaaattgatttctctctaacaacttgataccctcgattcaaattaattgaactgctctgctcaactcctcttcatgtttgttgcctgctgcagatgcatatgtgatatgcaggtcccgctgcatatatttggccaccgagtcgcccggggcgcacaattaactgtatatgtcaacatctaatttcttctatttactcccttgctttgctttgctctttgtagatcgatcttccatcacacgtcatgaacaaactctcaaagctatcaaatgagggcagccattgttccgctgctaccgcaaacctgggcaagacgaggatgccagccgtgaagtcccatggagcagcgttgaatctccctgttgcatgcgtgcaccgtcgattttagatcagtggtgctgattgtatgacatgttaaattaactaggaaggtagcccgcgcattcgcgcggggatgtattgtacacagggttaaacttttcggtttagccgatttgattgggcatcagtgcatcaccgaaataccgaaatttctgaaattttgaaaacatagtttagttgaatttgaacaaatattaccaaaattcatgaaaagttaaaaaaattcggccaaaataatatcatatctgaggggtccgaaatgatcgaaatttctgaaatttccaaccttgatttgtacattgcgtttgaaatatatatatatatataaacagaatatcaattggttgacacctcccatgtttaaaagtacttttttatttttttatttgaataagacacatcaggtgaggcctccgctgttcttcaatattttgctttgataatttttccaagatatttgttaggttctaaaatatatcaaatttgatacatctatataaataattatctacaatctctttattatatataagaagttcgatttagtttgtttggaaaacgtgtctaacaaatcaactgtaaattagaagtaaggtgttttgttctttttttaacaaattctaaagaactatatttttaataaatatgttttatttgtaccatcaagtagttctccttttagtaggtttaagttgatgcgagttgttacatacttatatataaattaatagagacatgtcatatacctcgcttcgttgtgacctatactatctttttcaaaagaatatacctagttaacatgaatccaaaattttaaatttagtagtaacaaatataacttttcaaagaactatatactgcgaaccttagtgcggtttatatatgtaaaaatatgtggagaaactcataatgcaataatataggatagatgtaaggccattaatgtctaagcattttaaaattgttacgaaaatggaacatgcaatggttggtccaattttagtgaaatgtaagaaccaatttttttatgaacgtatcacgttttctcaaaatagtttaatttagtccctattgatattttctattacctgctttattttatattttatacagttcaaaatataggctttatggatctttaaatcattattctaattataaatacaataatatttagattagaaatcagatgagcttgaaatttatgcatttttttaatattttgattatttttggctgtataaacaggaagggatagagtggagaagggatgtgacgagtagtgtcgtgttgtgcgtatgttctgggggagggcgaagtggaggcgtggatttttctattttatctaaatgatttaagtgaaaccgttgatatattttttatcacattttttttattccaatttttaagacataacatattgcggcttaagacattcttaaatgtatatctattggttgaaaataatagatctacctatttaagtggaaactgatggtcagatgatttttcttccaatttgtaaagttttatttttatttaaggcgtaacatgtgacgccttaagtgcgttcagaggatgtacaatgatttacgataatatagtactcattttcattttgtattatggtttgtattttttctatttggttaccatgcaaaggaacggtgtctatagagtgaaatatgggtaacatggatattaaattatctatttaattataaataaaataaaaattcaaataagttaaaattatgattcaactttagaattataatcatttggctttctaattattgatctgtttttacttagttaaaaattaggagacaaaggaattaaatgagtgaggagaggaagagagagttgaagagaggagattatgcatgcatataattgtaataattcccgagttgtagtgttttagtttttattacttttttaactgaaaattaaaaaaaaatgatttattgatcgattaaaatctatagtttttacttctcttttccagtatattcatagtagatattaaaaatgcgaacactacaatctaataatctaataatactattttgacttattctaatgttataatgggggagtagttttttaaagcattcggtcattttactgttatccatatagatctaatttaattattccgaagtcatatatggtgataaaatatatatcattatctttctattattttataattgttcgaatggcacacaaaagtcagaaaatatagccctaaactgacatatttcttctcaaaatcgatattacagtggatatggatcttcaaatgtaaaataatctaaagacgtaagttcatcaaataatattagtagtgtgagtcagatgttatagttcttattttgttgcataagttttgctttctaactaacatattttgtaaacattactcatagtatattcattttactttcatgattgtagacctaatttaattattataaagttatgcatgatgataaaatctatattattgtcattattttatatgtttttataattgcttgaatggcacgcaaaagacagaaatataaaccaaaatgacattttttttcaaagctaaattgtagtgaaatatggtcttcaactgtaaattgagttataaataatctaaagatttacgctgatcagaaattagttgtatgattaagaagcttaattgtttaacacgatattattgcttatctaactaataaggcatgaacataggagaaggaataggtgggtggataaatgaattgaagtaagaggaggcgtacatacgtatattcgtttttgtaaaaaaaaattaacttatacatacaaagctctttggtaggcccgagtttaggaaaggaattttttcttgaaaattaatctaatgcttgtaaataatgggttcaccaaatttaatgaaaatatgttttgttattttagaattttaagaatttcactaatttattagagcatcagatgacaacttagaagcgtttggcgaattaggagcatttttggaagtttaatgggctttaagacatctaacctaatgttgtaaaacatcaattgagtccaccaatttaaatgaaaattgatggtgatatttatgtaaatttatagagtattatgtttcatctatttctatatgttactacgtgtaagtatatatatgtgttcttccggtgtttctctgatcatgtattacgtacgtacaggagtatgttctttccggtttatctgatcgtgctatactcacgtatgtactcgcatgtcttttttttgggtgaaacaatagcataaaaataggatcagaaaaaggaggaaaccc

SEQ ID NO: 91538 - DNA, 2284 bp, Oryza sativa
agagctcctagaaagtgtccaattagtatataggtatagaggtatgatagatagatagatactccctccgtcctaaaaaaaggcaaaccctggatttccgtgtccaactttgactgtccgtcttatatgaaatttttttataattcgtattttcgttgttgttagatgataaaacatgattaatattttatacgtgacttgtctttttaatttttttcatatttttttcaaataaaacgaacgatcaaacgttggacatggaaaccagggtttgtctttgttttggacggggggagtagatagatagatggattgtactggtgtcagaagacccatcttgaaaaaaaaattaatggctctgtaattttcagttctctagggctgtctttagatttaaagttaggatccaaacttcagtcatttttcatcacatcaacctgtcatacacacataatttttcagtcacatcatcttcaatttcaactaaaatctaaactttgaatccaactaaacacagcctaaacacagcctaggttctattctaattttcaggatgttacccgcacaacagggagggaagtagcgggcagatggaggcactgggcggcttgtccatctcgtcttgagccgtaggccttgaatgtataattgctttgattttctcctcctccggtcgccgatctgaggtcacctgcgagtgcgactggtctggctggtgtccccaccagttggaccctcagtgcctagttgcttaattaattacagcaattaatcttctattttttctcacctttgttggccggccgttccatatgtttattttatcgcgatgtttctttcctatgattcatttctgttttctttggcaatttttaaggaagagcgatctttgtctccaagcgtttctgaacatgtgccagcagcttccgttctcgggttgccaaacctcagatgccgtcatcattgcagctgctcgattagggaaggagattcaaatgggtttggttaggctgaggtgttaattaatcaactgaggctgcaagttgggttgagtgtagaagagtcaattgcgaaatgttgttccccatttcactcgttttatttttttaaaaaaaaattgatacacagggaacgttaccgataaatttctctaacaacaagtcaataagtccaaagataactgaaaccgtaaaaccattatgttccatagaaatctaaggtatatctatgggagataatagtacaagacctctaaaagaaatgattgatttctatcgattacttcgaaattagcttttcgggaaatttccaaacgaacaatttcaacgaatctttcaatttcttattttattatgttcaactttatgtattcctctatccgtagagtacattgaatgtacagaaaaggctataacatagtaatttcgagaaattcctacggaatgattattgtataggaatttcgaaagagaattagcatgaggtcttacattatgttttcttctttcaatgtcttgaattctattttttctgtgtgactatcaaacattagttttaaagtgttcctgtgttttcaaatcccctaggaatccaataaatatgatattctatttttatatttttcctattcccatgatttgataatcatgcgttcaaaagtgatcctgaacttgtaaaattattggcccatttttcttttctttaatcccattacaacacttgggtacgtccctagtaaaagttcgagcaattctgaaccaaaacaaatcgttagctagctagctagctaggatgggtgataaaatatgggtctctctctatgtgtgtgtgtgattttttttttaagaacgtgatgatgggtctcaactcccgcggtctcgcccgcatagggtgtggctaatgcgggagcgatcacccgcacgcccctaccccctatacgcgatcacccgcacgcccctaccccctatacgtacggatctcccccttcctccttccctcattctcttcctactacagtaaactataaaaaaatttaaaaaaagttgaaaaaaattatgtataaaaatactatatataaaaaatatttgaattcaaatttaaatttaaaacgtgtatataaacttttgaccagagccggtcctagggaggcgagcggtgcggtcgctctggcccccaaatcgcagggccccgcgccaaccccaccccccccccttcggcgcgcgcggcgcgactatgtggcgttagggcgaaagcgaacagacgccgaataccccactcgcgagat

SEQ ID NO: 91539 - DNA, 4581 bp, Oryza sativa
ggtgtaggtggctaccggccaggcgctgcacgggcaccccgccacccgctgcttgcttgcttgatggcttgatgcttgccgccggctgccctagcccctagagcactggatgtcttgacgaggactcgagaaggatgggccgaccgccgacgggggttagtgaatctgaatactgtatttgtctgatcagtgatcaatcaacaatcattctattaaggtgagtgtaacaccaatacatcgccatcgccaagtgaaaaattgaaatttttgtaacattgtgattttatttgttaacatgtaatctcatgtgttggtttttgctgtgtattgatgtatggtcctatgttaggttaatttaattgttccgataattggacaaaccgacgaaggcacaaatgtttgaagaaatatttgaggtaacatgtactataatgttttctatataaatattttttaataaaattttaatatttatacaataatttatatataaagtatatgtatatactaattatatgataagggcctctatatttagtttcgcaccggggccctaaaaagtcaggaccggccctgctttagacttataaattttcggtctataaactaatatttgaattcaaatttaaatttgaaacgggtatgtaaacttttgacttataaactttagatctataaactaatatttgaattcaaattcaaatttgaatcgggtatgtaaacttttgacttataaagtttgggtctaaaaactttaggtgtataaactttagatgcacagaaatactatatataaaaaatatttaaattttaaattcaaatttgaataggatataattcaaattcaaatttaaaatcagcacctataatattatgggtgccggttctacaccaaaaaccaacacctatatggcactataggtgccggttgtacacccagaaccgacacctatattattgtaaccaacacctataatattacaggtgccgattttttagccgaaccggcgtctattctcctcgctggcctatatgatgcaaactataggtgtcagtttggttaaataaccggcaccattgatatatgtgccggttttttcgcacggccgccacctgttgtattttaggatagttggtgggaggattttttgtgccaccaatgtccctcccaacaaaaaccgacaccaattaaccgttataggtgccagtttttcactatattggcgggaagtgtcttataggtgtcttttttagctaaccggtacctttgtggccgacactaatggttgtttttgtagtagtgagatttgtaaaaatactagtggaagtcacgggcttgttcactttgctaccatttttaaccttatcaagttttgacattgccaaattttggtaaggttgccaaaaccaaattttgatttactaaaatttgacaacaaactaagcttagccaaaatattggtaactttataaaaaaaatggtatggttgaagacgatgacatcaaagtgaataggccccacatcttgaagattaggaaaaactaaaatagattaagtaaaggtagccgttgatgtaacaatccatttgaccctgtaattaatcttatccttcccatttctatacacataaatcatttgtttgacccatttattttttatacgaggttatcaccacttcttgccgaagagaaaagttctacgaagctccaggtatatatactcatatatgtataaaaattaccacgcacgccatccaggattccataagcattgaccgctctgccgtgacgcttaattaggcttcgataagcattaattgacctttccttcaccgttggcgtttgtatcactctccacctagagccacctactcccttatggactatacagactatagtcaaaataaaccttactaaattagtaatattgctaagttttagcaggattctttatatatttatcaaagtttagtaaaaaaaataaatgtatgcatatctttgacaacttaaaagaaatatagtttaaaatggcatcaatctgaacaatcccttattgtattagtcatgcaggtggtgcatagcttgatgtgcaaagtactggatggcatcgacaaacaaccgatgcactcatttttcctagagcaagtataaggtgatgtaaatggtttgtacaagctagttgtggcatcatatttgtgtttacatgatgtagagagggagggatttagagaaaaaaagcgggctataaattgtaactagctataacacgagctccaataaactgagtatgtgagagataggtggattaagtattaatgatgcagtatagatgtataactaaatatgcatgaatatactattaggtcgttataactgatattttaatttttggagctgggagttcactgtattattaaacttgctcttaagcacatcttgagaaaaaagtcctagaagatttcgagcgcccttggatgccaccactggtctactgtcgtcacccaacagctgtgacgtgctctgttttctggtgcgttcgttaggagatgtgataagagtggaaaacttgctcgcttctctacgcgcatgattcccaaacggttaagcgatatgttttttattaaaatgccgcacttatccagtcgtgttcacctatagatcttgtcgttgctgtttctctctctgtcggtactacattattgccagccacattcatgctattatgactttcttcattaccaacctccaccatctatggacgaagacactattcattcttggtctagcctaactatgctcctgaaccactcatataatattgagacaatagaatatgaatataacaggaaaattctaatttatgtcaataaaatggttacctattcagaaatgatggataggatttgtatttatgggctaaaataagtttttttttaatttctagctaattttagttgtttttccatttacaatattaattttagcactatttgatcgattaaaaattattgtattaaaattattaaataattttgtcagggttatggataccacctacctaatagtagttgactaaatctcggaaggacccaccacataccatgtcctatatggaaacaacctgtggatataggaggagttccggataaggaaagataatcagagttctacatggaaacgacaaggactactcggattatatccatattggtttccctagttcaacttggacaaggggacacctatgggtataaatacaagcccccttaggaggagagtggggacgaggcaatcaacacccaacacaatagacatagaagcctacatacgccaagacacgtcgccggatatcgacttcagggataggcatggctagtcccctacggtgtctctagatactgtcaggagagacgaaagcactatctctgatctcgccaggcacggatttgaggaggaaggctaccctgttgtcgactacgagttatatcatcataccgccatgtcgacaacagttagataggctaccccaaatattatactggtgtgattatcatgaataagagcaataccggcttcggccaacaggatgtagggttattacctgacaattcaggggcccgaacctgtataaaaatccctgtcttcatctcttttacctcggtctcgcgtatatcctagtaccaatgatccccataccatgcaaataccgtagtcgagacatcaaacgtcgacaaatttgaattatcgtttgggccaaagttatttatagtttcatgttgttatttttattattatatttccttcagtcgagttgtgatatatgatttaggattttaatttaagcatatttctttcagtccagttgtgatatgtggttcaaaattttaatttttgtcgatgaatgttatttagattccgttgtaacgcacgggcattattctagtaagttaaataaatggataatttgatgtgttacccacttatttaatctatatataagtgataggtttgtgagatgacccaccgctccctctcttccgttaggccttgttcgtttaatccccatgagggaggggttggaagggatttattccacacctattgtggtatggaattattctctctcaatccctcaaatcctattcaattccctccagactccaaaccaaacaagaccttatagagataagacatgctagccccaaactcggaaccggatcctctgactttgcttgcaaagtcacaagcgtgcagttgggtttaaatccaccgttcgttgcatccaacggttctgccatgcactaccatgcgggctgcgacctaattcggcccaatagcacaaatgcacgatgatctattcctccagtcctccggcaagggcagcgccgctggcgccgtggcggctctttcctccgatgctggcgtatcgtgctcgttcccttttctgtcgcctccaccttcaccttcaccttcaccttctccttctacacatccacacacgcgcgcgtacatgtattgcatgaggcatatcaattccagcctcgtcttccaattgaccgtggtctcttggttaagcagctt

SEQ ID NO: 91540 - DNA, 839 bp, Oryza sativa
gtctacgtcttcccggccggcctgcttctttccccgccgattggtgcctccgctcctgcgcctacacggctggcctattatgccgccgctattgggcgtctacgacttcaccaccggcctgcctccgtcgccgccgattggtgcctccgcctacacggctggcctattatgccgccgctgttaggcgtctacgacttcaccgccggcctgcctccgtcgccgccgactggtgtcctcgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccaccggcctgcctccgtcgccgccgattggtgcctccgcctacacggctggcctattatgccgccgctgttgggcgtctacgacttcaccgccggcttgcctccgtcgccgccgagtggtgcctccgcctacacggctggcctattatgccgctgctgttgggcgtctacgtcttcaccgccggcctgcctccgtcgccgccgagtggatcctccgcctacacggctggcctattatgccgccgctgttgggcgtctacgacttcaccgccggcctgcctccgtcgccgccgagtggtgcctccgcctacatggctggcctattatgccgccgctgttgggcgtctacgacttcaccgccggcctgcctccgtcgccgccgagtggtgcctccgcctacacggctggcctattatgccgccgctgttgggcgtctacgtcttcaccgccggcctgcctccg

SEQ ID NO: 91541 - DNA, 2191 bp, Oryza sativa
cgtctgtcatgatctgtgctcctgaatgatagcgtggcttgccagaaaacctctaggtcgataggtcgactgctctgatacaggatgttatgtttcttgatacaaagaagacaagggaaatgcgaacagagaaacgacttgcattggaagaagaagcagttggaagcggtgtggaaaaaatctaattattgtattttgtttgttttctgatctattacatcgaacctttcatggggtatatataaaagtacacaggggatagagaatataagtaagagtagatttatctctaggactctatcttatctctaggattatatctctaggaaatatcttacctctatatttgtatttgactgttatctctaaccgacatagctatcttttcaacaagcggtaaaattttggattggggagatagagcccgtgtttagcttgtacaagttcagcgagattgctaaggggcgatcgatcgcccctagcgatcgcccatagcacgccccccctctccacctccacgtggtttcttttttagcactgcattatttttctattttagtaaatttatacacctaaagtttgtacacctcagtttacacatctaaagtttagagacccaaagtttataaatcaaaagtttatatatccgtacagtatttctatacatctaaagtttataaacctaaagtttatagacccaaaatttataagtcaaaagtttacatacccaattcaaatttaaatttgaattatatccgattcaaatttgaatttgaattcaaatattttttatatatagtatttctatacatctaaagtttatacacctaaagtttatagacccaaaatttataagtcaaaagtttacatacccgattcaaatttaaattcgaattcaaatattagttcataagtcaaaagtttacacacccgttttaaatttgaatttgaattcaaattttttttatatatagtatttatatgcataattttttttaactttatgttttttatttaaatttatggtgtagtaggaaaagaagaaggggaataggaaagaagaaagtagtgtatagggggattggggtgatatgagcgatcacccgcccattagccgcccccaagttcagagagaaccagtcagttgcctggtagcagaagaaaaacacgattttctattctgcagtcacctgcaaaattcgtaattggtcagtcgatttctttgtctatccgattcgcttcatgatacgtgcatgttatatatgcttttaggttagtttattgtatctttgaaaaagtacgaattacctccttaactgtcgcagtcgtccgaattatcccctgaaccacaaaactggacattctttacccctaactatacaaaccggacgaattacccacctcgatccaatccgcagtggttttggtctacgtggcgtacacgtggcagtccagtcagcattctatgcataaaaaatatgagacccacctgtcatatcctcttccactattcccccctctctcttcctcttttctctctcttctatgtgggacccacctgccatatcctcttccacctgtcatgtctcattcttcccctctctctcacacacccacacggcggcaggcggggaacacaaagtggcggcggcgcgcgcgaacgcacgcgggcgggggccgaaggtggcggcgaggacggcagcacgcacggcgcggggcgtgcacgcatgcaaacaggggcggcggcggcgaggacggcggcacgcacgcggccaaacgctcgaggcgtcgacctccctctgccccgcgcgctcttgtcctcctcgacgcgccgccccatcaacgccttcaacaagagggtgggcgacctccggcacgtcgccgtagacgcgttcgcgcggcttaaggcgcggtgggcgtgcctccagaatcgcacggaggtgaagctccaagacctccccgtcgtgcttggcacctgatgcgtcgtccacaacatctgcgagacacgcggcgaggagctcgagccggtgctccaatatgagctcatcgatgacgagacctcgccggagacccacgtcggctctgaggccgtcaagcgcgacagggacaacatcgcccaaaacctcctccaccgcggcttcgcctgaacccaccttcttatgaagatcgattcgataacaccaccgccgct

SEQ ID NO: 91542 - DNA, 9133 bp, Oryza sativa
tttaattatctaagctaagcaaaggtaatttcctatctgttgctaagggcaccgacccctgctggtctgccagcgtggttccggctatagctctatgatgtatccaacgtggaggattactaggatgggattcagggctgtcaccacctgccgcctacctctgacaaatccgtgggatacacaacaaacaaaggtaatctctaacctagacaccatgtctaagttattaattactactctaatacttgcgcaggaacttccttctctatccggagtcctagtactagagcacttagtataaatactaaacaacgaacctgcaaagatgtaaatcttacttaaacaaagtaattaaataacataagaaaggaacacgaatgcttactttatagaagtttccccgaacccggagcagagtgtaccaacagctccggtactcctccagaattcctcctaggaagttacactcgtcgaggtagaagtcggatgagcgccaaacttctaggcactcctccagagcttcccctcactctctaccttattctaatgtacaaaagatacaatagagcctcttgtaattcagcccaaagttgtgtgttggaaatgagagtgagctcctccttttataggcaggtatgacggttacagcctatgcgaaatgaccaaactaccccggaaccgccattaggatgcgatcagggccatccacgcaaaatttgacgatcaacgaccaccaaaacggttcggccgaactggagcttcggccgaacccgggacggctccgttcggcccgtttttcgtcgtggacactaattttgaggccctcagcccattggcatgatagttgggcccatttggagttgtttaattgacttatggggcctccaatccgtgtaaatgtgtcctgaatgcgcggaggtgcagtttgtcgcttgacggatgtgttttcttctcaaaatacctgcatacacatatttcaccaacactagtggaaatgattagtaataatgcctaccactacgttggataccatgttttatttcattatacgaaggtattgacggtcagatattatgatttaaggaccgtcaacaaccaccatgcagtaacactaataaaatatagttaaaatatagtcatgacggatctagttttgtagagttctttttttaaagcattacgatgcaaacggttcaaaaatataatagatggtgtgagagatatcattgtttaaagatgagaattcaaaagatatcacttgcacttacatttactggttcaaagtgggtggtaggtcatgtacctgtgtgtttggttgttaccacatgttttgcagtaacgctattaagaaattgcagtaacatgcactgttactgtaaaaattatagttgttactgcacacatacaataacgtcatgatggaatggtagtaactcacaataaaaagtagtaacaataatgaagtcgaagtcaggaggcaacccagcaaatggatcctcgagctcttcctctggctcatcgggctcggcttcaaaacccggaggggaaggagggatatcgatgtggtggtcctcattatatcgcgccttgaggtatttgacgtcgcgagccgttttcttcgccgaattccgcaatcggcggttattttttgcctccgcggagcaaagaccaaaaagactccacaaaatacggaataagggagacggctcacaatgagccacagaggaagggcgcttagaagtagaaggcggctgagtggaagaagaggggatgtccctagctgctgaggagcctacctaggaagagcggggggccttgacaaggcccaagtgaagctgggaatgagacacatcatgatgaaactgaagctgagtgacagtctcgatcatccacataatgtgaggaacatagaccaactccttcctgtactaaatggaggccatgcagatttcctcccacacaaagtgataaacatgaaagcgatgaggagggggatcgaacctgacaagcacggtcctggagaggtggttaatgctgctagcatcaccatccttaggcacaaaggaccggtgaaacatccggttcaagtaggcaaagtacggtttgagactgtcgaccttacccaacaccacattaggatcattaggaatgtaaagagggagtaaatcagcgttggcaggaattggaagattatgcagatcaggaaggttgagcaagtcatgcaaatcaaaaccccaaatctcagccaatcgcggataggagacagaaaaccaggatccttgggtcatccattgcatggcatgatatggatcaaagaaaacggtggcatagaattgagcgatgacttcgttgcaccaatcctgctgtaaagtcatgaaagagcgaattcccatgcactcacaattggcaatcacaaagttgagcaccggatcatcatgcgcctgcagctactcccagttgatccattgcatgggattggtgggatgagctttggacttgatcacagactcataaaagtcttgttgaaagagagtccaaaaccgcgaatccgtggcggtgcggcgaagggggcgcggatcctcatctcagcgaggagcaacaacttcagtcttccgcctccaatcatacacttggcgaatcaccgccggatccctctcgggggtatgaatgtgaagaggagcaatagggacattgggttggtgcggcggcgtttgcggttgacgagaggagccctcaccatcaccaccaccaccaagagcttgagtggaccgccgaggagggagagtgccgcctcgagccacccacgcatactgaggagccgcatcctctctcccggaccaatcactgtccgaatcatcatgagaggatggggtgggagagcggtccctttggcgcttggatttgcgggaagttcgcttgcggggaggcatccttcaaacaagatatagacaagggatcagtgaatggaagccaaagaagcaagaaccaagtaagtgaaggcaagaatcgtgcaaaaccgaggtgataggggtcggccagagattttcggatatatccgaaaacaattttccgaaccctatcatccggatgccgcacaaatccgccaacaaaaacttgggaaaatgaatctgcaggtcctagtgcactaggggaagaactccaccaaaggaaatcgcaagataagacttgaggaatcgaaggatttgattttagggtggatacctcaagaacgcgaagaacacttgaagaacgcggtgaagatcaacaatgtaggtcccaagtagtgccccaaatgcgctcccacgaggatggagaggaggggagccgcgggaggtcgtcggagaggaggtggtcaccggtggggagcggaggagggagtcaagcccgtggtgaaaaagagttgaaaggagggagaaaggagtccacggggtgaaatataaagaccccgatattttcagatatttccgaaaattttcggataagtccgaaaggatccagtaggttgcgcacgcttctgtagattttcggatatatccgaagattttttggaatgtccgaaaaatcctgggatagctttgaatgaagagcgacaggacaggagattttcggaatgtccgaaaatttttcggaaagtccgaaaattcctggaaaacagtttttcaaagggatttcgctgggaattttgaagaaacagttttgcaaactttctaaaggaattttgcaggggactagcaccgggaattttttttgtcaaaaacacttttcacaaggagttttgaaaggattaaaggaatggagggatggtcgagcactaaaggctccatttgaagttgcggctagcacacacaagcatacaaaacaatagccacaaatcaaatgatctatccgagggatcaaaagagagggaattaccatgagataagataattcaccctcgagagagggaatgtgtgaatctatttcaaattgtgttaggaacaaaattcattgaaaaatgagatccccatacacatagattcaagatctccacaaatatgactagtgtccatccatgagttgaatgtccattttgtcacaaagtggtatgcaaacctattctagcaaacaaacatgcatgcaatagatcaagccacattccgagaatccaagatatttagttcaattctcaactcacaaaacctagcttcatctaaaagcttggtaaagatatccgccaattgtttgtcggttctcacatgttggatgtctatgtcgtctcttgttgaatggtttctcaagaaatgatggcgaatatctatgtgtttggttcgggaatgttggacggggttattggctatcttaatggcgctctcattgtcacataggagtgtgattttggacacatttaggccatagtctctcaaggtttgcttcatccaaagaagttgaacacaacaactccccgccgaaatgtattccgcttcggcggtggatagggcgacagatttttgcttcttggaagaccaagaaacaagagacctacccaagaattggcaagtacccgatgtgcttttcctatccactttgcacccggcataatccgcatcggcatagccaatgagatcaaacctcgctcccttagtataccaaagaccagattaggtgtgtgcaccaaatatctaagaattctcttcacggccacaaggtaacactctttcggagcggcttgaaatctggcacacatgcacacactaagcataatatcgggcctagatgcacaaaggtaaaggagtgagccaatgatggaacggtataccttttggtcgacgtctttaccttgctcgttgaggtcgaggtggccatttgatggcatgggagtgtggattagcttggcattctccatcccaaatttcttgagcatgtccttcaaatactttgtttggcaaatgaaggttccttccttgagttgcttgatttgaaggccaaggaagaacttcaattcacctatcatggacatctcaaaacgtttggtcatcatcctactaaactcttcactaaaagacttgttagtacaaccaaatataatgtcatcgacatatatttggcacacaaaaatatcattatcatgtcttttagtaaaaagagttgaatcggctttcccgatttcaaagccgtttttcacaagaaaattttgaagacactcataccaagctctaggggcttgcttaagcccgtagagtgccttgtggagcttgtacacgtggttgggatacttcggattctcgaagcccggtggttgctccacgtataccaactcgttgataggcccggcccgttgaggaaggcttaaaaatgaggttagtagcaaaagcaagcaatatgcgaatcaactcaagtctagctaccggcgcaaaagtttcaccgaaatctaatccttcgatttgggtgaacccttgcgccactaaccttgccttgttccttattatgaccccggtctcgtcttgcttgttgcggaagatccacttcgttccaatcacattttgccgaggtcgctccatcaaagtccacacttcattctgggtgaaattgttcaactcctcttgctgcgccatcacccaatccggatgattaagagtttcttccacccttagaggctcaagagaagacaaaaacgagtaatgctcacaaaaatttgcaatacgagaacgagtggatactcccttgttgatggctcctaagatgttgtcggtggggtgatctctttggatactttggtggattcttgggtgagctagattgatcggtgagggtggcacttgctcgccatcttcaccttgatccacgtttgaagtagagggatcgtcggcttgggttgatgtagttggctccacttgtgtggaggaagaggccccttgttgtggctccctaggacgtacgtccccaagagccaacctcttgattgcttcactcgggtcctcctcttcacctaacacatgtgagtcaacttgctctacttgagagccattagtttcgtcaaatgtcacatcacgcgcgatctcaacaatgccggaggttttgttgaaaacggggtatgcgcattcatttgacccatacccaagcaagaacccctcatccactttaggggcaaacttagaggatctagccttcttattaagaatgtaacacttactaccgaaaacacgaaagtaagagacatttggtttgttactggtaagaagctcatagggagtcttcttaagaagatggtgaagatatagtcggttgatggcgtggcatgcggtgttgacggcttcggcccaaaagcggtccgatgtcttgtattcatccaacattgtcctcgccatctcgatgagagtcctattcttcctctcggctactccattttgttgaggtgagtatggggccgagaactcatgcttgatgccttcttcatcaaggaaactctatatgcacgtgttcttgaactccttgctgttgtcgcttcgaatgttcttgatcttgaggttgaactcgttttgtgctcttcttgcaaacttcttgaagatggcttgtgtctcactcttgtcatgcaagaagaacacccacgtgaagcgtgaaaagtcatcaacaataacaagaccatatttgttacctctaatgcttagataagcaattggcccaaagaggtccatgtgaagaagctccaatggtctcgtagtggtcatcacattcttgaccgggtgatgcgctccaatttgtttcccgacttgacacgcgctacacaccctatctttctcaaattgaacatttgttagtccaaggatgtgatcgtgctttagaagcttgtgaagattcttcataccaatatgggctagccttcgatgccaaagccaccccgtgttggatttcgccactaagcatgtctcatgtttggctttacttcaggaaaaatccacaaggtaaagctttcccttgagaacacccttaaagactaccgatgaatcatttcttctatagacggtcacatcaacatcggtaaaaagacaattctaacccatgaaacataattgagaaacagacaaaatattgtagtttaaagattttaccaagagaacgttggcaatagaaagatcattagagattgcaatcttacccaatcccataacctttccctttccatcgtccctgaagactatgttatcttgtgaagtgccatttggatcaagagttgaaaatattgattcttctccggtcatgtgattggtgcatctgctatcaattactcaacttcttccaccggagacatattcctacaagagatcaatttctagttttaggtacccatacttgcttgggtcctctcatgttagtaacaagtgccttaggcacccaaagcactctcttgatagaaatattcttgctccttgggcctacatacttagcaacaacacgaccactagcattcttcctaagaacataagatgcattaaaagaacaatgtgaagcataatcattaggaatgatacttttggccttaacaaagttgctaagaccttggggcctcttgatcatcacactcttgtccacctttccttttggtggaggaacatacccaagaccctcatggttgaagttgttcctttaatagcctaagtactcctttagggtcttactacccatatgacacttaagtaggccattgtgaaggagtcccataagcttctcattttgcttttgcaaagcactcaatgaaatagagttggtagtacaaccttgaatatcaacatctttgcatctcacacatggttcattacttgggacaattttggaacaagatggctcgctagggagagagacactattttttaaagtttcgaacttctcttcaagagagaggtaagctttgtccaagccatccactctctcttgaagttgagcgttcgccacctcaagattagcatgagactctttggtttgcttgtaaagccgtaccaaagcctcatttttctctctctccttagtaagctcactcttgagttcatgagaccgctctttctcacgaatgagcaaagcctcttgcctctcaagagtagcatattggttctcaattctcccaagcaactcactcaagtgtcatagggattccttagttatggatttgaacaattcgtcatccataacctcatcctcaacctcatcctcctcatcactaacaagatcaacattaaatgacttgagaggagaaggtaccttaggctcctttgccatgaggcaaatgggagcatcctcatcacttgagtagtcgaagagtctcggtggtgatgaaggcttgacagcgaacgtggcgactccttctttatcacttgagcttgactcagagtcggagccaaagatcataccaaggtgagcttggtcataatgttcctgcttgctatgcttgtgcttctccttcttctcacccttcttcttatcttccttgatgtgggaaccatccttgaggtgggggcaatccgcaatgaagtgcctgggctctttgcacacgtagcacactcttgtggagtgtcttccacttgacttgttgtagtgcttggaagaacctcccttgaagaggccgcttcgcctcatgaacttgccgaatttcttgacgaagagagtcatctctttatcatcgatctccgccttgctcttgctcttgcggttctcttcttcttcttcctttgccttcaatgccaagtcttccttcttgatgcttgcggttgagctttggttgatgtattggatgacatccttggactcttgcacgaacatgtcatgggcaaggatacgtccgagcaaatcatgaggtgtgagagtcttgtagtccggacgctcacgaatgatggtcaccaaggtagagttccttggagtgattgcccgaaccatcttcttgaccacaacctcatcggtattgtccttggagccaagtcccttgatctcattgatgatcttgctcaaccggtcatacatgttgcttgggctctcaccatccaacatcacaaacctctcaaattgccccttgaggatctccaccttggactcatgaacactatccgtgccttcatacatgttccgaagcgtgtcccaaatcactttggcactctcaatgccatccaca

SEQ ID NO: 91543 - DNA, 4152 bp, Oryza sativa
cgaccgtcaatattactaaaacaggagagaactagtgatgcttgcaatgcataaatatgttagaacaataatattccactattattaggtctactaacctttttgcagagaatgacaataaagtgaaggagaatcaacatcaacaccaacgataaatcaatcagacgatgtcgaggaccagacttatgtatgaatgggcaaagaactcagaattgacacgatgaattgggccaaaattcacaagtctgaggagtggagcaatagaggaggccaccagccgaaattgggctggattgggccagccccaggttcggccgaacctggtggttcggctgaaccaatcccggcgccgttgggtccaggttttggcttggacgtccaggattgcatcccaatgacggttggagggcacttcggacaattccccttccacaaccgtcatacctacctctatataaggagctcactctcttcacttcaacacacacctcaagcaagagctctctcattcctctcaagtttagtttagtagtatctagctggtggaatagaattagaataggaatcaggagtccggaagtcttcggaagagttcgggtatggctctagcagctttcctttcctcttttgtcagatttgtaattttattagaatactcttctatatacatttatggtattgaaatactttctgagtatacgagtacctactttacattatgttcttgttatactgaatatactgctagcttatctgggagatgctttggtgcgggtataatgtttgcttatgcaattactctatgtcatgatgatgatattagagtagtatctggtagtttagacgtggtgtctagattacgggatatcattatttggggttatatattgcggatgagaggtgggccgctgatggtgacaactcagtacgggtattcctccgcgcctatatatatcctaagttaattttctggggagggtattcctcagtatttagccctggttggatggtcatgacgggctgtcgtaaggaactcggcagtcaggggtggcttctcgaagtaccaggagggcatcgaatagagggtattagctagtatatcagttaactagaatgtatgtatactatgtatattagaagtattggaatagattctctttctcttttctttccacctagtttagattatttattatgaggatgagtagaaatgcttgtgtgtcactctacccatggattatcttaacccctgcttagactatgattatcacaagtaatatataatttattagttgagttctctctacatgattttcccacgggataaaataaatacgatacccttggaatactctcgggtgaaatgctacaatggtatatccgtgcgcttgcggatgaactctgtaaccataatataccagaagtatttctgcgccattactgggaattatatttctagtaatgtcgttaagaaataccaataagcatttcttataataaaataaaacatgatatccaacatagtggtaggtattattactaatcatttgcactagtgttggtgaaatatgcgtatgcaggtattttgagaagaaaacacatccgtcaagcgacaaactgcacctccgcgcattcaggacacatttacacggattggaggccccataagtcaattaaacaaatccaaatgggcccaactatcatgccaatgggctgagggcctcaaaattagtgtccacgatgaaaaacgggccgaacggagccatcccgggagttcggccgaaccgttttggtggccattgatcatcaaattttgcgtggacggccctgatcacatcctaatggcggttctggggtagtttggtcatttcgcataggctgtaatcgtcatacctgcctataaaaggaggagctcactctcatttccaacacacaactttgagctgaattacaagaggctctattgtatcttttatacattagaataaggtagagagtgaggggaagctctggaggagtgcccggaagtttggcgctcatccgacttctacctcaacgagtgtagcttcgtaggaggaattctggaggagtaccggagctgtcggtacactctgctccaggttcggagaacttcttctataaagtaagcattcgtgtttctttcttatgttatttaattactttgtctaagtaagatatatttgcatctttgtgggttcattgtttagtatttatactaagtgctctagtactaggactccggatagagaaggaagttcctgcgcaagtattagagtagtaattaataacttagacgtggtgtctaggttagagattacctttgtttgttgtgtatcccacagatttgtcagaggtagtcggtaggtggtgacagccctgaattctgtcccagaaatcctccacgttcggatgcatcatagagctatagccggaaccacgctggtagaccagcagaggtcggtgcccgaagcaacagataggaaattaccttcaacttagcttaggtaattaaaatacatagaaagttctctgtagcctgcctacctatagttgttgtccttggatcgtcttagccttaggtagattacacacgttccctgagttcgatatcctttaggggtcacccgaaggtgaagtgctacagcggtattccgtgggtttccggacttatctgtggttgtaagaaataccaacaaaaactttcctgtagggattagtccacagaagatatatatccaatgtccatgaacatattaactctgaaattcattagtcaaactaaactttatgtccaatttgattaaagtagactattttgacctaagcaccatgcttaatttaaaaagcctatagatgtcttgcacgaacacccaaaatagagcatatgcaaatagacaaaagaaacataaccatgtaggatcaagtctcattcaaatgaagataagtatgagtaaaaggaatggtgaaccttgtcttatctttcacatacctaagtgtacttgccgccagcatgatgtatattttgaaatctcgggggcagtggcatggtcacatatgattgtcgatttctcctccatctccatgcagattgtaccggaggaaggtgctttgaccatgcaaactcaggcaagtagtttagtcatgcacacacctcgggtgcaagaaccttgtgccttgaattcgtgatccgttggcacattgctgtagagacgtaggatacatctctttttggaaaatgtgcaagtaccaactagggtggagcatcaaacgcctaaaaaaaagaaagggggcaactcatctttcttgtatgcacgtaagtgctgcgggagcgagaagttgtgcatagctaggagtggataaaggctaagccaaggcggcacatgagctcgagagagcgactaggtgtagccaggcagcacgattgctactagcgaggtgtatagccatatttcaaagatacgcacataatgcggtctttgatccaaatatagctcgtcagctctcttgctcttttcttctcctcccattttttcttcttttcttctgtctctcttttctcctctttctttttttataatccttttttttctagcaagctagtactaacaccaacttcaaactaagatggccctagttgatggaactcgtcatgaaaagctcgtcgaccttcctccccccctgccccacacacacacacttggacttttgtgtcgcaagacatcaaaaaccaagtgtgtgatgtcggattctcctatagagtgtgttccaataccaatggtcaccaaagtgtacagttgatgtagctaccgtgttcttaagcatcgcatgaccctcgttcttaatctcaacctaaaatggttagcgaccaagaatacctgaaggtgcatattatcctaaaaactggttcttgcttttattagaaagaaaacttaccatagtaatctgggctatctcccggcagtgctttgtttatggtcacaagcttgaccatggggacatcgctctgcaagattagtgccacaaatacgagatttgcagtatttatgataaatataagcatctacaaccattcttctaaatatgttagaaatgaaaaccggaagatggttgtggtcctcgcaaagcgacgtg

SEQ ID NO: 91544 - DNA, 512 bp, Oryza sativa
taataaattgttctatcgtcatttctttaccggtcaccaacggctcgatctcctggtttggttgctctccaagctgagggactggtttggactttccagaagatgctttcttcagcgttcgctcatagtccgatagcttaatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttctttgttgcccttgtgtgggcaggcggtggagttgggggggcccttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagac

SEQ ID NO: 91545 - DNA, 2100 bp, Oryza sativa
  unsure (1)..(2100): unsure at all n locations
ttacttcaaatggcataccaaaattacctttcttttgttctaagttacttctataatatatgtaaattacttttagactttactgaatctacttttatatgtttaagaagtagcttagtgaaatctaaaagtaatttagacatatcataaaagtaatttatgatttttcatcaaaatataattatatgagatcttgttgtaaagatttaattgttaagaacacaacagtgtaatcggattacaaatcagatgagtaatttaagagaaaattttatttaaagcatagatgataagaatatttttcctacttatttaatggactagtactgtaaaagacatgcacgttgacataaaaggttggtacaaatccatgccaacctagccttaaactctggcttagatttctctcacactgcaagtggaccgtcgctgattagtactaaaccgagagcgctctcggtttagattttacgtaattttaaccattatatctctatcttaaaaaataaatctggtgtccccactttaaaaaaaattgccgtgtttgctccaacgaaaaaaaatcaggcagggtatttacgttctattctttttttccggtggcgtaaatacgttactacgtattatttgtttttctccctttcttggcaaaaacaaacagtactactacgcatatcgtacgtacacgtaccgacgtacgggagtttaggaggaattgttaatcgatataaaatcacatgttaccgatttaagtgaaaatctattattagatttttttctcataatttttaatatttcttttagtttagagatatgacacgtggtgacctaagatcgtttacacgagtgccatgtgacgacttaagagcatttatatcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacaaatcatagctttaaactccatgtagggcttggtatcggttccgtcatttggtccgcggcaaatggagagaaagacttaggcggaagttcaaatttcctgtgagtaaacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatacgcatgtgtacacattttctataatgtaaatatattttggtcatatatatatctatatacatatgcatnggcataacatatatatgtataaatacatatatattatgcatgtttatacatataatataatataatatatatatatacatatatatatgtatgcatatatatgtattgaaacatatatatgcatggtttatatatatatatatatatatatatatatatat

SEQ ID NO: 91546 - DNA, 1120 bp, Oryza sativa
ccccccttaggatagtgtatgacattagtagtgacgacgaaccatgttcgtcgaatcgttccttagggagtggggattgctttgggggtggagacgtaatttatttgtaagctaggctgtaaagccggtgctatttgtacttgtatcatgttgtatgattgcatcctccgattatttttcgaagttaataaagatgtgttttatttccttttcgctgtttttcgcattgtcacctttcgtgctttcgttaggtcgaactgtgtcggcccctttgcgtatactagcgaaataggtatgctgacttttcagctttcgtctttcgttttcggtctgtggtattccgagctgaaggaagcgcttatgttttcacatggatcgagtgtaacggtgttggttagttatttcccgaaacaagctatcgcggtttcaacgcttggtgagcaatgcttcggccgatttgtttcgcccccccccggcgttttcgctgatcaggcgtttgccttggggtttttccacgaattatcattcacacaagtgcgaaagacacaaggcttttatactggttcgggcctccaaggtggataatagccctacatccagtttctttttccttttttcattttcctctttttttttgtatttttgtgccgaaaggcttacataatgagagatgccggaaggcctatacaatagtatgtacattttttacaagttggcgatttgggtgccacccgttctagacatagaaacgcttaagggaagcagcgttccaggaatggtcgaactctttgccttccagcgttgctaggcgaaaggagcctatcctggacctatgtttgatgaggtatggcccttcctacttcaattcaagcttcccgaccgccaccgggttcgccttcttccttaggacgagatggctaagcaatagctctgtcggtcgaacctttttgttgtaagttgccgaagtgcttgtggcgtatttgcgcatgtgttccaatgcttcgactctcaccccctctaggagttcgagcgacacctcgcgcccatcttcgcctccagagaacatcaccttggtgaattagcccctagctcagttggggtcattgcttcatcgccatag

SEQ ID NO: 91547 - DNA, 538 bp, Oryza sativa
acttagtacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgtagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgctgagatcat

SEQ ID NO: 91548 - DNA, 705 bp, Oryza sativa
gtcccacacggggacacttccttcttccacacagtttaagatctttgaccagttgtcttagaaacacatcgatgtcgttaccagggtgcttggggccttgaataataatcggtatcattatgtacttcctcttcatgcatagccaagggggaaggttgtagatacacatcgtaacgggccaagtgctatggccgttgctcatctctccaaaaggattcatgccatccgtacttaaaccaaccgtatgtttcgtgcgtcctttccaaagtctttaaattttctgtcgatgtttcgccactgcgaaccatctgcggggtgtctcagcatcccgtcctgttgacgttcttcagcgtgccaacacatcattctagcattccccttgttcctgaacaaacgccttagccgtggtattatagggaaataccacatcaccttagcaggaattctcttcttcgttagctgcctgtcaacctcacctagatcatctcgtctaatcttgtatcgtagtgctttacaaacagggcatgcttctaggttctcgtactcctcaccgtgatataggatacaatcattcggacatgcgtgaatcttctgaacttccagtcctagaggacagactatcttcttagcctcatacgttgtctcgggcaatttgtttccctccggaagaatgttctgggtaccgagctcgaattcgccctatag

SEQ ID NO: 91549 - DNA, 664 bp, Oryza sativa
atgctcaaatcaatgataatggacacgtgtgataatgatatgttaatgagagaacaacatctgtattaccgtggcaagatgcagtcataccagttcactgctggaatctcatacaaaggtagtggcctgacgatttccaagaccttaagaacacttgtactcattgatgtctcaaataacgctttccatggtagaatccctagaagcattggggaacttgtgttgcttcgtgctctcaacatgtctcataatgctcttacgggtccaatcccagttcagtttgctaacttgaaacaacttgaattgttagacctctcgtcaaatgagctttctggggaaatcctttgaaaattagcacctcgagaaatgtttttgccacctttgaaatcgagccatagatatttgatcctctttgtcttgactgcttgagatttggtgtctgctctagaattacaattctagcaatatgttgaagtaatcttgtgagagtacttctatagacaatagactaaaagattatttttgttattgacccttgatcacctcagaaacaatcagaaagagaaggtcctgaaactatatcaaattaagcatctttgcctctgcaattctctagcttggaaagaaaacaatcgtgggtaccgagctcgaattcgccctatag

SEQ ID NO: 91550 - DNA, 966 bp, Oryza sativa
atgaatttatcaggacgtgacacttgtcgaatggggttcgccaatcttctgggtcttcgcccagctttgcctggtcgattgccatgatgtccaggctttctgtgggcacacttggtgcgtacaagacttcaaaaaagatgcctgatgaatgcgggcctccacagactgcagattttgccagggtatctgcttcctcattctggcctctaggtaagtgttcgaccgttatgccggtgaagcacttttccatagaccgaactgcttccagatatctcttcattccttcttcttttgcctcgaaggacttgtcaacatgacttgccaccagcttggagtccgttcggatgagcaagcgccgaaccccaaatgctttcgcctttcttaggcctaatagtacagcttcgtattctgccatgttgttggtcgtgtcgaactacagccttgcggcataccgaatcagcacaccccctggcgaagtgagtactgccgcggcgcctgccccgttgtgcgaccatgagccgtcggagtacatttacccaaggctattcgacgggctcgggttcaggggcgaatgccagtgtccattcggccacgaagtcagctaggacttgggactttatggcggtgcgggcgacaaaatgtaggtcgaagggggataattccgccgcccacttgctgagtcggccagtgatttctttgccccgtagcacttcgcccaaaggatactgcgatggcacagtaactttgcgggcctgaaagtagtgcttaagctttcgcgaagccatcactagggcgtaggcaatcttctccatttcgatgtatcttgtcttcgccccttgtaacgcttcggagatgaaatacactggtttctggcctggctccgtctcttgaacgagagctgcactgaccgccaccggcgaagctgctagataaagcagcagttcgcttctcggcgctggactgacc

SEQ ID NO: 91551 - DNA, 668 bp, Oryza sativa
agtatccagacggtacctttatgctctccaagcattcaaacatactttccttctctgccttgctaagagtgtagttggctggactcaagtaatggcttcctttctcctttggttccgggtgaaggtcgccgcgttgttccatatgcttcagatcattacgtgcttccagtgtatctttcgactttccgtatacacttaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttggaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaac

SEQ ID NO: 91552 - DNA, 1300 bp, Oryza sativa
ccatctacgagtccgcgatcgaagccgctcacggcgatgaaaacaccaaggcaaaggtaatccatctcgctttagatggcatcacccgttcttggtatttcaatttaccagctaatagcatttactcatgggagcaattccccgacatctttgtccctaactttcgaggcacttatgaggagccgaagatgcagcagcatctactcggcattcgccagaggccgggggaatcaataagagaatacatgcgtcgtttctcgcaagcccgatgccaagttcaagatataaccgaagcgtctgtcatcaacgccgcttcggccgggctgctcggaggtgaactcacaaggaaaatcaccaacaaggagccgcagacactcgagcacctgcttcgcatcatcgacgggtacgcaagaggcgaagaggattccaagcgacggcaagcaatctaagccgagtacgataaagcctccatcaccacagcccaagcccaagtacaagcacaggtcgccgaaccggctcctctcaccgttcgccaacctcagctggcaaaccaaggacagccgccaaggccaagtcaagctcccatgacttggaggaaattcagaaatgaccgcacgggcaaggctgtgatggctatcgaagaggtccaagccctccgcaaggagttcgacgctcagcaagcagtcagcaatcagcagcctgttcgcaagaaggtcaggaaggacctctattgcgcattccacgggcgatcctcgcacactaccgagtaatgctgaaacatccggcagcgtggcaacgctcaagacccaaggctgcagcaaggggcagctgtcgaagcacctcgcgaagccgcccaagaacaagcacccccagtcgaacagcgccaggacatccagctcggagtaattcaagtgattacaagggccgatccaccagttcaacagtcgaagcggcagaagaagatgcagctgcgaacggtgcacaacatcaccgcggcaggccaaggggctctgaggtacttgaactagcatatctcttttgggccagaagacgccgaaggggtgctattcccacatcaagaccccttggtgatctcggtcgaagtagctggcttcgaagttcggcgaattttggttgacgggggaagctcgaccgatgtcatctttgctgaagcatatgccaaaatggggttgccaaccctagccctcacctaggcaccagcctcgcttcgtggttttggcggtagagaagttcaagttttgggccaagtacaactggtggtagctttcggcacaagtga

SEQ ID NO: 91553 - DNA, 1001 bp, Oryza sativa
ggtgatcaagatgcaagtcgatgacgccgatcccacgaatttttccagctagggggtgatctaggcgaagaggaagccaagaatatcctggaggtgctcaagaagaacattgacatcttcacctggagccccgacgaagtgggaggtgtttcgacgaacttcatcatgcatcatctggcggtcaagccggatgccaagccaagggaacagaagctgcacaaaatgtccaccgatcaccaagaggcagcaaagcccgaagtgtagaagctgctcaaggctggggtgatctaagagatcgaccacccagagtggttggcgaacccatttttggtgaggaagtcaaatggcaagtggcgcatgtgcattgacttcacagacctcaacaaggtgtgcccgaaagatgatttccccctgccgcggatcgaccagcttgtcgactcgacagctgactgcgaactcatgagctttttggatgcgtactccggctatcaccggatccacatgaatccggccgacatcccaagacagccttcatcacgctgttcgacacgttctgccacctcagaatgcctttcagcctgaggaacgctggagcaacattcgccaggttggtgtataaggtcgtttacaaacagttggggcgaaatgtggaggcctatgttgacgatatcatcgtaacaagccgcaaggctttcgaccatgcgtctgacttgtaggagaccttcgacaacttgcgtgcggctggtatgaaacaaaaccctgagaagtgtgttttcggtgttcgcgcgggcaagctgttgggctttcttgtttctgaaaggggtatcgaggcgaaccccgagaaaatcgatgccattcagcaaatgaagcctctgtcgagcgtacgcgaagtacaaaagctcacaggctgaattgcggcgcttagtcgatttctctcgaaggcagccgaaagaggtttgcccttcttcgagacgggtaccgagctcgaattcgccctatag

SEQ ID NO: 91554 - DNA, 897 bp, Oryza sativa
cacgtactttctcctcactattgttccctccttgtgatcgctgcatgagtaaggggtgtcttcatttgataggaggatgctagggtcaatcgtcaccgtgaaagggggttgcccatcaaactgatcgtaatcctcgtcagtcttgtcctctactccgacaatttttcttttgcctgggagaaccacatggcgcttcggctcgtcaggccctttgcccttctttcctttgctagacatgtccttcacgtaaaaaacttgtgttacatcattggcaaggacaaaaggttcgtccgagtatccaaccttgttaaggtcaaccgttgtcatcccactgtcatcaatcgttacgcctccaccagtcaacctaacccattggcaccggaacagagggaccttgagaggtccatagtcaagttcccatatctccttgatgacaccgtaatacgtgccagttgtaccatcgtgtcccatggcatcgatacgaacagcactattctggttcgtgctcttcatgtcttgggctcttgtgtagaatgtgtacccattgatctaatatccctggaatgtcgcgatcgagccagatggacccttcgccaggaaggccagttgttggttaatcgtctcgttacccatgagatgttgtcgcagccacgcggggaaagtatcaatgtgatgccgtgtaatccatgcatcggagttaccgatgtttctggcgcgaactagagccaagtgctcctcgatgtaaggagccaccaatgaagattattgtaaaaccgtgaaatgggctttacggaataaattgttgtctaccgtcataattgctttccttccgagagtcccctttccccgtagtctcccttcatggcgtgattcaggtaccccgattgtgcgaaggtc

SEQ ID NO: 91555 - DNA, 1772 bp, Oryza sativa
tagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgtagcgaagaagcttgagggtcggcacatcataacggaagtggaagaagatggacgtcctagtgccccgtccgaagccgccaagaactatgtacgtcacagcggttgggttgtgcgggataacgtgcctgtcagtacggtgtactggcgaagaacaagggcacgctgagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaaaaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtgctatgctcacggtggaacgctcaacccagctgatggctcactggtcttcggcgatcagatacgagaggctgcgcgacgactaacagatgcagtggaagcctcctctcaaggcacgttccgaccagacagagatagggacgagctgacactcgccctgcagactccagagcattcaagacgaacacgagggaaaggggtgattccttggaagattgtttcaaggaggacatcaacacatacaggagtcggatgaagagcaagagagataccgaggcgaagattgcagacctagagttccgggtatcgagctacgaactcaacatgcaaaaggaagtggcaaggaaggttgatgaacgcatggccgcacatcggtcccatgatccccagctgaccattccttctgcaatggtgagcccgtcaggaaacagtagcagctgcgcctcaacggggcaggtaggatcacagagcatggacgccatgcaaacacaggacaaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagtaggatactcgaaggtcgaagttgagttggtcgaaggcgcgtacgaggacctcgagctggattaccctggaggagacggggagacgcatctacgagacacatgccatgccattattctatggcgcaggcggtacatcatcctccctgggcgacaagcggcgtctcgtgcaccatctcctctggctccg

SEQ ID NO: 91556 - DNA, 543 bp, Oryza sativa
cttcgataaattctatgcaaaattcaatgacctcctctgtgccataacccttggcgatgcttgcctctggacgagcacggttacgaacatacttcttcagaacgcccatgtacctctcgaaaggaaacatgttgtgtaggtacatacgcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgatattgttgcccggacattgtctggaaggataccccttattacaactggtagcagttgtgtcatcaacacgtgacagtcatgagactttaggtttgtgaacttcttctcctttgtgcttattattcgcttgatattcgtggagtatccagacggtacctttatgctctccaagcattcaaacatactttccttctctgccttgctaagagtgt

SEQ ID NO: 91557 - DNA, 2286 bp, Oryza sativa
ctcccggtgatcaccggattcgagcagctcaccgaactggtttatcttgatctctccgacaccaacatagcgggcgaggtgccaggtagcatcggccgccttacgaacctggtctacctcgacctctccaccagtttctatatcgtcgaatacaacgatgacgagcaggtgacattcgactcagactcagtttggcagctctcagcgccaaacatggagaccttgattgaaaaccacagcaacctggaggagctccatatgggaatggtggatctgtccggcaatggagaacgatggtgtgacaacatagccaaatatacaccaaagcttcaggttctaagtttaccttattgctcactgtcaggtcccatctgtgcatcattctctgccttgcaagcactcactatgatcgagcttcactataatcacttgtcaggttcagtgccagagttcttggctggcttctccaatctcactgttcttcagctatccaaaaacaagtttcaaggatcgtttcctcccatcatcttccagcacaagaagttgagaacgatcaacctctccaagaatcctggcatatctggtaatctgccaaatttctcacaggacactagcttggagaatctgttcctcaataacacaaacttcacaggtacgattcctggttccatcatcaatctcatatctgttaagaagttagaccttggtgcaagtggcttctctggatcactgccctcttcgttaggcagtctcaaatacttggatatgctacaactgtctggattacagctagtaggaaccattccgtcgtggatctcaaatctaacttctctcaccgttctccggatctctaactgtggattgtctggaccagtgccttcttcaataggaaacttaagggaattgaccacattagcattgtacaactgcaacttttcagggacggttcatccacagatcttaaatttgacgcggctacaaactctcctgctccattcgaacaattttgctggcacggtggatctcacctcattctcaaaactgaaaaacctaactttcctgaatctctcaaacaataaactacttgtggtagaaggaaaaaatagttcatcactggtattgttccccaaactacaattactaagtttagcatcttgcagcatgacaaccttcccaaatatcttgagagaccttcctgacatcactagccttgacctttccaataaccaaatccagggagctatacctcagtgggcatggaaaacatggaaaggcttgcagtttatcgtcctgaacatatctcacaataactttacgagcctcggatctgatccttttctgcctctttatgtggaatacttcgatctcagtttcaacagcattgaagggcccatacctataccacaagaaggtagtagcacgttagattactcaagcaaccagttctcatccatgcctcttcgttactcgacttaccttggtgaaactgtgactttcaaggcgtccaaaaacaaactttctgggaatgttccaccgttgatctgcacccctgctaggaaactgcaactcatcgatctatcttataataacttgagtggctcaatcccatcttgtttattggagagtttcagcgaactacaagtattaagtctgaaagcaaataaatttgttggaaaattacctgatattatcaaggaaggttgtgcacttgaggcattggacttaagtgacaattcgattgaagggaagataccccgatctctagtttcctgcagaaacttggagatcctcgacattggaagcaatcagatcagtgactctttcccatgttggcttagtcaacttcctaaacttcaggtccttgtcctcaaatctaataagttgactggtcaagtaatggacccttcatacacaggacgtcaaatcagctgtgaatttccagcactcagaattgctgatatggcatcaaataacttaaatggaatgctgatggaaggatggtttaagatgctcaagtccatgatggccaggtctgataatgacacgttagtcatggaaaatcaatattaccatgggcagacataccagtttaccgctacagttacatacaaagggaatgacaggacaatttccaagatcttgagaagccttgtgctaatcgatgtctccggtaacgcattccatggtgccatcccagataccattggtgaacttgttctgcttcgtgggcttaacctgtcacacaatgcccttacagggccaattccatcacagttttgcaggtta

SEQ ID NO: 91558 - DNA, 1873 bp, Oryza sativa
gcttcagatcataagtgcttttccagtgtatctttcgacttttccatatacacctaggaagccaagaaggtttacacaaaggttcttagtgaggtgcatcacgtcgattgcgtggcggacgtccaagaattcccaatagggtaactcccaaaatatggagttttttttccacatcgccgcgtgaccatcttcgctctctataggctggctgctaggtccctttccaaacactactttaagatctttaaccatagcaaacactgttttcccgctgcgatgtttaggctttgtacggtggtccgctgtatgttcaaagtgcttgcctttcttccgtaccgagtggtttgctgtaaggaatcgacgatgacctatgtacacaaccttcctacagtgcttaagatacatactttctgtttcatccatacagcgagtgcaagccttgtaccccttgttggactgcccggataggttgctaagtgtaggccaatcgttgatggttacgaacagcagcgctcataggttaaactcctcctgtttgtcctcgtcccacacggggacaccttccttcttccacaacagtttaagatctttgaccagttgtcttagaaacacatcgatgtcgttaccaggttgcttggggccttgaataataatcggtatcattatgtacttcctcttcatgcatagccagggggggaggttgtagatacacatcgtaacgggccaagtgctatgaccgctgctcatctctccaaaaggattcatgccatccgtactcaaaccaaaccgtatgtttcgtgtgtcctttccaaattctttaaattttctgtcgatgtttcgccactgcgaaccatcgggggggtgtctcagcatcccgtcctgttgacgctcttcagcgtgccatcgcaacattctagcattccccttgttcctgaacaaacgccttagccgtggtattatagggaaataccacatcaacttagcaggaattctcttctttgttagctgcccgtcaacttctcctggatcatcctgtctaatcttgtatcgtagtgctttacaaacagggcatgcttctaggttctcgtactcctcaccgcgatataggatacaatcattcggacatgcgtgaatcttatgaacttccagtcctaacgggcagactatcttcttagcctcatacgttgtctcgggcaatttgtttccccccggaagaatgttcttgacgagtttcaataaatcgccaaatgccttgtcactaacaccattttttgccttccattgcaagaactccagagtggtatccaactttttgtgcccctgctcgtaacctgggtacaacgacgttctgtggtcctctaacatcttgtccaatttatgggcccccttttcactttcgcagtcctccttggcatcctgcatcatctgaccaagatcatccgcaacatcgttataatctgcatctatgtcctcctcgcccgtttgatttccttcaaatctagcgtactaagcaaagtctgaaatattgtcgtcttccacttcatcttcttccatttcaaccccttgctctccgtgggatgtccaacaattatagcttggcatgaaccccgactcaaacaagtagaaatgaatagtcctgaatgcagaatactccttctgattcttacacttgttgcatggacaacaaataaaacccctttgcttgttagcttcggccactctcaaaaaatagtgcacgccatcaataaactctttggaccgccggtcagcgtacatccattgccgatccatctacatgagtcaaaaaaaccgtacacaaataattattcttacaataatgacagtcagacaataattataagatatctttatt

SEQ ID NO: 91559 - DNA, 526 bp, Oryza sativa
aaattcagtgatgctagttccttggggatctctccagaaagctcattgaaagagaggtccaatgactcaagttgatctaacctgcaaaactgtgatggaattggccctgtaagggcattgtgtgacaggttaagcccacgaagcagaacaagttctccaatggtatctgggatggcaccatggaatgcgttaccggagacatcgattagcacaaggcttctcaagatcttggaaattgtcctgtcattccctttgtatgtaactgtagcggtaaactggtatgtctgcccatggtaatattgattttccatgactaacgtgtcattatcagacctggccatcatggacttgagcatcttaaaccatccttccatcagcattccatttaagttatttgatgccatatcagcaattctgagtgctggaaattcacagctgatttgacgtcctgtgtatgaagggtccattacttgaccagtcaacttattagatttgaggacaaggacctgggggatcctctagagtc

SEQ ID NO: 91560 - DNA, 614 bp, Oryza sativa
atgggagaaccgcttcgcgccgtagacgaggaagaaaggcgtttccccggttgctcggctggtgtagttcggtttgcccagagcaccgctggcaactcctcgatccatgaatcgccgtgcttcttgagtatgttgaaggtcttggttttaagacctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggtactccaaaccgggccgtgatgcccttaatgaatttaagtgcggagtgcttatcgatcttgacgaccggataagcctcgggccacttagtgaacttgtcgatcgcgacatacagatactcaaacccgcctggggcccgcctaaacggtcccaggatatcgagcccccagacagcaaatggccacgaaagtggtatggtctgcaggacctgggccggctgatggatttgcttggcgtggaattgacacgctttacatcgccggaccaggtcgaccgcatcattgggagctgtcggccaatagaaacc

SEQ ID NO: 91561 - DNA, 685 bp, Oryza sativa
gttaccagtaagaaaaaaaatgctcaatcccacaagatgactatcaatggttgggttttaatcagggattgataccacaagaagaaccatgctgcagtagcatagctaaaccacaacagaaaccagggagtaaaaagcagacgagtaataagggttttgcaaaacgcaaatggcaacagcatagattatgtatggataacgctttcactcatgataccaatcagagaaaaacacccagaattcatgtttcatttttacccaatatttgcaatacagaatccctaaactcaaggatctgtagcttcctcacctagcctggtgcgatgccattagaattgtagaaatatgtcttaggtctcatcaaaattccaggttattaaatcatcacagcaaagcaaaatcgtatatcagttctttcctcatcacaaatcttccagggctactgagcaacttttgtgttgcccctttgcctcgccaggcgaacacatgcttcaaatctcttgactgcctcagcacacttgagtgggtcctgtgcattgctcacgtaacactggcggcagtttgacctctcctcagtgcatggcgtggggttttggtacggcagcttgaactccttgtcacgcaggtcttttgatttcttgatgagttcatcacgcatcccagcatgctgcttatccagcttctc

SEQ ID NO: 91562 - DNA, 1733 bp, Oryza sativa
  unsure (1)..(1733): unsure at all n locations
cagcaatatgtaatggggttgctccaccagctctgatattcggatgtgcacctgcctgtgtagcagattatatgatcggttttttatacgaatcatagatgtaaggggtgtagaagcaacagagcatcaaacaaaaccaagaacagaaacagcatatgacaaaagtaagaacagacactttgatcctcttatcaaaatcttttgatataggtagcacacatataagaacgtgacatactatgatttgccatgcagcaatctaatcaataacacgaaaaatgagcttgtctgaacccccattgcacaagccagattactaaacaaggaaatatagcatacagaaaccatatgaccaatgaatggcatcgaagtggataatatcctaaagtaaaagcaacagattttggtattttactcttgaaattagatttgtgtacctgaattagaatatccaagcatgggagggaacccgctgcaacagcagacaacaaaggcgtaataccatcatcgttttcagtatttggctgccaagcaataactagcttcagtaaaaaagttaaggaaaggccacatgaacggctgattgaaaggtggttgagtgctaaacaaagagaagcctgtccaattcaaagaaacataatagatacagatgctattagaaccaaaagatagcatcttcttaacaatagcaagcttgagaacccttggtggttactgttaaagtgtcagttgctactagtatttgacaatattaaaaggcgacatattaaaatttcagcataatgaagatttctgaacagaatgactagaagctcaggttcgttaaatcagtgagatatgaagtgagataggagatagtggatttattgaggagcaaccttagcatcgtgttgaagcaaaagtttgactgcctcttgctgtccatgaccagcagcccatatgaggggtgtgccggcatcgctttctgattcaacatcaacccccttggagagaaatagtttcataaggtccaggttccctgcagatgcaaacaaaaaaaaaaggagagtggtgttggacgcatttatagaggcgttggcacaatcaaaatgggagaaaaaagaaaagagtatagaccatcaatccatggaaagaatgaagtgaaatggcaaatagatgatgaattttacctatgccggcagcatggtgcaatggcgtggctccgagggaagaagcaacggaaggatctgctccatggtgaagcagataggttacagtttgnagatgggcttggcgcgtagcatggatgagtggagtttcacctggtggagtggatgtaaactgatggatgagagattgtgaagaaatcagatgagagtaagagatagtgatagttagtagtaccatcgtcgtccttggggtcgacggggagggcgaggtcggagatgaggaagtgacagacgtgggtgcggccctcgcgggcggcgaagtgcagggcggtgcgcttgttggcgtccttgacggcagcagcgacggcggcgacgcccttgccctcctcgtcgagcgccgcagcgagctctgcaatggcgcatgaggagaggagatgagaagaaacgcaaggaaagcaaaggagagagagaggaaggcatgggggcacctactcttgagggagtcgagatcaccggcacgagccgcttcgaggaaagcttgcaccttgctccgagctgcagccaatgaattcgaagcgacctcag

SEQ ID NO: 91563 - DNA, 3517 bp, Oryza sativa
tgtttctggccaaagcaaaaatacaaacaaaaggtcatagggtgatactcatgggtttcctctagacagagaagccagaaaagttactttaagccctttgccaaaagcatgttaaaaaaacagatactgctaactagactagcacagttctctatccaatattaaagatacctaccaaacaaataggctgtgccttgccaagtctgtgagcagggagaggaaaggagtgtacaagttcgactaaataccttgccctaacttcaaaactgcagccgttataaatatgctcaaaacctgcttaaatactccaacgtcgaatatatcacttggtgtgccaccattccaggcaataataatcatggcctgtattaaaatataagactaagaaatatgttgaaaaagaagcaatggcaagtactccaaaaaaagggataaatgtatatgaacggtcaaccaacctgtaaggataatatcaagaagatccacattctgtcgaaactacgaaatatgtgccagaatgaacggatctcgacaaaattaatctttcccatccaatggacattacctgcggatctgttctcctgcattcgcgaccaaacgagaaatgggtacccagaggattaatactccaagcaagtatttctttttcttggcattacattgaaggacaaggctggaaatgtaatccattccaattatctaagaaacgaaggcaataatgtacaagccacggataagcataagaacttaaaagacaatgcatcaaaactgtgcatgtgttggtgggtgtgtgggaggggggatccaaccaagaaataatgctacatcacctaaaaaacagaacaagcagtagcagcgagcatctgatcagaatattctatttatgaataactgggcttttataaattgtaatagtgcatcacaagccactactaacacttagatatgaaatatgcgcaagatatatctgtattatcaaagaacctactccattaagacgactagggtaagcatcttcaggagttttgaaaaaatcagcatctgctctcataggccatcctagccgaaaacaatccactgacctgcaatacagtaacaattccatgactttctttaaaaaaaaatcttgggagcataggatggtaaaagcgacaactaaaatctgataattgcttaccaaaaatactcatttaaatcatcatagttcctccaatgtgagtgttttgactttatggtcttgctccgttcagcttcctgtaaaatttcataagggcactaactgatcaacctgaaaataaaaggaaaataggaaatagtaacatatttgatacacaagtgaatataccttctctataactttgtaaattggagtcactactttcatcaggaaggcctcttcatcaccaccatacgctggtttaacattttcaccagtcattggactcacgtttccagccaacatgccatagagttcaaaagccatctgttaagatggaaaagcatcattaccatcaagatgatctcaccagaacaaaaacttatacatgcagagtctcatactaatacaaaaacatgccccaacgattatccctacaaactactcttctttctccataacatacatgatactataataacgcaaagtacatttcattggcatggtataaataacaaacctatcctatgccttatatttcccaccgtttatggacagttagacacgaggaattaaatttaagatttcataagctcaaaataaaattgcaagtatttctaattcaacaatatattatgaatcccatcagttttttttctttggtgtgtgtgtgtgtgcgcacgcgcacaaggacatagaactgcaggcacctatatttaggttcgtctgaatcctttgaaacatattcttgattcctcatactacttcttgtgttaacaaaacaaccagtcctccatatcacaatagtgggccacaaacaaggtgaaagggcatcaaagtacagaagagaccaagcggatatgaattctcctaagctactacaggttttgttagaatcaatggaattcctcacaaaaatgatctgagatgttcattattcactatcaaattcctaaaccagttatcaggtacaacccacaaatggagaacagtcaaaccaaagatatgagaaacctcaaatctatatcatgggaaagagcaatatcctctctgttgcaggttttttttttttacttacccattggtcgtacatgggttatccttcaaaagcctggtttactggacctggtggttgcgggcttgcggcgttgcggggcagttggagagggtggtcaaggagttttttacccaaggtcatgggtggcgatcttagtcttaggaatgaatattgacaaccattaattttcctggtgatccattatgttttttctttgggtgggtgtgtgtgtctgagttggttgtgtgcatcttagctacgtagaggctgggagtgttgtcatgacaattgtatcacctcaatgtaatttattgagttcaataaagcttccattatctaaaaaaagatcatggtaaagaacaagattatcttacatgatggtagatgtagcaaagacactctggcatgaacctcaagttagccgcctcaccccaaattagcaaatagagacccatgtagagaagcttacgctgctgaacttcctgctggatagttggcaacctgcagatcaattggccgaatcattttgagagaaggtagaataggaagaaaggttgagaccataatatcagtttcaaatggcataagagcaagaccaaaactataaaccaagtttgttcaaggaagttaaaacaatgaccagcaaatgacaagtattggcatctctgggaaaatcagtgcatgtggtccctataaatcatcccatttacttgacttcactgaagcactgaacctaccataaactgcttttgcggccaaggtacttgcaccacttcttataattcttaaatagcttcttcattacagcatctagagctctgtcgtccaactggaaaacaggattccaagaaaatatatcaataaaacatcaagtcactagtgtgcgagtgatgcgagagggtgggaaaaaactcggtcactcccggaacaaaagtgaaaaataagcacctttgcttgttgctcagtcttaggagactgccttatgtgcacatttgcaagtaacagtattagatgttctctttggttggacacattatctttctgtaaagaaagagactcacagttagactatgcacatttccagggcaaagtacatgttgtgatgtcaacatggagagtttcaccaggaagtggataactacctgaaacccaaacatggcctgaagccaatcaagaaggtctttgccagtcttcttttcatcaggcttcttttcatgttccttgggccacggcaggcctctaatattccttagcgcattaacagctgcttgaatctgtgtagtttatgaggaacacaatgggaa

SEQ ID NO: 91564 - DNA, 1724 bp, Oryza sativa
tgatgcgagagggtgggaaaaaactcggtcactcccggaacaaaagtgaaaaataagcacctttgcttgttgctcagtcttaggagactgccttatgtgcacatttgcaagtaacagtattagatgttctctttggttggacacattatctttctgtaaagaaagagagtcacagttagataatgcacatttccagggcaaagtacatgttgtgatgtcaacaggagagtttcaccaggaagtggatatttacctgaaacccaaacatggcttgaagccaatcaagaaggtctttgccagtcttcttttcatcaggcttcttttcatgttccttgggccacggcaggcctctaatattcattagcgcattaacagctgcttgaatctgtgtagtttatgaggaacacaatgggaaacatttacaaaggcttgatttggtaaaaggatagtattatttttaaaatggtgttgatttgggatagatggaaaccttggatattgcataataggttgataagtactctcaggatcgagtggcagaatattgtaaggaacatagagctttttcttttcctcaactttgttgtgtgtatccagaattgcataacggtcacaggaagagtgcattcgacagagaagaggagaagttgcagttagcaaagaatgcatggaacaataagctgataaaagaagaaggcgagcataacaaaaaggaagtaaaatcaagtaccgcttgatcgacttcaacagattgggaaacattgacggctttcaagacctcgaacaagacagcagcagtttggtatgccttagtgagcagagcactggacaagcagaagaaagacattgctgttagtaaaggagcagagttgtgtccaaaaataaaaaagagatggtgcgaaacggaagagaggaagggtggaagcaaccaaccggtcagccttgtcggcagcattttgaagtgcctggatgtacttcttgtagtattcacggtagaaacgttgcatctctcgagcgtcactctggtgaacccttcccttcaatgttggatcattttcctgaggaatggaatggaaaaaaaaaagaagaaaggaggtagcgcattacagatgaattgttggtagtggtgaacaaatacgggttgtactacataagtagtagaaagaaagggatcgggcaaggaagaaatagataaagagattaccctttcaagcctctgcagaagcgcggttttgaattgacgaacaccacggccattggaggtggggtcgaggcgatgagccttctcgaaagcatagaaacggcctgcaatgcaatgatgaatggagtagtagctagtagttgagtaactagtccagtaaggaaggtaaggaaggaagaagagcattgaattgaatggaacatacataggtaggcgacgcgtgggttggtggcctcgacctcgttggcgacacggaggatgggggcgatctcgacgagcgaggaggggacgacctcactgtcgaagatggactcgcccaagttgccgacggtctgggtgcggagcagcctcctcccggctgcccccgccggcgagggaaagggcgaggccgcgaaggaaaagtcgggcctcctggcgccgccgggcgccgccatcggaatctcaaatcaaatcaaatctcctcctctgcaacacctagatatcgagcaaaaggaaagaagagaaaatccgtcaaaaaggaaaa

SEQ ID NO: 91565 - DNA, 1169 bp, Oryza sativa
gttaaaccttgagcatggattttttttgtcataaaatatattctaaatagaaccaaaattgtgtgaaaacattttgaactggtatttgtaacttgtctagtttttggtcaaaatctacaacgtttgactttttaaatcaaaatatgccttatagaaatcaacgaggagatacagcattacaattaacatgtggtaatgaggcataccagatctgaccaacgattagggtcccgcatgatgaatggaaatatttctgctggttgcatagtttccgagagcaagaaatgatttacagcatcctcgaaacgcaagtcgaaaaacaacaagaatccaagttgtgcatgcacaaaggaaatcatgtcatttgagatttccccatcggcctcgaactcttgtaacaaagaaatagcttctgcataactctttcttcgtagtagtgccttgatctgttccaccgctgatactttacggtagcaaaatacctggccaagccaataaatgtgtccataagtacagtgtgtgatacaaaatcgacatgataaaatggcgctgcacatttatgagagaatccattgtcagggtttcacttgagcatacaaaatcattgtcttgtcattggaaattgtaattattgagtattactaacaaacacagaacgcagctcagtagctaagcaatccggtagagcagattggaaattttgagtcaagttgcaccgatggatgagttgacatacctacgttaccttataagccgtagcaatcacaactacgtcgctgccaattccggcatcctcgctcgctacaattagtccacctgtaccaggccttgcaaaaggaatagcctgcaaatgtgcgccgttctttcttctgtagacatctaccttggagtccccggcaacaacaacataggggtacacctccgctatacaatccggcgtggtgttaaagacgaagctgctttcaacgggatgccccgatcggtccacgacgaccccgacattgtcgacgagcagcatgacctcgtcgcccccggacaggggcttcaccctgggtggcctggaggactcagggagcgtgaatatatcgcaccttgggcgttcgtggtggagaagagcgagtagcccgaggcagtgccgacgaagacggagttcccgacccaagcgagcg

SEQ ID NO: 91566 - DNA, 1280 bp, Oryza sativa
aggagactttgacaagggcaacgtatgtcttcattatttactttctttataatctactcctatgttgcacttgttcctctgtttcatctgacaaactctattggaaaaagtcacatagtgtaacattactcacaacactgaatgagctcatgtgtttgtttctatctatcaccattgagccaactatttctccaaaaaaaaaaaagtttgatttgttttatcaatgttagcgctttatgctgttttggatagaaagctgacctatatatgtgttttggatcattatacaactttgtgttatgcacttcagtgcttgccctatggtgttttagatcattatactgctttgcatcatgtacattatgagtatgaattggtagtttgtgatcagcataatgtgtatgcagtgattattgacttcatggctagattacaaggagattagcaccaaatcctttttctttaaattgatggcctaaattaaatcatgcagctgcctggtttcatgaattatgaatttttgacctagcctacatcaaatcattcagctttcaacttctgcatgtggataaagtaggtttcaaaaaatgaatatttcagggtactggagggaaaagcatatatggccggaccttcaaagacgagaacttcaaatgtacgtctgacaaatgacctaatctgatcgttctttctgcttcttatcttgtggttgtgctgattatatgtcttgtaatgtttgtagtggttcatactggacctggagtggtcagcatggccaatgctgggccaaacaccaatggcagccagttcttcatctgcactgtcaaggtaacactgtactgatatgttcactgtgtactagtgtcgaaactcactcaaaattacattgcgctgactgctacctgcgaatgcagacaccttggttggatgggaggcacgtcgtgtttgggcaggttattgaaggcatggacatcgttaagatgatcgaatcgcaggagactgacagaggggaccgcccgaagaagaaggtggtcatcagtgagtgtggggagcttccagtggtctaataggtgccagagggctaatcttcttcccccggagactttgctgtttttggtttcatagtaagctgtgaacttatcgcatgttctccgcgcagtcagagatcatgctgagttgaggccaagatttctaagttgagaagaatcctctattgttcggctggaataaaacgttcttacctgtcgagggtcaggaaataatgttgtggttcatgaaag

SEQ ID NO: 91567 - DNA, 2084 bp, Oryza sativa
aagggatatcaaattagagtagcacttgctgtgacatcacacaactgcatgcctcaattagaatgcatgggatatactccgtatataggtcctctgtctgtaaactctctgctctctttctcaaaactctatactaaattatataccagcacatcatctacataacagagtaaagaatacatgtatgtatattgatacaattatatatgagtttctatgccagaaccaccgcttgcttccatggcactgaaaagtattgagctctacattttgccacaggtaagatgaagaatgcagcgctggcgtcaagggtgcaactgccgtcaaaataaaaactctgaaaacaagccaagccacaacttccattttccaccggcttcttcttggcaaattcaagttggatcatcgcagacaaacctactacagccacaggcagctcaatccaaagcagctttggtcctcctaggtgctgtgggtttcggaaggccatcaagcaatggtcgcgtgaacgactcatggttgaaagtccatgccgagcttgaccacatagagatcccattctctgcatctgcaaagtttggtgtgctaggcgacttccgcactgatctaaatccgctcagaaatgaaccattgctcttcaggctggactctgggttgcttgtgtccatgttttgtcggatactagaaattggccttggcaacaaactcttggtcatcttaattgggtctgtaaaaacatcgtcctgggtatctgtggtgttagacacttgatcagcttcaactttttgccgccgacgaatggaaccatcttgctttgctttggctgtcccattgatcttggccccactggcaccgtttgttgctgaaaagccattcgacgtgtcttcagagttcctacttctgtcggtattatgtgtgtctggtaatctagatgaagtgaccaatgtttcactgttgatacgctccaaactgcccttactgtacaaggacatctcagtgccagcatctgtcatagccccattttgaggagttagaccataataggactgcaaggtgctcatggcgagtgacatttgctgcttagaagaattgtagttggatgagtctagcgaatccgtaacatctctgttttgctgattgtttggagcccacgctctgcacatagacagaaagctaagaatgagcctatcaacagttacttacaacagtggggaaaaaaagaagtgttgacagacgacaaattattaaggtaaacatttatacggtaagggtttcatctttagaatatcagcattgagattgaggtgaagtcccgttttgatttcttgcatcacaggatggattaaagagaggaaaaataaaggaaatgcgtacctcttcattttctgaccagaaccattgagccttacagaggatggcatgggtcttcctggtagaggtatgagcaacattttgtgtgcgaacatctggctgtcagtcatcaaactgtttgccctcttgatgtcagatatctgaaaaatgagaggacattgtttaactcactgataaaattgacaaatttggtgaacatgtacaactcaaatcaagcaagaaaagctaagtttggctaatatgaggcactgaaatatgcaaataaatgatatggtttagtaagtacatcaacccttgtgttgctttcgtaatccgaggctgatgttacttttatgcatgatgacttatgagtgaataagatttgcagagttgttgtgaaccacagttagtgatgctaaatggtagtggtacgtgaccctgtgatttataaattggccaagtcctaaaatacttctatttcttgtgagtctgtggaaagcacaacatttttgtaagacattacttcattaaatcatctatgtgtaaatagtttaggacggtgatatgatataagaaagagcatcagacagccggtaaaaccgaatagaaaagataaaaaaataattgaagctttgattttgtcacaggcaagttttctttcctatctactccatcaaagaagtagtggcaagatggcaagttttttagccggcggcagtaggtaaataattgct

SEQ ID NO: 91568 - DNA, 1199 bp, Oryza sativa
acgcgcgccgaccgctggccctcccccgtgcgccgctacctgtctttgcctccgcctttgctgccggccacacgagcgacctccgtctcaaccaccggcgcccgagagacattcgcctccgccgccaaccgtccgcctgcccccacgacgctgcccacctccccgcccctgcgcgctgccctgtgtgagatagagaagacaaaggagagagagaaagaggggaagaggtgtatgactaatgggtcccacatttttttaataaataaaatgctgactggattgccacgcgtacgttacgtaggataaaatcgctctggattgggtcgaggggggtaattcgtccgtttttaaaagttcagggtgagcaatgtctagttttcgggttaagagggtaattcggtcgattgcgatagtttagggggcaattctaccccaacccccccccccctttataatctatgcggaagactgtggtaaaaacttatacacattaattatatacatgacaggcgcaatatttgttacatagattaaatagaagatactttgtgttgtttttaaacactacatacggatacggtgtatatgagtttgataactttcctccgtttgatttagattataaagtagatcatctactggattatagagataagttaaacatttcaaaaattcgatgaacaatatgagaaaaacagagcctcttatgcattagtacaatatcatattaaccgcttcctgattagaccattatatcgtttacttcaatcctacatcaaatcttatccacgctactgtataaacccaagtacatatctcctctgtaaaaaaaaatataaacaaagaaaagaggtgctgctagccgtgctgaggagatagaactagagaagagctgcagggtcggacgaaatgcgcgaagtagaggttttcttagcgacagacgaaataatatatgaatacataatcatttttaatttttataatatatatactccctccttttttaatagatactgttgacttttgagcacatgttttgattattcgtcttattaaaaaatatgcaaatgtataagatataaatcatacttaaagtacttcgagtgataaaacaattcacaacaaaatgaattataattacgtaattttttaataagacaaatgatcaaacgagcgacaaaaagtcaacggcgttatct

SEQ ID NO: 91569 - DNA, 679 bp, Oryza sativa
taccgaaaagcgttggagcttcaggctttccttgacatggccaaagatgatggtatttctaatagttcagtctatatgttctgaactttcctctgtgacctatgcaatgactcatcttcctgtttccattagatcttatggaaggttacagagcaactgaactgatgtctgaggactcgcaattgatgactcaatgcaaagctatagctgacatgaaatttacatatgttgtctcgtgccagcaatatggaatccagaaacgttctggtgaagcctgtgcgcatgatattttgaggctaatgacagtgtaagtttttctttcccttgaatgcgcaggagagctgttgtgatagtgtaagttttaatcaaatattgcaatgatctggatatatgttatctgtatgtagcacaaattgccttttttttcttgctttatttcttttataatttatgcaatcaagttggagcacacatgattgttcttagtgcaacagtgcaatcgagtgtctttctgtgagtatatgtgaattgggttaaaacaatgagtaccatgtgcattatttttagtagcgagtaatgaaataaatggtagctttgttatttactatgctgggagtaccatgtgtaacaatttgtatcatctaaattcatatctattgaagaaacaacaaaaaacaaa

SEQ ID NO: 91570 - DNA, 1414 bp, Oryza sativa
tgattcagcaacgtagatctgcattcaagttgttacaaacatcatagctaatcagttattgagcctgataacattatttgttcacttttcatgctatgccttaatacaatatgggtacggtttgcactgttaattcctgccgtttgggagttgacatggtttaatttgtgtttgctggatataggtaatgcacatggtttgggagttgaagccttgcgaatgctcatgcaaatggtcctcaccaatgaggaagagcttaaactgaaatatttcaaagatgatctatccaccaaactttgccctgtggaagcttttctaaaggcagtgctggatattccatttgcgttcaagagaatggatgctatgctctatgttgccaacttctatttggaggtcaatcagctcagaatgtcatatgctactcttgaggtatagttgagcccttggttgaatattttgtacaaattgttttgcaccctttgttgaaagaagcaaaacaaaactttcatatgcaattgggtattatgcatatcaatatttacacaaatgatttgaatctgtgaacggaatagaccctcacttactgtttccttggttataggattactcatctctgagggtttcttatcggttttcatacaggcagcttgccaggagctgaaaaacagcaggttgttccacaaggtccttgaggctggtttgaactttggcaacttgatgagtatcgatacaggatctccgaattcacatgccatggaacccaacactctgctgaagatcgttgatgtgaaaggagctgatggcaaggctgctctcctgcaatttgttgtccatgaaattgtgaaaccggaggccacagtcccgtgtgcaaaacgaatgcaaatactactcagcagtatgatgtggaatacagaaaacatggtcttcaggttgtgtcaaaacttgcggctgagctgagcaataccaagaaagcttcatccatcgatatgatgaagctcagcagagatgtttcagagctcggcgtagggcttggaaagatccacgacgtgttgaggctaaacagcatggtgacctcagcggacagcgcgaggcggttccacaacacaatgagcatgttcctgaggcaggcagaggaggagatcctgaagctccaggcgcaagagagcatctgcctgtcttgtgtgaaggaggtgactgagtacttccatggtgaattgagcagcggcgacgaagggcacatggcgagagtttttggcagtgtgagggagttccttgccatgctggaccgaatctgtaaagaagctggagaggagatgaagagcagcggctgtatgatgggtagagactggaatatggctgccccaatgggaatgacaacgccttgagctgcagcaatgctggcatatttgttatg

SEQ ID NO: 91571 - DNA, 651 bp, Oryza sativa
ggttaagtgttagaaaatatcaaaggaaaccttgcggtgtgtattcatactctcatgatctccatgcagatcaagcctctggtacagccaaccaaagatataatgaaagagccgatccgggatttccagtggcatgaatttttccctcgtggtacttaagttgaaaactgatgtttttaccttttggaatttttggcacacttatttcaatctcaatttgcattttgcagctaacaataacattggtgttgttattgcgctgtgggctccaataattcttgtgagtgttgttcattgtttcctgttaacaaaagttgattagccaatattttgagttttatcaattgatatgtccaggtctacttcatggacacccaaatttggtatgcacttttctctacattgatcggtggtatctatggggcttatcgtcgtcttggtgaggttggtaaaatgttttgttatcaggcattcattaagtcattttatgactggtttgatttgttggacctgctttctctgataaaacagttttcttgtctaatataccgcgtactgcatccaatagcgtataagaaaacaatgttcttggactgatgttattcacagtgacatctctacgtttaagctacctttcccagttatattttg

SEQ ID NO: 91572 - DNA, 1711 bp, Oryza sativa
acccggttaaaattttcttgccccgtggggtcccctggccccacccttctgaactcgtccttcttcttacgcataaccgcagcaggcacgaagttctcgcgaaatgctgcagtgaactcttcccaagtgggttctccagcatcctcttcccgagcttccttgtaagtatcccaccaatcaccagcgggtccctccagttggtttactgcgaagatcactttgtcggcttcgcgcacccggataagggtcagtttcttctctatgatacgtagccaatcttctgcctccataggctcgtctgtcgtagtgaacgtgggtggcttggtgctcataaactctccaaagcttgatccttcgtggttgccttgattgtttgcaatggcttgcagaagttgggtttgagtggccataactccggccagggtggttaggtcaggtgtctgggtttcatcattgctggttgacgcccgacgtcggcttgccatctgtgtaggtcgattgagtaagtatcctaatctcctaactggctcttatggttttatctctttaagggaattgtcttgatgtgaactttgttttgcaagcatggtggaataaactcatttacaacacaacagcaataatatcataaataacatcacagagttccacaaatagtacataaatcgtgatgcaatcgactgcacacatacgcagtccaaataaggttcatccaaaagatacattgaactaatcatcaaactactcgtcgatctaggtaagggggggtgtctcgcatgctatccaaaaaccatatgaagcgagatcgaagctgcaaatagtcctccagtctagtcatccaaccatccgcaggatcctggggcaggtagagggtggttgctggcacgggcaaacctgagtccccacggcttggaggtagtggcctctggatctggcttgggcttcttgcccggggatcgggtgctcttgcgggcaatgctgagggtgtgagggcctccgatgaaggtgatgcggggaacaggggtctcatcctctgaaggatcagtgatgtctggctcgatctctggctcggtgtcggtcccctctgtctcggagtcgacctggatcggagtctccatactggaacccagctgtggtgacggggtagggaccagtggggtgtgcacaatctctggtgcaggtggctgtgtcactgtcgtgtccactaggtagggtgctgacttagtagctagcatgccaatctctcccagaagagtgtggaatgcgggtggatatggcgggtgaggaagaagtagcggtcacgccctactgctgtggaagtagaagctcctggggtgctgaccgtggctgctggaagctgctcctccagctggctgacgggctcctgactctctctcagctgctcctcaagtgtattcatcatcccggggcgattgttgtactgataagataccggctggaactggtcgccgtggacctgaagctgggccttcagtgagtctatctcactgccccaagcctggtgcacctcccctagctgaagctgttgcactgtgaggtcagtcacctcggtctccaactctcccacaggcctctgtagtcgtcgatctctaacagagcctcctcgtagaagtcgtctactgcctcagcccatcgtgacagtcgagtcactatcgggttgtagcagcaaggtgtgtcctgaactgtgcag

SEQ ID NO: 91573 - DNA, 1049 bp, Oryza sativa
cagccatccattgcctcaccaagttggccttcctaattatgtagtcctctttgtagatgctaaggtataacagacatgctttcaaacaatgaggaagattattgtaaataaggttgagtacttgcctcatcccctgcaaagtaggatttttcttcaaattggaagtagtcaatgatttttgtatgtgattccattgctgcattccatctaacagctggcttttaaaatgtctggctgttatagttattgctagtggcaagccaccacatttttttatcatgtcatgagaaacttcagtaagatgtccaggaaattcatttccttggccaacaactccactgaaaaacaattgacttgagacatcatcacccagtggatcaatcttaataatgtgctctgagttatatccacagcatgccaaagctacaggttcaatttctgttgttattagtattctactgcaactattattatcaggcaaaccacggctaacaatatcccacattgatgaagcccataaatcttcaattatgatgaagtacctgcagaacatttagtacttcgtaaacattaaacttctaatgtacgaaaaaataaatcatatttaaaaagctatacgtgggatagcatgctgaatttaaaaagttgagtgcaatttcattttatcaactttgcaaacatggtgaagacatgttctatatcttgtaaatttcagaaattaaatttaaccacatatctaagagcaagtttaatagtatagccgactactagctccaaatcatctagagccaaatagccaattcatacaatagttgcttactatactattaatacttggtcctacctgtcatacacacattacgtcttagagtccgtgctgcagctggctacagatctgtaggctgctgctcttctctctcttcctatatctctttaaaatatgtttatagctagcttataacctgctattgtacctgttcttagacatggaaaaagacacgtactcctaagcaaatactctctcatgtttttaatgtttgatgtcaaac

SEQ ID NO: 91574 - DNA, 10334 bp, Oryza sativa
ccttccttcaagaaccgacattaaccttctaaggggttgcattgccgcctccttgcacacaaggcgtatatcagagcctgaatatccttcagttttctccacaagaacatcatatgggatattcattgtgccaggaacagatggcaagagctcttcaaacatggcatgtctagcttcttgctctggtaagggaacaagaatctaattgcaagttaaggatggatttccctttttatgtggaaaaatcaagtgtggtcctatatacaaactccagtatcgcaataagaaaagatacaagaatcgagattgaattctttaacagtttttagtacaaacaataacttcagtaagaagcctatgatgtgtcagttacaactacaaatagatttaaggcaagcattggaaataggcaacatttacaactacaaatagatttaaggcaagcattggaaataggctacataaatgttcatcatcaaacattctctttactacataataagagaatcacttattctcaatctgaaattcaaatcagtagttcctcacataagaaaatgatctttggtattgttacttctggttaaacatatttgagatttgaattttttttcatggtcttcaaggtgcgattgttaccatgattttattagaataggtttataaaatctaataagtttatgagatgttggaagtactttaaaacaaatcaaagcatatcatatttatgtttttgaactaagtttttaaagttcatcgatagtcaaggtttcaaaagtttaaccagattttgtccaaaacatcaagcatttgcggacaaaacaagggagtttacctaatagcaaaactggcaattacggagtagtatttaggagcactcgtgaacaaagaaattacaagatggtttgagaaaaaaggatacacgtttctccaaacggcgcaacattgctgcatccagttcccatggcaaatttgtggcggctagaacaaaaacgagatcatctgtcttagttaacccatccatctgcagcaacaaattatcagaattcatgactgcttttatcaccatgtgaatgaaatcacacaagttcaggattattatacatatcaatttatgaaaggtttcatatactaacagaatcctgtatgttgagaaccaccaagggtcttccggctagctccacaagatggtgggctagacgacctgggttcgaagcctcaccccttctagttatttgatattagatccttccctaatattcgcgtcctttttaacagaatcccatatgctgagatatatgatatctaaagagtttgttctttgttaattttcctccatagggttatgttcacaatttagggctgagaaactcatactacttatgaagcagtgaaagtttcagcataatcactttacaaagcctcaagaatgctacctgtattaatagctcagtcttcaatcgccgactggcttcatgttcactacgagcttcaccacgttggctaataatagcatcaatctcatcgagaaaaatggtggatggtgcatgatgccttgcaagctcaaataagactttcactagtttctccgaatcacctgcaccgttgtaactattaggtagggaaaacttactaaaatatcgatagaaatggagcaaggacagaatatcatgtatggtaaggatgtgagttagaagttataagttcgatctagtcaggtacaggttcatccatccgttattaatagcaagaaggaattatatagttccacatatctgttcttccaaattgatgaatgaaaaggatgaggtgattgttccacaaaggttagtgctgttggatatacaatgttccacaaaatgtacaggcggagtgagggtggcagaggagtattaggctagtaggctctggtgcaaatagggagccagtggtcagtgggcagtggccaacaatggctatggaagccctacaccattgggtgccataacatggtatgcaagggtgaaggagaagatttgatggtttcattaagtccaaaagaaatgtggcatatgctaggatccatagaatactgtcatgcacaacagtgattattgatatttttcaagctgctagtacatgaggccaaaagataactgcctgttaggggaatatagaaagaaggaaatgaaaaaaaaaaaaagaattatgaatgtttcagtcctattggtggcgcttaagtgagtttaaggatacagttgagtagtatcaatgaatagttaactgtggacctctttagtgctggagaaacatgtattaactttataaaacttggaagagtaaatactatccaatgtaaatctatagaaatttgctaatacggattgctttaaaaaatatataaagagcagatagaaacacaaaaaaatagtgcatgcatgtatcacatatctacatgattagttggtcatacaagcaatacaacatgacaagaagtagaaactacaacaacaatagcattaaaagggaaacaatgcaaatgcatctcagaacgcaagcaaaagtaatgccataccacgccatttactgacaattgatgaggctgaaatattgaagaaggttgttttgcactcagtagccacagcttttgctagcattgtctgaaacaaaatatatcaaaacagttacatcaagcatacatgatcagcaatttgagttcgtatagcacgacaagcaacatatggaatggaaacggagttggtatgaagggaaacgtatgcaaacaagtacataaacaaatgcaatagactagtggaacgttctgtagcacaaaagacaaaagaagcaagggaaaacataacagaccagccacagcttattgtaggtgctaactatatagttatatgtgtaaaataatttaattatctatgatctttgacagataaatgctgaggtaaatctactatctttaacagacaaatgctgaggtgaatcccagtagagtatttcaaatggcgattgatgttttttttaatacaaggcagcaataatataaaacaaagatacttcaccaaataattcaaccactatagtccatgatgaaatgtaacatattttaggacagggagaacatagattcattgttatgccaaaaaaataatcttacaatatacaagaaaagttccttgctaagcatctaaatagtacaaagataacaatatagtcttagcatatacactatacaactaaaatgcaatgatctttgtaaggtgcaaacctttcctgttcctggtggaccaaaaagcaatatacctttccaaggtgatagcagacctttgaagtacctacagttcaaaaagaaaataattgagaaccaatggtaggtccaaaatactgatttctaacacaagttatagaagccatcagataagctaatttgggagttttttcctgaatctaattagcaaaaaacgatatagaaagcatgcggtgtaacaactagcaaaacgaatatacaggttagataaataattgcctgactggtaaagattctacatctaacaaaaaactttcttcagaagataccaaaaacacacacatggggcattgtaccatcaaactgaaagagttaaagtaaatggtatgcgacatattatcatgaataacagtggttgcttaaatgcaatcttagggagatctgatctgaccttttaaatatgcaaacatgaccatgcagatatgtgaagcatcaccaatcacaaaattcgatgcaagaatgcaacattcttttgagccacgaatgtcaggtatgaaaatattttccagacatgttaaacgacaaagttacttgttcaaaagtgtttagatagttcgtctgcctatgctatacgttgatgaaaggaagttaggaagagacacatcttcttggtattgcaggtcatatcaagaattttgagattctataagcagaaaagagttaggcttaatagattcgtctcgcagtttacaggcggaatctgtaatttgttttgttattagtctacgtttaatacttcaaatgtgtgtccgtatacttcaaaaaaaaatttgaaaaggaactaaacacggcctatgttgtgagcatatatcatatatattatttctgtgagaagacagaaacctacttggggtattttataggcatcacaactgcttctttcagaagacgctttgcattctccaaacctttaatgctttcccatttgacatctggactcccacgaatgatatccctattggcattacaccaagaaggtatggttataagtctgtatacattacagtaccaaatagataagtctggccacatttaccaaaaggcagtgttacctcaacaatgtctcagctaaattgcgcatttctgcagattcaaaagaaggaagtagggatttctgcctgcaaagatcttaagtcagttatcacaaagatacatgtgtaatatacatgataggtgaaagaaaggaatgggctggggagttttattgtgtgactggacaatacaatattacttcagaattatggttgaacaggggaaaatatagctggaaacttcctttgaatatagtaggtactgttaggaataaccagatatctaattgacattaaagcgataagttccagcaattttgttgtactataaactaatagcatcactaaaaatgaaaaaactaatgtttacatttgagatacttatagcaaatactattttccatagtatatgccagacataaaactgcttaaaatgcatgcatgcagacaactatagcaacaaaatcatcataaggttgctatttctaaggtttggacaactgaaatacaatgcatggttttgatcccatattagctaatgcccaaatcaggatcggatcaaccactttggtcacaattaaatttcatcccgccaacgaaggagctaacaattttacaccagacaaaaaccaaataacttcagaggaagttttcacaattcagatagaaaaaatgcagtcaaactggatgtactatactccatagaaagcaacgagtcttacggaggcccagcttcaattgctccattccgcagctccaccttcctctcctggcaccaaaacagagaaggcaaaaaaaatcacaaaatcatccctgaagcagtaacaacttatcatccagagcagaggggggatatagagagagaagggcggacgcaccagccgctcgaactgctcgaagacggccaggtcggcgccgccgttggcgtgcgccgcggaggggcgggtgctgcccgcggagccggatccaagcggcgcgtagccgcgacctccgccgccgtcgccgtcgccgtcttcatctcccccgggctcgcggcggatgccgaggcgcacctcgtagtagacctcgaagtcctgcgcacgcgaaacggacacgatctcagcacgcgcgacagcgacgaagggtgaaaaagggaacaggacagcggggaggagaggagaggaatcgaatcaaacagaaagccaaagggagagagtggtgcggagtcaggtcacctcgaaggtccagcgggtgatggacggctcgtcggcgccggtcatggcgatcggattcgatcgcccgcgcacgcccgcacgcgcgcgcgcacgcgcggcgcgagagctctcctcctccgcgccgcggttgcggtgcggggcaagcggacgagctggcgatgtgaggaggagcggaggcgctgagttggagttggacttgctacaactgctaggaggagaggggggtagtcgctaccggggacaggcgggcgaatctgcgctgattttgcaccgggcggggacctccccacttgaggctgacaccgtgggcagggcgacccgctaccgaccacgtgggcagggcccgcgtgtcagtgatgctacctgcagtggtgcggctatagctgtagctacagtgctactactgttgaagcaagtacagtactactatgataaactcttaatcgcttgctatgtataaacagaacaactaaagatgagattagacttattattatattactaccaatctaaactactaaaataggtaaaatcaacccatccatactagtactatatttttatattttaaaatgaagatagtaaacgactatatgaagaaaagtgagatgccgctcttcatacaagagggaagagggaagatgagagaataagagagtattgcagatttgcattttgcagtaatggattagaagctagtttactagtactagagatttgtaaactttaaaattgatgagtggatggtgtggataaaattagaggttagctataacctccgtagttaaacttgtttaaaatgctcattgtactgtttgaaccaagtgctactagtagtagcactcctgtttaaactttaaagagtacaagtgaatgaatgcacgagtcgttagttccaaggttgacatagcagcttcagaatattccagcgagagagatgttccaggccttcgctgagttgcagggaagaatggtcgttttctgtttaatttaatactccttccgttttttaatagatgacgtcgttgactttttctcacatgtttaactattcatcttattcaaaaattttatgcaaatgtataagatataaatcacactttaggtactatgagtgataaaacactcgtagcaaaataaattataattacgtaaattttttgaatgagacgaatggtcaaacatgtgagaaaaagtcaacggcgtcatctattaaaaaacggaggtagtatttatgggaaaactggaaccatgctattataattttgcaaaatttaagatatgtcatcctgaatcatatgtcattgactcacatgggtcctacgtgttattgagataccgatagcatatctcaaactttacaaaattataatggcatggttccaatttacccgataaagccacgtttgcagcatgcgcagacaggcgttcgcttcgtgaaggctccgctgcgtgctcacaggctcacagccatccacggttccaatcatttgcgagtgcgtgagcccgtgggcgaccccgtagcttattcccgtcaacatcatcaaattcgcaagccaaagaaactgaaatggtccagctaatggctgctttggatgaccggggcatgaagtacgctgtttggaattttgacgagcagcaattaaggtcaaaatcccctcaaataaaaatcaaaccacaaaggccagaaaaaatataagagaacaataccatgttgcacttatgttcgccgaactgatactgaaaaagaaaaaacaaaacaaaggggcacctgcgacagcacatacagtacatctgccaaatcgaaacgcacgtttggaaggcgtatacgcttatatatgcagttgacaagctacaggcatacaagtacggtagtactttgccaacaaagtggcaagacgatgccacaagtcgacgacaaccgcaaccgattttgccaaatcgtcccgtcaggcttcgtcggaacgatctcccatttcccaggtaacagaaactagagggtacaaagtgcagccacacgaacaaagatccaatttcaacaatttaagttttccaacataaagtaataaatatattggaggagcaccaagttctaccacagatactgattagtcaagggtgccctagggtaaagggaaccaaccacatgtatacagacaaataattcaagcggtagtcatttaaactcccttccactgccaatatctccagtttgttcttatcaagcaaatggcatttgattaaggctaaagcatgacgggttattacatcacgagaggcattgggttttatgcaccgctggcatacaggcgagtccactcctttgctgcaaatgccagaccatcgcttatcaggcaaccaataaaatcagagtgtgaggggagacactgttaactggattgctagcttcaatttacctgtttcaacagcttctgcttcattggctttccagtgctttgcaatgttatcagagagaggatcatcagggtttggtgcacttaggagtgcctggatactgaaaaaaaagagtgttgtcacaaggtaagtatagcaaagtgatacccctaacttccaatagttgacaatgctcaagagtttttgttggaaaaacacatcaagggcagtgataaaattactaaatgcaggtaagctaacaaataattcaaattcaacagaaatcatgtcaatcgtaataagacaacagcttagcagacaaggaatttgtgcaggatataaaaagctaatacacatgtgcaggcaacgggggagagacctcaaaagaactgtccgaatctgaagggctgggctccatttgtccttgagaatgtcaaggcatatcctaccaagctacaaaagtaaacctattaatgaataaacaatgtattacgaagtaaactaaataacaaagaggaatgtgactgcaaaccttgtcaatgttggggtggtatattttggtcaggaacctaacctgcatacgcaacaaagaaaaaatggagactgaggtagacaataatgaattatatagctttacacttagggagactgaagtagacaataatccggtatggttgtataacatatgagtaatatttcttcacccttccaatctatgacattgtcaagccaaacagactaaaaaaataactaatcaaggtataatttggctgaacaccaaacgaacaatgtgatgttaagaacacctttaagaacttgaagcaaaaagacggtcaagagaagcaatggcgtgctgatgctcaggacacagctaaaagttcccacaggaccaaaagtatatcttacaaccttggtccttggcacaggatctcattgcaaattacatctcaaataggcagggtttgcattatccctaaaaggaaatcaagcaaatgtaacaaaactattaccaacaagacatcacatataacatataaaaccaacgatggttccagagcgacacgattaaatatgggtaactaaaaattaggctataaagaataaaaatttttttttgccaaagaatggttcaaacaaattaaatgtttcagctactttcctgtatttggttatatgcatgagtccaatgtcaccaaattaatgctccgcttcacaacacaagtcaatgaatgcagaaatgtcctgacttttaatatgagtatataaccacacgcaattctaaatacgacataattagcttgaaggtatacagtccccataatatcatataaaacataaccaaagtttatctatgtcttgttacctttggagcagccataggatattcctcaggtaaaaagagttcaagcttaaaaactccacctgatagaaagaacaatatcaggaagccaaatgataatagaataaaccatctaaagctactaactgttaacacccattatatatccaacccgaattaacgcaaaaagggtttaagaaaggaaatatttaaattatacaccacaacatgaaaagccaacaatatcaatactcataattagtctaatcaaataaatcgaagagatcaatttggttatggaaaatcaagggcaacctttgccgcacaaagcatcaaacaagttaacacataaaagaaaagcacttataagtcacgtatataatccgagtttagaacattattgctaaaagtcactagtgttttagcattactaacttcatactagaaagggaatatgagacacatagaacatgcaagtgcccgccgcccgagaaactaaaactggtaagtgcaaaagaaccagcctaatcaagcaaaagcaggcttacgaaatgcgtgcccgtccatgactgacacataattaacacttctagtaattgggtttatacagaatcacccaattctgcggtatacctagaaacgccctaatcgaccaccctctacaacaaataacatatccatcgggagccgtaacaccctctacaacaaataacgtatccatcgggtgccgtaccttcatagggggactgtgccgggccaaggatcatgacgttgaagtagcgcatgttctcctccgacggagacgcgctgattcccggcgctgcacaaacaaaccaacccaaaaccatcagaacaacacgaacccaaaccacggaaaaacacaacaccatcgccaaaatccgcgatacataaaaaaaaaaaaaaccgcccgcacctggctcgctgaggagtcgctgcgtctcctgcgcagatccaaaccagacgcgaacacacagacagcaaaaacaaaaaatcagcacagaaaggggaaaataaaaaaaaaagaaaagaaaaggggggaa

SEQ ID NO: 91575 - DNA, 2899 bp, Oryza sativa
agttctgctacttcaacaactacaacgtgcggcagccgcgccacctctgccgctcctgccgccgctactggacggccggcggcgcgctccgccgcgtcgcctcggcgtccccgggaaggcgcaggccccgccccagcgccgcccgatcggccgccgccgccgccgcctccgcctccgcggcgtctccccccgccgccgtccccgccgcctccgagggggcggagagcgttgactcgcggtcgtaggcgtgggcgcggcgtggctccggctcgcctcgaggcttcctcctcacatggcgcgggtgacgtcactcctcccccccccggggggcccacgcgtcggagagtctcctctttccactttttggcatttttctggagggtacgggtaggtttctgtttttcttttttggagataccattttaggattcttttggtggccaaatggatgaggccagcaacgaaagagataagaaaaggaaatttggaaatttgggtgctttcaaaattggtaggcagttcaaatgaatgtactactactactagcagcagcagcaggcctcgaggcaatgagatgatgaatcagagtggcagattgagccgtgatttattgaaatcttcgtcttcttgagttcttttggttgcccatgttttggctctgcaccattcacagttaattactccataagtcattcaatagatcatgtgttcatgtggtacctgtgacaatgctgagagttgctgtagtccgcggcgtgcaataaatggaatgtacggggtaggtgtgtgtacttgacctcttgccaatcatctttttgaacaaatgagagtgtaacagatgtcatggagaattcctgacaaattcatgtgttgcgaaaaaagctgttttatggacatatcttaattctatatgcactacagtagtaatagcatgagggggagaggcaggagtattccaggaggaccaggacaaagggaaaacaacaattcatcttccaaataaatccaaataaagggtaaaacatcatagtaaaaactttatagtgataacagttcagctgttcatgatagtgatgatatggtgctagtttttttaatttgttctccatgtcaaacaataaacatacttcaaagtaattgtctcagattccatgtgcagtggttgtgattgtctttaacatgccacttttaaacaagtaggcactggtgcaggtgcgtttttcacacagtacacggagcaatgtgataaaggtcatatatgtactcccctcattccagttaagtacttcaaaagagtctccagttcatgaaaaagaaaagtttccataggattccccaagcttactgaattgtgacttttaaaacagctgtattgacagcctgtgttattcgcattcagaattggtcccgagtcctgaccatatatactgttaaatttaagatcaaccataaaattcggtggtcactgtgctaaaagtttagaggtgtacatgatttttgatgatttacgtgtaatgttggatgaagttgactacatacctatgtacaaactttctattgtgcagctataataaaatttggatcaagattcagatggtatactcgctcctcaatgactgagtgtgcatcttatcttggtaacatccccagatcagattcttataaaaccttggcctgtaaaaaatagtaacaacttgatcaggattagacagacagaaggtacttcacttcaaaaggtgtacaatcatatgcgcacttaaagaaattctgcttcaaaggtacgatatgcgtaaatcttttaaatttattcaacagtcagaatcacatgcatcagttgtaagtacattcatagcaatttaaaaccactgttgacagcaaaagatatgtcatcattctgaattggtgtctactccttcaagtctatggttatgcggcttcaaaggcaccgtgaggacttattactttctcaatggtcacttggacgtaagtacatgcatcggctgcaagcatactcatagctacttaaaaactattgttgacctgacacaggcaactattactactgtgttgaagaaaggataaaagcttgcacctcagtatctccgtgacctatcttcctcagggcaactacctttaattctattcaccagaactatgttcaagattcacgattcccaactgcaggtatagattcttgaattgcctgagcaaatgttgcaatcttgtaggtgaaaaacccaacaagcatgggtatcaattccaggtgcatgaagccataatctggaactaaaatcctgcatcagaccagcaagcacaggtatacatgtaagaaaaccatacgttctactatttgaatattcaaacatcaaaagtttaataaaatttcatctacttactcattccatcggttatacatcatcacaagtgccactggaataagcagtcttggttgggcagcagcactcctgtaagcatgcaagaataaaataagatgcatgtgagcatattttaaaagttgcctagcatttgctgaacatcggtcacattccgttgtaaaatttttaaagaaaagatagaggtgaccaacataattgaagggcattgtataatacatgggaggggaatgttcagatgatgaagttttatcattttagatttctttcaagataaacccctaagcgagatataccaaactaaacgagttctacaagaccttgaattaataaactgcagtgctataaaatattaaaatgagatcacaaagccttagtagctgagccaaactaaaccaattatgagaagaagtctactcaagtgttttatctttttcttttctcaaataccactcaagtgtttatccacaagaccacaaataccaattgaaaaacaacataatgaa

SEQ ID NO: 91576 - DNA, 5320 bp, Oryza sativa
ggcggacggacgggggcaggtggggttagccggatagatcggtgtgagcggtgagccggtgcggcggtggggaataaaaggaggggggagaggcaggcgggcgagcggcgaggcggcccgtgggccgtgaccgaggcggaggggggcacgtggagacgctggggcggaggcattgggcggccgccgttggatcgaccccccggctcgctcgtgttgaccgtggggggcaacgagccggcggtgggaaaggggtagggggggagttggttgtcgacttgtcgtggacgtcgcgtcggggacggagtccgaattaaaatctcgctcggttgggccggcgcggcgcggcgcgggatgcgtgcgtgcgtgcggcgcggacggacggatcggtggacgacgacgcaccaccgccgggggggggggggggaccgggtgccgtgcgggaggaggactcgtgtcgtggtggcgtggcagaggcggacacggctagccgccgggcggggcggcgcgtgcgtcgcgcctcgtttgggtcgccgtggcggaaagagagaagcgtatgcacagtggagacgcgatgacgtcggccaagtgggtgacaacgagtgctttgtgtttgggtggattttttttttttttgggcgaggtgttttgggtggattttgttggttctcccggttgagacgaagtcatcaagatcctaaaacccagttcagtcgggaacaggaggatttcatgtgaattttgtaaaatttcgtagaaaaaaagtttcaaggggaaaatttcatagaaaatgatttgattcgcatagaggaacataaaaaattttcgcttttcagatatggcctcaaatatattgcgatcctcgtaacatatctctacattcctggcaactttggtatggagcacaggcgataagcagataagcttggatcatcaaaccgtgggtactgtactgagcagtacattcagatcaataataaagtcagaaaacacaggtactctgctcaatttggttgcatctcaaggaagatctcaaatgtcaacttttaccgagtaccccggccaaaactttcagagaaacaaatgatagatccgaggacacgcaacggtcctgatgaagtatgacagcaaaactagtcctgcgattcaaggcatgttcttctataagcggagacacattctttttgtacattcatgaaggttcgcggttatacagccgcaatataagaagtcaatatgtgtaccctcgccggtttgcaaaatccacaggctaatttttacaggttttacaggagaaacttatcggcctctgcaggcaaggagtgagctggttcgtcagcttgacttcagctgacggcatattcgcagtcgagcaagcgggtaaggatctcctgacagctcggccgatcttggggctctgcccaacaatctgcatcaaacaaaagcaaacactttgctaagctataactgaagccgatgcatgttggtgcgacatgactctgaacactggaataccccaattgaaacatctgtcatataaaagcaccattacctgcaattaacttgccaagaggtccttcaggaatctcgagccgtgaaccttcgtttgcaacagtatataccacctacagtggaccaaattcatgaagttcaggcaacaatgccatgtcaaaggaactgtgttggccatatataagtacatcaacaaactggaaacatgatgcatgcaattttttaactgatcatgtcgctagagagaaagattcatcataaacttcagggaatataacttttatcagctatcattcatgatgcaactgttttgatacaaagtggatgggtgcttacttgaactggggagatcccatcccaaggacgactcaatgtgcatagctcccacatgatcacaccaaggctgaaaatatcacatttctctgtaaagggttcgttccttataagctcaggggccatccattctggggtgccagcagaggagttgtcagtcataggactatcagtcatcactcgggaaaggccgaaatcacatatcttgacggtccaatgcttattcaccaggcaatttgcacttttcaggtccctgtgaactatcttcatgcggtgtatgcacatcaaaccccttttaagtaaacaaaacaatttgtcagatgagaatgaatgctaaaggagggctatgagatgatgtccgcacgacaagagaattatatcagaatcttctgaaagtttatatgtaataccagctaataggaatatatagtagtaatagttattgtacaatgagaaagatttaacctgcagatatcacggacaattttcaacctcctacgccaactgagcttctttttctgaccactcatatggatgagatagtacagcgatcccatttccatatattctgttaccattgacaagtgtggtggtaccatgcatgccccaagaaacaatataactacagatatggaatttgctttagaaactcgtgatttatggcatttgcatgatatctagtgcagagctgctgagtattgtagtttgacttaatcaaagtgagtccttaccatttggatgccgcagccggctgaaaggaaattgtgaagttctcaaagttagtgtgcatattatgattaaaaagaaggctgccaataatacagaagcaagcatagtacaggtacctcaggatatatatctcattgcaaaaatcctccatgttttcagttgtcagatcctgctctagaaatactttgatagcaacatcagtgccattccatataccacggaaaacctctccaaagaatcctgatgaagtaatttgacaaggtgacaaaaatgttaaaacatgacaggcaaacaagaaaggaaaattttcataagaaagctttcccaaaataaaagcacacattgaagtatgaaacaacatatcaaatggttcaggcataacatgtttagcatcatccccattaatattcctacattcgtattcataatgcttatcaataccatggatgagtaagctccattaaatggtctaaagaatgatagaatcaaaagttggtgacatcatgatcctcagaaagtaaatcgctgttcaactttgcagttgcggtatccaatatataatttttttgtgttagtaaattttgactgaaccaaacatattcaataaagtgtggatatggaaacaaataacaatagcaagtcatatcttatgggagattgaatttattggatcatttttcaacaccaagtttgatggatctaattcttacaggaagttggtaatagctaaggagaaaataactacccatgttgtgtttagtttttgttcattttgaaaacatgctagaaagagaaagcagcatagcaaaagtagcaacaagatgaagagtcaagaacacaagcatagcaggtaggctgacagtttacaatagacttcggtaactttggctgaggaagttcaagtaacttgcctattccaacccttgtgccaattgttagctcagagaaatctatgttccactcttcaaagggcaataaaggtttattgagaaatggggaactctgcaaaaccttgttccacgccaataccatcttttctttacttacaaaatcacaaggattgattgtttcagaaatttgcgccctatattcatgaggagaagaaggcaatgacatagctttctgagtggaaccatttcggttccttgggccattgttggtagcaacaactcctccagatgtatcatcctaaattgaaatgaaattatgagcaaaataagtcatatttccaactcccaaggaataaagaaccaatatagataagattaaacaatggaatttgcaggaacatacattatttgggcaatcacttgcattgttttggtcctccccaacatacgagggtgaaccttcattaacatggtccctttggaggcgattttgctttagtgtttcattcatagcccgaaccgccctgtcaaagatttaagattgaaacaatgaattcctgatactcattgaggatatctagcaaaatacagacaaatgcttaaggatatctagaatcaaaatacaactaaaagaaaattatcaatatattttggttgaaagcaccaagcgcagctatacaatacaactttgaaaacaatatgccatctcaaatatcgtcaggatagttcaaaataagaattacctcacaatgtcatctccaatctcaggcgtgatgctaatgcttcttccccgtattcttcgagttttagatgttgatgcaccacctagaccatctgatctgcaagtgtgttcttggcttgtcaaatgaataagaaggttcacaaaaagggtaaaagaaactgagttgaaacatgttcaagacaaatgtttgacccatgaaaagggtaagtaagtgttaagtatcaatagcaactcacacgctaagtcattgaaaaatgttattccctgtggtcacaaacatgttgttttggacatgtatgaagtcaatttcaaaactgaatataaatatatttttaaatgttaagattggatgtatgtacatatgcatagatttgtcatgaaaaacattttcataatgttatagttttatcaagtttacaattatattataacaattagtggccaaggttgtactttatacactcttatcaatgtccaaaatatcagttacacatccaagaatttattcctgttacatgtttatcccagaatgctgggcagaaagctaacgtatgacgtgaatggacatcagatatgtaacaaaatctgctctcaatggtttgccactatgaagaataacccaaaaattaagtagatttcgatcaaaattatgtggaagacttacatttgtaacattgaaatatataaaattgcacctagctaaaagaaaaacaaaagggatatgacagtaaactgaagacagcagtggagaatttatgcacttttaacaatattgtttcacagaaaagaattgaggaaaacatgcaaacttcagaaaaataaaaagatcagttgtcaaaccttgatgtaactccactttctgcatattcctgaaatgaatgttgctcgccacctagtatagatcttgcccttgtcttcattaatggatgctcagggctacaccagaaaacaaaaggagaaacatagagcgtgagaatagcagcaacacatgaaacaggtaggaaggcaatgaaacaaaagaaagacatgttacgttactgctcactactagccgaaacacaggaaagaaacaaactacaatcgtgaaagtaaccacaactacaatgtaataattctg

SEQ ID NO: 91577 - DNA, 2689 bp, Oryza sativa
tgtcacctgcatgcaggagaggaggaggagcaggaggaggaggagggggtagtgaggtcgccgccgcggaggaagaggcgcaatggctgttgctgctgctgctgctcgcgcctgatcagaccatgcactccaggctgctcaagaggctcgcgaagaggatcatgtgacgtggagcgagccgcaatgtggaagatggtggacgcgctgctgcgttgctccgcgctcgtcgcgctggttcttcatttcgtcgtcaatggctgctcggcggtcaacactgaaggttagcggcggcggcggcggtggcgtctcgccggtgttgtgggctgcgttcattattaggtctgtgggtgattgattgggagctcttcttggttgcttgtggttgcagggtcggcgctgctcaagtttcagtcgagggtggaggaggatccgcatggcgccatggcaggttggagcgagcgggatggcgatccttgcagttggaacggcgtccgctgcgtggatggcagggtggtgattctgtgagttcattgcccttccttttttattcttctgaatgtgcagtgattctgattggaaatgcagtttacccattcgatcaaggatcattgttgcaaaatgtagcaggttttctctctttgatgatcctccgtttgactaaaaccattctgttgaagagttgcgttgatttattgttaaaatggacgttccttccccactacttttctcctctgatctatgtgcggtttgacttgagaatacatgttagaaaatgcagcaatgcttcagttgaatttctggcaacacaagcatctatcaactttatagcccagagaagttagatgtgcaatgattgacttgttgtatttggtaacagagcctccttggctcctttggactgtgggatttctccggattcttgtgaaaatcctttagattcgtgcaaaatggtcctgcgttctaaaggaggccttggtgcaatcagctcctcttccagccaaacagtcaatacaaagcatcatacacaatattaattccgtcccattttgatttgaattcttatttctttgatacatatacagtattcagaatgtccataaaatgtgctgtagaaattaattttccctttagaagcctgtatggaagtttaaaacataatgttgatatcattatttggtttatttaaatggtttcttgactcagccaatgtgaacaagtggccagatggtacattcaattctgtgacagggagatgttgactaataaagtgagattatcgactaaaacaatttagttgattcttttaaattgtaattatattggaggcccaagatagaggctaagcattggtgtagcttgatacttcagcagaaggtcaagtataatcaccatcggctgaacgttgtgatctgcctaggtaagagtgctgtagtagggtccatatgttcatataaaacatcccttatgtgtcagcggctcatatctagagagcttttcttaggcagcacattaagaaagccaaactaatgctgtttggcatgcttcacgcttatatactattcaataggaaaactgacatttccattcgtagttctagatccctaacatattagtctagcaaataaaaggtttgttcaatactctacatgtacttcaaccaagcacaatagcagccctttttctttcctgattacaaggtaggcagacacacacggacattgccactcacaccacacgcagaaatgcactattgtgtgcgctttgaactctttcgatgtcaagatttgctatcaaatgcctcaggacgtgtgacaggttgagtttcatacaccaatcatctcattcagaagtttaagttactaggaaaagagacatcattttctgctcatagagctttggagtagtcccttcagtgctacttaatattgatatttttacatgaaaacaccttaaggtgattctccgactcactaggttaataattttttcttctcaagatgatctattacagaaaaactcatgttcagattcttgtgtttcactatataagattcatttataattgccgcagtgtttctacatattttgagtggataatggttgctttatcatcttaagaattgtacttactatgaactctctttctgtaggaatctaaaggatctctcactaagaggtaccttgggtccagaactaggaagtcttagtcatctgagggctctgtaagttatcttgactttgctttaaagaatatacattggacatcttttgaattggatttctttaagatctagtaacgagaaattactatagataaatatattaattctttatcggttgatgcttgactagcttattcagtttgtcttccaggaaccaggtgtctaaataagtcaattaccgtcagtaaggacatctgaagcatatgtatccaattaaatgaatattggtttcaataggccataatcaaatggtgtagttcatatcaactaaactccgtgctaaataaaaatgagactaaaatgccacatgaatacattgtgcatttgtgtgagtaactgaggagtttacacagtagcataagatcttggctaatcttttgatggggcatccattacttgaattactagagctaatgagttgtaacactgtaatcttactcctgaatgtgatttgagtgttttctaca

SEQ ID NO: 91578 - DNA, 738 bp, Oryza sativa
ttcctgagatgatttccagcatgagtagaccaaaactgcacacgttcccagctggatcggcagacacaggctcatggtgatcaacaatgtcatcgttcttgggcatttttcctttagaaatcacttcttgccaaacactcatgtctgctacctgcgaaaaggactcggtttagaggaaagcataaacatgtagtctgatattacaactaaagtgtttgtgcaaacgaactagggagtacttcatattgctcaattgtgatgtagacaaacattttatccagtttgcttttccaaacaatgtgactctaaattgaaggtataatgtccagaaaaatggtttagaagctgaaattctgatcttacactatttcctttttgttttcatattactgaaattttggacaatcctgtgaagatctccacaaactagaacaaatacaatttgaaatttccataagcatatttgtacctttgcagctccatcctcagacaacaatatggcacttgaatgtaagtcaggatgtgtgatagaagggttcagctcatgcatgtgttggatgcagtatgctacccccataattactctcatcctaccattccaatcaatatgatcgaatccctcaactgcaaaaaggaaataaaaccaatttaatttggcataaagaacaaacattttacagtgggatcagcatttaacaggcttttaccatggagatgctcatagagtgttccattggg

SEQ ID NO: 91579 - DNA, 3000 bp, Oryza sativa
tgcactggggggtgtgtcttgttgagtacgggggttgtactcagtcttgctcaatttttcccaaaccccaaaagaggagttcctaaaggatgaggctttggtgtctagctcgtgcctgccgtcaagcgcctgtggtcgtcgccctagtcttccgctgcttctcgtttgtctttgtgtgtgctgggccttcgtcgcctatgtaataaattaactatttacgcttccgcttgttaaactctgaattgtatcaacttttggtgtaccttgcctcctgggacaaggataatgcacgcacgtcaggaacgcccgttgggttatttccggtcgtgacaggtttaaaatcaagcaccgactcttctaataccagaaataatcccttcttcacattatagcaagatgcttgttgtgacaaatcatttgctctagaattatcatgcctagcaatatatctaatagcaaaattatcaaaattggcaataatatccaagcatgagtcaagatacctatttagtgatccgtcctagcatttgtagactctggcaacttgttgcaccaccaattctgaatcaccaaaaacttccacgtgcttatctccaaccaactccatcacttgtaagccgaataataaagcatcgtattcgggttgattatttgtacaataatacttcaaacggaccgatgcctcataacacatgccattaggtgaaaacaaaactacccctatgccttaaccatctttgcaagaagaaccatcaaaataaatctttcaaggtataacttcaactaagcaaacctcctcctcataagcaatatccacatgatggtctactaaaaaatcacatacaatttggcctctcatagattttaatggttcataagccaaatcatattcaatcaaagcatatgcccacttgccaattctcccacttagaattggcctttgtaacatgtgtttaataacatcggcttgacaagcaactatgcatgcactagataacaaataatgcctcaatttggtacaagcatagtataagcataaataaaatctctttataaagacataccttgtttcggcatccaaaagacggcggctcaaatatgtaatgatatattccttgccatcttcctcttgcgtcaaaacggcaccaatgactttgtctttggaggcaatacataaccgaaaaggctttacggttttaggcgcccgcacaacgggtgaagtagacaaatacttcttcaaccctttaaatgcctcttgttgttttgccccccaagtaaaatcggcttattttttcaagcgaagtatagggacaaaagcatcgattttacccgctaggttagaaataaatcttctcaaataattcgccttacctagcaacttttgaacttccttcttgcgtgtcagtgctttgaaatcacgaatcttctctatcttcttaggatcaatctcgactcatctctcatgcaccatgaatcctaagaacctcaccgccgacacaccaaaagcacatttaagtgggttcatcttcaaaccagaccggcgcatcctttcaaaagctaacctcaaatcggctatatgtccctccataccattcgatttgacaacaatatcatcaatatagatttctaagataatacctaacaaatcatggaagatcaaattcattgccctttgatatgttgcaccgacgttcttcgatcaaaagtcatgacaacccactcaagcaaaccaacaaatcctgggcacctaaaagccgtcttgtacatatcctcctccgccataaagatttgattgtagccggcattaccatccaaaaagctaatcaccttatgacccgagacaccattgatcatcatgtcggctataggcataggatattcatctttgggagtagctttatttaaatctctaaagtctttgcaaactctaatcttacaactcccctttttttccaccgggactatgctagaaacccattccgcataacaacgtggcctaataaacccatccttcaacaaccgatcaatctcctctttgactcggtcatatagcaaaggattaaaacgacgaggtggttgttaataaggcctaaaacctggtttgattggaagccgatgctcaacaagctcacggctaagacccgggatctcatgatactcccatgcaaagcaatccacatactccttaagtagctcgattattttaaccttataatcggctctcaaatttttatttataaatgtcggccttggcttaattccatcacctatgtctacttcctccaatggattggccgatgtaaaccctttaccaagcttctccacttcatcaaaatcttcaatagtttcaccaatatcgttctttgtagaccgatattcttgcaccctcttttgcaacaactctaaattagcttctttactcattatacaaattgatatggcctagccgtgctatacaagccggctttacagagatgcaagaatagctagagagatccatccccgacaagcattgaatattcccatgacgccactcaaaagtagcatcggtcattgcaacctcggccgatgtatcgcttgaacaatctcaacatcattgatcgtctcattgaattaaacattgatgcaaggtagaaggaacaccacaattggcatggattccaccacgacccaaaataacattgtagttacctttcacatcaacaatgaaaaaaacggttggtagggtcttgtttccacggtaaactccgccgaaaaaatacccttcgcctcggtggttcaccattgaagccaatgaaaatcatgttagtttttttcaacttattattttcacgcccattttttgaacaacgagtacggcatcaaattcacggcggcacctccatccaatagcatcctaaagacctgcttcccatcaacatgaccttttaaataaaaagggttcaagggacggttttatttaatggggtttttcaaaaccggaatcttaaggacttagtc

SEQ ID NO: 91580 - DNA, 1686 bp, Oryza sativa
ccggtcagatcggcaaaaggcaccggtcagaccggccagatgcgccggtccgaccgatattaggtcggcggtcagaccggcctgaggcgccagtcagaccgtcgttgggtcggcggtcagaccggccgtatgtctaccgccagaccggctagagggcctggtcagaccggccgactatgataagctggtctcggcttcggatttgttgcttgaggactccccaacttcatctccagaaggtattggcacatcatgagaccccactttgatggtaatcaccttaacacgctttccttccctcttttcttccttaacccgatttttaccataaaaccggccattgtttggtgaagacaaacgctcatgaattggcctccttggtcctccccacccttggttgaattgcattggaggcatatgattgaacattggcggtgttgtcccccatggcatgtagtaaggataaggataacccggcggcggcattgggtaaggcccccatgacatgtcaagtgaatgatgatatggaggtgattgcgaccgtcttgatgagtgaccaaatcgctccctaggaggtaatcttggtcttttccctttattgcgagctctctcaccaccttgcttctcatacttctccaaaagcatatcgaaggtcaccttagtcttcttaggagctttagaagttgagacttcgctcctattctctttccacacaccaaagactggattctttggcaccatcatctttggcctagttcaccaatgatcactcattttcccttagtagattcggcttgctccggccgaatcaacaccttcttatcattgaaattaattgtattcaccagaaaaggatcatgattaagcttcatcttggaaccatcggtgaacttcaatcgtccttcatctatggccgattgaacctatcatcgaaacacattgcaatcattagtagaatgagagtgagaatcatgccatttacaataagcacgatgttggtatttaatacggtcacagataaaatccgcaagcgcacggatataccaatgtagcacttcccctacggagtattccaagggtatcgaatccaagggaacgtgtgggggcaaattttcttccaggttatcccaggatcccacgcaaaagataggttgggatagagaaggattactagtgagaaggagaaacagtatctagggaaagcttaactttaatcctaatgcaatactttaaggcactggcacccgctgttcccagatgtcactctactacgtatccagacagggaggacttaagtgatctcgagggctgtcaccacctctacacccacctaaaacgtactgtgggatacacagcaattacgggataacaattacctaaacaccacgtctaagcaattaatatttacttcagtgtttataactcaccaaagcaatcactatattttagttgattatagtgaacaataatcacgtatgctatttaggaattaaccaagagataattctcacaagataaatctaaattactcaagaagaatattatattaaattcagagtaataaatagaataaaagaaataggagaaaattaccgacaactccggaattcttctgactccttttactctactctcttcctattctagtatacaatatagtacaatagagcctcttataatttatct

SEQ ID NO: 91581 - DNA, 4039 bp, Oryza sativa
  unsure (1)..(4039): unsure at all n locations
aggcctgatggtacaatcgaaaagtacaaggcaaggcttgtggccaagggttatacccaaaaggaaggcgaggatttcttcgacacatattcaccagttgctcgcttgactacgattcgagtactacttgctctggcagcctctcatggtcttctcgtccatcagatggacgttaagacagctttcctaaacggagagctggaggaggagatctatatggatcaaccagacgggtatgtactagaaggtcaggagggaatggtgtgtaaactattgaaatccttgtatggcctcaagcaagcacctaagcaatggcatgagaagtttgacaccacgcttacagctgcaggctttgttgtgaacgaagctgacaaatgtgtatactatcgctatggtgggggagaaggggtgatcttgtgcttgtatgtcgatgacatactgatctttgggaccagtcttaatgtgattgaggaggtcaaagactatctgtccaagagttttgaaatgaaggatttgggagaggctgatgttattcttaacatcaaattacaaagaggagatgagggtgggattacacttgtgcaatcccactacgtggacaaggttttgagtcgctttggatatagtgactgcaagccagctcctactccttatgatcccagcgtgctattaaggaaaaatcgaagaatagcaagggatcaactgagatactctcaaatcattggttcattgatgtacttggctagcgcaacgaggcctgacatctcatttgctgtaagcaagctgagctggtttgtctcaaatccgggagatgatcattggcaggctctggaaagagtaatgcgctatctaaagggcactatgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctggcagaccagtttaccaaggggctaccacgtaatgtgatagacagtgcatcgagggaaatgggcttgatacccacctaaggttgcataatagtggaaacctgtccattgtgatcggagatcccgtgaatttggatggtgaaacaaactattgtgtgactgagagaagagacccttgaaaagggctcatttccatgatgtgcttctcttctttcctgcatggtaggatggcttatgtcttaatgtgatccgagtggcttttccaagcagagatgttgacctgcagaacatctcagaaggaacacacctatatgagtttgactgctagtcacagtctatgaggtttgggcaatctctagatactcatgaaaggcctggagtttgacttatatgctccaaacagaggggatgcgaacggcagcccagtaccagtcaaggttctgagtgaaacctgatcacacaaaacttacaattcaaggcatagtccattgttcagttgtggtctgatgtagctcatttcctaggtggaagttcaacttaacagtctccaccaaaaccctggtatatcaaacaggcacaacattgagaacatttcttatgagccttgaaatttggtggggattgttagaataattgggctaggcccaatttataataattaaatctcaaaggcccataataaatgttgaggataataataccacctcaggatttaagcgagaaatatctcaacctaaatagggagttattagaggctcctgttgaccagttgaggtaggggtcggaatgccacacgcgcgcgcgcgcgccgggccgggccgtgggcgtgggcgagggcgagggcgaggcgaggcgtggcgtggctggctggcggtgtgcgtgcgtcacgtcacaatcctttgccagccactaacccacgttcccacgattccctccgcaacagcgcgtccacgttctttctcctgatagataangaggccgcgagtccgatccgacttcttagcttttttcccggtgttagtttctccttctccgcgcctgagttgctccgcttccccgcttctgatctcttgcgcgcacgagagattggaagaagcagtgcctccgaaaccacacctttgcctgagatctgcaccgggtaggcgggagatcaggtttttggggagtgcctcctgcacgactgctcatcgccatgtctggagttgctgctgccgccgctaccggtggaggtggtacgccgccgccgacaggagctggtgcgccgccgccgacaggagctggtgcgccaggaggaggtgccgtgaacgactacaacaacggaggcaattctgcctcaccatccagcggagggccattctcggggtataatcttctcctcctgctactgctgttagcgctattcctgttcccattgttagcgctatactgtgtgcgctatgttcttgttcctgttctacatgatgcctctagcatgttatcgcgttactggtatgttcctgtttctgacattcatgatgcgcatagtatgctactggttatgttaagatcaccctacactgcttatgccatgatcattgtttcaatttcttggattaaaatatgccgaataatgactatatttccaacacaacctagttcatctgcataccgcttcgcttcttctttctcccatgtgtcctgttcatcttcttcccagcgccgagcacatgtcgccatgaactccaagacgccggctgatgcttgaggatacctagttgatattttttttgcaaaaattggaggataggctagagcctgatggagcctacctgctagaatcgccactggccgtcacctttagggtttgggttttgcttattctgtcaagaacagtttcgccgctagatcggtttgtaaggcccgaacttgtgagcttaatcattcatctgcaattttggttgtattcttctttgttcctatttgtgttctttgattcgcaaatagggattagccttctcggcaaggtcgtccgcgtttcaacacgggtgataaccagaggagacatggtgctgcgattgcagggctcaagagcgtgttcgttcaagaagccgaatcgatttgtgtcgcgactccacccaaatcattgattatcagaaccttccgaaagatcgaaccctagtccacgtcactttccacgcaaatagaacaattgtgctattggaatagcgatagcagaactacaatccgcatagttcagaaattcaagtgcataaggaaagatgtaatctcaccatttgtgagcacatagttagaaaataaaacttttcttgctttacccgcatgcaggccagtcatttgttatcagaatagaatgcatcaagaattcgacatacataacatgtataagaataagtgattaatagcctgtaacatgaaatatacgatgatacccagttgcccattgcagataccaaaacacataccccatggcagcttgtttaatataactgatttccaacgagacagacaaacacaagaaaatctttgttagcaatactaatggacgtgcagtgaaatagagggatttgcagtcttcaagcaggtaagagtgtggggtgcagtttgcttcaatccacattatgctacttgcaagattgcctaagaagaattcagactacatgctgaaaataataactcactgattcatcaggtcaatacattaaaatactgatggatcattaagtctacataactagctaataaa

SEQ ID NO: 91582 - DNA, 3082 bp, Oryza sativa
cccaactgacatgtgggctctcagtcaaattagtataaatgccaccgtctaggattgataaacttgtaatgcttgtattgtagaacttggtacaactgtaccctatctttaaactgtgataatatctctctgcttgtagagatttgtggttgaaggattgaactgtaagcctgtgatgggtaaacggatatgcccgcgagcacatggcgcccgcgggcgatgggcatagacaatgttccttccacgtcatgtagtaacgggcatgcccgcgggcacgagcatgggtagtcactacccgtgcccgtcgtgcctgccatccctaaatgcaatgataatgaaggggtggatcggacgctcaatgttcaaacttgagagcccagaaaataatttatattgcggcgaagcccagaagcttgtctatttttgaaaatgaataagtccacttgccgtccctcatctttatgtcgagtttaattaacatcccaaaactgcaataccataaatcttcacctccccccaaaaaaaaaataaaactttacaaaaccgttcaagtgaggtcccttggcagtatggatatttgttttggatgacgtggcatcttagtcatcggaaaaaaaagttaaaaagaacatatggggccggcccacatgtaagtgccatatcaccttcctttgccttctttccctctcttttcaccaacgggtagcacgcagtgggaatgggcttcagctccatgctgttatccatgcttgcctctgtcacgacgaactcccaacggaaatcggcttcggctccatgatgttggagctcatcagcgcggattccatcggctccgacaccggcacaaccatcgtgcgcaacttcttcggcatggcggctctacgtctcgctaatttttagagaaaaggtcagagacctggcttttacttgaaagccacatcggcggtgtcttttaacagctggggatgccagcgaaccatacaagagcaaaacaagactagtaagcttaaccacagcaaggagcttaggagcagaccaaaagctgaacaaacacttgacaacaacctctaaagccaacacaccaacagctaacgctaaccaactaacccacacctaatctcggatgccgtaggcctgtcatcacctttatttcttctgtcatagcttctagcttgatctcatcgttaggtttgaagagcctcctccactgcaaaagattagagataatttgaaagggcaaagttagtgtcacgcccagaaatttactagtaatttccgaactagtttgttgtcacgctcagaaattcactagtaatttccgaacttatttgtgcataaaatcctcgtccaggaatcagccgaggtacacaaactgacaatttaatatacagaatcatcaataatagtgttacatactttcaaaagaaaagaaaactgcaacggaattacggtctagcgaagctccggctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaacagcatttagcaaaacattaagaggagtaaaacagtggagtaattaatcagaaattttaatcaacactgaacagcacacccatgctgcacaggcccaaccatcctgaacaaccatacccggctgcacagatctatctccaaaccaggaatgtaccattccaaactaggagctaaattaattaccatcaattaccacattattattaatgagtagtgtgggactaatcacgaaagacattgttcgacccgcccataaccgcgggcacggctattcgaatagttttactctggccagaggtgtactactgtacccacaagacacatctccacaatatgtcaccatatcatcatgtgcccatgctgaacatgtcaccatttgtgtagttgtgacaagacccctcgcataacttaacccaaagcagtgcaccgttcctggattgtagtcaccccctcaaaaaccagaggcatggactccccagcgacccccgtgggcttatctccgccacttctcagtctggtgctccgcaatgagccttgttatacaaagtgtccagctgttgcccattctggcttgtggttggcacggttaatgtttcacaaccgaaactcgtgaaccggtccttaattgtcatgagcacgaccatcaaaaccatgtgctcacaacacaccattatcaagttttagttggcacattaattaattaaccaatcacgattgatcatcgtgagctatcattaaatatccatcattaagtaatagtgaaacattagttatcccaattgtgtgctaatgtttctaagcatggctaagtaattatgtctaacatctagctgaacaaatatataaagctcaactagtcaaattataataacccaaggtatcaaggaatagagtaatcaatgcaaacagaccataacaaaggaataagttcacaccacccgattgtaacactagaaatatgggccttcaaaaactttttaataaattgcatcatgccgattttatttgcctattttattggaatttggtttcaaagtttaccgatcgcgaataaggaataattaattaggaataaacactaaaattaaattggcaaaataactaattaaaataaagattaggtgagtttggaaataaataaaatattatcgcgaccatattggtaacaattgaatttaggtgcgatggaataagaattaaccctaattaaattcgaataaattaaatataaaaataaaaataaaatatgggtagtgataatctaagttagagcaacacaaatattgtgtaaacttgatttgtgcaaaaattagaaatattaggacaagatttgaataggaaaaacaaccaaattggaaaaataggaaaagtcactgttcattgccccataggtgttcgcttgaggtcactagccctaaccccccccc

SEQ ID NO: 91583 - DNA, 2406 bp, Oryza sativa
acttctcatctttcttaagcaaatgagtcatgggtcgggcgattctggagaagttttcgatgaatcggcggtaataacctgcaagtccaagaaaacttcgaatctgcgacacggtcttcggcggggtccatttggtaactgactccacgtttgatggatcaactgccacaccctgagctgtaatgacatggcccagaaatttgacttccgtcaaccagaagtcacacttgctgaacttggcgtatagctggtgctcctttaacttctcgagtactagacggagatgttgttcatgttcttcttcggacgttgaatagataagaatgtcgtcgatgaacaccacaacaaacttgtccagaaattccattaacactttgttcatcagattcatgaagaatgcgggtgcgttggtaagtccgaacgacataaccgtgcactcatatagcccgtaccgagtggtgaaggccgtcttcggaatatcctcctcccgaattctcaactggtggtagcctgatcgcaggtctatcttagaaaacactttagctcctttcagttgatcaaacaaatcatcgattcgcggcaaaggatatttgttcttgatggtgacctcgttgagtgcgcgataatcaacgcacatcctcttcgtcttatcctttttctctacaaaaatgaccggagcaccccaaggtgaagtacttggtcgaatgtaccctttctgcagctgctcatcaacctgcttcttgacctcggctaattcgttggccgccattctgtacggtctcttgtaaattggggcggttcccggtgccaagtcaatccggaatcaatctctctcttgggtggcatggtagtgaggtcttcgaggaacacttccggatactcgcagactatgggtatatcttccaatttcctcaaattcttctccacggtgtccactgggatttctgcttcaatctgattcaaagagaccccttgctttggtgagactagtgatttgtacaccacggtttctcccttctcgttggtcaaggtgactgtgcgattcgcacaatcgatgacccccttaaacttggtcagccaatccatcccaagaatgacatctaggtctttggattcgagaagaatgaggttggctagaaatggtgatctttgaatttctattgttatagaagggctgaattgaaccgaagtggagctattccctggggtatgaacccgcatcggtgtgctaagttcctctcttattaacccatgcatcccaacaaacttctttgaaatgaacgaatgcgttgcaccagaatcaaaaagtactgttgcagggattgagttaatagaaaacgtacccagtacaacctctggtgctgcttgtgcctcctccgcagatgcgtggttgacacgagcctggataaaccttggcccggcacgcctaggcttcgggcatttgtcagcgaagtggccaagctcaccacagttgaagcaggaccctggttttgctccagtctccttcttggcttgcgcgggcgggcctgactgtgccggtgccattggtgggcgtggagctgcaccgcggttggactgacctccatggtggttctgactgccactggcgccctggggaaagttgctagggttgaacgggcggtgctgaccaacgatcatggtggtaggtccaccctgctgcctgggagcgaagcgcggcctttggtgacttccctgaggtgccctgaactgtgcggctttctttttcctgtccatcttggtggcgtggatctctgaccgatggcttgtcaacaacttttaaacgtcagcgtagtccccaaatttcaagtgggtgggcaacttcgtcttccaaacccgccatgaacttttcctgcttttgggcgtcggtgcggacattctctggtgcatatcgcgcgaggcgattgaactcgtggaggtactctgtcacagtcctgttgcctgatggagtgcccggaattccctcttcttttgtgccacaaccccatctggcacctgcgccttcctgaagctacggcagaactctacccaagtgacttcagtacctggtgggcgggtggccatgtgattgtcccaccaagctgacgcgggaccttgaagctggtgtgtggcgaaagcaaccttctcctgatcattgcattgcaggagattcagcttcttctctatggcatggagccagtcattcgcctccatagggttggtggtgctggagaaggtgggtggcctgacacgtagaaactctggcaacttggactgagggggagggggaccaaactgttgatgctgctgttcggcgtgctgcagcatccgctggtgcatctgctggtgctggtgctgcatcatggctgccatcatctgggtctgatgtgccattacttggactagcgt

SEQ ID NO: 91584 - DNA, 699 bp, Oryza sativa
ttgatggacacaggaagccgaagagcattcattgcactcaagtgctacctatcaaatccacctgtacttgttgccccccaacctaatgaagaattatttctctatattgccgccacgccatatttcgttagcactgtcattgttgtcgagagagagaaggtgcaacgaccagtctactatgtcagcgaagctctccacgacgcaaagacaagatatccatagatccaaaaactgctttgcgcggtaatcatgacatcaagaaagctatgccactactttcaagcccacagggtcacagttgtatcctccttccctctcggtgaagtagtgagaaacaaagacgttgtcggccgcattgcgaaatgggtagtcgagctaagccagtttgatgcccgctttgcgccacgaacactcatcaagtcccaggtacttgccgacttcgtagccgattggactatgcctgataacaggtcagacaaccaaatcgacaacgaaacgtggacaatggcgtccgacggcgcactcaacagccaaggagcaggggcaggatccatcttgacatcacctttgggagatcaatccaagcatgcaatccacctcaactttacggcgaccaataacatagccgagtacgaaagactactcgccaggataagaccgcagctgcactcgactgatcgcgataaggggactctgaac

SEQ ID NO: 91585 - DNA, 700 bp, Oryza sativa
ggcacaaagcggacatcaaactggcttagctcgactacccatttcgcaatgcggccgacaacgtctttgtttctcactacttcaccgagagggaaggaggatacaactgtgaccctgtgggcttgaaagtagtggcatagctttcttgatgtcatgattaccgcgcaaagcagtttttggatctatggatatcttgtctttgcgtcgtggagagcttcgctgacatagtagactggtcgttgcaccttctctctctcgacaacaatgacagtgctaacgaaatatggcgtggcggcaatatagagaaataattcttcattaggttggggggcaacaagtacaggtggatttgataggtagcacttgagtgcaatgaatgcctcttcggcttcctgtgtccatcaaaatttgtcttgctttttcagcagagcgaagaaaggttgtcctcaccctcccatcctagcgacgaacctacgtagtgccaccatgcatccggttaacttctgtacttccttgagtcttgtaggcgacttcatgttcttgattgccttgatcttctcgggatttgcttctattcctctaccagagacgaggaagccgagtagcttgcccgatggtactccgaacgtgcacttctctggattgagcatgaggcgatatcgtcggaggttgttatacgtttcccgcagatcgtcaatca

SEQ ID NO: 91586 - DNA, 607 bp, Oryza sativa
cccttgcagtggcagacatgttgacttcatcggctgcccgtacgtcctcacggagcgtgtgggagggcatcaccgggacgcacgacttcgaggtggtcggctactcgttgatggacggcttcggcgccggaaggcacgtctgctccggcgacttcagcgtcgccggccatgactggtatgtgcgttctaccccgatggcctcgaccaggattccgccggctacgcgtcggcctgcctcgcctaccgcggcaaggagaggctcgtgagagccaagtacagcctgagcttggtggccagggacggcagggcgtcgccgctcgccggcgacacgctgcggtcgcactacttcacgccgacgagccgcagcgccgacgtcctcaagttcgtcgagaaatccaacctgtcgtcgtcgccgtcgtcgtcgtcgtactcgtgcctcgacgacgacaccctgaccatacggtgcgtggtcaccgtggtcaccggcccgcgcgtggtgagcgtcgcgccggccaaggagagggcccccgcgtcacggtgccgccgccgagccttcacgagcacctggcgcggatgctgcgcgacgggcggggctcggacgtggcgt

SEQ ID NO: 91587 - DNA, 8880 bp, Oryza sativa
caggaccgaagcacatcccaaggttttacatggagcacatgcgaaagttttcagacatgcatctccgatcggcaaatccaaataatcaacgtagaaaggacttaaatttcggccataacagaagtgcatatgcacacaatgcggacgtactctgctgagttttcctaccaatgagctgctgagatggtcaatgtcactctcatcggctcacagcctgacacacataccagaagggactgcagcaacgatcacttcccttgtcgttgctagagaacggaagggagttgtacaggactggaatgcgatcagctaacatgaactggaccatactcagatcgacgcagttcaccttgaattccccatgaatcccattcttaacttaagggcatgctatcacttctcgtcgtcgaaccaccgccggtacgctgatttctcgtagaaatgaccagggttcgaattttgagtattgagcgatcagcgtgacttggaatattgagtgatcgagtgtgacttggaacttagtgctattcattcaattgtattacaatgtgttgaatagtttcatattagttgtggaagagtaagagagttaatatatagaacaattttacggttcttgaggaggtaccactttttctattgtaaatttggtacttcttggtacctaagtactatgaggtaccaaatcttacactaaatttttggtacctcatagtacctcattaaggactataaaatgtaaaatcaaaggtgtttttgattattattctgtgatgaacaattggcattggagattattggttttgatatttggaatttatttacgaagtggttttggagatgattgaatttacaggtgaattacaggtgctgtcattttatgtgaccggtcagaccgggaattgtgtgctggtcagaccggcggtatgcgcgcggtcagaccggccagcccgcggtctgaccggctgactctgtgtcggtttcggtttcgggttgtttgtttggatatccgtgattatttcatgattatggcttctagatggatactatacatatgtaatactgttgtttgctactaatgagtcaagttggagatagcttgttctcggaatatggtttctttgtttatttcatgtgtaggtgactcgatgcctcgggagagtatttgcggtgatggaccgggagtcggcttggggataagacgacgttcgtggtggtcagagatcatgcgggatacttaggctagagttgatgcacgtggttgatggagattccatatggcatacgatggaggtattgtgtgcgtatgggatgcggagttaaatttggaaggagtccaactttggtacgattggttatgtaaagtttgtttcttgtactagagggtttcctaaggtatttagaactctaagtatgagtttggttcgtggctttaggctgcctaccttgggtataaatagtgggggagcgtgaggcttcccggtatcgcttttgagagcaattgagttgagttttgagttagggtttcgagtttagttgaaatttttgtaaggagtgctgttggtgcactttgtaaacacagatagaatcaataaagtcgtcatccactttaagagttcttcgatttgtgtttcactgagtttcggcggtccaaccggcgatataccgacggcaagacggcggtcagaccggcgggagcaaggcggtcagactggcggaggtagcaggtgcggcaggcgacttcggcggtcagaccggttgatctataccggtcagactggcggcatccgagcggtcagaccggcggcatccgagcggtcagaccggcatatcaatctcggtcagaccgacttccgtcgaattcgagagtaacttttatttccgctaaaagttttcggtttttgggtataccaaccattcacccccctctggttggcttagttattgtgattcgatcctacataaaattgctctaatatataagtggggggacctctcatctcattggctagtttttaggatgagaaaaaccttttacgatccttcaattggtatcagagactggctagttcaatatctctggtccaagggacacagtatgtgaaggcccgatggaccgtgggtgcctgcgagatccgtatacctaaggaactgttagtgtacggtgaacagctgagggacaccaatgtgtctcacctcattggctagcttttagggtggaaaaatctctttacgatcttacacaatgtagtgttcatcgttgatgtgaagtgctgagaacttaagattgcttgataatatggaatgtgtctctttggtgattgtcagtttctcgttgacaaatcacaagtgcaactcattatctagtatatgtttcaactgtacgcatttttcatttataggttcaacaagcaacatataaaacgacttggttagacattttttggagggttaattaaaagggagatgaattgcatctcggcctgtgccaaagttcttctaattaaacaaatagaataaagtcacacgacactaaccccatatagagtaaattaggccccatggggattaagaagaaaaacgaattagctaggcaaagtatgcacctatatacttcctcctgtgcttgggagttatggtgtctattgattgcttgccatctaacggtctgtgataaaaggtactccctccatccctaaatgtttaacaccgttgacttttttaaacatgtttaaccgttcgtcttattttaaaaaaattaagtaattattaattgtttttatatcatttgattcactgttaaatatatttttgtgtatacatatagttttacatattttacaaaagtttttgaataagacaaatggtcaaacatatttaaaaaagtcaacgacgtcaaacatttagggaaggaagaagtatgtctcagaaggtattaaaaaagtgagttaggtattaactcgatgtttaggtggaaggttagattagtaactttactttcatacatattagaggtggggttctaattaatcagtaaaagaattaggatcgataagccctgcttgctgataagaacatctttcttcagcaagtgccgcacggacaaaacaccaccaccactgatgatccacaatgaccaagaattttgtatacatacaaagattcatcaaactagttgatcgagccatatttgtctttgtgtatggacgaaagaggattatatgtgtttctttggactctaaatttagatgagaacctgaagaattaattagggaaattggattttggacaagtgttaagatgtgaacgacagaatcgaagataagtaacaaaccggatgcaaaaaaagagagagactgttacatgtaaaaggaattaattatcgacttttataatatattgttttctattcctaagttgtgcttaactgatcaatggtgggtgattaagtagtgagggaggtacctccatctggtacatctcaagcaccttaaaaggtttcggccgtcgttttggccggaagtggacaagcgttgggcatgtggactcggtcgatcgaggtgagactcacaatccatgacaggtagcgacagcaccaaccacttcctagcctatgcacccaaaatgggatgggggcagtgtagcacaacctttgactatacaaccacattgtcatcaaatacagtgagccgtgctgctacaattggatcctattcacatcacggaagttcttctcgaattccccatgcatcccattctcagtgtatatctagtatttggtttgtcgaaccagcaacacatgttctaactctccttatcaccgatttctagtagtcagtggaagagatggtcaaggtttactgattttggagtgcgggtttgtctagagaagtagcggttatcctatttataggcactaggcacttggcgaggtaaacgtagagtgatctttactccctccagttttataattcttgacatattgaacaatgacacgatctttaaaatatattttgactatatttttattataatatataatacaataaaaatatttttacttattgtagcactttgtaaaataaatcgatatattgttctagcacttgacctcaaccttatttaaaacgtcaagaattatgaaaccgaagggaatagttattagcagttcaacactacactaccataccatcttattggagaaaagaaagtgtaacattagactccggatatttagtaacacgcatttgactcgtcacaatactgatgtacccaacaaagtataactatttcataacaacctaataggaggtggaaaaattttcatacatcctttgcccaaaattggatgctaccgtcctagcagtataagtggttaaaaaaaaagcttggctcaaaatccatgacccaagcatacataacacattataagtggtcaagaaatgagtttgactcaaaatccattgtccaaatatatactatacatttcttagcgaacaaatgttccatgtgaaaatgatataattggagacaagattacatcgtctccgccccacgaaagctcaacggactcactcttgtatggttggcaaatggcaaactaatgtagtggccattaaggcccactgaatctgcatcagggtttacaaaaccacgcgattatcacgtgtggtaaccttctcagttgttaaaactgtggtaatcctcgaggtaaccactgtttttatgataaccgcgcgggtaccgtgataaccgctttactatggggtgatggtaacctcacctaaaacgctttggtgaaccctgatctggatcgccacaattgcagtgatccaaactggcctattgtgaaatggatcacagaattagtttgggcccacttgcccatagaagtaattgccatttgaagatagttaaactagtcattccatttttatatataaaaaaaatagtcagatctgatgctcgccttgaggaagccgagattgacggggagttgccggagctccagcgagtggtgtcaccaccggcggattttcttcgccgctgtatctctagaacatcattttctatccattatcgttgaccgtctcgacgctgttgcgcatcatttgcatcggagggctactgtctattgtggctcccaatcgcgttctaaattttggaaactagatgtccctggtacgaacccatttgttccgatgtgtctttacatatgaagatagtaacagagtcagtgcttgtataccatttgaggtttccacctattttttaaagatatatacctcttcatacttaagatctctttttataaacggagttaccaaaacaaatgttaaaggttagaataagattgaaaactcatttttttaaatatcctttaatttttatttcatttttaaagcacaagtatatatgtcggtcaggaggtatatacctcataactaacaatatgtggcatatatacctctatgtactttccaagaataaaaaaagcttcatcattactaatcataaatttatcttctaatcagtttagtcaatttatttttttatcactaaaataataaggagatatatatacctcttcaaagatggaagaataccttatatcagtttccaacaagtttcgaatttttatttacaagtgcataatcgaagcacatcccaattaagatattcactgtcgaaatgtttttttttatcctcacaacaaatctgaggatcaacccaaatttcgagaggatcacatatgtgtgtcttgcgacgatgatttgctgaacacgatctttttaagcgccggcgtggtgccctgatgccgcgccaccacatgcacggctgcggatgcgggtttgcctatgcccaattctttttctgatcaactccaaacttcaactttttcgttttttcgttagcatacttttcaaactgttaaacaatatatttttgacaaaattattatggaaatagatgcacaatggagacacgaattttacgtggaaaatccttgcggaaaaaaaccacgggcgccgaccggcaatgatcactatagaggagttgattataaacatagggaaatcacaatgggaacgtcaccccttcccgtatgacttacaagagtatatataggggataaaagaaaggcacctaatagggctcctactagaaaactaatccgaatatattgtggacccaaaattcggatcacatatttaacaatctccaccttgagatgaatttcctcttgtagcataaaaatatcaatcaccaaaaatacctcatgtaggtaaaatcaccgcgcgccaaatagtctctaggactatactgtgcacccaccaagcttgagcaaagctcaaacttagtagtaggaactggctttgtcatcatatcagctgggttatcatgagtacttatcttgcatactttgacatcaccttcagcaatcacacctcgaataaagtgatatctcacatcaatgtgctttgttctctcatggaacatctgatcctttgtaaagcatattgcactttgactatcacaaaatatattaatgcaagacgtaactccacaaagctcagtgtacaaacctctaagccaaatagcttctttacaagcttcagaaatagccatatactctacttcagtagtagataaggcaacagttgcttgcaaacttgccttccaactagcagcacatcgtccaatagtgaatacataacctgtgagcgatcttctcctatccagatctccagcaaaatctgaatccacataaccagcaagtccatctctagatctcccaaactgcaaacaagcgctagatgtaccacgtaggtatttgaaaatccattgaacaactttccaatgctctttgccaggattagccatgtatctactgacaacactcaatgcatgtgataagtcaagacgagaacataccatagcatacataagtgaaccaactacacttaaataaggaactctagacatgtactcaatatcataatctgactgtggacataaatctgaagataatctgaaatgtgcagctaaaggagtactcactggttttgcatcatgcatattgaaacgacgaagaactttttcaatataacctttctgactaagatataacttgccagaatgtctttctctagtaatttccataccgagaattttctttgctgcacccaaatccttcatctcaaattcactactcaattgtgccttcaacttttctatctctgatttatcttttgcagcaatcaacatatcatcgacataaagaagcaaatatatagatgaaccatcaacaactttaagataaacacagctatcataattggatcttctaaacttctgagaaaacatgaaagagtcaaatctcttataccactgtctaggtgactgctttaacccataaagagatttctttaacctatatactaggttctcttttccaggaacaacaaaaccttcaggttgctccatataaatgtcctcttctaactccccatgtaaaaatgcagtcttaacatccatttgctctagttcataatcatgcactgcaacaatactgagtaaagtgcgaattgaactatgcttcaaaacaggggaaaagacatcattgaaatcaatacctggaatctggctataacctttagcaactaaccttgctttgtaccttgcctcatcacttggagacatacctttctttcttttgaagatccacttacaacggataggtttcttctcctttggcaacttcaccaattcccaagtatgattcttttcaagtgactccatctcatcatgcatagcagttatccatctattgcaaccatcagaaacaatagcctcagaatatgtagaaggttcggcattaccttcaatttcttctgccacgctcaaagcataagcaactatgttcgcttcttcaatatatcttcgaggaggtttaatatttcttttgggcttatcttttgcaatagaacgttttggagactgctgaacagcagaagaatctgaatcttcaataacagatgcatcttggttaatagcaacatcttctttttctggtgcatgccctgaactgatcaagtgctccacctgcacacttgctttctcctgactctcaacaggaacattagtagaaggtttgtcatgtaacataactgattcatggaagacaacatttctactaatcacaacctttttggttttaggacaccataacttatagtctttcacaccagacggataaccaagaaaaatgcacttaatagctctaggctccaatttaccattatcaacatgagcataagcagtacaaccaaatactcttaagtctgaataatttgctggggaaccagaccatacctcaattggagtcttcttatcaatggtatatctgggtgatcgattgataagataacaagcagtggaaacagcttccgcccaaaactatttaggcaaaccttcattagacaacatacaacaggcctttgatataattatcctgttcatacgctcagctacgccattttgttgaggtgtgtgaggaacagtgtagtgacgcacaatgccttcagacttgcaatatgatttaaatatcatagaacagaactccatcccattgtcagtacgaaggattttcacctttctttcagtttgtctttcaaccatagttttccactctttaaacacatcaaaagcttgatatttgtgcttcaagaaataaggccaaacttttcgcgaataatcatcaacgatagtcatcatgtaacgagcacctccaaaggatgtcttacgagcaggccccataaatcagaatgcacataatcccagaatactttcagtagtatgtgtagatgtgttgaactt

SEQ ID NO: 91588 - DNA, 657 bp, Oryza sativa
attcattggagatatcatggttgtcttttgtatcgctcaaccagtatatagtgcaagtgaggcactgttatccaaattgaacttggatattcgtctgttttaaaaaataaaaactactcagctacatttcacacattagataatgtgaagcttcatttcgtggcatgcatctttgttggcaaccctatacattgcgtagtcatttaggcatatgaagctctcctgttaaccgtaatgattaatatttgacattatcatccctctaaaaaactcatcctagttatatttactgcaaatacaaattgccctaactgcttttagctgatctactatttgctttccgctgaaggatgtaatgcatggagcacctgttatgccccaaggatggtctcttcctgcaccattgaactcacatcaagctagcctccagaagttccaaggtaaaaatcgtactcattgtcgactgcttcctttattttaatggaaggtattaaaatgtttattttatttattcattacactaatcaaaacattttacttcgaaactcttcaggcacagcccctgtatatgtagccccacctatcatggcaactgggaacctgccatttgtggtaccaagccctgcaccgcttgtgcaggcattccaagccgttcgt

SEQ ID NO: 91589 - DNA, 668 bp, Oryza sativa
  unsure (1)..(668): unsure at all n locations
cttacatactttcgctctttgctactgtcttaggacaccctggcggtaagttgcggcggcatggtttggttaagaagagcctggatggagttgctaggatgatactggaggataaggagaagatgggcgacgtgtatctggagctgaacagtggtgagttccggaggcagaatgctgcgcttgatttgctggctgcaattgttaagcgtggtggaaggttggcgtcggagattgctaagagctttgatttcaagatggctgttttgccgcagctctcgggggtgcggaagaagagaggtggcagagatggggggaatcggaagaagggaactgatttcggatccacaaggcgatcgtttgttgggtttgccatgtcattcttggaggttgggaacccgaggatgctaagatggatccttcaacaaagggagctctattcaggggttcttcgtgggatcggagacgatgatactgataccattgtctatatcctctcaacgttgcggaataatgtcttggtagatgagtcacttgtcccaccagggcttcggagtgtccttttttgtagtgccacactggaacaactgagcttgatatcttggaatttggatgcgggggaggcagctgacattgctcatgaggtgttatcatggngggactgatccaaa

SEQ ID NO: 91590 - DNA, 670 bp, Oryza sativa
  unsure (1)..(670): unsure at all n locations
tgccacaaacccaatgcaagcctgtctcagctgcgagcagtgatgttgttctgctaaaacaagagtggttgccactgtttccacatcaatggtttcgctgagccgcctctcacaaatcagcctcagcctgtccactccgtaccgatccgcggcaactagcaagtgctgcattgctgcagccttgccatctctgcagctatctggcagcctatctgtgtaaatgaagtgaagaagagcctcaaaaacctcaggctccatgtcgtcgatcttgatacattgcgtgccattttctttcatcggaccgaaaagctcggccttgaacaccggggaccggaaggcaagaacacatttatgagcacggaactcttggccacccacggtgaatgtcacatctgaaccttcaccatcctggagcatgttctcaaaatcggtatgcaggttggacggtgggacaacaacagaattgacctcaacatccttggtgtgggattccctgacgacggtcagcaagcacctgatggtcaggcagtcgttgtggaggaacggcgagctctgcagcttcgatttctcggcgaatttgatgaatccccaattgtcactcgccggggagaaggtgtgcttcatgtangaatnggtcacctgcgacaatttgccgtccttgccgagcaga

SEQ ID NO: 91591 - DNA, 1235 bp, Oryza sativa
ttctggctcatcatttaacaaaagactctggccttctgttggggttatcctctgtaatctcatctcatgtcgaagggctggacagtgtaaaaaactcctattcttctacagtaattgggtcagcgttggaggtaaacactgttttacattactttctataacacttttatagatgagattcttgactgtacgagttggttattgtattttctgcatgtatcactgcagtcaaacatatgccttgagattggtgtaaaatcttcaaaattcaaaccaaaccacccatgttccctatccattcattctatcgtgttacctttgcacagatattgaagcactataactgggcaggacagtgcatgtacccacatatatacacttggagaaccatttctctaggatttgtcatattttttcatgaatcttgattgtaggttgtagcccatcatttctttcatgggatctctgctggtgaccatgaggatcatttcaactaactactttgtgggactgattcttgccgttgcttgatattactagaactgactgatttattaatgttgattttgttccttaagtcaaattcactctgcagtgatatttgctgtttccttgtgtcaatactttaaaagtatatataattattgcagctgtcctagtttagtttataacattaattggtgcatgcagttctaaatatatgtttctcactcattagtaatgctgtttctttagacaagttaagtaggttgcaactcacactcctgataatgccagtcagttgtttctgtcaagcaactactactgaaacatgagtcactaaatcatatctttagaaaacagtcaatgaacccataggattgatacaaacacactattttagcccgttgtcacctgcataccattaaccatcacagattataacatttgtttttctatgagaacgacattgttcaatggtctagtattattttatgatttggagagtttttttagcaatgttttgcacatcattttctttacgatagtattgtgaatctgctttttaatctatacatatgattttatgtcctctctccaggtagtgaatgatttgacatcatcaagattaattgcagaatggctccaagaaaccgcccttgagcaactctcaagaatatctaaatacctttatgtccttgttgaagatatgaaattgttgaaaggaaatgttccattgctaacttcagtgctaa

SEQ ID NO: 91592 - DNA, 650 bp, Oryza sativa
agaaagatacaaatgtttcaatgcaaaccgaagatgtggagggtcctagcaatgcaggggatgttgttggaccatcgatgcaaaatgaggaaaatcaaccaagggaggagcaggccatgggcatggcggatgagggggagagagtcggtataattgttgatgaaatggagagggaagattcggataatgagcaagcggaggacgacgcatcatccgatgaggaaggtgatgtaatggccactgattgggcaaatgaggacttctctggtcttgttatatcagagggtgatcatgtaccctgggagtataaggagtacgaggtaattgagggtgcaaggtatgctcataaggatgagatgaaggaggcggtgaagcattgggcagtttcattgcagagagagtttaaggtggtcaagtcaacaaattatgtgtatgaagtgaggtgcatgaaggaagattgtccgtggcgtgtccatgcatataaaggtaaatggaatgattattggaaagttagcattgtgaccgagcacaagtgctacttacaaggggtggagaagtatcaccgaaacatcactttagcttttggggcaagtgagatgtacagcaatgtttgtggtaacaattgctttgaaccaaaatcaattattagg

SEQ ID NO: 91593 - DNA, 757 bp, Oryza sativa
tggaagcaaaacaagggtacgccggctacgggaggaggtggaagtaacaatcataaggaccgcaagcgtaagcctgcggaacttgttgcaaccgccagtcactcttctcgacagcgttcgcgcgtcaacacgttcgacaagatcatgaactcccaatgctcgcaccatcctaactccaaccacgtggccaaagattgtttcgtctacaagcaattcgcggatcaatacaccaagactgcacggaagaattctgacgaagaacaaagcacgtcgaggaagaaggacgacggcgacaccccggcaggttttcaagatcaccgcaaggagctcaatcatatcttcggcggccccctggcttatgagtctaaacggaagcagaagttgactgaacgggagatcaatgctgttcagcccgacacgccccaatatcttcgatggtcagagatcgcaatcaagtttgaccgctcggatcatcctgaccgagtggtccacccggggcggtaccccctggtactagacccagtggtccgtaatgtcaagcttcgcagaaccctcatcgacggtggcagtgcactcaatatcctcttcgccaagaccctggatgatatgcagatccctcactccgagttaaaaccaagcaatgcgccttttcacggagtgattccaggattatccgcaactccactcggccagatcaccctcccagtcacttttggcactcggaaaaactttcgcacagagaacatcagctttgaag

SEQ ID NO: 91594 - DNA, 2477 bp, Oryza sativa
atagatattgcaaggaaacttgattgatataccatgtttcacgaaacttatagtgtgcagacataagggatatggtaccttccaattgtattgtcaacatagaaaccatagcccttgtcagatttggcagctttatgcatttcagctagtttccttcccaaagctgactgaaaacaaatggtttgttaacctcaaaggattttaggaaaaggtagcaatccgaactatatttgcataactttacctggtcacctctagagcaaccgaattcaataaactccatgattataaaagaaccaccagttggtaatgacccaacctatagcaacagggacataataaataagaaataaaaactgaagaagcttaagtcctctgaagaagaaaaagaagctgactaaggtaactggtgaaaaaacaacatagtatatgcctacacagcctgagccatctatgtaactggttgcctgtcaagtctagtccaatcagcaaataccaggcacccaagatgatgtaacacatatcaatattcacatgagaagaactagaaacatgtactttgatgctaataaaatggtagaactcttagttttttttttagacaatggaataaaacaaacaagtagaactcttagttaggtctggatattaacaaatcatggatatacatccatcgtgtatgtgtaggacaataaaaccactcatgtgcttacatgcaatgtactgtgctgttctatgcattacggaaaaaaacacacttgttcatgcatctgatcctttactaacccctttttatttagaggaaaaacctttactaaccttgtatggaatggaacacggattgaatttgtgtcatacatggccttcaaaccaagagcctccccttcaaacatagatggaccaatacgcctggcacataatgaaatgtacattttctgtcattgccactataaaacccagaccatgactaatcgtgccgctccaaagacatcattgattcaaagaggaagttagcacacccattggtcttcacaaagaaggaactggcatcggtcttgtagcactgagcagagttaatgcagccaccgccgatggaactgaccccggtgatcttcgtggccttcccttcagttagaatccattgcctgattggatcctcgcccaatgcagccactggcaaattcgtgcaaatccggctaagagggaaacaagaacaaaacaacatggtgcataacatctacagctattacagtattgtaattgtgcaatgccattaaactacccatggaaactggaatcaacagccaccaccccaccactatactacttgcgactgctccgtccgagtaaacccagtcccctatccaaatcttaaggccctcacttcatctcgaatactggagttcgcatctcctcaccagaaccagcactagtctagaatcgacaatacatccatacacgagcccggcgaatctaaactggaaaatttgggcgcacaagtagaatgccgagccaagtgaagaggtgaggtagggaaccggggggaggcggggcttactgatggagagcctggaggccgcgcttcgggggcagtcggaccggcgagacggccgacggcgacgacgtggcggagccggggagcggcggagtaggtgtagggcgaggcggcggacagcagcgccacgtttgccatctcgtccgtcgcgctcgctttctgcacaccgagttcgccgcgcgccgcggtgcggttggcttgccacgaaataacatagggtcttatctgcaaatgtacattcgctgtgtctctcttccattaagggctcctgcgttcaggagaatcaggagtgagggttgggctcgcacggaaaacggagcagcgattagcgcttgatcaattaaatatttactatttttttaaaaaatagattaatataattttttaaagtaacttttgtatataaactttttaaaaaacacatcgtgcgcgtaaaaaacgagggagagactccgaacgcagccttatacagtacggagtagtagttagtgagcctttttgagacggagcccaggactgatcgctatctcttgggcctataccgtacaggttgacgggccgcagatcagcgacctgtgggcctggacgttgtaatcggctttgaacgcagaattctcagacgaacatgaaaacataaaaagagagtagaaatagaatgccacgctctttgtcgaaacatgaattcggcaataataaaagggggtagcgtacgggacctaaagtggatggatgcagagacaaaggatttagacaggttcaggccctctcaatgagaggtaataccctactcctgtttggggatttgaatccgccgggtgtgtattgatctgacgatcaggttgtctcatgcccctagaggggctccctgccctccttatataggttggggggcagggtaccgagctcgaattcgccctatagt

SEQ ID NO: 91595 - DNA, 629 bp, Oryza sativa
gcttggttaatacgcacggcgagaactcttacacgaccaggtcttacatggtctttcgtctctacaggatccgacaaggccttatcggctctgggcgtccccagctgaagatcccttaggttcctcggaggccttgtcaggacggcataaagggacatgaggataggtttcaacgcaaggtgtcatctgggtaaggggtcatcaggcaggaacactgtgattgtaatatgcgcctgaaaataggctttattgatactgtaaggtgtcttacaggtatggattgtattgacttatacatagaatttacgtagttggtcaatgttccaagaatttgccaactcgcggccatcgccgtctgcaattttgaatgcgcctggccgcaagacttgtgtgatcgtgtaaggtccttcccatttgggtgagagcttgtttcgccctgcttggctttgaacccgtcggaggatgtagtcgccgatcgaaagtatgcgtgctcggatgcgcttctcgtggtaacggcggagggcctgttggtaactggctgctcgaacggcaactcgttcgcgatgttcctcgagtagattcacatcgtcgtttcgctgctcctcctgatcctcgtcggaatacctctg

SEQ ID NO: 91596 - DNA, 559 bp, Oryza sativa
ccctttacaagctttcatcagaaaacttggtacacccacgccctgaaccctctatgccgttggcttattgcagcttcaggttgaatgaaccacacatcacaacacaattttttcaatggccattggacacttcggtgacggcttgacctttgacggcgtagaacctcctgtacatggagtcgacgtgggtgaggtagtaggtgcctggagcgagcaggctcgtgtcctggctcgtcgtgaaatccttggcgccgtaccggtgctccatcagcttcagcgccgccacgaacttctccggcgcaacctgcggcccaaagcatttgttgatcaggaattcaggttcatccgttcatgtcaagctactagtttcaggttttcagtcaacaagatgaagcagtggtcagcagctgcacttaccacatgcctggactccagtttcttggagacatccagtatgcctgcaatgtttgataggatgaatggatgctggccttcattgatcttgaaagagaacattgttgatgtcaagccactgccgtatgagaacatgacaatcctt

SEQ ID NO: 91597 - DNA, 678 bp, Oryza sativa
tgacttgaagaagctggtggaagatggatatcttctttctgatcatctaataaagcatgctgacagcaatcggtgggtgactgttgagaatgcagcttcaccactggttccatccgaattcccctcagtatattcagatgtctcaacacagctggttagcccgccagaagccccaggtaatttacttgatgaagctcgagaggaggcatctggtactgaccatgaacaaatgaaggaagcttctgcagaagagcaggaagatttctacattgatgacagggttgatgcattgatggatggatctatcatggtggatggtcaggagcttgagattcttggaggtaaaaatgctcccttgtcgtttgaacctgagattcaaaatgttttttttttcccgttctcttttggtgccaatgggctagctcaatttgggtttttcttcagtttgcttggttatatcctttttggggttgcataattcttggtggtattggtacacccctcgatttctttgtaggtttgtagagggcgggtgatgcttcatccgtgattttgctgtttaaacctaatggtgaggtgtttcatgctgtccacgtggttgggcccgggttttataaggtgtatagatcttcttttggatacagttttttccgttgcaaaatctagtagcgcggacct

SEQ ID NO: 91598 - DNA, 3303 bp, Oryza sativa
ggatctttactcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttgtctgtaataaattaagtagataaatcgtaataagcaaatatatgacttataattaataaaaattccaatatatatatatacttagcatatatatgaatgatattattatattggtaaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataatttgcatatgaatgatagtaaattaaatgttaaaaactctaattaacatatgaaattgccacttgcgtgatttaaaactttcaaaaatcctctagtcaattataattagcatatgtatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacaacgctgttttggttcgtgctcttcatgtcttgggctctcgtgtagaatgtgtacccattgatctcatatccctggaatgtcgtgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtagaaatatcaactcaaaactgacgagacattgcaccacttcattctgaagggcttctaatctatctggatcgatgaccttctgcgaaattgcgttcatgaatgcacatagctttgttattgttgcccggacattgtctggaaggataccccttattacaactggtagcagttgtgtcatcaacacgtaacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttcttttttcacatcgccgcgtgaccatcttcgctctctatatgctggcttccaggcccctttccgaacactactttaagatctttaaccatagcaaacactgttttcccgctgcgatgtttaagcttcgtacggtggtcggccttatgttcgaagtgcttgcctttcttccgtaccgggtggtttgctgtaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttctaccagtggtcttaggtacacgtcgatgtcgttaccaggttgcttggggccttgaataataatcggcatcattatgtacttcctcttcatgcatagccaggggggaggttgtagatacacatcgtaacgggccaagtgctatggccgctgctcatctctccaaaaggattcatgccatccgtactcaaaccaaaccgtatg

SEQ ID NO: 91599 - DNA, 1439 bp, Oryza sativa
caacagcattagaagaatgttggcatagttctgtttgagtgtaccagcagcagcgtatgcctgaaatggatcacaatatatcagcattcagaaactacacttgtgaaatctccagttatcagaagggaacacaaattaacatccactttataacatttgatatgagacaatggttcaatggaagcatgaggaaactttgttggatcataacaacaatattctacacatacttgctccagcctccaggacaaaaggaaattcagtaatgttgaagatttaacatcacttctcctggtcacatcaatgtcattttggacatctacgtggtgttcaaaaatgcaaatttgaccactaacttttataatatttgtaaacctcaataaaattatgatattatgagaagtgccttcacatgacaaatctccatgggtgtctatcatgtatacaatccaaatataaattttcaaagttttgaaagtttagtcgatgcatgaccaaaatggcatttcatgactagaattcggaataccagatgcaacacaaatctacactatacggaggccgtccacagaaaagtttgactttaaaatttaaccaaccttgaactgttgccgcgagcgttcttccagcgtcaaatagaaagctcgctcctcttttgtaaaatctactttatccagattaattgtctttggaggtagctttatgattggctcaccatcaatcagagtttctacataaaacaaggtaacatgtgatcaacgacagataatttaatcaaaggaaaaactagagtaacatactagcattaatatgctattaaaaatcttgcaacaataatgtaaccatatcaaatttctttgaaaaagagaaaggaggtatagcatactgagtagaaacaagtagctgaggagtgaggacttgtagtaaaatggcaactggcaagcaattgtaatgcagtgtcctttatattgacgaaaaaaaaggaaatatcataactttccactatctgctcatcaattaaggtaaattgatcgaacctgtctacctaatgtttgtatggcatatatcaatttaatacaaagccaccacaatagcaaatacagaccctagtagatgtttaaccacatgcagagtgttaagcgtgtttctgtaatctgtagcaacaaagaatgctatgtgttgtggttgaaattgcttccttacaatgaaatatcctaagctagtatataggcaaaaaaggaacagcagaaaacatatggaataaaaaaagttttatcaccttttgtgcggcgcaggagaactatcctcaacacagtctgaagtttcttatacccatgaactgcatttctagcaatcgggtgctttatcattgtacaaaatgaattataagtagaatatggatcgtatttcaagaaatggaaatagctgtagagctcatc

SEQ ID NO: 91600 - DNA, 1355 bp, Oryza sativa
ctgtcccatctctatcagaaatcaaccttgggttctcaagtttctttgctagctggatgaaggccacgacaatctgtttcatatctcccaagtcacttcgacctttatatctgtaatggcatatcaaatgtcagatagtgcattatcacataaaattcaactactttgcaagccttcatttcatttagacccactttaccttaatgcatcttggcacatagaacggatgtcattcttgatataactaaagccatggcgagcatagtatccatttttcaacctaacttcaattttcgcaacctggaatagaaaataaagtaccgtgaactattattagggtcaaccaaaacatcaaggttcagaaaattgtattaaaggatttcgatagtacctttggaacaaaaaaatcaaatctactgctcttcatgatttcttttagtttgttgatgacaaactcttccatcttccggtagctattctcggccttccgctgcatcaaacgcctcatctgtgcatcccttgacaaaaccgcagacgactttctaatatcaagccactttgatcgtttatagaacccttgtccaaaggaaagggtggaactctctctatttgaaatatcagcaaaatagccatcaagctcatcagaaccacccatctgactggtcaagatccttccagctttggatgtgctgttgctcccatcatctatctgcttcaagcttctaattttctggtatgatgcatctggattcaaagagctcttaatccattttacatgctgaaatttgtttttaagatcccctagctgactgcaaccttgaatgtgcacatatgatatgtgcggaaaacgcttaagtacttccgcaagggcaagagaactaagatttgaacaccctgttaaaacaagtgttctaatattttgcatgtcataaccagcctgaaaggaagatacatgattttgagcccgaagttagaagatgacaaaggaaacatcttgaagttagaaagatgagcgaatataccatgatgtcgtggaaaacattatcagtgcactgagggcccaaagaagacaaatcaatgaatctacaaacactcctgtaatacttggctgcagtgttccaccagctacaggtagctgcagaagaaataagtgacttcacgtctgccctcagaaaatggaaaattcttgctaacacatgttcatttaataaaccccagctttcactttccgttctggaattcagagggctttctttaacatgagcagccccctcaaataagtcttcaaaacaacaatcatccttctgactggcaagaatgtcctcagacatatcagtatattcatcactttgatc

SEQ ID NO: 91601 - DNA, 940 bp, Oryza sativa
ttcaactttttcttcaactccattggcaactctaatggagctttctcttctttgcgtagtcctcgtcgaacggaatgcctttaaacaattacaagcatgaatagttgctctagaattaatccaccatgtggatctagagtaatcaacataatgagattcatttacaaatgtaataatgttctcacctttccttgccatgatcattttcaagaagtctggacaatctttcttgtaatgtcctgtcttcttgcagtggagacactgatctttctcaacagcgaactgttgttgctgaggtagatgctgagactgtttagcttttgaggtgggagacttgtggttctttttcttattatctgtaacatagttaattgaaccaccatttgactctttgtttctctcctcctcttgcacacagttagcgatgagcttttcaaagtttcatttctctggacttatgttgtagttgacaataaaattgtcaaactgctttggcaatgaggccataaccaaatggaccagaaagtcatctgttatgcccaaatccattggcttcaacttgaaagccatgttgctcatcctaagtatgtggtctctaacacctcctccatagtacctctctgtcacaagctgcttgatcagctgtgtagcataagtttttgaagagccagtaaactgactcttgattctttcaaggtactctgagacagcgtcacactctgggattgagcccaatatggtaggctcaatcgtgttctttaccacagccaaacatttcttgttagctaaggaccatttcttttgttcaatgtcatacgacatgacgagaggagcatctgttactgggttacttggcagatttcagagtagtccaagcccagagcactggaaattggtaaagaaagtcttgcgttatttgcaaggaacaaaatgcctcatg

SEQ ID NO: 91602 - DNA, 1295 bp, Oryza sativa
aatagttgaggatcgaactctatctcaaaagaaaaatcgatgttttactaccagccacaagctttatgttcggcgcagtactaatactggaacttatgagcaagaattgctctatcaatcaccatctactttagacatatcttctgaaacttttttcaaatccaaaagtccagtatcttcctacaaattagtgaattaggaggagctctttgtgccgaaaaagaaagagcagggcaatatttcaaacttgcattcgaactgcgaaatatttatacaaaggaggagagatcaagataatgcagcagggttggttatctaattggctagtcaaacatgaggtggttcatagatctttgggcttcgatcatcgaggaatagagactttgcaaataaaagcagaggattgggattccattgctgtcattttatatgtatatggttacaattatttacgttcccaatgtgcttatgacgttgcacccggtggatctttagctagcgtgtatcatcttacgagaatacagtatggtatagataacccagaagaagtatgcataaaagtctttgcccaaaaggataatcctagaatcccatctgtcttctggatttggagaagttccgattttcaagaacgcgaatcttttgatatggtgggaatctcttatgataatcatccacgccttaaacgtatcctaatgcctgaaagttggataggctggcccttacgtaaggactatataacccccaatttctatgaaatacaagatgctcattgaatgataagaaattcatgctcacttatacaacacaactccagattttatgcaagtcaaggaatatttttacgctctgttcctagatgaaacagaatacctattacattctaattaattccaattatacaaaaggttcagatagactaagcaaaaaagggcttcatttcgttggaaaatcacatattcatttccttcgtatgaacagaaaaatatgatgactcaaagaagttccctaccacgaactttgtaccgcgtgcattacttagaacaactaggaaagtaagataagataagcaagaataaaaaaatatttgtcggaatagcggaatagaaaattaagaaatgcaaaaatgcagaaaaagaagtgcctctatttagagatttatctacttagatgaaaaaatcatactctatctatattattaacgaatatgtatcccaacccatctcgaggtatttgtatcaatacctattcggaagatcccttttttctgtgccaggaaccagatttgaactggt

SEQ ID NO: 91603 - DNA, 1230 bp, Oryza sativa
gtctctttctcttttaacaaatgtctggaactttggattaagaattggtggaataccaggcaatcccaaactctcttaactgctattcaagagaaaagagttctagaaagattcatggaattagaagacctttttatcttggacgaaatgataaaagagaagccgaatacgcatgtacaaaccccccctataggaatacgcaaggaaataattacaattggccaaaatagataatgagggtcatctccatatcattttgcatttctcgacaaatataatctgtttggctattctaagtggttctttttttctgggtaaagaggaacttgttattttgattcagtttactcacttaaaattgagtatccgtttccctccttttcccgctaggatcggaaatcctgtattttccatatccataccatcaagtccttaggtttccgaaatagtgtaatggaaaaagaagtgcttcgaatcattgctatttgactcggacctgttctgaaaaagtcgaggtatttcgaattgtttgttgacacggacaaagtaagggaaaacccctgaaagaatttccatattgaccttggacatataagagttccgaatcgaatctctttagaaagaagatcttttgtctcatggtagcctgctccagtccccttacgaaactttcgttattgggttagccatacacttcacatgtttctagcgattcacatggcatcatcaaatgatacaagtcttggataagaatctacaacgcactagaacgcccttgttgacgattctttactgcgacagcatctagggctcctcgaataatgcgatatctcacaccgggtaaatccttaacccttcctcctcttactaatactacagaatgttcttgtaaattatggccaataccaggtatataagcagtgatttcaaatccagaggttaatcgtactctggcaactttacgtaaggcagagttgggttttttggggttgatagtggaaaagtcgacagataagtcacccttcctgtccctctacagaaccgtacatgagattttcacctcatacggctcctcgttcaattctttcgaagggatccttttcctcgtgcgagagtctccgcccttcttccactccgtcccgaagaataactaagaccaattgagtcacgttttcatgttctaattgaacactttccatttatgattaaagaagaagattgttcttttac

SEQ ID NO: 91604 - DNA, 2103 bp, Oryza sativa
cggcgcagcatcgtttggagaaggggtcggagaacgtcttgtcgcagagtggcgcagccgatggcagcggaggccggctcggcgcgaaaggcgcggccggcggagatgaaggccggcttggcacgagaggcgcagccaatggagggaggccgaattggcgcgagaggtgcgtacggtggaggaggccggcttggcgcgagaggcgcggctggcggtggaagaagcgacctcggtgcgtggtggagctgccggtgggtgtggcgcggtctttagcgcgagaaggttggccggcggggggcgtcagtgcagggggcccacatgttggtagagtttgagtggtggtggagcatcggtgtgtcagccgtggattcgcaggtggcgagcagcgggtgaaaacctagctcggccttggccggaccgacaacgatggttaattccccctcctaagggcgttgttgtgctgtctcacccctcaagggtggttgccaggcgaaagcccagtcttgcctcctttgagccctgacggatggcgacagcggtttttcgttgcttctcttcttgaagacgtcgttttggcaccccccttgctatggcgatctcgtctatgcacctttgttggtctagtggcgaccggtccggtgctaaccttctcctgtcatgtgtgttggcgctgccggtgtgtgggtggtggtatatttttttctttttcttggttatgacctttcagggttgtaatcttgtaattttttactgctctatcgatagaacaccgcaccgtctcgtgcgagtcgttccatgaaagttcaagtgccattgatttggttttgatgattaataacaaatccaattatgtgagactaatgtttttataagcatttctttgcctagtctcatgtggatatgaaagtggagtgttggtggacctaaatcacaaggatgaaatacatggagatcaagctatatgtatcactctttctcttcatgtacatattgatatgttcgtatataatatttccacgtgattggcatatgcatgtgagactaatgttttgtttgagtattatctcttatttagtctatttacattgagaacgtggagatgatgaaggtatgtttttattttattgtctatatttaataaatgccttctattcttatataggataagctctcaatgtttaatatcttgttatgcatactcttgcttcacacaaatattttgtacgcatacatttagggggagcaaatcctatactttagttatgcatgtaatcgatccaaattattcaccttcatttaattgggatctttacacttgaacatatatttgagtatatgacacttgtggtgttgattaatactcatcatttattcatatccttttatacatgcgatcggttggtcaacatgtgtaggttgacaaccggatcattgggactaataattttattgagttgaatgaaagaaataggtcccaaggattacaaaggtgttgatgctcaactgatatcattacatctaacaataccaagaatgacaaagtgaagatattgaagatgtgtgatacgaagtggctattatggcgagacggtgaagggcaagcgatgctcggtcgcgatggaccatgcggcggtgaagggcaagcaaggggcttggcaccgaagaaccaaatccggtggtgaagggcgagtgacggctttgtcatgatggaccgttcgagaccatttaaagctacaagtaaccgcatcaatcatttgaagaatatatggtgaaacggtatcggcattggcgtccctcaagacaatgaaagaaagatgaaaaaagggcatttctaatggtgtagttctcttcttatttacatttgaatttaggaatgccgtactattaagagggatgcaacgtcgaggtgtttgtgtatgtctcggtgctcaaagtgacctatcatagtgctaccttgagagaaacccaagctttaacctatcctttgagtgtttttagaccttggttttggttgagttgggtagtcctttgagtgagctttccatagagtccaagttattcaaaaacggactcccgagcgaaaagttatagtcgttttactct

SEQ ID NO: 91605 - DNA, 1290 bp, Oryza sativa
gtgtcaatcttctcatgccattgcttaggtccttgcttgagcccatacaaggatttcaatagtttacacaccattccctcctgaccttctagtacatacccgtctggttgatccatatagatctcctcctccagctctccgtttaggaaagctgtcttaacgtccatctgatggacgagaagactatgagaggctgccacagcaagtagtactcgaatcgtggtcaagcgagcaactggtgagtatgtgtcgaagaagtcctcgccttctttttgggtataacccttggccacaagccttgccttgtacttttcgattgtaccatcaggcctaagctttttcttgaaaacccatttgcatcctacgggcttgcacccatatggacgctcaacgacttcccaagtaccattagacataatcgagtccatttcactgcgtactgcttccttccagtagtcagcgtcaggagatgaatatgcctcttctatggttcttggggtgtcatctacgaggtatacaatgtagtcatctccaaaggattttgcaaccctttgtctcttactcttgcgagtatctacaatgttgtcctcctcaggattttcctcaggcgtttgatcattgtgttctatcggtgcatagtgctcatggggcatgacagtttctttactagaagtgctaggtgtatatttcataggaaattcattctcaaagaatgtagcatctctggactcaagaattgtaccagcatgcatgtcgggtactccagagtttactattaagaatctataacccacactgtggatagcataaccaagaaacacacaatcaacagtttttggtccaagtttccgctttttggctataggtacatttaccttggccaaacagccccatattcgtaggtatgagagatttaatttcttcctttcccattcctcgaatggtgttacttccttttgcttcattggaattttattcaggacatgacacgcagtcaaaactgcttcaccccaccattccttggaaagccccgcagtgtctaacatggcattcaccatctcagttagagtatggttctttctttcggccaccccatttgattggggtgaatagggaggcgtcatctcatgaataattccaaactcttcgcaaaaggatgcaaactcattggaaaaatactccccacctctatcagacctcaactgtttgattttcctttcaagttggttttctatctcagctttatagattttaaagtaatgcaatgcctcatcctatgttttcaataga

SEQ ID NO: 91606 - DNA, 1697 bp, Oryza sativa
aatatatgtggggcccacatcattttctcgctctgacatgtgggcccccacatataaattttattaattttactgactaggatgtcacgtcagcaaaaccaggcagctatactgccttgggacctaaattagaggttttgtatagtttaggggtgaagatttctggttttgtggttaagggaccttaaaaaatttcgttgttaagttgagggacctccggtgaacttatttcttttgactaccttaattgggtcttttgggctcacctgattttcatggtgggctcagcaatattcttaggaataagatcactttgactccctcaactgaccacgaatctaaatcgtatccctcatatgcaataccagaaatcttgaccccccaaacttgtaaaaccggtgcaatttaactcccttggtggttttggatggtggtttcgctaacgtggcacacacgtggcagtgttgacctggtctttgttccacgtggcattgacgtggcgcttatgtggcattaaaataaaaatatatatgtgggcccatttatcattcacacaaaaaaaattgtgggacccactgacatgtgggtcccacatgtcatcttctctctcactacccttcttcctcctctctcccttatttctctctctctctctccccttgacatgagccggcggcaggggcttggtggcggcatcggcgagcgggtgccggagtggtggctgcggtgggcggtggacctcgggcgacaagcgcgggagcagctcctccttgaaatgggcggtggacctcgggcgacgtgcgacgaaatgcgtcgggggagatgggagcacgctcccagccgccgctcctcgtccccactctgtgtcgtgggcagtgaggtgggcggcggccgcggcgtcgacggcaaggtgtgcggtggccgcggtggaaagggagcaatagcttgcgcgccccaacgcatggcggcagactggcctcgagcgctccggcgtcgacctggccatgatgcggagcagcgactggaactcctcctcctcctccgacacgggccccctccccgaccacgtccgccgcgagaccgcccctttttcctcttggacttgccgtcggccgcgcccgcggcggcctcgcaaagactcgggaagttggcggcaggagcaggaggctcggtggccactgggcaccaccatccccatctcccgtggcactagcaccgctccagtcccggacccgctgaagccaaatccttgctactgcggcggcggcagcggaggcgacgcgaagaccgtcggctgctgctggatggcaaagtgcagccctagccccgccgccatcatcccccgcggcaagcgcaccaccgatgccacgaacgcctcggcctccacgacgatggacagcgacccctcctcctcctccggcgagtagactagcgcaccggcgaagcggtagaacgccgggagcaacgcctcgagggagtccctgagtgcacggacgacgtctccgaacagtggtggtggcggacgagcagcagcgcgcccagtacgcgtcgaatggggagagcggcacgcggcagcagccgccgccatctccatgcgtcgggagcgcgacggaggtgacgctcctcgtgcacaccgacggcggcggttgcggcatcttggcgacggcgaactcctccgccgtgttttgaatctcgcc

SEQ ID NO: 91607 - DNA, 604 bp, Oryza sativa
ggccattctcggggtatatcttctcctcctgctactgttgcttagcgctattcatgttcccattgttaccgaactatgtgcgctatgttcttgttcctgttctacatgatgcctctagcatgttatcgcgttactggtatgttcctgtttctgacattcatgatgcgcctagtatgctactggttatgttaagatcaccctacgctatttatgccatgatcattgtttcaatttcttggattaaaatatgccgattaatgactatattgccaacaaaacttacctgttcttggctaccgttcacgtagtctttcccgctgacggagaagatcttctccagcgtctgagacgcgaacttgcgctgctcgtcggcctccagctccgccaccctcgccgacgtgaaggggaatgcccgatcgccgtagcggtgcacgagctcgacggcatcaggctgcacgacctcgccgttcggggcgagcaccaccaggcgcgggatgccctcgacctggaacctctcgctgaggcgcttcttgcacccgatgtcgccgaagggcacggcgggccacggcatggcgcggtggaacctctcgaaggacggtcgatt

SEQ ID NO: 91608 - DNA, 1195 bp, Oryza sativa
ccttacttttattttaaacttaatttgatagacatgttctctaaacaaaataagtctaccatctttaaaataagtctaccatctttttttaagatgatgaagaagattataaataattgtttgtaaggattaattaaatatgatgtagtataaagctaactaataggttagaaaattataaaagcaatgctgacaaaaacaatttacggagaaattgtatgtggcagatattctccggttaatattgtactcttgtatgtgtctcaaacatagtctactatacatacccacaagaatgcgcaggtatctttctagttaattctaacacttaaaacattagagatggcattatatgccttagtggattggctgtgctacaaacttgtagtttttgcttttatctcttaaaacatcaattgcaacgcatgggcctttagccagctcgcgtggaaagtcttggacgacgcgagatctcactttcttgggaacatctcactagagaaaataaagttttaaatagattgtcattcaatttgaagatatttgaagaaaacttcaaccaaaaattaaaatattggggtggatcagaaattttttaaccagctgaaaaataatctcggaaggttcaagttagggagataccatgttgtaaaactgaattctggtcgtgtatccttgtgctcgttatgttctcctacgaaatttcaagcttcaaaggccaatatatgtcaggagccatgtgggctgcaatatgggttggatcagctactttccaagaagtccaagaaagcccaagagacaaccatatataagaagtagttcacattaggtccctctatttgttgcccagtccgattttcgtccctcggtcgcaaaaccgggtatgacgggtccctcaacttacaaaaccgtgcaaaagaggtccctcggcagtattgtgtccagttttggatgacgtggcgcctacatggctccctttgacttggtcctcgtcccacgtggcattggcgtggcgcttatgtggcaataggatctcaggaaaataataaaaaatgtgggacctacatgtcagctacacaaaaataataagaaaaggtggggcccctgtggtcccacatgtcagccccctctactctctatcccccctctctctcccttacagaatggggagaggcgacgcatcggggggcggtgg

SEQ ID NO: 91609 - DNA, 924 bp, Oryza sativa
accgccgagcgctagccctctccttggaccgccctaagtcggttcccaaaccgacattgccatcctataaacccgagcttccccctttcctttcctctcccattcgcctccggtgctctgttcgccgtcgccgttcgtcgttgcgcatgtcggaggagccggcacgagcaaggacgcggaaggggacttcgggcgcgccctctccttcctcttccccggcccgaggccggagagattactcccgcgccgtcggactctcgtcactgcgccccgttccgcacggtagtgcatctccccattctccctcctcgctccatctctcccccttagttttcggtagtaacacgagtagcctccccgtagctagccggcgccgccccgaccgttgccgccgctcgccgtgtgctcgccgccgtcgccgcccgagctcggaagcgccgctcatcgctggcctcactcggcgtagctccgcccaatccgacgctagcatcggattcccgtagccacgtagatgctctcgccgccgggaatcggccccacgtgacctcgtcgccgtttcccccttcttccgccgccggatgccgctgccgcaattcgccgccgtcgggcatcctccggcgaatccgagccgttggctcgtctcctctcgtcctgtgcaaccacccggtgtgctcgctttcgcctgtatcgccgtggttcgctctgccgctcgccgctgtcgtccgccgtccgttccggccggcgtcgtcgtctacctcccgccggcccgcgtggcagccacgtaggcgccacgtcggcgccagctcggccgagatcgggtcgagccgacccgatcagccctttcccgtgcacgcggtccactgcgagccgtgaggctgcacgtgggcccgccgcatccgcgttctccgcgaccgcgcgcgtgca

SEQ ID NO: 91610 - DNA, 677 bp, Oryza sativa
cagactcagctaatgaacatgatgatgcaacaacttcagaatcagcagaaccaaggaattagccatgcacctcctcagaccaagtaagcagagtttcttcgtgtgaggccgcctattttctctagtaccactaatcttgtagaagctggtgattggctgcatgccatagagaagaagttggatttgcttcagtgcactgatcaggagaaggtctcttttgcatcacaccagttgcatggtcctgcttctgaatggtgggatcacttccgcttgaataggactactgctgaacctatcacttggcttgaattcaccgctgctttccggaagacgcatataccatcaggagtagtgtctctcaagaagaaggagttcaggtcgcttacgcagggatctcgctctgttacagagtatttgcacgagttcaatcgtctagcccgttatgctccggaagatgtgcgcaatgatgaagagcgtcaggagaagtttttggaaggacttaatgatgagctttcttacccactcatgactggagattattctgatttccagaaattagtggataaggctattcgtcaggaggacaagtacaatcgcatggagcagaagaaacaccggattgctactttaaggcacaacaggggaataatcaaaggccacgtcttactttaggaccc

SEQ ID NO: 91611 - DNA, 821 bp, Oryza sativa
ttagccccctcccgcggtctcccgtggtctctagccacctccccaccgtcgccctctctctcccacgttgccggccgcctccagccgcctgtgccgcctcgaccgtgcgccggccggccgcgccgtcgcctcctccagcgtcgccgccacctcctccacgccggcctgccctccgtttcgcgaggtgacccccggagctgcgtttccgccgtcgcccatccatttcctccgcgccggccgcctccagtcgcctccatctccctgcctgcacgccggtcgacgtcgccaccacctccctcggctccacgacgccgctctcatccccggcatcacctcctcctcgcccgaacatcgccggaacaccgtcgcccgcgccggcctcacctttctcctcgtcgacatctcctccggctgcccctttcgccatgcccgtgcatcagccgacgctgccgtcctttccctcggcatggtgacgtagccctccacctcgtccactcctcggtttcgccggaacgccatcgccgcgagcccctccatccgcctcgccggagttgttcggccgcccgtccctccacgccgtgcaccggtcggccacacccccatcatcttcggcatcgcagctgcgacgtcgtcctcggcctcgcctcccctccgaccgaacaccgccggtgcccgtcgtcgtcttcaccgttccctctcgcccggctcgtcgtcttgcggcgccgcctccggcatcgtcatcgctgcggcgtgttccacgccgtcctcgcctccatgcagccgttgccggctgccctcgtcgtctcctcgccggctgccct

SEQ ID NO: 91612 - DNA, 1626 bp, Oryza sativa
catcttcacaggcgctcaactggggtataagccaggactccgcctaagacatcttctccaaagcttctcttactgaaggggggaaagattgagcaagaatgagtacaaccacagtactcagcaagtcacaccggcagatgcatggttaatgcaagggggtacaaggagataataatataggggttaagttttgcagaaaagcagcatttataagtcacttagttgcccaaagctattttataaagacgatcctagagctacacagtattattaaacaaggccgtgaaccctcacgaacctgccttaacccaaggcctacgatgattcagaccgaactggcaacccgaccctgggtcccagctcgtcccaagccaacccaggccaaccattccatattttagtcgttgagcaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacataacccttcacccatcctagccgtgaacaaaagtaccgacccaatcctacctacggccgggatacccgggacaggcaggtagaactgagcccctagcattgggcaccaaccctccgccgtatgacatctcgactaccgggccgcagctcgtgtagccttcatttgccctggagaatgtccatcgacgcccgacttcatccatctccaatccgtgtccttttgttcaggactagactgagcaccgagttaagccttacccattagacatgtggttagtacggtagtgctttgcaacagaggcccgagcttaatccttatagtggccggggtgctacttcccataactggcatgcacccaaaccccaccgaaaacaggttttaggggttttgaaagaggaagagaggtgtatgtccaattccaacataagccaaccattccatggtgtccaaatgatatgagaatttcccaagtctaaagttatgaaatccaactaatgttgtcctattaaattgcgaagcatctacctaaatttaaactagggataccacgagtagagtgtccactagttgaggttttgtttactctagggtgaacaaggtaataatcataacaataacaataataaggtcataacaaaggtaaataggcatggctaaataaaacagtgataacgcgggaatttaaataaagcggtaatgcaataatttaaatcaacataattttacaaactgggattcaatatgttcaaggatgatgtgacttgccttgctcgctttcccaaacgacggcttcgacttccacgaagagcggatcttccgaaactgcagcgtctacacgaccaacggaaaagaaaaaggcttttactctaataaactccaaataacaagcaggaacaaagcacaaaaatgggttctttacttcttaaggaaaaattagagacttgaacggtccaattccgagttcaaatggccaagatatggccatttgaagtttatatgctctttaaatggatacttgcgaattcttcatttaaattttaattaaaa

SEQ ID NO: 91613 - DNA, 4678 bp, Oryza sativa
cgcgggggggttccctcccttcgcccgtgccggcgaggccgccttcgggcgcgccctcgcggttgccatgtggggcccggctgtcagccgcccgcgcccgcgggtgcggctgacgcgtgggacccacggcgccgaccgccgccagccgcgtgcgcccggtccaccgtggaccgagcggctgacgcgtgggcccccacccccgtggacccggtccgcgcgtcccctccctcggctgacgcaataaataggttttttaattaaaatttaaatgaagaaattcgtaaatatccatttaaagagcatataaacttcaaatggccatatcttggccatttgaactcggaattggaccgttcaagtctctaatttttccttaagatgtaaagaacccatttttgtgctttgtttctgctgttatgtggagtttattagagtaaaagccttttcttttccgttggtcgtgtagacgctgcagcttcggaagatccgctcttcgtggaagtcgaagccgtcgattggggaaaacgagcaaggcaagacacatcatcttgatcatattgaatcccattttataaaattatgttgatttaaattattgcattatcgctttatttaaattcccgcgttatcactgttttacttagccatgcctatttacctttgttatgaccatattattattgtcattgttattactaccttgttcaccctagaataaacaaaaccccaactagtggacactctatttatggttccactagtatgaatttaggtagatgcttcgctgattaataggtaacattaggaggttttacaactttagactttgggaattctcatatcatttggacactatggaattgttggtttatggtggaattggacatacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcagagggttggtgcccaatgctaggggctcagttctgcctgcctgtcccgggtatcccggccgtaggtaggattgggtcggtactcttgtctaaggctaggatgggttggaaactatgtcacgtcttccgtccgtataccgtggtggtatgtggcacgtggcaacacgtgaggaagatgtgtcttgtgggtaaagatgtacacctctgatcagagtaaatctattcgaatagccgagcccttggatatgggcaagcctagcaatgtacccaagtcagtgttttaattcttaaaatttgctcaacaactaaaatatggaatggttggcctgggttggcttgggacgagctgggacccaggtcgggttgccagttcggtccaaatcatcgtaggccttgggttaaggcaggttcgtgagggttcacggccttgattaataatattgtatagctctaggatcgtctttacaaaatagctttgggcaactaagtgacttttaaatgccgtttactgcaaaacttaacctctatgttattatccccttgtactcccttgcattaattgtgcatctccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaaatggataaaacctaaggacatattttataaataaaattatttgcgaaagttcctcttttttctccttcccctaatgctatttgcaaaaggtttactcttttctttcttcggatttcaactaagtactagatggtcagctttgcgaagaagaagatgtcgtcagttgtttgccgaagctccggaagactgcaggatccgctagcgaagcgaaggaagcagtgaagccagctgtgaagcaggagtgaagatcttggagaacccgtcgcagaacctaagccaccctctagtgtttcgtttgtcgtgtgtttccttgcttgtgtgtgtagcgcgtggtttgcatcggtgggttgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggatattggtacctcaagctcccgagtgaatgaagcaccagacaccagtcgtgtgacactggtccaacacctgattaaccagaaccgattgcttatagagatactacagcagcatcagacgccaatgctgaacctgaatcaaatacaacctcaagtgcagttggaggcagtccaagcactcaccccacaagtcagcatgccgccagcatcccgaaggacccatgatgacgtgccacctgttgacccaaaagaagcaagtaacatttgctttacgtgtgatgagcaagtgcactatgcaagggagcgtcctcagcagaaaagaaaaacaccaatgcgaaccgaagatgaagtccgtaagatgatcattaccagcacagaatggcctccaccaggaatgacaagacgtcagagaagaaataccttccgaggtgcaccacagttgacagagcatcttttagctaatggaggtagagtatctgatagtgaagattcagatcaagtctcctcagatgatgaagatgaaatggaacgtaaggcatgctctcgttgtggagaaatcggtcatgtcgccagctcgtgtgccactatatgcgttcattgcgaggaagaccatccacccgacaggtgtccaacgagcaggatcacttgtttcttttgtgaaggaactgatcatgtaccaaaagattgtcaattcagttttctgctgacgaagaagatggctaaccaacccgccagttccaacggagagaagcatcaaggcaacaccaatcctcgccaagattacagtttcagcctaactccagtgccaggacagaggaatcgaaatgagaaaagaaaatgccgagtccgggaagacatctgttgcttcaattgtcaaggaatgggtcatttcgccgacaagtgcccaaaaccgagaaacatagctgccggcacgtcagtccacgcaactccctgcaatcagaagcttgctcctcaacgaattgtcatccatgcatccccgaagcagtcctatagcccgcgttgcaacagctccaattccaatgaatgcactaccacaaggtgtcaatgctcaatttcagccccagccaccagctgacaagacagaggccagtatctgcgttgtacctttggaaattccaatacagcagctgagaaatcaagtacaagatgaagaacccgagtgtaagaaagttattgtttgttacaactgcagtgaagaagggcattactccgaaaactgtccccaaccaaggcaaaatcgacctccacattaccgccaatttacacgaagcagacattccaatcgtattgtggtcactggagcaaacgccgtacccgtaaggcctcgtgataatcagaacccatagcagaaacaatgcaccaatgctcctccagctgcacctgactcggcaataaatcatagcaaccactctctgcatcgacagcctcagcaaagaattgtcgtagatggaagaagttgtgtctctccccgacctactccaggccgagccaagggcaatcaatatccggagggcgataccaagcagaagaccgtcatccgcttcaaccagcaatcagaaggaagcttctcctgtgaatgatagcattatgcagtcctatcacatcatcacagaaccaatcaaggatgcagtcactagaacaatgccagctatatctctccagaatcaaaatgagcagccatgtttgtggttttcagttcgctacttatcatggggtaatcgaaagtttgcagcaataatgcaatacataaatatattcatgtctataaacagtgagcttgctatgcttatggatgattcatgttgaggatacaatgtaccgatgttaagcaccgtccctttttgtttaaggcagtgcctcgtattcatgtaatgagggagaaatgtgtaatacagacaagttccatgaggattcttttggaagatgcggatatgtgattatgtgtataattgcttactgataaaggagacctagggtctcatttcaaaggaa

SEQ ID NO: 91614 - DNA, 938 bp, Oryza sativa
gaacagtttgttaacctctgtagagggggtacactttacccacacaacattactaaccgggatcacccagcccgtggggatcagccacgtcgggagacctccaagctttcatgacaaggcatttcgaaagccgacacaggtttaccatatgctgacgagaggggtcccagaccaacaacaggttaggtcccagaccatactgtgccaggaagcccaggggtcctccccgacaccaccccggtgaatccacatgtctctcggcatcaaggctcccctgataagctagttactcagccaggggtgtcccattccacccatgtggtcgtacttgtcttatgtttggatgaaattccaaggaaacggtccttaagtgcaagagcggggaaaccgtacacccgatatgttccccggttcgcggttttggaaattcatttagttcacaagcaccgacccaggtgtcgggttttccaagtcttttgtaaaacccaagttttacccaagatgtttttcagattttaagtttgaaggcggccgtcgatactcgtgcagagtgcacgatttccgaggcgcaactgggtggttacaagggaacatggtataacaattaacaaaggaaggatcaaatgcaacaaactaggtaggtccaccaatctgccttgcagacgggacaacagattaagtgcgatcctatcaatgcataatatttttcaagcaacataattaaattcaaatacaggctcaagatgttcaaaggtggcttgccttgctcgagatctagagcttgatcctcgaaatcctcgcactgcgggtcttcgggctccgaaactacacgcgaaacgggacaacttaacaaacggcgaaaataaagtcctattaatgacctctaagcgtgccattagatagatctcgagatttgaggaattttggaagttgaacgg

SEQ ID NO: 91615 - DNA, 1383 bp, Oryza sativa
cgggcacgggccagtcccctctcgtgcttaggtgatccgggaagcgcaagggcccgtcgaagggcccgccccgatccatcacgccccccctggcctgaatgcgtcggccagagaaaagctacactacaagcccagccgttgccaacgctggcttgtggtaagtacgataagttcttccaaggcatcccgcgaaccggtccttaattgccatgggtgcgactagcaaaaccatgcacccacagcccaccattcagtcgcattttagttggataattacgaccatgaagcatggccagatgtctcgagcacgcagctcactctgatactaaaaaggtctaatactgtaattatctcatcaactgagctagtggtaattaagcatggctaagcatatagttctagctaggtcacacaagtaacatgagctagtcgattcattacccaaggttgacaaagaacagatatcaagtaaacatggcacaagcgagcagataggtaatacccggatcccatgtaattagcaaaacatgcatatttatttgtaaacggtaaaacatttataaattgggatcaacatgctcaaggggaatgtgtgacttgccttgcttcttcacttggatcttctgaactcttatccttgcgaacgcgatcttccgaaacgacgggaactacacgctggcacgcaaaacgaggaaaaactctaataaaaaccaaggaaacagtacataaaaagtaaacaaacatgtagagctcaattttagatgaattttgcaagctgaacggctcaattcggagttcgaatgaattagatatgaattttagaagttttgagccatttaaatgaatttctagaattattaacgaattatgacgcaattattatttatttttccaaaggaaaagagggttgctgacgtcatcaaaggggaggggcggcgccggcaagcgggccccaccggtcagcggcacaagggctccggtccaccgtggaccgggaccaccgaggcggtccaccaccggtccacgggaaccgacggtccgaatcggcccaagccgatcgggcggccaggggcggcgcggctggggcacagcacggcacaaagccggcctagttgagccatggcgcggcggtagcgcggtctccggcgatggcgaccgacgggcggcgcgggagaggcggcacgcatgggcggcggcggcgcacgagatcgacgcggcgcgacaaggggggtccgggcggcccaagcgagcggggcggcggcgcacggccaggtggtcaccggcggcggcaccggcgcagcagcgcgcacgggagacagaggagggaggcaaggagggagaggaggagctcaccaaggacgcggcgacgaggggcggggaaag

SEQ ID NO: 91616 - DNA, 894 bp, Oryza sativa
cctatagaaattcaggggattccttttccctcggacctgattcttctagacacaaagaacttggatgtgatccttgggatgaattggctggcacaattccaaggagtagtggattgcgcgagacgcactgttactatgtaccgaggaccagaacaaccggttgttttctttgcacctccaacctctgtcagaagttcagaactgcatcagataggtctgtcagaaatccccatcgtcagagagttcggagacgtgtttccggaagaactacctggtatgccgcccaagcgagagattgagttccggatagatcttgctccaggaaccactcctctgcacaagcgaccctaccgtatggcagcaaatgaactggccgaagtaaagaaacagttggaagagttgaaagaaaaggggtacatacgtccgagtacttccccatggggtgctcctgtgatttttgtagagaagaaagacaagacgaagaggatgtgcgtcgactacagagctctcaatgaagtcaccatcaaaaacaagtaccctcttccccggatcgatgatctgttcgatcagcttaaaggtgccactgtattctccaagattgatcttcgttccggatatcaccaattacgtattcgggaagaagatattccgaagaccgcattcaccacgcgatacgggctgtatgaattcacggtgatgtcgttcggcttgaccaatgctcctgccttcttcatgaacttgatgaacaaagtgttcatggaatacttggataagttcgttgtggttttcatcgatgacattctgatatactcacaatcagaggaagaccatcagcaccatctccgtctggtgttgggaaagttgcgggaacatcaattgtatgccaagcttgca

SEQ ID NO: 91617 - DNA, 6605 bp, Oryza sativa
attaatactgcttaatttttacaactgtttaaatccttcaatctctatttataaatgctcgctttatgcaaatgaaccactttagctcttctttgatgattccctgcatcatacctctattccggtatgacttgctgagtacagtgggtagtactcatttttgctctacttttcccaaccccagagttcgagttcgggtcagatgaaggtttctctgaggagtaggcttcgtccgtgccgtcgaggatgcctgtggagtggtgttcccgctgcagtttagtcaaggattagctccagtttcttctgttttccgctgcatttatgtaagactttacgatgtttgtaagacgtggatctgtatgtcaacattgtcgtttgtgtaccccggctggtcctggacggggattttaatgcacattctgcttggaattctattcgggaatttctgggcgtgacaagttggtatcagagccgaccttgaccgtaggacaagccaaatggaaaaacctaagagccctctgaatccttttcattgcatatgttctttgcaattggatttgttccgggaaaattgggatctgttcttgtggttcaagggaaaaaatcttggtcgctcgtttaagcggggttttttcaaaacaagtcagtctagggttttagtaaaattattgggatttattcgtcagtcagttggggtttgatgggtgaaatgcattaggtcctagctcaggaatatgagttgcaaggtgtttatgctcttatcgttattattagtatgtatctaatttctcattattttatcgttatgtgggtctgtcttgtttattcgctctcatgcaaaatgatctatgcataaaaatttcgctcttgttcgtttcccttatttgggtcttttattgctttatttaaatttggatttgagcatgcattgatcctactcctttgtcttctctagatggccggtcacccacccaaccaccgcggagaaggcatgatcgatttcgtggcagagttggcacgtatgacactggtggtgggctaccccaatgcgccggagtacacgacgattccgctgcttagtggcgagcttcctcaccgtgtccgcttggaggtccatggctacgtggggacttgcctcgctaacatggcggtcgaggcatctggaggcacagcagatcacgcctgtcaggaggcagcctacttgatgatggccagactacgggagcgccacaactacatcttccacgacacggcgtaccgctaccacccccgtcgagccaacggtgatggcgtcagctccttccgtccgacagctggcgagaacgacaccacctttggtcacatgtgtgctgtgatgaggggattggacaggatgcactcggacttgcacaaggcgaccaaggctttgaacgatgggaagctcatgaggatcgtcgctctgaaggacgagatagcgcgcctgaagaaggagaacgctcagctaaagggtcttccagcgccagaaggagtccggatccgcaccacgccccgcaagacgacgactgcacctgtgcgcatccagcttgcgcccaggaacccacctccagcagcagctcccgcagcacctccagttccgcccgcagttcctgcagctccagttccagctcccgcgttcactctctccttcgctccagcatcagccgccaggggtccagccagtggcaccggaggttggttgtctgctactcccagtggcagcggcgagactgatctgtcaggctccaggagtcgctcagagggaccgggtgacgagcaggaggacgccttcgactccaccgaccgcaggagccgttccgagcattaggctcgttttcccattagtttatcgatggtctagcttctggttgttagtttgcgtgtttaggttgcttgtttggggtcagttgacggtcgatatcatgtgcctatgatatggctgtcttaataaggatttttgcttgctttttaagtgttttaattcagatcagaacaattgcagttttaattcctttgtaataaagcttagttcttgagcatctgtttttcttcttttcccccgtctgcttttccctccagatggtctacaccaggactggcagtcgcgcgacaggcgagggcagcaacggcgaagagcgcactgatggtgtgcaccccaacagcgattctggcaatggtccgccaccacttcccgagaatccgacgcttgcccaagttatggcacatcagactcagatgatggcagccatgatgcagcagatgcagcagcagcaccagcagatgcaccagaggatgatgcagcacgccgaacagcagcatcaacagtttggtccccctccccctcagtccaagttgccagagtttctacgcgtcaggccacccaccttctccagcaccaccaaccctatggaggcgaacgactggctccatgcaatagagaagaagctgaatctcctgcagtgtaatgatcaggagaaggtcgcttttgccacacaccagcttcagggtcccgcgtcagcttggtgggacaaccacatggccacccgcccaccgggtactgaagtcacatgggcagagttctgccgtagcttcaggaaggcacaggtgccagatggggtcgtggcacaaaagaagagggaatttcgtgcactccatcagggcaataggactgtgacagagtacctccatgagttcaatcgcctcgcgcgatatgcaccagaggatgtccgcaccgacgccgagaagcaggagaagttcatggcgggtctggatgacgagctgaccaaccaactgatatctggggactacgccgactttgagaggctggttgacaaggcaatccgtcaggaggaccaacgcaacaagatggacaggaagaggaaggccgctcagttcagggcacatcagggaagtcaccagaggccgcgcttcactcccggacagcagggtggacctaccaccatgatcgtccgccagcaccgcccgttcaaccctagcaacttccaccagggcaccagtggcagtcagaaccaccatggaggtcagcccaaccgcggtgcagctccacgcccatcagtggcaccggcacagtcaggccagcccgcgcaagccaagaaggagactggagcaaaaccagggtcctgcttcaactgtggcgagcttggccacttcgctgacaaatgcccgaagcccaggcgtgccgggccaaggtttatccaggctcgtgtcaaccacgcatctgcgcaggaggcacaaacagcaccggaggtcgtactgggtacgttccctgttaactcaatccctgcaacagtactttttgattctggtgcaacacattctttcatctcaaagaaatttgtcgggatgcatgggttaataagagaggaacttagcacaccgatgcgggttcataccccagggaatagctccacttcggttcaattcagcccttctataacaatagaaattcaaaggtcaccatttctagccaacctcattcttctcgaatccaaagacctagatgtcattcttgggatggattggctgaccaagtttaagggagtcatcgattgtgcgagtcgcacagtcaccttgaccaacgagaagggagaaaccgtggtgtacaaatctctagtctcgccaaagaaaggggtctcgttgaatcagattgagacggaaatcccagtggacaccgtagagaagaacttgagaaaattggaagatatacccatagtctgcgagtatccagaagtgttccccgaagacctcactaccatgccacccaagagagagattgaattccggattgacttggcaccgggaactgctccaatctataagagaccgtacagaatggcggccaacgaattagcagaggtcaagaagcaagttgatgagcagctgcagaaagggtacatacgaccaagcacttcaccttggggcgctccggtcatttttgtggagaaaaaggataagacgaagaggatgtgcgtcgattatcgcgcacttaacgaggtcacaatcaagaataaatatcctttaccgcgaatcgacgatttatttgatcaactgaaaggaactaaagtgttttctaagatagacctgcgatcaggctaccaccagttgagaatccgggaagaggatattccgaagacggccttcaccactcggtacgggctatatgagtgcacggttatgtctttcggacttaccaacgcacccgcattcttcatgaatctgatgaacaaagtgttcatggaatttctggacaagtttgttgtggtgttcatcgacgacatacttatctactcaaaatccgaggaagaacatgagcaacatctccgtctggtactcgaaaagttgaaggagcaccagctatacgccaagttcagcaagtgtgacttctggttgacggaagtcaaatttctgggccatgtcattacagctcagggtgtggcagttgatccatcgaacgtggagtcagttaccaaatggaccccacctaagaccgtgtcgcagattcgaagtttccttggacttgcgggttattaccgccgattcatcgaaaatttctccaggatcgcccgacccatgactcagttgcttaagaaggatgagaagtttaaatggacagctgagtgcgataagagctttgaggagctcaagaagaaattagtatccgcaccggttttgatcctgcccgaccagatgaaagacttccaggtctattgcgatgcatcccgtcacggacttggatgtgtcctaatgcaagagggcagagtggttgcatatgcctcgcggcagttgcgtccacacgaaggaaattatccaactcatgacttggaattggcagcagtggttcatgctttgaagatctggaggcactatctgattggcaaccgctgcgaagtatatacggaccataagagtctgaaatacatcttcacccaaccggatctaaaccttcgacaacgaagatggttggaactaatcaaagactatgacatgagtattcactaccacccgggtaaagccaatgtggtggcagacgctttaagccggaaaagttactgcactgccctatgcatcgagggcatgtgtgaggaattgcggcaggagtttgaacatctcaacatgggaattgttgaacacgggttcgtagccgctctggaggcacggcctacgctcgtggatcaagttagagccgctcaagtaaatgatccggaaatagcagagctgaaaaagaacatgagagtcggaaaggctcgggatttctttgaggatgagcatggcacaatctggatgggagaaagattgtgtgtacctgacgacaaggaactgaaggatctgatactcaccgaggctcatcagacccagtactccattcatccaggcagcactaaaatgtatcaagacctcaaagaaaggttttggtgggtcagcatgaggagagaaatagctgaattcgtcgcactctgcgatgtttgccaacgagtgaaagcagagcaccaaagaccagcaggtttactccaacctcttcaaatcccggaatggaaatggaaggagattggaatggactttataacaggactgccccggacatcatcgggtcacgattcaatctgggtagtcgtggatcgactcactaaggttgctcactttatactagtacataccacctatacgggaaagagattggcagaattgtacctcgcaaggatcatgtgtttgcatggggtacccaggaagatagtatccgaccgaggtagtcagttcacctcaaagttttggcagaaactgcaggaagaattggggacccgtttaaacttcagcacggcctatcacccgcaaactgatggtcagaccgagcgagtcaatcaaatcttggaggatatgttgagagcttgcgctcttgattttggtggagcttgggacaaaagcttgccatatgcggaattctcgtacaacaacagctaccaggccagtctgcagatggcaccgtgtcgcgtcccaaatcgactctaaaatctatcctcgaaattgtgcaaagaataattaaaattcatgtgaaagcctccaacaattaaaatgtgcaaagataaaagtcaaatgaggcttggaggatttttgtatatttcctaaaagcctaaaatgcttaaacaaattttagtggaattttcagagcacaaataataattgaaaagaaataaacaaagttaaaaaggttttataaaaagaaaaccctaaaagaagttctttttttccccctccttccctcttgggccggctcggcccacttccctctccctctctctctcctctcccgcggcccatcggcctccccgcgcgcgcgcaccgctgacaggcgggcccgcccgccactctcgctgacgggtggggcccacctgtcatctccctcctcgcgccgcgcccgccgccgcgcccgtgccctagcgccgccgccgccgcggattgcgccgcatcccgccgtccccgcacgcattaaagagaggggaatcactccccgtgattccctctcccgtttcccccgtttcccctctctctctccctcggattcgccaggatttaat

SEQ ID NO: 91618 - DNA, 3149 bp, Oryza sativa
cccccctcctgaatcttgggaggatctgaatttctagtacagatttgatcagcttgtaaactgtttactgttatagacagctttggatcagaacactgaacacctaactccacacctttgacaattcagctgggggtgttcatttggctctctcctgcaagaattagtatctgggatatatacaaggaagcaaatggaggttgagggcattgtacaacaggaggttaacatggtagtcgtgacaccgtcagcttgccggaccgtcccgggtggtggcgagggcaaacccgcctcgttcatacatgcgctggatctcttcccgatactcagttagcgacttgtgtgggagcgcaggcgtcagctccaccacatctcccatgcacagtttccggttagggtcacttatgggcttgtggttaaccctcgggcgcaattcctctttcagtgggaagctgtaagggctgcatcttggactattggcccccactctctccatcagatcgactacagttgagttcgcaggaagctcttggacagacatctaaagtcaaaaatataattttgtcagacaattgaaatggccagttatatcatcacagaatattactattttcgacatgacaagttgggaagaaatcaaaaggagaggcataccttatcatgttcaagcataatcacaaagatgggtccatcgtggttgcactggcgagtgtaagaataagggcagtcctccgaatgcgagggaaatggacatggtggcctaatggcatcagagcggcctaaacctgaggaccgctctttgctcattgcttcgcattgccatgtgagcacccatcttgcccattccaccatttggagtacaaaagagtgcttgcaaccaccttccttgtatctccagtgtgcagcaaatccatactctgcttgtagatgcatttcttttgttcggatctgaacttcaaatgggtgtatgccctcacacatgatgacagtgtgcaatgaccgatacctgcaactagtaaattagcagggattcttgtagagattttaacaaattgatcaaacattattctacatacccattcaattttggatgcaggatatagtccttaaatcgtccagcaactcggggccagagcttatggacaatgtcaagagcttggtaacaatcctgctctgtatcaaccacaagacgtagaccatgaatgtcatgaacatcatccatcgttaagttcttcctggagggccacatgcattgcatggtaagttgctgtgcatacccatttgtgacaataatattcagttttcaataatttaaattaagaattcgacatactttatcatcttggagtatatgctgtacaggctcttgtgcctcccagaaagactgtgatacgaaataccttcatctcttagacctttatcaagtttatccagagtagatgtaagaagtgcttcgtcaaaagatatgacaagtttggaggaaagctccttgtgctcctctgggttcaaatgcttaaagcaaatattttccagctggtctttccagctagcgattcctaaccgattagccaacggcacaaatatctccatagtctccttagcgaatctttgttgtttgaccaaaggcaaagcttctattgtcttcatgttgtgtagacgatctgctagctttatcagaactgctcttgcatcagccattgcaagaaacattgtatgcaggcggtctgcttcaacggttctgcttgcagtattgttgtcccgagcaagtttgctcaagtggcttaacttggagacctgaataaagcataaattgcaatacaaagacttttacatttggactaggtgtaatcaaaattagttagaagatggttcaggtaatgcattgctaccaaaaaaaaatcatttttcaacaaggaaatgtatttaaagacataatcaaattccttcagatgagagcaggaaataagcagttcaaccaaactccactgttgtttaacatttcccaagaatggccatatacagtattaaaaaacaaagaagaaacaacaccaccacacaggggagtacaaaatatggttaaagttgtgtcactaattggttgctacaagtaatagatcaaatctgcagcatgccaaaaaagaggtgggcgacatcctgagcaagcacttcagccagctaaacatttcgtttacttagcagtaaagctatccatatgattgaaagctttagtagtgaagttatccatatggttgaaagcttaagcaagatgagcacatggcctgttgactttgaataatcaacaatgataacatagataattcaatcatagccgtggaaccagcccttcatctactaaactgggagagctcctaaactattatgaatttatgatccatctaaaaatcaagtaaacaaaactcataccccttcaactagatcagccacgccggcaccaaacatccggaaaatctgatcataatccatgaagctatcatcaatggtgtcatgcaggagtccggcagagacgacggtcgcgtttgcgcctatcttggctagaagcacggcggtctccacacaatgctgcaagtacggatcaccactcgcccgcgtctgatcacacaggcaaagcacaaagggcactagatttaaggacatagataattacaccttgcaaaaaagaaaaagcaagaagttaacattggagtttcgtccaagttcttgggaattgggattccacctggcctcggtgcgccctctcagcctcgaagaaggccttgacgacgagctcgtcgtggaagatgcggtggcgagcctgggcgccggcgaggaggtcgcgagcgtacggctcgcacgacggctccgcctcggagaggtgctcgtcgagctcgaacgcgagctcgccggcaccgacaccgacagcagccgagacgccgagcggcagcgcggcgaccggcgcgtaatcgacgcaggagccgagcgcgttgcgcacgaagctggagaagagccgctcgcgctcgcggccggcgagccaggacgccgaggggctccgtgacgccggcgaggaggccgggctgtggaacagcggcacggggctgtggtggagcatgtcccgccacttgaacggcgacgacggctgcgggtaggagtag

SEQ ID NO: 91619 - DNA, 4212 bp, Oryza sativa
caacatcagtcagtttatgaatgaagctttatgacgtagtgtagcagtgaggtaactttctttcttgcttagaaacagaactagcaatgcatgataatctaaattctaaagggacagtaactagcatggaaaatggcatggggaaaacatgataactcatacctcaagccaaagagggaagccaaacgatgcccttggaagaatctctgattttgttgcatcctcctttttgcttgactggccttcacacgtgatttcgaaagctgctttgcttgtctcacatatattggtaatccgaaagacaatattttcttgattttccagtataatctcgcttgtgctaactgtggtgtctgggacaaaagaagactcctcaagcatagaacgtactttttcattcgtttcgattatttctccatactcttgtcttcttattaactcatccactcttgcaatgtcaacgctaaatgtgcatctcacaggtttgtggtcactctctgtgacatccatgcaagctacatacctatcaaaagagggcaaaaatgatcaatatcaaagaaagggagtcaaaagaagagaaaaggaagtgttatagcatctgacgatgtaattgaagcaactacagggcactccagtgaacagtcagctactgatataggacggctgtcgcggtatagtactctatcacaccaagcaggtatcctcttcttctcacccgaatcataccctgcaagacaagtgatgtaaaggcctcagggacaatgactgaatcttttagccaaatacagtcaaataattactctaaatgaaacattgacagaaaatttaatctattacacaatgaataacaatctaaattttaagtgtcaagctagacttacctcctagacctggagcgtgcttttggaatttgtaggttggagggaatttgatgagaccttcacgcattccttgaaacacctttccagctttcatttctgctcgaagctgatccttctctcttagccaatcaaaacttctttgtgagaccatgtcccttgcttcatcatatgtgataccataaagccggtagttgaaatcaccaaggaagacaatcatatcagcttcagccaagtctggcctgacctcatcgacctggttcccatttacctgtcatctccacaaatctgaacatcagtacaattcattatgatagataatttgaatgttgtataaaacacatacatttactcctctgtgcaattggacggatgtcgcagaagctgcatgaagagaaaccgagagggtcaaggaaacaccttttcaggattatattaatgtagaaggcatgtaacactttttatttagataatgagaaggcatgtaacacttaagacgaattgagagaaaagaacctgtggatccatgaggtttgttgaaagacattgtccggtaaatatgatcaaagtcagcattgcgtctgcttacagcttccaaatgtgcagcaaaatgattgctgacgaaacacattttacgatcatagactcttattcttaatcctacaccaccctgcagaagtatctattgtcatcacacagacaactgaagattataacttagacgcatgcaccatgatataaaaactgactaacgactgcaatgtgcggcatcatccaacgaggaaattaatgcctacacatatatgaaacgacttcaggatgtaccttattgccgatagcacgtccaaaaccacatggcactgcagcagcttccacatcaccaacatatggcttaaggctctttcttgcccttgaaaagttaatgtttacatgtaaaataaattacacgagaatggtaattcatctaattataaattaaacaagttatcattatgtgacaagaaatttatagtgtaaaccaaatcagctaagtcatgacaagacacaataccatgcggcaataagcaatgcggccaactgcctagaaccaactcgatggaatgatgttccctcatcaagtgctttaccaatattgtctatccaccattgcccattagcactgccttcaagtcctacctagaaccatgaacaagggaagctgaataaaatgagtgatatagagttatctacacacacaaaaagtaatagtggaaagttattacgacaattaaagtttgtgatatacacagcacaggtaaaagtataaaaatatagaattcgttaacccctaagaaattctgtatacttccaagtcagtattgatattgaccccattaaccatatgctccaaaagtaacattcctaaagcaccggtattctttctgtgctacctgcttgtttatgcttatctagaatctagatgcattcttcctaacacttaattgcattgaacaaaagcaaggagaaataaatgattgaaggcaagatcaagtatcttacagtttcttttgctgcagaaatggctaggaaacccgcacccatctcgacctcttgtaagccaacgacaaccaacccaacatcagatgatacactacccaaccatgatttaagtgactcagcagatgccttcccctgtgctacattccaacttccaaccattatatttatcttctccattctagtgtatgaaagctctttgttagtcaattcagtgcgcaaaatgtcatcaagaggtcctggtgatgtcagtggccatccccgaataccaccatggtgcgccaacgtgtaaatgtaagaacctccaattgccattcttatgactggacaactatgtccagtccatcctgcaagaaggttaccttcaacatccatgacttgaacaatgccactggcatagcccgcccacaccctttctccaagtgcctttatgcactgcacagaagaagtatgatgctggaattcttgcactctgtttccatttccatcccacagtataatggaaccatttgtgcatcctgaccaaattgttccatccattgcttgagccactgctcccgttctacggttatcttcgacaaatgttccttttgttgcaaccctgcgcaccgcatcagctgctccgatcaaggcattcctagatttctggaagaagttcaaagaaccctgggatttatctttctttgaaggttttactttgacctcctcctcgataggttgctctggcatgaccggtgtctcaagccgagctgactcaacttgcccgtccatcccaaatactttcagcaactcccttgtacgagcatccctgtagcaatatttcaatacaatgtggaggttagaagcaactaatgggcaaaggaacagcaatctgtaacacatggtaacatatatatctttctggaatcataccagatagcaaatgtcatgcttgtaaccgtccacacttttgcgcgagaataatcggcaagcatgtgcttcacatcagaagcaggcaaagagcacacatttccaactgtgcaatggttcctgagatcaatgtatgctctttccaccaacaatgcagccatgtgtctctcctccggtgacaatgagagcgacttggcaatggcatcgtaaggccatgcctttatgacaccaccctcggatcccgaccatatctcgcctgttggattcaaatggaacatgaagtttttttgtcacaatgatttgcgtttgcaattcacatgcaaatatgcaacgatcaaattcttaatactatgagaatctaacaacataaaaatacattggcattacaagatcatgggcaacatatgctcaccatacgaagtgacgaccatggagagcacgggagtccggccgtacgcctgccacgtgagggcttccttgaacaccggcgcattgcttggcccgccatggttgcttcccccaacgctcccaccgccgtcgcctgcgccaccaggcggaggcgcgggcgcggtggcggccgcgtcgaggtccatgcgccacgaccggatcctcccgtccttgtgccccgtccacagcagccggttagccctgtccacggcgacgcagagcgcgggcggcgcgggcatgccctcgcggaacggcgcgctctcctcgtcgccgcgcctcgcgcctgcgccccacccggcgaacacctcgtcgagcgcccacaccctgatcccggactcggccccggcccagagataccgcccccccggctccgccgccagcgtgcggaggaacgaccccgcctgcgtctcccggagcgggtgcggccgcacctcgagcgggg

SEQ ID NO: 91620 - DNA, 6740 bp, Oryza sativa
ttcaaaatggaaaattatttttgtaaaacttttaataagaaaaattataaataaaaaaaattcctttcttgagcatatggtaaaattaccctaactaatatgatgtatatttatgcagaggattaatacacctatggttgatgccaaattcctccacctgaactacttggagatttattttgatggtcttgatggcgatgatgaggccttcccctagaatacgattatttgtctttggtttcagttcttgatgcatctcctgttttggatactttcatcttgtccgtaagttcctaattatatcggtatctattgtgaaccaaagcactttttaggtgccatcatttgttatactatggaggtgcagcagggaggaatgaagcatgattcagtttccggtgacacaaccacaattttgagaacaatgcctggacacaagcatgagagactcaaggaggtgatgatcattggattctgctccgctacgagcatatggttaagctaacatgtcatatactcgagaacgcgacatcgctggaaactattacattggatactgtatgtgatgtggatgatcttgaagatgttgggagatgttgcacgactactcttcgcaaaactggctcatgctacccgctaagaagggagatgatcttggaagtccatagaggggtcatggcaattgaaagatacatcaggaggaaagttccatccaatgttgagttaattgttcacgagccttgtacctggtgccatgatcttgaacgcttagatgccttagaaaaggaaaacggccacatcattccccacctcatcttaagcttgagaacatttcattattgttaaaacgtgtataatcgcatgtaaggttattatggtttcagtcatgtgttcggcactgctcgtgtgatgtctaggattgggagtatataaaaaactatcgtatgcccgatatgtgtggaatttttttaatttctagcaatttgtttttcttcgtacataaatcttgagacgatccaatggtcagttggtcataaatctgagttttgagggcaaaaaacttagaagtttttgaggaaatctatttttaatatggtatagatatcctggattccaataaaagatctttcacatttcctctgttccaaaggggcccgagcatctttcaaatacatggattttagaggatttttatgtaaattgaattatctcgtcgtagaaaaattctgtaaaaattttgttaggtcttctcctcctccgccgtctcgtgcgccgatgcaagcggcaaccggcgaaatccccgcggcaaccgccggattccatggaaatctcgccggcgtccgccggtagccgccgcggtcacccaccctagtcctcccccacagctcgctcgcgccgctgtgaatcagtgaatgacttccggtttctcgcccgactccgcccagtctcctcccggttttcccctctctgagctcgccgagcagatctgccggctggagagcggcgagcacaaggaggaggaagccgccgacgccgacgccgacgcggtcggcctctaccatctgatggtcgacgagaggtggatttctgctgctctgcacttgtactcttatccgattctttttttttcagtctcttagatcgaatttggattgtattctactgaaatcacacggttttcgatctcagtgtagttgaaatcgccggttaccgctatcagtgttagcagattcagaacttctatgctcggtgctgtggttgcttaatagttactgcttaatttcatttcatttgagcatgtatgctttagcaatagaattactgtccagtaataccatattaagagttattgctaagtgtttgagcatgtatgcttagcaatagaattactgtccagtaataccatatcaatagttactgttaaatgttttctgagagattttctgttattctgtctatggtagaactgaggcagttggtggttcagacaccataatggcatcacctccagcttctgcctcaaggccactggatcctgcatgggttcatgcaaaagtaattggcaattcaaagaatgccttagcatgtcttcattgtgggaagaagattggtggcggtggcatcacccgctttaagtaccatcttgctggaattaccggccaagttcaagcctgcaagaaggtgcccaatgatgtcaggcgtcagatgaagcaacttgtcaatgagcataggtcacggcatgacactcgagatggccactattcaggctttgaagaggattcttctgatgctgttttgtcgaatggaagctcaggggttcaacttaggccgtctaggaagcgaagaacagggtgtgtttctccgcaagctgctgcaggctttgaaagaacaggatacgtctctccacaagctgctgcaggttttgaaagaataggatacatctctccactagctgctgcaggttgcgaaagaacagcatacgtttctccacaagctgctgcaggttttgaaccaagcaatgatgcattgttggtatcacgagacttggttcaacatagcatggatggtgtggaagttccaaatgatctgttacacaatgctagagttgctatggcaagatggtggtatgatgcaaatataccctttagtgcagcaaaatctcctttctatcagccaatgttagacgccatagcatccgctggagcaggtctcaagggaccgttgtatcatgacctacgcgggccattgttgaaacatcttactgatgacattcgcgaatatcttcatgatatgaagaaagaatggaatgcatgcggttgctcacttattgctgataggaagaagaatcatggagagagttcaataataaatttttttgtatactgccgacgaggtactatgtttttgaaatctgtcgatacttcagcagagaaagcaaatttgcttgagatctttgatcaggttgttagagaagttgggccggaaaacattgttcagtttatcactgatttagatccgagatataagactactgttaaggttctggaagaaaggtataaaacttttgtttggtctccatgtgcagcacgttgcattgacttgatgttggagaatctcgcagatcctagatattttcctatgattgatgaaactctaaataaggcaaagaagataacccagttcatatataatcatgcatgggttttgtcattgatgaggaaagaattcacaggtggtagagatctgtgccgtccagccatctcaagatttgccacacatttccttagtctccaatgtattcttaaatttgagaaagagctctgccaaatggttactagtaacaaatgggtaaaatcaacttatgctaagggtggtgtcggcaaagaggttgcagctatgattttgaatgcccacttttgggcccagtgtaagcatgtagtcaaggtcactgagccactgttgtgtgtgcttcgactggtggatagtaatgaaaaaccttcaatgggttacttgtacgaagcaatggaaaaggcaaaggaattgatcagggcacggatgatgcataaggtgtctctttatgggccgtatgttagagtaattgatgctaggatggagaaacaacttaacagtccattgcaggcagcagggttgtttttcaatcccggaatattctttagtcccactttcaagatgcaaagctatgcacatagaggacttgttaagacaatttcttgtctggtccctgatgatgatattcaagataagatatttctccaacttgaggagtataagaaaggaactggtgactttggcctaccaattgcaattcgtcaacgtgaaaaacttgatccaggtaacaatttattcctccatgtatacttattacattgattatctgaggtattttaccggtgtttatggaaaataaacctgaattcctcgaactgttttttgaatatatggatttattttcattctcacaatgttacatgtttgtttattagttgcatggtgggataactttggcaatggaactctcaagctccaaggtcttgcaaagcgagtccttggccaatgctgcagcgcaacaggctgcgaaaggaattgggacattttccatcatatccactcaagaaagattagcaggcttgaacgctcaaggctaagtgatgttgtcttccttcaatacaaccagaagcttcgggaacggtataatagtctggaatttactgattaactaactatttgctaatatgatactctcatcatgtgattgtctacttactaatattggtaacaatcttgtaggaaccttcacaaacacagagatgccatcgacccaatcagcattgacaatattgatgttttagatgaatgggtcagtgaagagcctagccttctttgcagagatgacctgaactgggagagaatagacgcaccatttgccgagccgacttctgaagacgaagaatttgtcgctattgatgacgaggaggctccaacagcgtcactgtcctggccggcagcagcagcagaagactcatattgcccaccacctgatcaagatccctatcagtatgtcacccaggaggatggaattctacctttctgaaaccgggaacttctgctctgtagcgaactgaaaactgtcattaggacacacatctagctaatgtcttggaaaacttcctgggcatggatttgtatcggtttaactgaatctgtccagttaggaaatgagaagtttcaatctactgctgaaatcatttacagtctgaggcatgtgcaaagcttattttccatccccccccccccaccccccaatcccctcctgttggttttggatgcttcagagttcagacttaagctgtgatgccaaaacctggaaggctggaatttctgttccatagtgaactgagctgtcattgggacacatatattaggttctgaaactttccctgtgcatgaattggtggcattttaactgaattctagacagttcggaaattagtagtataatctgttctaaaataatgttctgttccaagtctgtgtcatgttcagagtttcttttccttccctgtatttttggtcttggattgcagtgcttcaagaaaaaaaaacacaagaaagttaccttcacccaacttgtacattttttagatctttcaatctgtgaattatgtatgataatatgatatcaatacctgtggttaaaaaaccaatacatgtgtgatcacagcaactacttaacgaacaactccataatataatgcacgaacaactccataatataacgcgattgataatataatgcacgaacaactccataatataatgcgattgtgggtgctttttgttgttatataatgcacttggtgctttttgttggagggatgtttgagcgtatcaaatcaagtaatcagaaggagctgacgccacgcaaaatttagaccagctctaccaaattcatttctcttactggttccaatgtggggatcaaactcaattcgattatagctagattttaacagaggagatagcagatagctagagtaaaattcggaaagaggagaaaaacaacattcgctactctaatcaaacaccacgagcttctggtactcctccccggcgatggcggcggccatgaccgcctccgggttcaccacgccatcgttctgcaagaagatcttgaggaggttcttggagaagccgctcaccatggccaccccgggctgcgtcgacgtcaccggcgtcgacgtggagtcgcgaaggttccagaacacgatctgcggcaccgcgtcgccgtagccggcgctcccgaacttcctgcagatggtctcgtagtcggtctcccagtggttggtcgacgcctcgtcgaactccatgtcgctgaacacgaacacggtcctgatcatcttctccggcggcagcctgccgtcgacggccgtgcggaggatctggtcgaacaccgcctggaagttggtgttcatgcaccagtccatcctctgcacgaaccgcagcttctcggcgagggtcttgcccttgatcatgtggagctggggcctcgcgctgaaggtgatcaccctccccgcccacggctcctcgctgagctccgacgtgagcacgccgagcgccacgcacacgtccatcggcgtgccggacatgctcccggacacgtcgcacacggagatgcagttgcgcagggagcccttggcgcggaggtcgtccaccatgcggcgccactgcagctcggacacgtcgtcctcctcgccgcgcatggcggcggacgcgatctcgtgcggcaggagcgcgcccgccgcgatcttggccttgccctcctcgacggcggcgaggtactgggcgaagcggtcctcgtcgtgcttcttgaacagggccttgtagcgcctcatggccacggaggcgacgcgggtgtagggcagctcggaccatcgccgggcgctcatgtacacctcggggagctggagaacgtcgcgcagcggcaccagcgcttcccggcggaggcggcggaggacgctgtaggcgtagtgctcgtccgagagctgggcgtagtctgggctggagtcgcgcgggaagaggcggcgggcgatggcctcgcagagcagcgtcgtcctgtcaaacgacgatcccggcgtggggcaccacttggcggcgagtccgatcttcctccgcttgccgccgggggccagctgctcgaggtcggaggcgaggagttcggc

SEQ ID NO: 91621 - DNA, 562 bp, Oryza sativa
  unsure (1)..(562): unsure at all n locations
tgattcgagttcgnnnnnnnnnnnnnnnnnncaacgtagcccctctatcagaatagaaattcaagaagtaccatttctggccaatcttatcctgttagaatccaaagaccttgatatcatcctagggatggactggttagccagatataaaggtatgatagactgcgccaacagaaaagtaattctcaccagcaatgatggtcgagttgtaactgttcatgcattatcttctgagtctttaaggtcaagtctgaaccaaatgactttggaagagattcctatagtccggagtaccccgatgtgttcccgaacgatttacttggtatgccgcctaaaagggatatagagttcagaatagatctggtaccaggaacaactccgatccataagagaccttatagaatggcagccaatgaattagcagaagtcaagagacaagtagatgatttgcttcagaaaggatacatcagaccgagttcatctccatggggagctccagttatttttgtggaaaagaaagatcatacccagaggatgtgtgtggactatcgtgcactaaatg

SEQ ID NO: 91622 - DNA, 1926 bp, Oryza sativa
ggcctaatcacaattttggccgcccataaagagcttgcggccgtactttttcatctgggtcccttgccgccccacccagatgaaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtctgggtcgtagaaacattatatggacttaaacaaggagaattatgtaacatgaagaaatagtagtataatttgaacatgatacgattatttgcattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctgtattgctctggtagttcaagctgctctactggaaagtgaagcaagtaaacaaagagaagactgctctactggccctgccccgcgccgcgaccacgcttggtcctccgggcctgtgctcgcacgtggtcctgggagtaggtgaaacgatccggtggcacagcacgggtagcacgagtgtcccgcgaaggagtggcctgcgcctggtcctgcgtctgcaccggcggtgcgcctcccagctgtgaggggccaatgacgtcctctgtcgagcctgaagcaaagtcgaagtcagtgatgtcgaagagcacggtggaagacaacaagcggtccgacgaggtcccagcatggtccagtggtggaccctgactcgacgtgccggctgcctgtgacgctgaccctgcagcctgggagaagtgggcggcctgcgtcatagcgaactgggcaaaacctacacatcgacaacgggacccttgtaagctaagacataaaatgtatgtaaattgattgtcgaagtaatgttgtttttttaagtacctgtggggggcacaacagaaggcctagccgaggaaggcggggtgctgaacggtgcatgaaaccctgaagcaatcggcaagtgaaacggctcacttatatgtgtgaggcatgtacagaaatagtaataaaaatacttacctccgtgcggagggggagtcggcctaggaacgtgcgcagctggacggggaccagtcggtacgggtggccgctgtacagctgcgtctgcccgagcaacgtcgtcggcacgacaggtgagcactcggagaaacgagcgcatcgactccaccatccgcgtgtacgtcgtcaggtgctcctctacgggtaccggaatccccgcgcctaaacgttggatcgtcgttgaaccgtcaacgacgacccggttgatgtcgtcgacctgcatggttaatttgttcgtaaatattcgtaaaatttgacgaagagaaagacatgaaaacataaaggaatggtgcgatgcagggtactcacagcacgagcgaagtcctggtcgcggtgcctggcatagaggtctctagtgctcgcaacgtggggctgctgttccaagggagcgaaggtgaccctagtacgggtgcgtggctggtaccagcgtaggtaggcctggtaagactcctcagtgtgtggctctccctcgtagtccatgacctcctcggttgcgagcaaccagtcctcaacaaaagtcgccaacttggcgggccagtcgccagctgagtgctgacccttgcgcgagtacctgcgaattaatgtgtaatattagtgtgaaacgacagatgttacaaattattgtgaacaggtagattttaatgcaacaacggaaa

SEQ ID NO: 91623 - DNA, 1448 bp, Oryza sativa
tttttatgtattgttattgcttctttatagggtttagctttgcttgtgtgcttcgcgtagctcctgtcgttccggaggttcccaaagcgtggttcgtggtcgtcgccgaaggatcggaaggccgttctctctaagcaaggcaagtcacatcatccttgagcatattgaatcccagtttataaaattattttgatttgaattattgcattactgctttatttaaattcccgcgttatcactgttttatttagcattacctattaattcttgttatagccttatcattgcaattgttattatcaccttgcttaccctaggcaaataaaaccctaactagtgggtactctattcatggttccactagtataaatttaggtagatgcttcgctgattaattaggcaacatttggtggtttcataacttcagactttggaaattctcatatcacttagacactatggaatggttggcttatggtggaattggacgtacacctctcttcctctttcaaaacccctaaaacctattttccggtggggtttgggtgcatgccagttatgggaagtagcaccccagccaatataaggataaagctcgggcctttgttgcaaagcactaccgtactaaccacatgtctaatgggtaaggcttaactcggtgctcagtctagtcctgaacaaaaggacacggatagagatggatgaagtcgttgcgacgatagatatctctgaggcaaatgaaggctacgcgagctgcggctcggtaatcgagatgtctaggcaaatgaaggctacatgggccgatgtccattagtcgagatgccatggcactggactagtatgccggtggtctcacccctatgtgtgtggcgcaaccggtctagatcctgttgctaggggctcaatcctggcctgcctgtctgggataccagccgatacttttgttcacggctaggatgggtaaagggttatgtcacattttttatgatgggttccaattgcaatggaatgcagagtaaaggcgtatcttataggtaaagatgtacacctctgatcagagtataatttattcgaatagccgtgccctcggatatgggcaagcctagcaatgtacccaagttagtggtttaattcttaaaatttgcttaacaactaaaatatggaatggttggcctgggttggcttgggacgagctgggacctaggtcgggttgccagttcggtccgaatcattgtaggccttgggttaaggcaggttcgtgagggttcacggccttgattaataatattgtgtagctctaggatcgtgtttacaaaatagctttgagcaactaagtgtcttttaaatgctctttactgcaaaacccaaccctattattgttactccttgtaccccttgcattaatcatgtatctcccggtgtaacttgctgaatactgtggttgtact

SEQ ID NO: 91624 - DNA, 3436 bp, Oryza sativa
acggcgcggcaggcggaaccggcgcggtgcggcgacaacaacggctcggggcgcgaggcgcgcggcaggcggcagcggcgcggggacaggacgcacggcgtgggtgcacggggagggttagggctagaggacacgatcgaacacctaaagcgcaatgaacagtgaatttttttatttttccaattttggttgtttttcctatataaatttgattctactattcctaatttttgcatatatggactttactcaatatttgtgttatcccaactaatgaattcaccctagattaatattacccatattttatttttatataatttatttgaatttttaattgggattaattcttgttccattgcatttaaacctaattgatacaaatatggcctcgatgatattttatttatttctatccttatatagtctttattttaaattataatttatttctttaaccaaatctaatttcagggttaattcctaattaattttcctctatttgtgatcgatgaattccgaaatcaaaatccaataaaatcatcgaataaaatcggcatgatgcaatttatttaaaaagtttttgaaaatccgtatttttagagttttgattttgtcggtcgaattttcagggtgttacaagtggtcatcacattcttgacggagtgatgtgctccaatttgtttgccggcttgacacgcgctacacaccctatctttctcaaattgataatttgttagtccaaggatgtgatcgtgctttagaagcttgcgaagattcctcataccaacatgggctagcctccgatgccaaagccaccccgtgttggacttagccactaagcatgtctcatgtttggctttacttgaggaaaaatccacaaggtaaagctttcccttgagaacacccgtaaagactaccgaggaatcattccttctatagacggtcacatcaacatcggtaaaaagacaattgtaacccatagagcataattgagaaacggacaaaagattgtaatttagagattttaccaagagaacgttggcaatggaaagatcattggagattgcaatcttacccaatcccataacctttccctttccatcgtccccgaagactatgttctcttgagaagtgccatttgaatcaagagatgaaaacattgattcttctccggtcatgtgattggtacattcactatcaatcacccaactttttccaccggagacatattcctacaagagattaatttctagttttaggtacccatacttgcttgggtcctctcatgttagtaataagtgccttcggcacccaaagcactctcttgatagaaatattcttgccccttgggcctacatacttagcaataatacgaccactagcattcttcctaagaacataagatgcatcaaaagaacaatgtgaagcatgatcattagggaggatacttttggccttaacaaagttgctaagaccttggggcctcttgatcatcacactcttgtccaccttccttttggtggaggaacatacccaagaccctcatggttgaagttgtccctttgatagcctacgtactcctttagggccttactacccatgtggcacttaagtaggccattgtgaagaagtcccataagcttctcattttgcttttgcaaagcactcaatgaaatagagttagtagcacaagcttcaatatcaatatttttgcacctcacacatggtttattgcttgggacaattttggagcacgatgcctcgcttgggagagagacactactctttaaggtttcgaacttctcttcaagggagaggtaagctttgtccaagccatccactctctcttgaagttgagcgttcgccacctcaagattagcatgagactctttggtttgcttgtaaagccgtaccaaagcctcatttttctctctctccttagcaagttcactcttgagttcatgagaccgctctttctcacgaatgagcaaagcctcttgcctctccagggttgtatattggtcctcaattctcccaagcaactcactcaagtgtggtatggattccttggttatggacttgaacaactcatcatctataacctcatcctcaacctcatcctcctcattactaacaagatcagcattaaatgacttgagaggacaaggtaccttgggctcctttgccatgaggcaaatgggagcatcctcatcacttgagtaatcgaagagcctcggtggtgatgaaggcttgacggcgaacgtggcgactccttcttcatcacttgaacttgactcggagtcggagccgaagatcatcccaatatgagcttggccataatgttctcgcttgctatgcttgtgcttctccttcttctcatccttcttctcacccttcttctcacccttcttatcttccttgaggtgggaaccatccttgaggtgggggcactccgcaatgaagtgttcgggctctttgctcacgtagcacacccttgcggagtgtcttccacttgacttgttggagtagtgcttggaagagtttcccttgaagaagccgcttcgtctcataaacttgccaaacttcttgacgaaaagagccatctcttcatcatcgatctccgccttgctcttgctctcgtggttctcttcttcttcttcctttgccttcagtgccaagtcttccttcttgatgcttgcggttgagctttggttgatgtattggataacatccttggactcttgcacgagcatgtcatgggcaaggatatgcccgagcaaatcatgaggtgtgatatttttgtagtccggacgcttagagttccttggagtgattgcccgaaccatcttcttgaccacaacctcatcagtcatgtccttagagccaagtcccttgatctcattgacgatcttgctcaaccggtcgtacatgtcgcttgggctctctccatccaacatcacaaacctctcaaattgtcctttagaatctccaccttagactcacgaacactatccgtgccttcatgcaagttccgaagcatgtcccaaatcactttggcactcttaataccatccacacggttgaactcacttccactcaaggcgctaagtattgcattagcggcttgagcattcttgtgctcgttctcgtcgtcctccttggtgggatcttcgggattctgcaaaacatagcctttttcgactattctccaaatagatgggttaatagacttcaaatgcatcttcatcttatgcttccaagcggcatagtccgtaccattgaagtacggagctttgccattgtaggtactcacataagatgtagatgtggagggatagtcaaaaggaatcctagctcccttttcaccatcattaccatcccccgtttgacccgacatgatctctccaagcggttaagcctaattaggagatta

SEQ ID NO: 91625 - DNA, 668 bp, Oryza sativa
gcgcgcagcggcgaggcggccgcgggcgaaagcgacttagccgcccgcctcgcagctgccgaacacaccatcgccgatctgcagggcgcgctagactcgtccgccggggaggtcgaagccctccgcttggcaggcgaggtagggcccggcatgctttgggacgccgtctctcgcctagattgcgccggtcggcaagtgggcctctggagagggcggaccgtaaagtacgccgccaaccagggaggcctcgcccagcgcctctcgaagatggccggggctctccaacggctccccgaggagctcgagaagacaattaagtcatcctcgagggacctcgcccaaggagcggtggagctcgtcctggcgagttaccaggccagggaccccaatttctctccatggatggcgctggatgagttccctcctgggaccgaggacagcgcgcgcgcgcaggtccgggatgccgccgactatatcgtcgacagcttcgagggctcggcccctcggctgcgttcgcccccaactccgacgaggagggcaatgccggtggtacagacgacagtgacgacgaggccggcgacccgggcgcatcggattgagccccagactcccgccattcttcagttttttcttcttttctttcttctaaggccttcgggcctcttttt

SEQ ID NO: 91626 - DNA, 680 bp, Oryza sativa
agaacaaaaaaaatcatgcttgggctaaagtaatcattcaagtctttcagatctaaacagcacgtaagaaatgcagatagaggttggctgggtcagctgattggttttatacggtacaaaatatgaaaaactacttgcctggttgtatttggcaaggcgctctgatcggcagggtgctccagtcttgatctgaccctgtttcagaatgacaaagatatattcagccctcacattcagtacaagagtaacaactaatacaggatgccgtaaagttcactacagtgaatgtagagcacagaatcttaccgtggccaaaccaacagccaaatcagcaatgaaggtatcctcagtctcaccactgtggcaatgaaacacaagtcaatatacaaatggttggtagtcagaccaggtccaccaggaataaagacaggtaagcatatcagtatacctcctgtggctggtcatcacaccccagccagcacgctttgacatcttcacgggctcaatactctcagtgacagatccaatttggttaacctgttgaaagacaagggtgatatattcgcacatggaagataaactattaaacgtgaaggaaagaatcaatagaaccataccttcagcagaagagcattgcatgacttctcctggattgcctttgccaccctctgcataacata

SEQ ID NO: 91627 - DNA, 504 bp, Oryza sativa
gatgatggccgtgtggttcggcacgcagaaggacagctacttcgactcggccgtccacgcggacgccgcgttccccgtggacgacaagctcgcggcgcacatcaagcacatacggtacgacgtgccgcgcctgtgctacgtgcgcgttaagttcaccgaggtccgcgacatcgtcttcgcggacaaggcccgggtcggtgaggtgttcgtcaggtcgcgcatactgggacaggtgcacaggacgagaacgtccatggaccaccgctggaaagacgaggaaaatggtcacctgtttgtggccgccgcgccgttcaaggactacctcaacatgtccgtcgtgggcgtcaagaacggcaaggaggaggtcatcggccatgtcaacgttctgcttgacagcttcgaacgccggtgtgacgcccgcccgattagcccaagatggtacgcccaattgtccatccatctcatgtactagcaaagaacgacaaagtacctggtattaggcaa

SEQ ID NO: 91628 - DNA, 1241 bp, Oryza sativa
ctcggggaaacctcatttcccctccaaagtggtcgtttaaccgaccccctcgcaggttcgtctctcacccatcgtggctgtattcactctctcaacgcgagttttcactcacccatcttgttcgtcttctagtcttttcttttgtttcagcgagatcccgtcgcgtccctcccgccattccaagtccggccagtctgaggccgaggatccggcggccgcagaggcccggaggcgggaatctgaccggcgagaggctgcggatcgcctacgggaagccgaggaggccgcccaggaggccgcccgggcccgccaggccgaggaaaccgctcgggagggggccgcccgggcccgccaggccgaggaagccgctcgggaggaggccgcccgagcccgccaggccgaggaagccgctcgggagaaagccggatttcgccaggacgaggcgatggcgacttccgaggcagctcgcgatgaggccgcgggcgcgtcgcttgggcccactccctcgggcgacgctcaggcgacaacttccggggcagctggcgacgaggctgcgggcgcgtcgcttgggcccactccctcgggcgacgctcaggaccaaccgggtccgggggacatccccgagtccggcacttccattggcggcccgagccgcgtggcatcctctccaaggcggctcttccccacgccttctatcgccccactgaacacagagccccttctgcaggccttggccgccgcaaacaccacggtgttggatgggttaagtgcccaggtggaggccctgcaggcagagcgggcggagctcgacgccgcgtgggcgcgtgtcgaagaggggcgacgctcggtggaggccatggtggaggtgggccgtaaggctcaccgccggcacgtctcggagcttgaaacccgtaagaaggtgctggcggagatcgccaaggaagtggaggaggagcggggggctgccctcattgccaccaccgtgatgaacgaggcgcaggacaccctccgccttcaatacgggagctgggaggcggagctagggaagaagctcgacgccgcccaggggatgcttgacactgccgctgcccgagaacagcgggcggcggagaccgaagcggcgtcccgacggcgcgaagaggcccttgaggcgcgcgccatggcgctggaagagcgcgcctgcgtcgtggagagggatctggcggaccgcgaggccgccgtcaccatccgggaagcaacgc

SEQ ID NO: 91629 - DNA, 1947 bp, Oryza sativa
tccccccccccccccccggagttcaccacgccccggggcagggctcggttctgggccccgtttggcgattttagccgacccgagcccccgagggcaggattgagcgcgagtgacctatttcaagtcaagattcttcaaaaggaaaaaacagcacagacacagcctttaggaaattgaaactgcttttattgaaatactgaaaaaaaagaaataagaatgtgcatgtgtggcagcccccgggcaaccctgcacgcccgagggggtgcggggttggcccgagcccgaaacctgacacccgaccccccccctcaggggtagaagcgacgaaggtgttcgatgttccatgggttaggcagctcagtgccgtcgcccgtggccagccgtatggagcccggccgggggacgccgaccactcgatacggaccctcccacattggtgaaagcttgctcaatccagcaagcgtttggacgcggcgtaggacgaggtcgtcgacgcagagtgatcgggcccggacgtgacgctgatggtagcgccgtaggctctgctggtagcgcgcggctcggagggccgcgcgccgccttcgctcttccaagtagtcgaggtcatctctgcgacgctgatcttgatcagcctcgcagtacatggtggcccgaggagacctcagggtgagctcggatgggagaaccgcttccgcgccgtagacgaggaagaaaggcgtttccccggttgctcggcttggtgtagttcggtttgcccagagcaccgctggcaactccttgatccatgaatcgccgtgcttcttgagtatgttgaaggtcttggttttaaggcctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagtccccagacagcaaatggccacgaaagtggtatggtctgcagggcctgggccggctgatggatttgcttggcgtggaattgacacgctctacatcgccggaccaggtcgaccgcatcattgagagctgtcggccaatagaaaccctggcgaaaagctttaccaaccaaggtgcgcgaggcggagtgggctccgcattcgccttcatggatatcggcaagaagcacaacgccttgttcccgaggaatgcacttcaggaggattccattagctgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagctgggagcactcccctcgggtcccgaggcctggactccgacgggcctcgggggccggtcaggcgcatccgtctcccctaaggggtcgggtcgcgccgacggctgggcaagcctttcttcaaaggcgcccggtggggtctgggctcgcgaggacgcgagccgtgagagttcgtcggcaatcatgttatcccgtctgggcacatgccgaagctcaatcccgtcaaaatggcgctccatacgccgtacttggcgcacgtaggtgtccatctgcgggtcagagcaccggtactccttacagacttggttaacgaccagctgggagtcgcctaacaccaggaggcggcggatccccagtccagctgccggggatcctctagagtcaacc

SEQ ID NO: 91630 - DNA, 2707 bp, Oryza sativa
tctttacaaccaagtcatcgacataagcctcaacattacgtcctaattggctacccaaagaaattcgagtagtacgttgaaaagtaggacctgcattctttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgctgtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggatgaatccggcctccagaagtcgcgccacctcctcgcggatgaaggcttgacgttccggggcctgccgccgcactttctgccggaccggccttgcgcccggccgcacggcgagacggtgctcaatcacctccctggggaccccgggcatatccgccggtctccatgcgaagacgtcagcgtttgcccgcaggaaggagacgagcgcgtcttcctatttgccgtccagaagaccaccgatccgtgtggtcttggatgggccgtcgcccagggcaacctccttgaccgggacctcgtcgcctatgatcatccgctgcctcggggtggcgggggcggaggcgccaagcctctcatcgccaccctcgggcttggacgcatcggcgaggtggtccgcgcgctgctccagacaagcgagcgcgactttgaggtcgccatggacagagatggggccaccggggcccggcaccttcatctgtaggtaggcgtagtggaccgccgccatgaacttcaccaacgcgggcctccccaggaccgcgttgtagggcagattgaggtccgccacatcgaagttcacccgctccgtgcggaagttggcggatccaccgaaggtgaccggtaggtcgatgtgacctaacggccacgtgtgccccggcgtcacaccgataatcggctgggacggccggagcaccatccccggggccttgatggcgtcaaaggccgcaggggaaaggatgttgagggccgctcccccatcaatgaggacacgccccaacttcacgttgcaaacggtgggggaaaccaccatcgcaatctgccctccccgggcaacgcacggtgggtggtcggtctggtcgaaggtgagggcaacctccgaccaccgcgcccgacacgtcgcctcatgagtaggggccgcggccagaagctctcgcttcatggccttgaagctccggcgagaaacgtgagcacacgctcccccatcgacagtggcaatggtggccccaggctcttggaaacctaggtcatcatcgccgtcatcgatgtcctcggcgggggccttctgcttggcctcacttcgccgattaccggaaggaaccgccggggacttgccctctcggcgctcctgcctcctctcctcctcccacttcctcgtccgctcagccaaacttttgactgcacggcagtccgcgaggtcgtgaagggaagtgttgtggacggtgcaccacttgccggttgggcgctccctgctgggagcgccggcctccttctttttgtctcctgcaggcctcccctttcgggtggcccgcgaagcaccctcgacggcgaggacatgaccctcgtcgtcggtatgggctgacctcttcttcctcctcctatcacgccgccctatctgagcggcggatcagggggcggccgaagctgccacaccggaaccggaggggttccaggtccatgcctcctccttacgagccactcggtccgcgagctgaaaaagctccgcggtagtctggggctctttggaggcgatcttttcgagcatgcggttgtgccgcacaccccccctgaacgcgtaaatcaccgcgtgtgcagggatgcatggtatggtgttgcggacttgacagaaccgctgaatgtacgagcgaagtgactcatcatcccttcgctgtactgcgtgcaagtccgcttcctcacctgggcgcggatatgtgccttggaagttcatggtgaactgttggcacaaatcctcccaagagtggacagacgcgggtggcaagttcattagccaaccccgcgcctgtcctttcagggtcatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaccaaccgggggcacggagggctgatccccgcgtccgtggtgaggtcacactccggacgaggaggcgccctccgttgcgtggggagcacgtcggccattacgccggcgctcgatactgatgcgggcatccggttccccacgcagatcttcccgggtcggaggcgttgacgaaggagtggcggccgaatggcgaacagcggctgccgctcgccgcgccctccgtcttgacgacgcggagccggtggtagcagcaccagaggccttggtggcggaggaccgcccaccagcatctaggcgctgccgtgcagtcatgaccaatttggg

SEQ ID NO: 91631 - DNA, 725 bp, Oryza sativa
aatctttacaagagactagagaaaatgtctcattgtaatcaatcccttctctttgcgtgaagccttttgccacaagtcgcgctttaaacttttccatatgccctctggagtcatatttggttttatagacccatttacagcctactgttttggcttctttaggaatttcttctaaatcccagacattgtttaatttcattaattttatttcatctttcatggcttccaaccattcagatgagcgagcgcttctcatggcctcttcatatgaggtgggatcatcctccatgtgcgactcttctatattatgaacatgatagtcatcatggatagccgatcttctgtctatttcagaccttctaggggcctcctgttctggcacattatctgtttgaggctgttgcagctcctcctctagtgtggcaataatttctgttgaatcctgtagaataggttcctcactttcattcattgttgccacaggagagataacaacatgtgttggtaccgcaacgtcatgcattggaggcacaacatcagcaggtagagagaagaaaggttcctgagtcgacggagcaggtacagacacccgcctctcctcaagatcaatttctcgaactaccgagctccccctaatccaagaagacgacgtgtctcgtttctacaaactttgtataactgtttggacagtagaaatgataaccctttgatctttcgggtaccga

SEQ ID NO: 91632 - DNA, 543 bp, Oryza sativa
gctccgaatggaatgagctcaaaatccgcacctttaaagtcagttgccctttctagaaatctctccggcataaacttctctgcctctggccatatgtctttatctcgacccatagcccagacatttataaacacttttgcacctttaggtattgtatagcccaatatttgaattgttgttgtagcttgacgtggtaataaaaatggaacaggtggatgcaatcgaaatgtttctttgatgacagcttgcaaatagggcagtcgaccaatatcagattcttcaattcttcttgtggatccaataactcgttgcagttcatcgcatgctttagccattggtaatgggtttctaagcaattctgccatcgcccattctacagtgctagagcttgtgtcacttccagcagcaaacaaatccttcaacaaaaaccactttgagatattaatatatagcacactcttaattatgagagagcattcaggtgatgaattattcagcactaatcactaacttaacccgtgcattagcacatgctattgatat

SEQ ID NO: 91633 - DNA, 603 bp, Oryza sativa
cagtgtatccagccttttcaattgcagtcttcaagagctcaagaccctccttgttttcctgcaatatcacacaacacaaacgattcaaaccacatgctaagtatattcatttagatttctaattacggattagcttcatacatcaaaacagaagttatctcagcatctaacatcaagcaaatacaaagcaaaacagggaaacataattgaagtgaagcacttcacatggatcaacagcatagtggaaagaaagataattgaattcactgctgcaggcataagtacctgaatgttaggagcaaaaccaccttcatcaccaacattggtggcatcctgaccatacttcttcttgataacagactgtacagataaaattaattaattttcaatgacgtaagatggggaaaaggtttaaaatgaagatgaaagaattaccttcaggttgtggtacacttcaacacccatcttcatggcctccttgaatgaagcggccccagtaggaaggatcatgaactcctgcaatatagagcacatcattaaataactttatgagcaacacatagaatgagaaaatcttagttcagatcactgcctgcatggcaa

SEQ ID NO: 91634 - DNA, 552 bp, Oryza sativa
ggaattatagagttaagcaaagtatttaatgaaattttatctggccccattttatattggaatttattaattaaaattagatcttctcttctaggcttttaaaatcatttctaataattccaattaaacaacaatttatatatttaggatttttagggtgtgacaaacctacccccttaaacggaatctcgtcctcgagattcggaagaactggcgaatagatgcggatgagctgacttcaattcatcttcttgttcctaagttgattcttcttccgagtgattactccattggactttataaaaacggataacttgatttctggttcttctctcatctatttctaagatacggattggtttctcaacataggttagatcctcttggacttctatctgttcaagattagcttcttcggtaggtacccttaaacactttttcaattgcgacacatggaacacattatggactcctgccaaagattgaggtaactccaactgataagcgacctctcctcttctgctgacaatcttgtaaggtcccacgaaacgc

SEQ ID NO: 91635 - DNA, 885 bp, Oryza sativa
ccttgccgtatacaattccgccaaccagcttccggaatatgttgtctttactgggatgaaatgagccactttggtaagtctgtcgactattacccaaatagagtcgtggcctgatgacgttctgggtaggccagtgatgaaatccataccgatttcctcccacttccactctggtatcttcaaaggctgcaacaaaccggcgggtttctgatgttctgccttgacccgctgacaaacatcacatactgctacgtattctgcgatttcacgcttcatacttgcccaccaaaatctctccttgagatcctggtacatcttggtactactagggtgaatggagtataaagtatcgtgagcttctttcagaattgcatcttttaaatctttgttgtcagggacacagattctctcgcccaaccatacagttccttgctcatcttccaagaaaccgatagcttttcctcttctcatattcttcttgatttcttgaatatcaggatcattaatttgggcttctctaacctgatcgattagagtgggctttgcttctaaggctgcaacgaaacctctactgacaattcccaaatttaatctttcaaattccttgcataactccaatggcaactgtcgtccttccgtagcattgcaatagcctttcctgctaagagcatctgctacaacattagcctttccctggtgataatgaattcccatatcataatccttaattaattccaactatctccgttgtctcatgttcagatctggttgagtaaagatatactttaaactcttgtgatcggtgtacacctctgtacgagtaccaaaaagataatgacgccaaattttcaacgcatgaaccactgcagctaactcaagatgggt

SEQ ID NO: 91636 - DNA, 660 bp, Oryza sativa
agattttcctttgttgaattctagattgcattgtcgtgttgagtgctggtttatttttagatttaattttaagttttgagtggttgcatctgttcatcacttaggcctagggttcatcactcaagtcggtgtgagttgtacgtcagttttaggtccagtttttcatctcaacgattgttgctggtatcttgaaaaattgaatcctctcttcgtcgggtaaaaaaaggtaatgataatggtgctacaactactcaaggtatgtatatttatgatgtgccaactatgtctactacttatgctacattagagcaacccatagtggaaacaattgctgaaatacctttgtcacaaaataatttgcttgatgtttcttgtgataaagaagagttgtgcgatgctccacttatatccatgccacaactagtgaatggacatgttagttctatagtagagccaccatgtgttgagtttaaacatgttattaacattgctagcgagaatgaagaggttaaattattatcttctttaaatacataggggtatattctatttgatgatgtttgtcctatcaactgttcagagaagaaattatttgctagatttgaattgccatgcccttctgatgtgatttttcatattattggcaattatgatagtaaa

SEQ ID NO: 91637 - DNA, 791 bp, Oryza sativa
ccgattgtggtatggtgtatgcattccacccaaatccaatatctttggtggtggagggaagtggttgggaatcttggaagtctgttctagagaaggactccaatggaagctggattgaacttccattagtgaagaaatctattgcaatgctgcaggcacttttactagattctcaacttgggggtggccttggcattggagggggatctggggctggcatggatgctatgagtgcacttaatcagttgttggatagtgatcagccattcttttgcatacttcggttgacacttgcttcaatcagagaggatgacaatggggaggatgacatttttatgagaaacattagcatgaagaatgtcatatctgaaggattaggctgtcaaactggaagcatgatgattcatgatgataattcttgttcgccttccaggaaacctcaatctgcgcttctgtggaggtacatagtgtataaccagaaaagtgtagtgatttagaataatagcttgttcaagtcatattctgaaaaaaaggctcttagctcagtaaccctgcaaatatgtactccctctgttaaaaaatataaggcatattttatttcgttaggacaagactttgatcaacacttactatattatgatatactgtcaccatttttaatgtttgacgctgttgacttttgaacatatgttcagctattcgtcttattaaaaaaaagagcaaatatgcaaaaatgttagtcatgcttaaaatacctttaataataaaacaaatcataataaaataaatga

SEQ ID NO: 91638 - DNA, 721 bp, Oryza sativa
gttctccattcgaactcggtacccgatttccacctgtccatccaggtgccgacattgatcaaggataacatccaacagactttgctcgatacctttcgaccggtcggaaatagacaatcctaactggaacgacctcttgtgggccgggcgccccggcgggcgggcaatccttgacaacataaagggtaagctccagctgcaaccatggaagcttgcgggcagccgtcaagtgttgcacgattaccggaacatgagtggtgcgacaatcgcgttcgtgcttgacgaactacgccggcgtcccgataacgaagaacaccagctaccccagcctgaacggggagggatgctacccgttggaccaaggacaggactgacgcacatggaatgcgtaccccccatgtccggggtcccagacaaaaaacctgaccagcctcctgaaataaaggatcgggcaatcctctgggggagggggatttcacgccgtgaggtttattaatggctggcaacgaactcgttgcgctggttaatcggctcccgcagcggaatcacctcactaaaggccggtaatcgggttccacaggaaacagggattcctccaggaataacatgcgaccaaaagcccgcaaagggccggaaccggataaaggcccatcgcttgcgcttttcaaaggcttccccccctggcaagcatcacaaaaatccctccccagtcagagggggg

SEQ ID NO: 91639 - DNA, 743 bp, Oryza sativa
  unsure (1)..(743): unsure at all n locations
attgaaannctggatattttgatattcgagctcggtaccctattaagtttctttgcaaagaagggacataaaaaacatctctaagtaaaagtgtgaagccattcgcgagctctaggcgaagatctctaatagtttcaacttttgcttcaactccattggcaactctaatggatctttcgcttctttgcgtagtcctcatcgaacggaatccctttaaacaattacacacatgaatagttgctccagaatcaatccatcatgtggatctagaataaccaatcataatgagattcatttacaaatgtaataatgttctcacctttctttgccatgatcactatcaggaagtcaggacgaactttcttgcaatgccctgtcttcttatagtggggacactgatcttgtcttaactgtgaactgttgttactgaggcagatgctgaggctgttttgcttttgagggggggggggtgaccagtggctcttttcctttgtatctttaacaaggttattggaggcaccattggtctctttgattctttcctcctcttgcacacaattagagatgagctcttcaagattccatttttctggacttattttgtagttgacaacaaagttgtcaaagttctttggcaatgaggtcataaccagatggaccaaaaaggcatctgagatgcccaaatccattggcttcaacttgaaagccatgtccctcatcctaagaatgtggtcttttacacc

SEQ ID NO: 91640 - DNA, 5211 bp, Oryza sativa
ccacccctaccaacattttaatgtagtatagatatagatcctctagggcaacaaaattaggacccaagataatatattaaaatatacagtttctgtcagcaaaaatatcaatgaatatgtatcgtcatcagcagataccatcacaagaaattttacattgtccatctatgtcaactaaacatcccctaacagtctcagcagatagtagtctttctatttccagcacaaaaatttactgacatgggtcagttttgggaagaaagataacacaagagggttgaacaagtggtcaaaggatggggcaggacatcgatgtcactggccaacatatatgggacgaatagtagataattaagtaaaataacgcaatgcagctaagaggtggcaacaaaaaggaacagcacatagataacgtacccaaatattaggtctatccattcatgcaaatgagcggagacataatcactctcaagagccttcctgtgtttacatatgaaatcaacagggttctcagcccaaggaggcaattgcacagaggctgcaatacaactcaacattagaggagttcagctccattcccttatgcatacagaatgaaacaaacttacatagctttccagtaagttgagttgaccctaagtcaaccgaattcacattcgtaaataactcaggaaggtaaaacatctctggaacctagagaaataatcacatgattaggttccaccaaagattctgattggacttactcactaaggaatcacaatgaattgaaggcacatttttgaacaaaacttactaactcttttacatcattcatgtcttcaaggacactattccatgttttgttgatacaagaaaacatgtgatcatcttgaccaaacctgccaccttgctgctgaatagaaagggctgtaaaaggctctatcctgacaagataatataagacctgcagtagatgcttatgtcaacaaccaatagcacagaaatcggggtatttgaaaaaaaaacaaatatgtaaagtcacactaatcaactacaggaggaattgtcatcgatgaacagtatagaaccgattaatcaaatgggatgacttaataaattaatctaactccaaataaaaggaacacatgcaagcaaaatgctgactcaaaacatgcacaagagaaaaggtaccgtgccaggacaggagtaatgtgaactgtagtgaaattttgggatggttggatcattgaaactagagtaatgttcctggaatttcttcagtcgtgcaggattcagagcgccaattggctgcattgaaatttttcaagcatcactaccagtggttattgaaaaaggtatcatccacagagttaatgaattgaaaagaagaaaaaaaacaaaagaggtctaaactggcagcaaggaatgaggtacaggatctacctccgaaagatctcggtatgcggacggatcttcaagatccagtgttttggagtggtaatctgctaatacccatggaaaaacagggtactgcataaatagctagtgatcatttaaatgcagtagtatatttattatattcagaaaatgagttatgaagcaaacatgcctgtgcaatgtcattgtaactgcgcccagcaagagtgttcagttccatcaggtattcaaagttgctaatctgcacaatgagatggctctacttaagtgttgaatacacttaacatgctgggctgaaaaaagtggtttattgcattgatacctcccatctagcccagcgctctgtcaattgcgactttttaaggattttctcaggtctctaaaacaaaagtacaattgattaaaactttcagtaagaaacagattttaacattaaagtttgcagaactgcactgaacaccaacctgggtagctaggaaaatgctgttcaaataaggaggtttggtatgaacgattgcccgataagcatgtttacatgcttctgtatcctgataaaaatcatatacatcttcaaaatattcaggtagctgtagtgtgcatatgattccaacaacgtaaactagagtatcatcaaggatgtacctcaaaatcgaagaagaaatttgacctatctaccatgaatagctctaaagcacttcgccgtaacaaatatctgcacagttaatttaaatcagtatgacatgcaagtactataaatggttactgctaactcagtagtccataattatatgataaggacacagatgataaaagcaaaaaagttatattagttaacactaacgactgcaacaagaagttcaatgtacaccaccatactggataatgaagaaccatttaccttctactataaattttatgaagtgaagatatgaaccagctccgatctttatcttgctgatcgtattgcccactagtagatgcagcatcatccatgtaactatcgctatcactcatatgctcatcaattataaagttaatcatctttgatgtgacctgaggaaaatcattatatactagggcttaatatatctttcgcatattacattggagatgaagcagaatactaccataaatgaatagaaatacaagaaaacaacttataatgtaaaaagaaagtgatatgacaaacataactagttatgttcatcagagaattgagattgattaaaatccagttaagaccaagatatacagcaaaaatattaactttactaaaacagaaaggaatcatgaatgtgtagacatgattattgtaacttcagtttacaactaatatgtcataatcatgaccaagaagtaatggcattaattagaatttgaaaacacccttatgcatgaaaaactacaaaagtgaaagtacgtacattagaaaccacttacttggaaggttccccgcacaaccttgaatggacgcaccatcaatgaaggcagttcaacaataattctctcattatttttgctagaactgtaacacggtgcaaccacggtcgatcgaaccaagttgtgaacactagaaaagtcagaacttgttgaatcatctacactgctatagatagtctcagtttctgtctgtttggcattcccatgtcctccatctactgatattgcgtcagctactataatggaagaatttgttcgaagagcatttgcaaatagagagtctgcatcttccctgtggctataattggattctgcaccatcacatagaagcatgttctcctcataattattggccatactcaaatgttcagaccatttgtagtttcttttcataaatcttctcattcttgatgaagtttctgtggaatctaacttccagaaaatctgtgtagaaaaatagtaaagcaaatcaagatgtctataagaaaagaaggcatgcatagtgtttactgctaagatgttctttttcctcttgttgactgaaacaatttatttgtatcatcataaattggtcatcaaggatagagcttttcataataatgtaaaataaaagaaaattttaggaaaagcaggactgttcgtacgttatcaggagtacacagaagttccccaaaaggtccgtatagcctacttgtctctattaagcaatgaacaagacgtcgccatgcccgaattccaatagatgcacaacgacgattcaaaatatctacctgtgttcgcctctccatctgcatgtccaaaagttgcctcaatggtgtattcacaagttagtaattcctaaatatcagagcagaagcttcccattccatatcaacatacctcaactcgttgcaagttccgtgccaatgcaaaactggaaacaagaagtgcaacatatttgtatgaaagggcagaaaaatcccttcctgatactgactttgaatcagcagattgaagacactccaaccaagcagcacacatagcttcagatgtattccacctctgggccctctcaatatcacctgcagccctcctttgtcctgaagttgccattgctacagcactaagaccccttctcgagccaatcttagcactgcgctcaaggtcacgagcagcagccaaggcagcagcttttgcagctgctttatcctttggtgcagatgttggtaggtttggtgttgcatcaataggcttctgaaaacttgagaaagtgtgtagtttagcagatctacgctctagcaatgaggtgtcacgcctgcgcaacttatttgttggtggtgctattgtttctgtcccagaggtaccagcagcaatcatggccaatgccattgcaaccgggggagaagcaaaggcagcagcccatccaggtgatatcattgagacagcagcctgagttcaaaagacacatacagtaatctcaccatgaacagataacctccagaaaagcatagaactgaagaggtctttctcaatagtaattattgcaaagtagtttatagttatgctaatgatccaaatcgtttaaatatttgacaaaactagctctgaagcattccatgaactactcaagagactagagataaaagaaaggagagatactgggacaagtgactactgtacacagcacacaccacatagtttcacgagcacaaaatggaagtgcctgatgagcaattgttaaaaagaatgaggatttaaggtaattagccaaattcagacactttgcaaacatagcattttaagctggatatgagaggagctcccgtattgattttttttaagaggtggtgaggctcaaaactaggctagctagctcaccaaggtgctagccggtaagactccgggtctttctcctaaccagaacttctactctacgtaaaaccaacattagttgacacaggcatacagcatcagcgcaactgccaggcaatttaagttgatagccattgtgtacgaactgtgaagaatcaattgttacctcaataggtaaagtgtctgctgctaaagcacagtcatcaacaactagtggattttgtccatctgaagatgtgagctcatgaattccagccaaaacagagcgatatcttttcagtacagctacaaatggtggcatgatcaatccaacatattttttccttagtggttttctatcactacttacagcatgccatacctgttaagatagaaacaacttcatgaataatgcataatataatataataaactttcttcgctttatctactaaaaacaaaaaaaaaaaaaacagctcatagagttccacaaatttccaagacctaacacagaaaatttta

SEQ ID NO: 91641 - DNA, 1834 bp, Oryza sativa
agttaacctacatggtcatctagacatctagtctagtcttaggttggctcatgcgacacatagctctttgtacatatttttccttgctaatagaacagatatgtagtttagcaccataggtcttttttatgacttcaccacttgcctttatggctaagggcatatcatgtaggccatgatatatttttccttgcaaatggaatagatgtacagtttagcaccataaaaacctatatagcatatgatggcaacaacacatggtataacttttttccttcatggccatatataattaacgatgagaaaatgcaactgcagtttatgtggacttcattgaattattcaacctggattacaccatggtacatgtgtgttgttagatgcagatcataagcttccatggaagtggaacgtgatattacctctgaataaataatagaagatgcaaccaaaaccctctgtctcttagattcagaaacaggcatattcaaaataggaccaagcactctgtacaaaaaacaagaattacatatatgaatgaagataatatggattaaaatatcaatgaagagatgacggagaaacaattagtctggaatataggctgagaccgaccactgagaaagaattgatcatgatgtaacccaaaaacaaagcttaattcacataattaattgtgcaaaaacatacagtaagggaaaaaaatctccaatactcctcgttaggagttcaatgcacatatattttcattaggttctgtatttgatgttcagccacattgagaaaaagaaaagaaaagggaaacatgtggcaaaattgaatgttggactcttgtaccccatttctactttggggcaaattgttcagtaacaccagaagatagcacaggtcggagaatggcatttgtgggcatgtcccctaaggaccagctgtcagactaatgatggacgttagtctctaatttatactccattaaaaaatataaggcgtattttgttttgttaggacaatgctttgattacaaatgttttactaatatattattaatgtgatacaaaagcataatcataagtactccctctgtcccaaagtatagcatacgggtattaacagagggatgaaaagatttggttgcctcctcggtatagatgaggtataggcccagactatttggggctataataaaacaacggggtagtagggatagtatggtaattggtaagtttaatggtaaaagtacaatactaggtttgagcagtagaagttatattttgggatagagggagttaatacttttgaataagaatataataacattaattttgtgttacaaaaaatactccctctgttttttaatgtttgacatcattgacttttgaacatatgtttgtttggccatttgtcttattcaaaaaacttacataattatcatttattttattatgatttgttttattattaaaggtattttaagcatgactaacatttttgcatatttgctcttttttttaataagacgaatagctgaacatatgttcaaaagtcaacagcgtcaaacattaaaaatggtgacagtatatcataatatagtaagtgttgatcaaagtcttgtcctaacgaaataaaatatgccttatattttttaacagagggagtacatatttgcagggttactgagctaagagcctttttttcagaatatgacttgaacaagctattattctaaatcactacacttttctggttatacactatgtacctccacagaagcgcagattgaggtttcctggaaggcgaacaagaattatcatcatgaatcatcatgcttccagtt

SEQ ID NO: 91642 - DNA, 8333 bp, Oryza sativa
acagacttccaagattcccaaccacttcctccaccaccaaagatattggatttgggtggaatgcatacaccataccacaatcggcttctgtacttcaaccttctgaaagatctgaaatacaggtcccataggatacaaatgcatgcctaacagatccatatggctccgctgctgctgctgcagtgacacgttccatcacctcagaagaaatttgcccgttcgcatcagccatagaagcaagaacctgatgttttgtacaccaacaataaagatagaattcaaaacgatggtgtgaaaagtagttcaaagcaagttaagttcaggctatgaaatatccttttggattatactcatattgctaccacgaaatagcttatatattcatgcttgtcgagttctaggaaagaatgtagaagaacattcaagacagataatagagataataggtacagtataccaacataaaatggccaaccagctactagctagtagtttacagacatttccttttgtcaagaaattagtgtacacgcatttctttttgtcaagaaattacaaactacaaacagattttcaattctaaaactacgtgtgtacaaagaaaggctgggagacacaaaaaacattgttcatagcaccaactcttcagaaatctcatagcagtatcctttactttcaattttcttcacgagaaatttttcttagaatttggacaatcaggtgtcttctcatacattattctatttatgagtttaacagcattagacaaagacaaaataattaatatagtgaattcataaaaggacctcgaaaaaacaatcaaagttgattcagtcatatgcagcaacattgaaaaaaaaaattgaaaatttcggagctccattatcatgttagtgaacactagattgaaataatgcaaataaaattatgatatatggtcttctagatatacatacatcaacaggaagaccaccagcatcactggacaaagattgccttgagccccctgcatccaaaggttcactaccagtcctgctcaatgaatttgatctagtggcagctgatgaagcccctgaggcaggagatgcagcactatcaattgagcacgataagaaataatgttgactgcgtgacctcaggtgatcttctacgagcatcagaagaacaattgcattctcagccaaggctagagagagatgggtagctttatctgcttggattttagtttccttgggcatcataccctcctctgcaacaccagctgctgcagcattgattccttcagtctgctatggatataaataataaaagaatatcatttgcggactaataaaattaactgaatactttctaccttcatagacacaatatgtgctatgtccctaagaatgaactcatgagtaattgaactggaattttctgcgcaacatcatgaagaactaattctgtttcaagagtgcacaacaaaagtgaagtttggaagacaaaggcaaagggataaattctttatttcactggaaatatcaaatgatggtagtagtgtgaaaatgaattgctactgcggtcacacaatcatgacgtgaaagtgtggtaatacaagcttactatgttcaatctagggacctagttagcggagcaacattaggagtcttgtgattctaagctcttaccagacacctgcttatccctatgcttatttggtaaggctatgctccttcctaaactgaaacttaagtcagggaagatgattttggagttctacaaggttgcaaggaattagaaaccagattaatcatgtatagtttcctgtgctaactccatgagttagctagtttcacttataatcctagtaaagtggtatataaatattaccaagaaaacaaaacagaattattacgatgacttattccccaaatttgctatcactttacacaaactgggagtaaaaagtctaaacagattgatgtggaaaagaaggtagaaagtagcaacaacaaaatatacaagaagaattggctgacgagtatattttgtaagagaagcaacatctacctgaacttgaagctcctgagcagaaaattcaagcagattacccaataatctccttttgaaaatcggtaacgattcctcacgccttaataagaagaaaatgcaaactaatattagcatatcaagattgacatatgttttaagcaccaacattcactatagttcaaaaacacaggggagtatttcgtaatgacatgacaaagctccttcagattctcagaaaaataagagagagatgtaacaaagtgcaaaaggctgcatgctaaaggagaaacttttttagaaaggtagaaacgaatattttgtaaggaatggtttagattatatgaggcaaaaccctgtaagtattcatgctttagcaaccttattgattgtggtggtttatcacctcaaaatttctgttagtgcctagtagatcaaacaatgacaggatgaatggaaaacatgttatggggccaatgcttcttgtttacctaattctttggtccccagtgctagatcctccaaccattgaaagccattctgcacaatgtatcgttgcctctacatcctggaaaaacccagatataatgttaccataaaaagaaaggttacaatcctataaagtaagttaatatcaaatagaaagatatgatatcaaagtcacttgccttccacccatctttctgccgcattgaatgctccaacatgatagctagataattgtatatatggtcttccatcacacttaagcttggaccatctgaacctctgttatcacccatctacatatcaatttttatacattagaagttccagtagtgaatgaacaaaagggggaaaaaacaagaagaagaatacaactgtcacctattaatgtaaccctcactaaaaaatgttttcatttgtcatcacagaaacgttacctcatgatttgaaattaagacctccaaaatccattcgggccattccgcaatggaagtcagtgcaattctattctcattattagttccccccaaatatagaagatcctgaaataatataagcaataagtaatcaaacaagagattttatgaaagatgatatacgatagtaaaaaagataatacttattttaagatttacaaaacatctgcacgtcgtgtatttaaatacaatgtttaatgatattggtacaatccatgccaataatgttatctgtggtaccatcaggttcttaaagtcaacagaaaatcaagacaatttaaatttaacaaatcagtaaaaaaaacctgaatagcatgggcttggaatgcccgtgatgcaaatggaagagaacggagtagaactgacaaaagtggagtatgcttaacacggtgaccagaatcatgtagtttcaagctaccatttgctgaaggaacattgatctgcattgaagaacacaagtcaacaattaaggaatttcagagtacaagcagttgaatctataatgagcaaaacttccactactgagaagcggagtaaaataaattaagggttttttttcttttttttaaccaaaatttagggctttatttgtttcaaaaatgttctcgaatgtctcttattcaaatacttccaagatgattgggaaaatgataaacataataaaatatttccagtaaaaagaagatcaatataacccaatagaaaccaaaaacatggatggccagcttttgataaatgtttggttacatttgttgagctaaagttttctgttcgagttagtgatgataatgtaaaaacctcttgaacataaagactcgttaactggtagttctgtttgaactatagaggttcctgttgaagttttttgttgcaatgtgtcacttatgtttgcagcaccatcctaaaagtcatgattgcatcactggcatggacccattagtgtaattctggaaacgtgttgtatattaattattcacaaggaacttaaaggcttaaagaacaccataccacagcagaaaataaagctttatagacatttctggtcataagccttcttggagctgcttggaaagctttctgcattgcaaagagcaacaaagaaactctgtcttcaaacatggaatttccttcgccattagaggtagttaggaaactgctgggcaactttggctttgcagcaggcaagttaaatttcaggtgacctgatgcaactaaagcacccaaaacatgaacaattccaacaagaactccatctccattatcgatattgtatatgtcgttctgaacattgtctgcaatattcagaaagtcaatgccacctagattctttaggaactgattcttcaataagcaccatttgctagagaatccaggttcagtgctgccttcgtgacagggtggttcatggtgctccaatggttgagtcttatgaccattgcagtttgcttcaccagcagtagttttcaaatccaaatcactactaatagattttgggtcagaaccagcattccacagagaattctgtggcacaatacaactgtcggaaatattgttatcaccagatttagcctccctttgcaaaagaacaagtaatgcctctacacctcctcgggaaatgaatgactgagcaaacacgttggctctagatgtgtttggatgtacaatcaatctatagatgaggagcaaaaccctagcaacctgacaaagcatatcgttaaaatcaccacaacagcacactcttactcagttaccacttaaagaagatatgtagattgagatcatgggttggctgcatatctcattcactaaaggaaagtagaaaatatatatgtgacaaatcatagaaaccacatttgatctttagaagaaaataattgcgaagaaacattttatagttcaaaatctagcaatgatgtgattaacaaagtactgttactttggaattttgctgtactgaaactaacacatctcattatatattgagatgtgagcttaacatgttctaatgaaccatgaagattaaaaattggatatgaaaggatcaagtgtaagcatcatcataatgccaacaaaactatgtcaagaatgtttgtttcgtgattgaaactaacatatcagaatatgttactaatgtgtgagcctttacatgttctggcaaaccagaaagattcaaaaattagatatggaaggagcaggtgtaaacatcatcacaatgaacaagggaaatgctggcgaaacgatgagaacagtatttgcttcatggaatgtgcaaagtccagttacctggttaggttgtggacagtcaacaacaaagcccaccaaagagcgaacatcatcagaagccaatgtagaagatactgctcctagtaacagttcaataacaaccaaaagctcatcaacaagagaattcactttctctaaaggtctctcagttccagtaaatgtgaatgtatcgattgaatctgcttcatgaattacccagtaacaccttctgcacccatcaaggagcatctgtagtgcatttgcatcatgcatgcaagccgattctgcaaaaaccatgtccgcaagtgaagatagaagctttttctgcaaaacgtagttgcatgaactccacatcttcaggtccaacagcaaagtgctaaagagctgcacttttagaccatgatcatttttttgagactgacacagagatgcaattgctgcaacaagctcctcatcactcagtatctctttctccccactttctaatctcgatagtgtttctaataggtaatgtaacacttgtgataaaagctctggtccatgggcacggcatagctcttccttatttccaggatgttgagttgccagcgaaataatcctaaaaataggaacagaaagagaagcagttgcaagagacgatgacaaatccccgagtataggttccatattatccatctcgacattgctcacagtcaatggtagcaaagccattggacctccataagctaatgcccacaatgattctgcaggtcgcactcgatatgataaatgaaccatcccaagaacttctgcgggtcttctgtgggtacctgaggttcaacatccaataatatcagtaatgattcttctaaatcaaccccaggcctttgtgcctttgtaagttatattattgcatggcatgtgtttttacacccattggaaacaccctgatcccagataatcgttaacagcatgggactataacattttgtttggatcaatattcaatataggcatgattgatgccagatagaaaagttatgcagaacgtgctaggcaatagcaggcaacccaagcaggaagtaataggataatcttttagcagactgagaaacattagtgtaactatttaaccacgattgtgagcctgtaagtagactatggttcagctgccaagtaacaaagtactctctctgtttcatattataagtcgtttgacttttttcttagtcaaacttctttaagtttgaccaaatttatagaaaagtatgttaacattttcaatacaaaacaaatatattatcaaaatatattcgatgctaaatttaatgaaactagtttggtgttgtaaatgttgctgttttttcttataaacttggtcaaacctaaagaagtttgactaagaaaaaagtcgaacgacttatgatatgaaacggagggagtagaaactaagcaaggaaagtatgactggcaatttataatctacttaattatcaggtggataggagtgcaacaacagtctgaacaatataaagaaaaaggcaagcataaaacaaacctgttgaaccagaaggtgaagcatcaggacagaatcgaccattgagtagactaggatgataaagaagatgtaagcttcctccaatctcaatgtcaagtgtataattgtcttctgcaatgtgcctaatgtgagcatttgtagctttccaaggcaaaccagaaccattgctgaagctggggagtgcatcaccacccctagaagctatacggctcattctctcaggcccaattgactctgtgaagatgtagataggccccatttctgcaaacaatggacattgtcgccggcgctgctgcaggcccgcaatagttggtggtgggttcgtcccaatgcagcagaaggccagaggtttcaagatgcgaggtaactcgaatggacagctctcatgaagctccccatccacatacaaccgcaattcactctcgaccttccctagcagggcctgcttgcttgtgtactccaaaccaacaaaataccagcactgtggtctgaattcataagtgaaatgcagagaagccttcttccccttcccagccccactctccacgaccagaaactggccatggaagtaggcctccacgccatggttatccatagtgaggaaacagaaaagtcggggcatgtgcttcgtcccctctcccgcaagtgtgctagcagcagcggctgctgctgacggtgatgacttcccggacgttgaggctgcggcggctgcaattgctgctgtagccatgcctgtgttgagcgagtccgagaatgactcaacatatatccacgttgcaaaaccaaaaccgtttgagaatggccatcggctttccgcaggggcaagcaagccagagccctccccaccgagctcaaatgtcactgcaggacccttggcctccttgcagcccacagccttctccaacgcaagggtcagcgacgtggcccagcacgtgccaagtgtcttcttgatcaggaggagccaggaatgtaggtccttgacactaaccgagtgcccacccagcatctggatgcattgcacaagcggtgctccgtcccacttgcttctctgacccattccgacgaacagcttctctgcagcgtcgagaaggatggcgagaaggcccgatgaagtgcacatggtgcggtttcgggtacaggagctgagggtggcgaggagggcgcgggccatgcgagtgcgtggcgacggctcgacgccgcaggggatgtagggcaggagctcggccgcgatggctgccgcgcgcgagctggacatgatgctaggcaacgtgacggcgccgtcgcctgccccctcgtccagaccgtcgacgccgcccatcgtgagcatcagcacgtccacgacgaaatgcgagagctcttcgtcctctccggagaccatctcgcggagcgctcgagccgccgcccatgatcaccgcgtgcaccgcccgcaccacctcctccggcacgtccgacggcacgaccggtgccaggcgcttccgcagcgatggcggaaaaggcagcgcggagtactccgagggtgccaccggcgatccctcgctcat

SEQ ID NO: 91643 - DNA, 2761 bp, Oryza sativa
caccgactagatgcacctaataggtgtagcccccgacaatgtggttaattgaacaaaccaagcatgtagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaagcaatgatattgtatccaatcaattgcttaaaaacccaaacagcaccttgacttatatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaacatatgccttcgacaccctttaaaggatgacgcatataacatgctcccgagtaataaatcttccgggtaatatagaccaagcgtagctcatatgaatagcttctgatctgagtggttatcccttatgggatactccaaaatagatgtaacaattgaatcccgactggcgcaagtattcagttgataacccttacggggaataataaatagtccagtctttgagcatataaaatagacccatgatcatgaattcatgttgcatgtatccggagcaagtccaaattgaagatataatacttgtatttgagctagtaagcccctgagcacgtagtcacaattcttcatcgatggtagctgacgcagttggcatagagacaagacaaccaatatagagagaatattgcccaccagaggtggcaaaaatattggtggtagtgaagatagtgataccaatcaaaagtactgaagtcgcatagccatggaggcgaagaaaccagtcggcggcagtcaggtcagccagcaatgaatatgaaggcgctcagcgataaagttgtgtagttgacgacgacaaacgcaaccgacatgatgaagatgacgatgtcggtgatccagccaatagcagtgtagcaaccaatgataatgacaaagacactcatcagcatttgcatagtaggtcaaccgtcaaggtgaaataataagtcggcgaaaacataatcatccattagcaacagcagagatgtcagggtcgatgaagcagaggtgctggtgatgatgtcagtgacaataatccatcaaattaatgttatagctgttgtagatgcttcacttggaggagaattgatgttgttgcccaactcgtctaaaccgaaatatttgaagttgttgaagtagaatgtctgctccgaagcaaagatgaagataatgactcctggagttgactcgtgggttgatgaattgatttcttcagcttgacataaattttgtcaaaattttgagccttgtatttgtgtagcccccgactctttgattagttgggaaacaactgaacatagagtcgagaactgtagcctcttgtcgtcgaatagttattgcttgattgaagatatgtgttgaagatgtccaagtagaaatcctgaatattggagagccacttgttgtagtaaaataacacggcatcgcatgccgagatgtcgaggttcacaaagacgtcgtggttggtgaagtagcaaaacttgcgaagtagcagcaatagagtttgccagtgacgaagataataaagatgaagtcgctccaccatgatgacaaagttgcatcgccgtgatgaagtgaacacgagtcggcggcaacagaagcaaactggtagcgaagacgcgcagttgtgaagataaaagcaccagtcggcggcggcataaccagtcggcaacggaagacgatgatgtccatcagtagtggtagctgtctaaaccagacgtagaggtgagggcactagtcagcagcagatgtagacagcttgcgttgaagatgatgatgcttattagcggtgatggtgatgtagccagccgtgaagaagatagcatcagttggcgtcataacaggccagccgttcaggcggtgacaccagtcggcggcggacgaggcggccggtcggtgatagcgtagacgcccaacaacggcagcataataggccagccgtgcaggcggaaacaccagtcggcggcggtcgaggcggccggtcggtgaagacgtagacgcccaacaacggcggcataataagtcagccgtgcaggcggaaacaccagtcggcggcagtcgaggcggccggtcggtgaagacgtagacgcccaacaacggcggcataaagaccagccgtgcaggcggaaacaccagtcggcggcggacaaggcaagccggtcggtgaagacgtaaacgcccaacaacggcggcataaaggccagccgtgcaggcggaaacaccagt

SEQ ID NO: 91644 - DNA, 3044 bp, Oryza sativa
gcggccggtcggttaaaacgtaaacgcccaccacggtcggaataataagtcaaccgtgcagcggaaagcaccagtcggcggcgaaaaagcaagccggtcggtgaagacgtagacgcccaacaacgtcggcataaaggccagccgttcaggcggtgacaccagtcggcggcggacgaggcggccggtcggtaaagcgtagacgcccaacaacggcggcataataggccagccgtgcaggcggaaacaccagtcggcggcggacgaggcggccggtcggtgaagacgtagacgcccaacaacagcggcataataggccagccgtgcaggcggaaacaccagtcggcggcggtcgaggcagccggtcggtgaagacgtagacgcccaacaacggcggcataataagtcagccgtgcaggcggaagcaccagtcggcggcggacgaggcagccggtcggtgaagacgtagacgcccaacaacggcggcataataggccagccgtgcaggcggaaacaccagtcggcggcggtcgaggcggccggtcggtgaagacgtagacgcccaacaacggcggcataataggccagccgtgcaggcggaaacaccagtcggcggcggcgaaggcaagccggtcggtgaagacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctagatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcatagcccccaagcatcgggagtcggtctaggcatttcccaaacatgcatatgattgacatgagttcgtcattaatggaacaaagtttcacggatcagaatttactactcaggtacttttgcaattattaagagcagaaaataaattatattatctctatgcttttgatttcttccgagtaatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacggaggcaggccggcggtgaagtcgtagacgcccaacagcggcggcataatagaccagccgtgcaggcggaggcaccactcggcggcgacggaggcaggccggcggtgaagtcgtagacgcccaacagcggcggcataataggccagccgtgtaggcggaggcaccactcggcggcgacggaggcaagccggcggtgaagtcgtagacgcccaacagcggcggcataataggccagccgtgtaggcggaggcaccactcggcgacgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagacgtagatgcccatcagcggtggtgtgatagaccgtccgtataggcggaggcaccagtcggcggcgacggaggcaggccggtggtgaagtcgtagacgcccaacagcggcggcttaataggccagccatgcaaacggaaacaccagtcggcaagagtagtgccgcggcgttacatgcaaacagcagaaaataccaagagagattaatctgacatttagagatcaatctaataaacaacaataagttgaaaaggaaaaaacccggcgaagtcagagattaaaaggaaaaaactcgccgagattgatctcttcgactgactctgagacggagcggaggaggcggaggtcgcagtcgcgggcggcgttggtgtccatcagcacgacgcaggacggcaggaaggcatcggcgtggctgcagccatctcctatgcatccgattagatcggttttggcatgcttcgtgtttgtagatccatcttgcaacaccatggcatcctcgttgggtagattggaccagtaggcttggtggtggacgaggacgaccatcaaatccgtcgaactgtcgttgccccgtcgttgccgtcgtgctgatgcgaacaagatcaggcagagaatagcagcgacgattcgtcttgttgaagtcgtcggcggcaaggaatcaaggagctcccaaagcgaagacgaagccggcgactcataaagttgattccatcgcactcgtcgtcaggaaactcggcgtttacccctacctggcgcgccaactgtcgaaacatgaattcggcaataataaaagggggtagcgtacgagacctaaaagtggatggatgcggagacaaaggatttagacaggttcaggcccacacaatgagaggtaataccctactcctgtttggggatttgaatccaccgggtgtagtattgatctgacgatcaggttgtgtcatgccccctagagggcctcctgcccaccttatatagggtggggggcaggattacaagatagaaaccttaaccaatacggtatcggtttcctaaatctac

SEQ ID NO: 91645 - DNA, 1993 bp, Oryza sativa
aaaatttggacacccctttcccctctggtgatttggtcccctttcagcagcgagagactgaagctttatacccataccccatacccctctgggggaaagtatttgcacatcgatgcctccgtgatgctgctacgattcggcccttttgggacttcttaagccaatatctttttggttttagctgcagatttttttacccaaatctttggaggttttctacaagctgttatactgcttgaattgtgatcctaatgtttaaaggactatgctttttggtgtttgcaggatgcaagtggcaaagatgtggacctgagcaccttcaaggggaaagtcctccttatcgtcaatgttgcatctcagtggtaccaattattaccaatccctcacctccacagtgtctacgttttaattttgtaaacttggaaattattctagaatgcataatgtgatttatctttttcatgttgaaatgttccatgaacaacgaaaccttggaaccctagtactgcgttatcaagcgcttaagttgaatgatatgctcatttgatgcctaatataatgtatattttcgatcaaacttccattcatgttgcaaagtaaagatgccgaatttatatggtttcatatggaacacattcgagtttctatctaggccatatgagacaaatcgaaatttgaagtattgttctgctaaatgaaactttaaaaagagccatggtagtgtttgtcccggaggatcagcctttgcatgtagattatcgatatatggaaaaaataataatctggtcagcaggtaagttggttttagctggacaacaggatgttgatctcttgccaattggaaagtttgtgcagattgtcataccattaactatttttctatttgcgtctcatcctccttgtgttaagggatacatgttctttagaggacggccattttttttttactaattttaaagaccaatgagatgcagatataataaaataacatacaaactgatatcattatcctcaaattaagaaatcttgttgctctctgtcattgttgcagtggcttgaccaattccaactacacggagctgagccagttgtatgagaagtacaaggaccagggtgagtgttagatgcatctcatcatttgttccctcattatgaaatctctcttgtgcgctgaattgctcatatgttctttcatttggagtttatgaccaaccaattgctaatgtcattgtcaatttgatttgacgacaggttttgagatccttgctttcccatgcaaccagtttggtggacaggaacctggcactaatgaggagattgtccaatttgcttgcacccgcttcaaggccgagtatccaatttttgataaggtaaatttgggcacattataccactacctcttgcatttttgcactttttttttcatttatctttcaagcggaaagaaacaactaactcaagtatatgttcaccttccagagccgtcataatattttaaaggaaattaatcccattccgaaagtgttccctttcatatgtagcctgtgatgtatttccagatacttgtctagtacttaaaaggaaattgatcaagtccatgaagtttttatccgattcttatgcatttcgtatgatgtatgcgatcgataagcctgataccagttttatcctttcatttatcacaagaaagaatcatggatgtttataatgtgatgatcaattgatttttattgtttagagaggtgagatctagaagttctaactaccattatcttaataggttgatgttaatggtgacaacactgcacccatctacaagtttctgaagtccagcaaaggtggtcttttcggtgacaatatcaaatggaacttctccaagttcttggtcgacaaagaggggcgtgttgtggagcgctatgcgccaactacttctccactcagcatggaggtaaatcccgagctccaagtgggtgtaatttgagttccatctcat

SEQ ID NO: 91646 - DNA, 632 bp, Oryza sativa
tgctcggtccccatagcaaaccaaagaaggggaaagggcccgatgagccaagacgccatgttgttctcctaggcaagaggaaaatcgttggagtctaggataatactgacgaaaattacaatctgtttgaggggcaaccttcgtttgcagtgacggttgacccgagcatcatactatcaaaggaggacacgccgtactcacgcaacgatcatagcgaaggaacaatagtgaggagaaagtacctgagtaagacagcgacctaagttgtttgatggaagatgtaaattatttgtattgtattgaaggtcgaacaatttggatcaatatattattcacaactgcttaatttgtaatgtattactatttttcaaccatatgatatttataaatggttactttcatttatttacactttgaataccattaattaagcaatatgttatttataactgaataatgggatttatttccactttgaaaacaattagtagggtattttctaaatataaaagattatttttatttaattacacttttaatataattaaatgggcttatgttaaatataaaagaatatttctaattaattataccttggaaacatttacttaaggcataatcctgtttatttt

SEQ ID NO: 91647 - DNA, 1980 bp, Oryza sativa
cttagccgcgtagccgccgcttcgccgcgacgccgccgctctccgccgccggtcggttgccgccggccgccgtctcgcgcctgtgccgcatgcgcaccgcgccatcgcgcgccatggccgccgggccggtttgcgccggcccgcgcgcgctggccgcgagctcccgccgccgtgtcggggccgtcggttcggccgccgcgtgtgcgccgcgtcggcgccacgtgtgcaccacgtggtgcgccgctcctccccggatcgtggaccccgtccgccgtggaccgccctccccgagtcacagccatgtggggcccgcatgtcggctccgccccttctctctccccgggatttatttattgcgcaataattcaattaaggatttttctgtttattgtaaaaacacaatgaatcttctaaaattcataactaattcatccgagctccgtttaagcccattcaagtctcagtaaatcaagaaaaatgcgtagaatccattaaaaatggttttgttctctgtttcagtagtcttatagcctgtttgtattgtttgccttgtatgtcgcttagattccagctctcccgacgctccggtgtacttcgaaatagtcgtcgaggttcctccagctgcagagcaaggcaagtcatgcttgtcacttgaacatgttgatcctatattgcaaatgctctattgtttttcttcaaatactgcattgttttataatattactatgggatgtttacctattgtcatagccatgctatttttgtaccatgcttagccatgcttagttcaactagcacacaatgggggaaaatcatattaatgtatagacgataggtcctaatgttaatgactggattagtgccaccgttctggtgttgcataattaaaatatattaaatggtgggctgtgggtgcatggttttgctagtcgcgcctatggcacttaaggaccggttcgcgggaaaccctggaagaattcctcgtacttaccacaagccagcgtgggcaacgactgggcttgtagtgtagctttcctctagttgacgcatccaggcaagggtgggcgtgatggagcggggcgggccctgcgacggcctctgtcgcttccggattcacctaggcacgaaaggggactgcccactcccatgcgaggagtgggggtgaaacatgaggtgtggtgtgcttggttaaagggggttatgcgagggtcctgtcacggcctctttccggtatgtcgtggtggcatgtcggcacatggaaacgtgtcgtggggctgtgtcttgtgggtacagttgtacacctctgatcagagtaaacctattcgaatagccatgcccgcggttatgggcgctcaaccagattcaccgtgattagattcaccctagactagtctaatggaattgaataatataggtggatggttgggcctgttgcaacgcggtgtagcattgaacagtggatggttaatattgattaattattacaactgtttaattctctcaacttctgtttataaatgctcgctttatgcaaatgaaccactctagctctccttgataattccctgcatcatacctctattccggtatgacttgctgagtacagtgggtagtactcagtcttgctctattttccccaaaccccagagtttgagtatgcgtcagatggtggcttctccgaggagtaggcttcgttcgtgccgtcgaggatgcctgtggagtggtgatcccgctgcggttcaagtcaaggcttagctccagttatcttttagttttccactgcatttatgtaagacttttataatgtttgtaagacgtggatctgtatgtcaactttgtcgtttgtgtacccccggccggtcctggacagggattttaatacatattctacttggaattctattcgggaatttctgggcgtgacagggtcccagctcgtcccaagccaacccaggccaaccgttccacattttagttgtt

SEQ ID NO: 91648 - DNA, 1317 bp, Oryza sativa
ctgggtgagtactggcaaacctgaaggagttcttactgctgaacagcagaagcaattcgaggaagccactactctctttgtgggatgcattcttagcgttcttggcgatcgtctggccgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaactttaagaagcagaagaagaacaagaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcataagttttccattgtcaaaggttctaagtgccatagttgtgtgcaatcgaagca

SEQ ID NO: 91649 - DNA, 2665 bp, Oryza sativa
ctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaatcatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccgggcatgcatgttggtacaattatggagtctcgtgatgctaccttctttgagagctttttcccaatgaaggatacacatagtggttcgaaccaaccctctggaataattcccagttcaatcacaccaccagaacaaactgaacatacacatgaacttgtctctgaggaggatgtcagtgaagctcctcgaaggagtaagagacaaaggaccgctaagtcttttggggatgatttcactatgtacctcggggatgacactcctaagtcaatttcagaagcatatgcatctcctgatgcagactactggaaagaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggctcggcttgttgctaagggctatactcagaaagaaggcgaagatttctttgacacttactcacctgttgctagattgaccacaattcgtgtgctactttccctagcagcctcacatggtcttctcgttcatcaaaaggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagtcattctgtgcttgtatgttgacgacatactgatatttgggacaaactttgaggtgataaatgaggttaaatcattcttgtctcaaaattttgatatgaaagatttgggagtagctgatgttatcttaaacattaagctaattagaggtgagaatgggattacactcttgcaatcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggctgcgtgatctattaatggatctgcctgttgttgaaaaaccggcgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccaatctatgtgatcggagatctcgtgaattagatcctgggaagaacaaaccattaataaactagaggagagtaccaatatatataccctctccaagtgaagatgcatatactctcgtgagctgcaaggcaggttggctatgccttaatgagttctgttggctttaattagcaaagatgttgtcctgcagagcattcttgaaagaactcacctttgtgagcttgactgttggtcgcagtctatgaagattttgggtgaatcttctaggaagcttactaaagacctag

SEQ ID NO: 91650 - DNA, 635 bp, Oryza sativa
cgaattcgagctcggtacctatcgaactaatacgagctaacaataagggtcgcaccaccgagtagataatgaaagaacacaagcgactcttcatagattggttgcgagacctagacttgcttgagggacaaactaccgatgaaataactatgaagcggttggcttgtggtccatcaactacagtaaattcttggcagggatatgacattaatggatactcgtttagtacaagagcccgagataataaaacatgtacacaaaatagcggtgtccgtgtggaggtaattgataaagccggggaaaaacaatcatactttgggtttattgaataaatatgggaaatcgactatgggcacacaatgcaattcaccatattcatgtgccagtgggtaaaatacccgaacggggtcaatgttgataagttcggccttactgttgttgacctagcgagtgtgggttacaaggatgactcttgggtactcgccaatcgcgtggcacaagtgttttatgtgaaagacccttcaaattttaagaaagatatagtgctacccgggaaacaaaagatattgggagtggatggggttgaagatgtcgaagaaaacaatcaatatgatagtatgccactttatagtcag

SEQ ID NO: 91651 - DNA, 1473 bp, Oryza sativa
aagggataaaaggtccaatgagttgcgaccaccaccggtatggaggcgtaaaaccatagagaaggaaaaaccggttgttgtagagaagaaggaagaacaattggttgctaaagatgagtcatctcctaaagaagacatggatatcaacatggtatgtatgttgcctatggaattttttgctatggatgaagccgaggttgctcacttttcactaggtcctaaagatgcagtttttgagaagcccgatgaatcaaaccgtcatatgaagcctctctatctcaaaggtcatattgatggaaagccggtctctaggatgcttgtggatggaggtgccactgtgaatttgatgccatactcgttgttcaagaagttggggcatggagatgatgagttgaagaagactaacatgattctcaatggcttcaatggtgaaccaacggaggcaaagggtatcttttcagcggagcttaccgtggggaacaagacgttaccaaccgctttcttcatcgtcgatgtgcaaggtaactacaatgttattttgggtcgttgttggatccatgccaattgttgtgtgccttctaccttgcatcaatgtttaattcaatgggacagcgatgatgttgaaattgtttaagcggatacatcggccgaggttgcaatggccgatgctacttttgagtggtgtcatgggaaatattcaatgctatgattttattagtatctccaatggcaaatttgtacatatatctgtaaagctggctagtgtagcatggctaagccatataaatttgtataatgagtaaagagactaatttagagtggttacaaaagagggtgcaagaatatcggtctacaaagaacgatattggtgaaactattgaagattttgatgaagtggagaagcttggacaagggtttatatcggccgatccattggaggaagtagacataggtgatggaaccaaaccaaggctgacttttgtaaacaaaaatatgagagtcgattataaggttaagataatcgagctacttaaagagtatgttgattgctttgcatgggagtaccatgagatgccgggtcttagccgtgagcatgttgagcatcggcttccaattaaaccgggttttaggccttataagcaaccacctcgtcgttttaatcctttgctatatgactgagtcaaagaggagattgatcagttgttgaaggcggggtttattaggccatgtcgttatgcggagtgggtttctagtatagtcccggtggagaagaagggcagtggtaagattagagtttgcatagattttagagatttaaataaagccactcccaaagatgaatatcttatgcctatagccgacatgatgatcaatgatgcttcgggtcataaggtgattagctttttagatggtagtgctggctataatcaaatttttatggcggaggaggatatgtacaagacggcttttagg

SEQ ID NO: 91652 - DNA, 1136 bp, Oryza sativa
atgcattaggactttctcaaaaggcatatatagaaaaggtgttgaagaaattcaacaagtacagatgcgatgcgacacctgctcctatagtgaaaggcgaaaagtatggggcatcccaatgtcccagaaattagtatgagctcaatgaagggaaaacaaagccatatgcgtcagctataggaagcctacagtacgcgaaagtgtgcacacgatctgacttggcatttgttacctggttacttggcagatttcagagtaatccaggcccagagcactggaaattggtaaagaaagtcttgcgttatttgcaaggaacaaaaggcctcatgctgtcttacagaagatcagaatcactccagatagtggggtattcagattttgactttgaaaagataatacaaagtcaacatcgggatacgtgtttaccttggcaggaggagctatttcatagaaaagctcaaaacagactatcactgcagggtctactatgtatgccgagtttatagcatgctatgaggcaaatgaggcaacggggcaggtgaactggctaaagaagttcatacccggtttaaaggtggttgacagtattaagaaaccactaaagttatactgcgataacaaacccgcggtaatgtatgctcacaacaatcagtcaagtggtgctgccaaacacattgacataaagtactatgttgtgaaggacaaagtctgggatcaaacaatcagtctcgagcacattagaacagaaaggatgctcgcggatccgctcacgaaaggcctaccacccaacatgttcaaggaacatgtagctggcatgggtttaagggaagccttatgaatcctggactacagggcccaaaagtaaaagtatctgtttctgaatagagatatgtatagtggctgtcgaatccatcggtgattgaccgtgacgatgaaacatgctctatttacaaatctgtgatggaatagaaaaagctaaaagaaatagtgagatcaagggggagaatgttagatagatctcccatccgtcgggcccaacggcacaacggaccttgaccgcgccctgttcgggggcggccagtccaatagctggtgggcccccgtcacactgagcgccatataaaaggggtggaggt

SEQ ID NO: 91653 - DNA, 708 bp, Oryza sativa
gatcattcttcggcgcaaagatcatcggggcgattctgaaagaaaatccagatcctaattctggtgtcggttcttcagagagatattgggggcctgtcattgttgggtgatggacttggctacattgctgatttagtggaaattttgctgccaagtcgcctatccgtgaaggaggtcttcgtctccaagaactcattgtcctctgagacagagttggctaggctgcagggtctgtgcttgccatgtcctagctctgcccctctagccactcatagcagtgagctcagcttagcaaaagcaaccagctatgaaagagtgttgctgtgcaaggcagtgttgccattctactccttgtactacactgctaagtgtgctgtggactctgagactgttactcaaagtttagtgttgtttagttcatttatagggttgcatcttattgcctaattcaaaaatttctgttttgttccatgtttgatgtaaccagtgctcttctcttctatacaagtactaattgaacttcacagttctctctttgttgcatcttgcagacttttcgcatgacgcttttcttttattcttgctatgctgttcgccctttcttgtccatatattttatttttaattatttatatagtttttgagtagattacaatactttggtagtattgctcctttcattttgagatgtttaaggggtgctcggct

SEQ ID NO: 91654 - DNA, 539 bp, Oryza sativa
ccgccatactcaccggtgaggatccccccctcctccctcttcccctctctctcatttgcgccgcctctctccacgcgcttgccgtcgccttcggtcgacgccgccgtcctgtaccccgtctgccgtcgcttcccgcgccgccgattgccgtcgccggcgaccgtgcgcgtcgccgccggttgccatggccggccggccggatatgaagccgagctgagccgtgcctagccgccgccgtgccgtccgatcggcctcccggccgatccggaccgtcggtcccgtggaccggcggtggaccacccgcgtggtcccggtccacggtagaccggccaccttgagccactgcccgtggggccatatgccggcgcccccttcctctcccctttgagccgctgacccgtgggccccgcctgtcggcgccccctggatgacgtcagccctggatattattgcgcaataattaattaaggactttttctttattagtaaaaacacaatttatcttctaaaatacataagtaattcatccgagctccgtt

SEQ ID NO: 91655 - DNA, 1525 bp, Oryza sativa
ttcaaatatcgaatcaaatgaatcctccaatcttcctctgtttcctaggcacaaatgttcgaatttataattaattcggcctctaaattgattgaaccggtcagaccactcggggtcgccggtcagaccgacggcatgtggccggtcagaccacccctggtctctagttttgccaatttcacacaaagatttaaaatcaagcacctgctcttctaatatcagaaataatcatttcttcacattatagccagatgcttgttgtgccaagtcatttgctctagaattatcatgcctagcaatatgtctaatagcaaaattatcaaaattggcaataatatccaaacatgaatcgaggtacttatttagtgatctgtccaagcatttataaactccggcgacttgttgcaccaccaattccgaatcaccaaaagctttcacgtactaggcaaaactacccctatgccttgaccttctttgcaagaagaaccatcaaaataaatcctccaaggtataacttcaactaggcaaatctcttcctcataagcaatatctacatgatggtccactataaaatcacatacaatttggcctttcatagattttaatggttcataagccaaataatattctatcaaagcatatgcccgcttgccaattctcccacttagaattggcctttgcaacatgtgtttaataacatcggcttgacaagcaactatgcatgtactagataacaaataatgcctcaatttggtacaagcatagtataagcataaacaaagtctctcaataaagacataccttgtttcgacatctaaaagacggcggctcaaatatgtaatgatatattccttgccatcttcctcttgcgtcaaaacggcaccaatgactttgtcttcggaggcaatatataaccgaaaaggttttccggctttaggcgctcgcacaacgggtaaagtagacaaatacctcttcaactcctcaaacgcctcttgttgttttggctcccaagtaaaatcggcttcttttttcaagagaagtataggaacaaaagcatcgattttacctgctaggttagaaataaatcatctcaaataattcaccttacctagcaacttttgaacttccttcttgcatgtcggcgctttgaaatcacgaattttttctatcttcttaggattgatctcaactcctctctcatgcaccatgaatcctaagaacttccccgccgacacaccaaaagcacatttaagtgggttcatcttcaaaccataccggcgcatcctctcaaaagctaatctcaaattggctatgtgtcattccataccatccgatttgacaacaacatcatcaatatagatcactaagataatacctagcaaatcatgaaatatcaaattcattgccctttgatatgttgcactgacgttcttcaatccaaaagtcatgacaacccactcaaacaaacccacaaattccgggcacctaaaagccgtcttgtacatatcctcctccgccataaaaa

SEQ ID NO: 91656 - DNA, 5241 bp, Oryza sativa
tatgaactcttcattatatgttctcccagggatagcaatggctgtagcggcctcaagagtattcccggagcgtccaatgggaacgtgcaatctgcagggtgtattctccttgaggtcatcgaaggggtaatctggctcaggttctttggtttcggggcgaggtaaaagcatgtgcttgacgcagaaatccatcatttgcctttgaaaatccgcagccccatcatctctaagtttatccttgtacgcatcacgcttcttgtgggggtcatgtttgaacccttccttccaactcatcttggacgacacacctcgaaccctacccccatgctcaggagtacccaacaccgtacttagcacatctttctccctcttaggcttgaaaaatcctttcttctgtgaactggataaattctctattttatcggcaacaccctgcagctccggatcttgaaacgatactttgccttcattcgtgatctttggagttcaagctcttacccaattccttgatctctgtgtccattcctccattggtaccggaagccccgccttcctcatttcctcctcctcttttgtccactgctccacctttggtgcgtatcccgtggagcctaagtgatgaggaaatttgtatttcttggccaactctgaatacttttggctccttcgaatttcttccggggagtttttcaacgtcagaaagtcctcccactgtttcggggttatgttggcatacgtcgaaaacggtgtacgtcccgtcttcacaaatttcttgttcaaggtggttttccaaccatgccaagacttggccattgtttgcagagcacaattcctcactgctgcctctaatccatccggggactggaagattttctttaactctttccataggacttccttatccctattcgatacatgatcccagtccttgaccctgatggggatcttttcccttactattatgccgcactgtgaactgaatttcgcatgtgctgtcttagaggcgagcggctctccttttggcgaaacatgggtaacaacatggaacccttcatcccttctattcacgcttctctcgcccttccttttctttgcctttgctgaccgctcgcttttctttaagccggttgtgttagctggtacctcgtcgtctttcgacggatcttttttcttcggctgcccttttgatcgccgtggcgccgtttcctacgagaaggtatatatcaaagtttcgaattagctcgggctaatagttatcatggtgaactgtttacatattaagtttatttaccccttctatagggggaatgtagtccttgtcgccttcttcaccgttgccctttttccttctcttcgggcttgggctttgacaaggatcgcttggcaatgagtactcattgtcttcatcagctacgtcgctgtcggaactatcttccggtgggaccgttggttctggagcaaccacaacagcaagcgactgctcttcctcccctaaactcttctcttcagtccctttattactatcggccatcgtttcaaacttctaacataaaaaataaactgtatattaacaataggccatatattaacactcagcaaaaatagtttaaaaaatttataagtactgtactatgacatattgcaaacatatcctccacattttaaattactcaaattagtacaaacaactttgtataaaatttgaaatgttattattaagtagtgcactaattcacaataacatttcctcaacatgttgtttaaataaaaaataaattgtatattaacaatatacaatatgcacaaatttaagtactgtactagtttgtgtacataattgcgaaatgttattaattagtacaaactaatttgctaaattaattagtacaaacatatttgtacaaaatttgatttgttattattaagtagtgcactaattcccaattacatttcctcgacatgttgtttaaaaaaaattaaaaaggcaaacatatcctccacattttataaaaaaaaattaacatacccttgcacatgttattaaacaaatttgacaaattcacatatcctgcaaaatagaacataccctcccaatttcattcacatatcacccacattcccaaattcacattcacaatcaacatataacccctcattcacatttctcccacccctcattcccattcacacccacatgcacacacatatatacctctcacacccacatgcacacacatataaaaagaaacacccacatgcacacacgtctgtggacgacgaatggccgacgacgagcttcggtcgtggacgacgaacgaaaggccgacaacgaggttcggccatggatgacgaccagccgatgaagccgttcggccgaggacgtcttcactcgtgtacgatgaaaggccgatgaagccgttcggccgtgagactgctactgcgagagagagagagagatggtggcggcggccgtggagcggccggcggcggtggagagaccggcggcgtggtggaggggccgggggggggagcggccggcggcggttgatgggccggcggcggcgtagcggtggagcggcggcagaggcgcgcggtcggtggagcacggtggtggagcgtccggcggcggcgatgcggccggcagcgggagcggttggtggtaaagctggatcgacggctagcggcgcggtggagcgcgcgcccggtgcgagctcgaaggtcggcggcgcgcggaggacgacggtcggagggtgaaggtcgcaggcgggcggcggcggaggacgggggaggcgaaaaaatttggcagcctgacggtgccaaaatttctagggttcccgcctggacttagaaattttggtgccgcgagcttgtccttctatagggaaacgatcttcgtaggcggacggtccgcctgcgaagatgtaaaccctattcggcataactatcttcgtaggcggaccgcccgcctgcgaagatttttacagtgttgagtatatttatttcataataattattaattaatttttgtgatttgaaattgtctacagtagttttaataaaaatggtaattgtacatacaaatagacaaaccttaggactactacttttcaaatgtaaatattacttcaatgtttgaaacattaatattactactttaaaaaaaacatatagtagcaattttttatgtggtaagtgaacataaaaaattgctcgggctaaatttttaagcctcttttaaataaaacttttaaaatataaaaaaatgtaaatgttaccctacaaatggtaattgcacataaaaaatagtacaaactaatatgcaaaatgttgagtgcaaatgttcgtcaatttgcgatataatcacacatcaccttatataccactattacataactactaacttcttagatgcttacatgcgactcaacaatcattaccctttaacattttttcccacaccgtccgtgcgcatgtaaggcttcatggtcttctaagtagatgtctcaacattcttaatcttctgtacaaactgactataaagtggcatactatcatattgattgtaatcttcgacatcttcaaccccatccactcccaatatcttttgtttcccgggtagcactatatctttcttaaaatttgaagggtctttcacataaaacacttgtgccacgcgattggcgagtacccaagagtcatccttgtaacccacactcgctaggtcaacaacagtaaggccgaacttatcaacattgaccccgttcgggtattttacccactggcacatgaatatggtgaattgcattgtgtgcccatagtcgatttcccatatttattcaataaacccaaagtatgattgtttttccccggctttatcaattacctccacacggacaccgctattttgtgtacatgttttattatctcgggctcttgtactaaacgagtatccattaatgtcatatccctgccaagaatttactgtagttgatggaccacaagccaaccgcttcatagttatttcatcggtagtttgtccctcaagcaagtctaggtctcgcaaccaatctatgaagagtcgcttgtgttctttcattatctactcggtggtgcgacccttattgttagctcgtattagttcgatatgttgttcgatgtaaggctcaacgatagcaaactgatgaaggacgctgaagtgagcttcttggaatgatttgtgatcatgggtgatgaatctcttctttcctatcgttcccttgccactcaatctgccctcgtgtcggggcacaggtactccaattgcatatccatctttgaggtaatcgatacagcactcgacaacctcttcagtattataaccctcaaccattgatccttctggatgtgcacgatttcgaatataacccttcaaaaccaccatgtaacgctcgtatgaccacatttgatggaggtacaataagccaagggcaaccatctgcggcactatgtgaacaatgaagtgctccatcatatcaaaaaatgacagagggaaacacatctcaagttggcactgtgtctcttgtgcgaatgcacggagacttcctaactctttgagactaatgaccttctgtgacactgcgttgaaaaagtagcacaatcttgtgatagcaacctttaaatgctccggttttatggcctttattgcaattgcaagaaacacagtgagcaagacatgacagtcgtgtgaattataaccagatactgacaaatctttcatggaaactagtcgactgatgtttgatgagaaacctatgggcactctgacatcacggagtgacttgcaaaatgacttcttcaccgcaggagttagtgtgaaacaggccggtggaagatatactttgccattcttctctccttctttagggtgtaactcttccctaattcccatctcgactaggaccatccttgattgcagaacatctttagtcttcttcggcatgtccaacaatgttccaactatgttgtcaaacacattcttttctagatgcataacatttatggcatgccgaacctccagatctttccagtacgggaggtacttaaagaatatggaatgcttcttgaatgggggagggagtttatcatctggcttcgaactatcatcttacttcttactatcccctggtttcatagttttctcgggtttcttgcgctttgtcccctttgatggtttcttagtcacttttccaaactcgcaaacaa

SEQ ID NO: 91657 - DNA, 1026 bp, Oryza sativa
cccttcctctcccctttgagccgctgacccgtgggccccgcctgtcggcgccccctggatgaggtcaggcctggatattattgcgcaataattaattaaggactttttctttattagtaaaaacacaatttatcttctaaaatacataagtaattcatccgagctccgtttaagtccattcaagtctcagtaaatcaagaaaaatgcaaagaatctattaaaaatggttttgtttcctgtttctatagtcttatagcatgttttgcttgtgtgctttgtttgtcgcataggttttggccgtttcgtcgatccgcggtttctcgaagacgttgctgaggtctcatcagttcgagagcaaggcaagtcatgcaatacgtttgatcatattgtacccaatttacaaatatcccgcatttctattaaatgttgcattcttttacaatgtaatgtgggatgggtcctattcctcagccacatattggttaccttatgccattgataacttgggtatcaaaatgactagatgttggcttaggaaatgcttagccatgcttagttcaactagtacacaaatggggatcacattattacatagactctgactattggcatagctttagattggtgccaccgcaagggtgtcagttaattaaaatattctaaatggcgggctgtgagtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagaatgggcgtgatggaattggtcggccgaggtgttcggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagggtaccgagctcgaattcgccctat

SEQ ID NO: 91658 - DNA, 2123 bp, Oryza sativa
ctgctgaatcggaacgcctgcccgggaggaaggcgaagttgttgatgccagaaacgaaacccatcgtacttagtcggcgagacgcctcccctacctggcgcgccaactgtcgaaacaagatttcggcaataataaagggggtggctgtcaagctaggaaagtggatgggtttggagacaaggaattttatacaggttcaggccttcttattaaagaagtaataccctacttctgtccagggatgattccgccgagtgtgttattgattgtatgattgaagaaaaaagaatcgtgccccaagaggcacacggaccctccttatataggggaagggatccgtaatacaaggtacagtccatatcctaacagaatatgggattacagataaaatacaatcgtaaccgactaggatcccgggtattttcttgacatacaagtttagaatctaacccgagtcctcgtaaagatattctatctatatttggtaccatatatccgactaaagtataactgtcatgcagatatggggtatccataatctccacaggaggactgaggaggtcgccagggtgagacgagagaggaggtccgacggagccagcgagttggttgggggcgagccacccacctgaggacgagctcccgttggttggggaaggcggcggcggggagctcccatgcgccagttgcttaggctatggacgtccacgaattggactgcgtcgttgacgttcttgccgccgccgctgtcgtagaggcactacccttgaatccaatctatgtatagcccggccggactaatctcctcaagccgtatacccacgtcgtcgatcaaccatggcgtcgtcgatggcggcagccgctgctgcaggcttgtctcttgcgccgaccgcgcgcgtctgcgcggcggcgccgtggtcctcgcgcgccactccctccggctagccgtcgtgcggcactggccgtgtcgctgtcctcgccaccggccgcatggcggcgccgcatcgtcgtctccagctgctacgatcatcgtcgacaaccatgcgcacgcgcgtgccatcctgcatcgctagcaatgaccacaaccactccagcagctccaacgtggaagcggatgagaggttggcgttgtgggcggggatgagcgtcgatgagctcgcggaggtcaggaacgcgacgccgccgtggttcccgagcatggaggagatcatggagttatcatggtagttattctcgtcaaggacatccacaaaaataatacttggtatgcgccgtcgaagtagtcagaccacctgagctcgtccagcacgccggcatagtggtccatcatcgcgaaggggttggcgtgtcctaggtccagccacggcaggttagtcgcagcgacattggcgctctgctcggcgtcggtcgtggcggggctgaggctggccatggatgatggatgtgagcgtgctggaactagacgccgaggggacgacgaccgccagtggttcgccgcatccggccgtggcctgctcatgctcaggcgtggtggtaggcccgagagcgtcgtcgtcgtcgtcgtcaatgagggcgctgtcgccatcccgttcccggcgaccgccaccgccaccgccgcaggccagtagtcgtcgagcggcatcttggcatcttgatgccgtccaccagctacattgcacccacgagcggcgcctgctgctgcacggccgccgttgccgtagccgtcggtatcagcctggcgtcgccttcaggaatcaggagcgcgcgggcctggctctgtcgttgccccttctcccgcgtcatcactgccgagcggcggttccctcgctctaagaggagaaaagtgagatagaggaggaagggagaggaggggaaagagagacccagatgacgtggcatccttacatgtggggtccacgtgggttccacgctgactcacccgccacgtcggataaaaccggggtcaaacccacgaataacctaaagtaaacgattttgtaagttacatctggttttgtgctcgggggacgattttgtaactcgattacaagttgagggacctttggtgtactttttccaattagaaaccagtccatttagccctttcccatccagcccattag

SEQ ID NO: 91659 - DNA, 1084 bp, Oryza sativa
catgcatgcttgtgcttattacagcatcaacgaatttggataaagaggtcactacatcttgcgaatgcacatcatgctaacccttcccttgaccatcgtcaagagaagtgcatttgccgaacggtccgtgaggaaagagattctaaaatagttgaaaaagatgacgatgaacaagaagattcaaagacaattacggagtctacacaagttatggccgtctgctccacactcattgcaactgtggcattcgcagcagcttttacattgcctggaggttatagagcagatgatcacaccaatggcggcacgccgacattcgtcggaagctacggtttcgatgcattcgtcttggccatcacatttgcattcgtctactccttgttggctacatttagcctcgtgtattcaggaatgaccaaagttgactacagcatccgcttggagcaccttaactcggccaatagcttggtctggctatcaatcaggtgcttgctagctgcatttgcattaggtttatacgttgtcctggcaccagttgctcacaagactgccttgcttatctgcctcatgtgttccgttgggttattgcacgggcatacgtcaatgaagacacagatccgcatggccgtgctcttacagggaaggattgggtttaaggtgtggtggattttgggcaggaagatacttcgaaactttctgcactcattttggcccttcctgattatctttggttggccagcttatctgaaatggaggcaccaacagtagttagactcatatatatgaccaccaaatatgtcgtatttgtaccgctgatcaccatagattgtatttcttatagtatcccttttgctattgtgattttgtttctatggtgacaacatactgtattgtgtaccattctgggaaaactattgtatttttgccacatcagttcaaattatgacaattcgagtccattattatatctataaatcctatataactatctgaacgcacagagatgtagcctagaggggggtgaataggttttactgaaattcacaaacaaattgcagtggtaaaattcagcagaaccggaact

SEQ ID NO: 91660 - DNA, 4213 bp, Oryza sativa
cccaggtattttattatctgcatatgcttattcattccgtatgggcaatcgctttattcttcgtaacactactctattcggcagacccgcactacggcttgcgcatacatcaagtgggtcgatacagaaaatcccgttctcgacctaaccacttgtttacaagaaggtcgctggtatttcgcatccgaaagtactaagcaatacttatagagaaaagcggcttatgaacgacaatgtcgtgaacaacagagcgactggcgggtgctaactacggcactccctccatgggaagcccgtccaagatgcaggtgtggtgatcgttgtcaggttcttcgttccataaatcctacaacattgggttgaaggttctttgtttgtccaaatattcttgacgacgatttcatggttagaatattttgattatatgaatccttattttctcacaacatttactaactttgcttgctttacatctattctttcctcccaggaaccaccaaggagatgtcaatacagagaatggatagacaccagaagggttctaactccacctagccgtgttgtgcagcttgaactaccagagcaatacagggttactaaaacgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatgtaaccgcaatgcaaatagttgtatcatgttcaaattgtactactatttcttcatgttacataattctccttgtttaagtccatataatgtttctacgacccagactgcgataggccgatataaattattcgagtactaatacgtcgaataaggtacaaaataatacctcacttaacatatgaaattgcgcaacaactaacttcaatacatttttataacaatattaacaagttttaccaataaatacttctttatttattattaacataacatagaaaaatcttttggccgtacttttttcatcgggcggcaagggacccagatgaaaaagtacggccgcaagctctttatgggcggccaaaattgcaattagccccttgccgccctctgtacgggcggcaagggcctaatcgcaattttggccgacggcggcagacggcgcggtcgacccaccgtctgccacgtcagcttgccgcccaccattagggcggcaggggctatttctgcaattttttttggtcgatagattatttctgtaaatattaaaaaaaaaatctaaaaacgaaaaaaattctacagctatgtagtattagaaatgggccgtgagcctttgctggtgttctatcagggctggaccatttcagtttgagaccttcataaagaaatatcagacagacgtgcaggtaaatggaatttcttgaggactgaggtcaggagctcactgaaaggaaaagaaaggggaacaagtggacatcctaaaaattaatctctaaaggcccctttgaatcgtaggaatgaaaaaaaatagaggaataggaaaaacacaggattcggacagaaatacaattgtaaaacagaggattgcaaaacacaggaaaaacacaggaatggccgtttgattggaccacaggaaaaacgcaggaatcagatgagagagatagatcagatgagagagatagactcagaggaaatgttccaagaggttagacctcttgctaactttcctccaaaatgtgcataggattacccattccataggaattttaaaggattggataggattcaatcctttgtttcaaaggccttcaatggatttttttccgtaggattgaaatcctccaaaattcctacatttttcctacaaatcaaaggggccctaaataaaatgtaggcaaaaggaaaatgatcacaagttcaattcctcatctccttcttttatggataacaagttcaattctgaacacagttttctgaaatttctaaatcacttcaaatagcatatcatgttgacaaaccaaaaaataaaatccacttgtcgcggaatgggggtaaaactgacggtaatgcttgaaggaggggggggggggtaaaccggaaaaggaattgatggtgcgtactcagtagtgacaaaatcgatggaaaagagtcagcaaagtagcaggggcgacgtcgaaacttagcagataggtaagtgtgtcgtaaggtccgattggcttcactgctacaacttattgggttttagccttaccagccattcgcgttgggttgataccctgtagccatagttgacgcagtcgaatgtgaccatataaataaattgttgtagccaaggaggtgtatatatatagttgggaaggctaattctcatggatagcgtgcggtctttatgtatcacatatacatgtaaggaaaaaaaaaatccgaatttccctcctagctatatggtagtatgatacccctcatttcaaaaaccagacattcttcaccctcaacttttcatatcgaacgaattaccccctgactgactccgaaatagttttggtcctacgcagttcaatcaacatagaaaaataaaaaaatggtgggatccacttgtcctcttctttttgtcatcacatgtgagccctactttttttttatgctaactagactgccacgcgtaagctacttcctccgtttcgtattataagactttttagcattgctcatattcatatatatgttaatacatctagatatatgtatgcctagattcattaatatctatatgaatgtggacaatgccagaaagtcttataacctgaaatggagggagtatgtaggaccaaaattgcttcagaatctgtcagggggtaattcgttcggtataaaaagttgagggtggagaatgagttttttaattgaggggtaatttgtactgccctgattgataagggataattcagactttttcctgaatatgaatataagtagcaattcgtgctgccacaaatttgcatataaatagtttgagaaggctaaaacaacttgcatttattgatttgcaaaaaaatagattgagaagattaaaacaacctgtgttgggaatgaaagagtggcatacaatatgcatataaaaagaaagataatgctttgtcttggagatttcctcttgagagatgaaaacatacacttttcaaaagaaactaggatatcatgaaaacatacacttcccaaaagaaagtaatattagttgttcacaatacaaacattaaaaacttgaatcctctataagggcataggcatacactttggtgaaggaactaattaaacaaagttgattaaaaaaatgtttgctgcctatttattagatttgtagtgtgctcctaacaaaaaaatgatttgtaatgttcatacttttaaaatgatacataagtaagccctatataggtctatatgggtcaactgcacaggatgttatagactttatactaatattaattatgtttaaactccaacggttgtagaggaaaaggtcgacatgtacaaacattaaaagttacaatattacaacttcaacggttattttgaaagtatgaacattacaaatcattttttgttaggagcacactacaaatctaataatctaataatgttgttttgacttattgttgtgttagaatgggggtctatttttttaatattgctcaaagttatgttcatattacttttattatatctattattttttatcaacgtatgcacgacgataatatatatataattatttttataattctataatttcttaagtggcacggaaaagtcggaagatgtagccctaactaacgtgacatatttattctcaaagttgaattaaattgtatgagtttttaaatgcaaaataatcaaaagaaataagcggatcaaatattagtattttgatttagatgttatatttgcttatttgtttcgcatagaatttttgtttttctaaaagcgtgaaaataggaaaagaaataggtaaaaaagaggggaaataattgagaggagggaatagacgtgtgaaacgtacgtatatacgtacgtacatgccatcaggcgcaggtgggcccagatatgggaagacggtttttttatagataaatctaatatggttacatataatgtgttcaccaaatttaat

SEQ ID NO: 91661 - DNA, 4478 bp, Oryza sativa
atgactcatctatgacgggctctatgataatgcccgatagagatagattaatctctatcgtgctataactaacgccctttcactgatgactatttttccatttttccatctgaagtaattatatctgtgagtgcaaaatatatagctgttgtataataactcatattattagtcataattttttttcggatagtaaattatttcaaatggaaatatggtcaacaacaaagttgtagagcctttcaagatctacaacttttatttcggtcatttttctatataactttgtttccaacagtttgaaattgaatttgaatatatgaaaaatttaaacattatttttaataaaacaaaattagccatataaatgactacacatatcaagtctttgtaataaaacaaaatacttcattcattacaatagataagtacaaaggcatcggtcatgaggttttgccttccgtatgatctgaacgagcatatgccacagcctcttggggatcatcgtcaaggtcgatgtgaggtcttacatgaagattctggttgtattttgcttcatcgacgacgtggtcaactccgacaattcggcgcttgccatccctcacgatgtgcagcttcttgtttgaggggtcttttatgtagaatatctgctcgacctgtttcgcaagtacgaatggttcatcagcgtatcccacccttgataaatctactaaagtgaaaccttccttgtcagctttcacacctgtgcgtagattcacccaatggcagcggaacaaagtaaccttgaacttgacgtactttagctcccagatctcctcaatgcggccgtagtatgtgtttgacccgacttgatcctggaatgcatctatacggacaccgctgttttgcactatgcttttgtcatcttgttggacggtgtaaaatgtgtatccattgatgtcgtatccgtgccatgtgtctacggtccaagacggtcccatcccaacaactgtactatctcatttgggacatccgtggatattgtcacacgattcatgaaccattcgttgaaccgagaattatgttctctgttaatccatgtatcagatcgccccaagttcttatctcggattttcgctaagtgctcctcaaaatatgggccaacttctgccatatgttggagcacagcgtaatgagcctgcacataggaagcctgacaaccttccttcatgacgagacgctggaactctgataggatcggtatcgaacatgtaattgacgcagaactcaatagcgtcctcggccgtgtaaccttcaatgatgctcccctcgggtttagctctgttacgaacgtaggacttcagaactcctatgtacctttcgaacggccacatttctcttagaaaagccgggccacatagttttatttgcttcaccagatgaacagggagatgaaccattatatcaaagaaagacagtgggaaaaacatctccaggtgatagagggtattcaaaatatcggtctgcaacccatctagatcttctggatctataaccttctgtccgattgcattgaagaaggcgcacagacgttagatcgtgtgacgcactttgggtggtagaatgcctctgatagcaactggcatgatttgtgtgattagcacgtggcaatcgtgaaacttcgttccaaccagttttagatcatccaatttaacatacttagttatcctcgctgaatagctcgatggaactttaatatctttaaagcatgataacattctgattttctcatccttcgacaatgtgtggcaggctggagggaggtacactctacctgtctctgcctctcgtatgggctggagttcactgcgaatattcatgtcctgtagatcaaggcgcgcgttcaacccgtcctttgtcttcccgagaatattcaacatcaggctaaccaaactctcacacacattcttttctacatgcatgatatcaatgcaatgacagacatcaagatatatccagtaagttagccgccaaaatatggattttttcttccacataccgttctgctttgtcttgctacgttttcttttcttcccaaactcattacttatgtccttgaccatattgtggaccccatctctggacaaatccttgggagcaggctaaagttctctcttaccgttaaaaattttcttctttcttctaaatgcatgacgtagcgggagccacctccgatgacccatgtataccatctttcatgatttcttcagccaccggcttcgtgtatgttgcttgcaatcggagcatgccttctttccttttatagtttgtccggaaagattaccgagtgcagggtagtcattaatggtgcagaacaatagaattcttagcttgaagtcctcctgaccatatgcatcccaagtttccacactttcttttcaaagaatctcaagatcatcgataacaagctccaggaatacatcgatatcattgccgggttgcctcggaccttggattaacaagcacaacataatatatttccatgttaaagcataaccatggcgggaggttatagttcgcaataagaactagccaagtgctgtgagtactactcatgtgaccgaaaggattcatgccatccgtacatagacatatcctcatgtttctagggtcggcagcaaagtctttgtgttttcgatcgatatttctccattcaatcgaatccgctgggtgtctaagcatactatcattctttctctccgtggcgtgccaacgtagtaacttcgcttcgttggggttggcaaagattctcttgaaacgatcaatgatagatagataccacacaaccatagccggaccactcctctttgacttctttccttcatcagcacttttctttcgcttgtatcgagaagccttgcagacaggacaagcatataagtctgcatattgcttgtggtacaatatgcagtcgtttggacaagcatgaattctacggacctctaaccccagtggacacagaacctactttgcttcgtatgtcgtctcgggcaatatgttctcagcaggaagcatagccttcaaaattcctaaaagatctgtgaaattcttgtctgtccatccactacttatcttcagcttcattaggtccaaggtaactgacaacttagtgtgtttttctttgcatccggcgtatagagacgtctcggaatcactgaccaacctgctgaacttaatggaatctctctcattctgggctgggtcctcaacgtcacttaacatgtcttgcagcagatcgtgatccacatcaaccatttcaccgcccaattgagaaggtataaacatgtcatactcatcttcatcttcctgattatgcacatcacttctgtctgctgctgctccacttcctgattcttgctctccatgcttcacccaacatgtatagcccttcatgaatcctcgttatatcagatgaccgtgtacaacctctccgctatcaaacatattctcattcttgcaatttgcacatggacaacagatgtaatcgctgtttcttcttttcctatcctcctccgcggcgttcataaaatttattacgccatttctgtacttcagaaaatgacgtttcacagttgtcgcatacattcaacttcgatcaattgctacataatgaaaaaaacaaattagaggcacatcttataagatcagtattgctaaagtaagacgtgatgaaattgctgaattaatgattagtattactcacttgattgctccattttgatcacttttgggaattttctgttttccttggaaaaaagacaaaaaaaattgccccctacagcctcccaccaaaatagtgaacagtgagatacagttacactaggtggggggtatttatactgtacaacaaatatctgtaacggccctaaaacaatcaaccgtgacgagcatacaagtaatctctatcaggccttaataaaagcccgtcaaagaagagtgtcatctgtgacgggcattaaacttatctcaatcgagcctctagttggagcccgtcacagatgaccgtcatctgtgacgggcttcttttaggcccgattgagatatggaaccctcatctcaatcgggccttaactatggtccgtcacagataagtgttatccgtgatgggctctagtttaatgccgatctagcatgtctgtgtgaccatatcttaatcggacgaaacttcggcccgattgagattactttcttgcgacggtccgcaaattccaagcttgttaggggccgtcacagatggaaggatatgtcctagtgatatatgcagcctacagaacgtggaagttcacgttgaggctgccatatcccttcagctcgtttggatggagtgagtcatatgtagaattttttttatttataatttttcttattaaaagttttacaaaaataattttccattttgaaaattgacggaaatagtcgcctaccgccctctgggaggg

SEQ ID NO: 91662 - DNA, 758 bp, Oryza sativa
aaccctgcgaggcacgcaccgatcgatcactacaccttcactttctcttctcatcatctatatcacgatcgatcacaaagaggttaacagtaacacatggggttcggctcgagggagatggcctgcgcgctcgtggcgctggtgctcgggctctgctgcgtcggcggcgcacgggcgacggggaggatcgacgaggggctggaggtgatgtggggcgacggccgggggagcgtctcgccggacgggcaggtgatggcgctgtcgctcgaccacacctccggctccgggtggaggtccaagaacacgtacctgttcgcgcgcgtcgacctgcagatcaagctcgtcgccaacaactccgccggcacggtcaccacctgctacgtaagccagcactcgcactgacacattctttgtgtgatcggatcttttttttttcttggctcgtgttcgagctcacgtacggtggattccatgcagttcatgtcggaaggggagtgggatatccacgatgaggtggacctggagttcctcggcaacgtcaccgggcagccgtacacgctgcacaccaacgtcttcgccaatggcaccggcggcaaagagcagcagttccacctctggttcgaccccaccaccgacttccacacctactccatcgtctggacctcgcagcacatcctgtaagctcatgcaattcactcatcaaccaaatgcacattctcagtttataatcactcactcgctcgccgccatggatgccg

SEQ ID NO: 91663 - DNA, 1012 bp, Oryza sativa
tgtgtgtttctccggaataagttggcacctgacatcatttgtttatttttctatgttatcatcacttttaccagcgtgttttttcttcttttcaaaattctgtaggctgcagaagagtgcacatctgtccttgagttggatagggagcatgctggagctctcatgttacgtgcacagacacttgtcactctgaaggattaccagtcagctctatttgatgtgaacaggctgattgagataaatccgtcatctgaagtatatcggaaccttcatgcacgactgaagacacagcttgtaagtttttcattctctttgctgtgctaattgattcactttgctttagcttcttgcatcggcattactctagttgcaatttcattcgatataactacaacaaatatccttacataattcaaatatgctttttagttgctaccagcacataacttctcccctttatttacaaatgttttctgaatgaaagaaactataccttagcttgtttacttattatcctactgcctgttaacctgttatctgtgttattttaacctttataggcactagctcccattccagaatctgaagaggaatcgttatatcttgaagaagataagcaagagttgcctccagagagaaatgtaaatatcgagatttgtattaccaagtctgataaacctgcaactgaaatgattctcaaaaagaaacctacaacagaacttattgtcgaaaataaacctgcaactgaactgattcttgaaaagaaacctgcaactgaacttattcttgaaaagaaacatgcaactgaacctccaaaggttgaggtgcctcccagtctgcctcaaaaaccacaagggtgggagaccatcgcaaaaccaaagggacattcaggacttgattactcaaaatgggacaaagttgaagatgactcaagtgaagatgaggatgaagaggaagaagagcttcctcagtataaattcaaagtcagaactgtcggtgtgcggtctgtgaa

SEQ ID NO: 91664 - DNA, 631 bp, Oryza sativa
caagatacctagttgaaacagcaagtttacgaacaaaacaagaaaaatccccatggttggaataattatctgttgaactggcaagtaattaccagaagctattcaggaaagtattagacacttttcggctgccactgttatatgcaccaccagcttccccaacccagggagcagaccatggtccatgccgctgtatcgtcatttggagatctctgaatgtatcagagctctggctcaaatactgcggattcaagatcctatttgcaacttgcggatcgttacctaataaaatttggtttatgtcagtcatcttaaatgtgtagtacaacctaaaaacaaagatgaattaaggagtggttctaacattatatctaggaagtacttaccagcaccaagattgtaaatatgatgagtcattgtgtcgagaacatttggaccagagatatcaagaagctgagcataccatttttggtcatagaatcctcctggggcaaccaccaatggtttcctagagtttccatataactggctgatgatgttcttgagctcaattatatcttttccatattgttcagctccaacacttgcaccaattccacttccactcaactcattacctagtacataagca

SEQ ID NO: 91665 - DNA, 1333 bp, Oryza sativa
catcttgaaacaaacattacatgacattataaactattttctttctttatcttttaccacactagataatgcaatacttaagtcattttggtgaaccacatgcttcactaaccataccattgtcgtcttgatgccacaatttgtatagtatatggcttcaagtttgttcatgcattatatgcttactgcaccatgtgttttgaacctcatattcatctttcttcctatagacgacagccttgaaaaatggttcatttcgccatgatctccactactggcttggaaaggatactagtcaggtagactctcaaataatctggcagcacctcacttgacttagctctcccaagctaactattaatacacaaatgcctaatatttgaaaggacgaagctggaactgctgcaattctaactgtggagcttgatgctgcccttggagggcgtgctgtccagtacagggaagtacaaggcggtgaaactgaaaagcttctctcctattttagaccatgcatcatgccacagccaggaggggtagcttctgggttcaatcatgtagaggtcaatcagcaagatcatgttacccgcttatatgtgtgccaaggaaagcatgttgttcatgttaaagaggtaatctattgaagttgatcactgcctttgtttatgcaaaggcttgctgggttttttattcttatgctgcttgtcatacaaaccaggttccttttgttcgttcatcccttaatcacgaggacatattcattttggataccgcgaccaaaatttccagttcaatgggctctaactcatgcattcaagagagagcaaaagctcttgaagttgtgcaatatatcaaagatactttccatgagggcaagtgcgaagttgcagctgttggtaagctttttgttttttgtttatgtgcttttgctttgaatattcaaagtcacatttaaagcatttgacaatctggattcctctcatagaggatggaaagttgatggccgatactgaagctggtgaattttggggtttgtttggtggttttgctcctctcccaaagaagacatcttcagaggacaatggggatgataaggaaactgtgaccaaattgctatggtaatactcaagtcaaatcactatcaatattccaatacccgcatcaagaaagtgttagttttgaatgagaataatttgcagtcaaatgatgctattttgagatcaattctcttaaaatttatgaaactgaattagtgatttctattacttcctcccagttttaaccaaggaacgctggagcatattagttttgaatctttggagcatgagttacttga

SEQ ID NO: 91666 - DNA, 583 bp, Oryza sativa
tacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggctccagtaccgaagatcccggctgcaaatcctgctggacaaggaccatcagtttcgtacaagtatttaacagtagtaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgcagttaaaacatggtgacatattcgtgcaaaagccaaaacaaaaatgaactaatatctgggctgaactgtaccgtgcgaaaccggtgctgtaggtcgcactgctccgaagctaggggcgctcgaaggcaaacgaggtcctacgaggatggaacatcaagttacgacggggtgatgttttcgtagaaaa

SEQ ID NO: 91667 - DNA, 894 bp, Oryza sativa
tttcactagctagcaagatgtttcaggctgcaaaattccaggctgcccaggtaacctgtccattgtccatatatgacatattacatcacattatcactctaattcattggtgcttccatgcaggctcgcctctatgaagggaaagaaccgattcaatttttcgtcatatttcagagtcttcaagtttttaaggtttttcttctactcagtagataagtcaatatccttgagtggatctgacagagtgactgttagatatatataacaatttgacacttaatccctctccccctcacaccggctttctaatgtagggtggacttagctctggatacaagaactttattgctgtaaatggtaccgatgacgacacttacgttgaaggtgggcttgctctcttccggattcaaggctcaggatcagaaaacatgcaagcaattcaagttgatgcagtaagtgcaaaggcatctgtttggtccagacatatgcgagagcgtaattcttatattgttatcaatggtttcatctctatgatccttttttactaggtgtcttcgtcattaaattcatcctactgctacattctacacaatggaaacactgtgttcacatggactgggaaccttacaacctcactggataatgacttggttgagagacagctagatgtaattaaggtgtgaatcacttattgcggaaaatattaatctttatacccatgcagttttcctgacacttggtatgctcctatacatttaaatccttgattgaaatcttacagtaggttttcatattaattagcaaaatgcagtttgaatatcgtagaaaagaagagaaggctatatagttgatcatgatgcgaccagattataaccatgtagatttattagatac

SEQ ID NO: 91668 - DNA, 1080 bp, Oryza sativa
ctttctggctacatgaagtggagttactaatatattgctctatgaagtgaaagtttcttcttgctcaaaaaactactcctataataaaatggctaaatatgccaattttctaccactactgaatctgaagttcaactgatgtgcttcattcccatgttagccttgatatggtcagccaccagtattaatattaacaaatttcctgtcatatttgagagaactgaaaccgcttctttgaaatgggatctaattgttgaaatatgttttttttttcatgtttgtgcatgattggagtatctcttttttttcggctgtactgaaatttggtttgtgattaacctgtgaaagtatctgtttgcactgctcgatatcctttattttgaaagcgacatcccgaggaggaaggctcttgtgctaaagaaaatctttagttcctctccttccaaattttttggttcttctttttgttttgattaatgaaagcagaaattcttgaactgaaggaaaaacaggtagctctactgtgtttatggtctttcctgtcgaagtaggaattcataggtgtgtggcaatgctcagcgattgcacaaggttggttctccacttctctgcatcagatcggatatatttcaattggttcgattctgatctatactgactcccttttagctaaaaccctgattactgataatatatatgttctactcagtgaaggggatgcaattagacttggaaatggagttagaaggcttaaaggttgctaatgtgatctgcatgatattatctcatgaaaaccaaacattgttttgccccttttatatattttgcccttaggattgaatcaatatttcagaatggacgaaggcatatatcctcttcaaagaatgaggtctcaagggatttggttgtcaatgtaaaatcacagatgaaacaatctttgttggtaagtaaatgcactttttgctgcattgactgggataatctcgatgagcaatgatgttgtttgctactttgattttaatgtagatcactgaattgccattctactatatatgaagcaatatttttaatgtgtaaaat

SEQ ID NO: 91669 - DNA, 2306 bp, Oryza sativa
taatatatatgttctactcagtgaaggggatgcaattagacttggaaatggagttagaaggcttaaaggttgctaatgtgatctgcatgatattatctcatgaaaaccaaacattgttttgccccttttatatattttgcccttaggattgaatcaatatttcagaatggacgaaggcatatatcctcttcaaagaatgaggtctcaagggatttggttgtcaatgtaaaatcacagatgaaacaatctttgttggtaagtaaatgcactttttgctgcattgactgggataatctcgatgagcaatgatgttgtttgctactttgattttaatgtagatcactgaattgccattctactatatatgaagcaatatttttaatgtgtaaaataccctaggtcatgtgcatgtttttttcctaagttcatgaataaaatctcacttctatatgttagggtggctactagatccaatcctttggttttgtgtttcttatacacccaatgatttttttttttttttaggcttgggtacatgtacatgtttaatttttcttaatgtcaattagatatcatttgccaattaaaattcatgtagaaatacacctacctgaaccaacatattcaatttcatgtagaaatacacctacctgaaccaacatattcaatcatccaatgcatgttacttcacaattttcggagctaggaatcttttagagctggacaaatccatttacattgagtgtttattataaaagaaatatattttcaatcactaagataatgataaaattctattatgtgtttgccgataagcccaggtggctgcccggggttgccaagcggtgtctccacctctgactccattcatgtaatcatgttcatggtctgctccattgagtttatttttactggatgcacatccttccattagtagttcttgcaagaaactgaaataagtaacagtcgtatagcattatgctgccagtatcttcagtaaagaatgtattgtcatttgcttacctcttttgtgttttcttcttctgatgcttagagacacaaaaacaagcgtgtacaaacgatggaaagagaataaactgtaattagtgatcaagattgcaccgctcatcttttgccacaaacactgcaagagagattgatttacatatagtgaatgaatcaattctacagtcttgaagatttagctctcggttttctttagatggaatgtgcctcagatttagatttatgtacattttaagttgccaaaataaacaactaaatgaatctttacgcaaccacgccaaaggattcacctagatgcttcagtcaacatactatgacaagcagaacaacgtttattcttatcttttttatatagtaatatgcccttgctatataaaaataaaagcagaactacaatgtcttaaaagaaaaaaaaccatgttttttagccttggtctattgtcaatcatttgaatatgctttgcttataaatagatggttcatattcatacaatatttgctaatacgtgcattgcacgtgcacgattactagtaaactctaaagggtgccagttgagaaaccgctttcggtgccggtttttccaaccggcacccaggagacggcacttattacctaagaaaccagcacctttaacacgcccatgagcaaaaaaaaaaaatcaactcaatgcatcgagccgatgcattgagccgtcaagacgatccaatctaatacccaaatcctaaaatttcctcaaattcataaacacaaacatagtccatgtcagggttacggataaggtataccctctatccttggacgtacgttgcatactgatacggtatacccgcgtggataccgataattcctgtgtacgttaaggaaatctatcacgtgatagaaacagaatccatagatggaaggagtcctacacagacaagactgggtttttaccatatcgtgatgggtccgatatctccgagttctacttggagatcaactgacccgtggtataaaagggaccccctgggcaggacctaaggcatcgaatctcaccgcccacacatccgccacagcctacgaagccggagcctacaggagcaaagtcgccgggtgatctagtcgaaccaactcgactacggtctcgtcgatatcatcgagttccgctattcccattgtaatctgtggtttccatcatataatcccttaccaactggattagggctattagctatcaaggggcctgaaccagtataatccttatcttttgtttgcttgatgtcgtactacgtagatcctc

SEQ ID NO: 91670 - DNA, 4525 bp, Oryza sativa
tggaaatgttcacatctacaaggcacgattggtggcaaaaggtttcagacaaattcaaagtgttgattatgatggaactttctcgtcagtcggcatgctaaaatctattcggattattttagcgattcctgcctatttcgactatgagatatggcaaatggatgtcaaaacagctttcctcaatgaaaatctcgatgaggatgtgtacatgacacaacccaagggatttgttgatccacaatcagctaaaaaagatatgcaaattgcagaaatccatttatgggttgaagcaagcatctcggagttggaatattcgttttgacgaagtagtcaaggcgttgggctttgtcaaaaacgaagaagagccttgtgtatacaagaagattagtgggagcgcactggtgtttctaatcctatatgtagatgatatattattgattgggaatgatattccaatgcttgaatccgttaagacatcgttgaaaatagtttttcaatgaaggacttaagggaagcagcatatattctgagcataaggatctatagagatagatcaaggaggctaattggaagccagagtacatacattgacaaggtgttgaagaggttcaacatgcaagattctaagaaaggtttcttaccgttgtcacatggtattaatcttggcaagaatcagtgtcctcaaacgactgatgagcgaaacaagatgagtgtgattccatatgcttcggcaattggatccatcatgtatgccatgttatgtacacgtccagatgttccatatgcacttagtgcaacaagccaataccaatcagatccaggtgagagtcactggatagctgtaaagaatatcctgaagtacttgagaagaactaaggatatgttcctaatttatggaggacaggaagagctcgttgtaaataattacactgacgcaagcttccaaaccgacaaagatgattttagatcgcagtctggatttgtgttctgcctaaatggaggcgctgtgagttggaagagttccaagcaagatacagtcgctgattctacaacagaagccgaatacattgccgcttctgaagcagcaaaggaggctgcttggataaagaaatttgtttctcaattaggtgtgatgactagtgcttctagccctatggacctctattgcgataatagtggtgccattgcacaagccaaagagcctagatcgcatcgaaagtccaaacacattttacggcggtatcacctcattcgcgagatagtgggtagaggagatgtgaagatatgcaaaatacatacggatttgaatgttgtagatccgttgacaaagccactccctcggcctaagcatgagacacactgtcggtgacatgggaccgggagtatcatgactagaggcttgggcagccgcgatcacccacgtggcctgaccccctcgggggggtcgggcccgagggtgatgtggccgcccctccttttgtctccccgaggggtcggaccgctcccgtttcggccccgagggctggggcgccccgaccccctgtgggtttggcgccacgtatatgggttaggtgagcacagtggggctcacctaaccgcatttattgcgggttgaacgagcgcgtcacgtcgcatgtaatgcagcgcagcgcgctcgcttatccggtccgtgaccgggcgcagcgtgtgaccggtcacagaccggtcagatcgcgggttaggtggtggcaggtggcctgttacacgcctcgccccgtcccgtcggattgatgagagcctccaggcacttgtccctagccggagacggcgtgccagctcctgaagatggcacgtcggtctcggtcagatatatgccaggcttcatcccaaccattgcaaggaagtcattgtatgaagaagggcagacatgcagcttgctaaactgacgcgtggtggacgagagtgaccggtctgtgactggtctgacgcctgtcatgtcataggcagacaaccgcgctcccgttttgcacctccttccagcggagtggaggtaggtatgacccatcccatcggagggtcattcggacagcagccattgcaaatctccgcccatttatgaagggatgacagggtgatctacgggagcagacgagtgaggacgcctggccacactgaagaacaagctgtgttttagcttccaagagaaggtgagccaagttttggtgaaaatagggtgggtccccacccaaaagaaaagtaggtagaagtggagcatgtgggatccccttgagttataaaaggaggaccttgcccaccgaagaaaaagagaaaaaggaggaagataactgagagaacacctaagctctctagctcttctgctctctgtaattccttcacactcagatccaccagaacacaggagtagggtattacgcttctcagcggcccgaacctgtctacgtcgctcgtgtcttgcgcatttgctctctcgcgaaccattccacagatcaagggcttggaacctcacttagcgcccccggtcgaatcggcaaaggggggcccgcgcggtctcccggtgaggagccccacgctccgtcacacacactagggcaatgagtataagatacgttcatgattgactctagtgcaagtgggagactgttagtgatatgccctagaggcaatcatagagatgattgtatcacatactatgtttacatatttatccgactttgttccttgaaatagataactcattattggttaatgaatatgcgattctttcatgagactctttatgttatgtgttgctatttctaaaggatccctgatcaaatatcatatgtggaacaaatatgtttagatgatcagcacatgtattaattgatgatcatgtctcatggatcatggtatatagataccaaattaataatgtggacacatgttggtgaacatgttagatagacccaacatgaggcactgcaagagccatatgtgttgtgtcatcagtgatctcatttagtgttggtgttgaatccttagacctgagattgtcatggttcccaacatgtgtagtagcttacttaaggactgctaaacgctactccgtaattgggtagttataaaagtagttttcgggtatgctatgaaacatgtagtgggatataaataatcaagatgtgatttgcccctcctatggagagatatctctgggtccctcgatgttgtagattatggaagtgcatggccatgccaaaggtgattgaggagtcaatcacaagttatataatctatcaacaggttcgagtgaatgattgagctattagaggatggcacatatctagccttgagcttaatcgatatcgtgaggcaaaggggttcatacaagtatacactagaggttcagccgatatgatctctatgtatgcccggtgggtcaatacgttctgctaggggccgctgttgacgcatggaccgaaaaggaattttcgggttacagccgagtgtacatgaacctacagggtcgcacgcttaatgggccggaataaggagattaaatggaggtccaatatgagcttaattcggattgggatccgaataggagtcctacgggccttggaggcccgagtgatggatcctatatattcgtgaggggtgtgaccggcggagggattgcgtcacgcgagaaaccctaaccgtcacttccctccccgagcaaaaccctagccgcgcgcgggtactagcacatctgcgcgtggcgttccgtccctgtacgtgtggataccggtagaggcgccgctggtttgcggtgctgatcggcgtgggagtacggtgaggagaacgcacgaggaggagaaggtcgagccagtgcgatcgactacttcctctacatcgacgcgcgctacttcgcgagaattccttcgactttttagcgcctttttccgctgcgcagcgtgtcgagtggtaacgatttatgatctaatacttgcacggttcctggtttacgcgatagaaaattttaattcatgctatcgtagcctacgcgtatcccaatagctagttcatcaggtttggtgattcctctgcttgactgactgggagttgctctcaattgccctctgcaatgcatgatcatcttgttcaatgtgcatagaacgttgtacctgtaaaactttttacaaacaagagattttttactgtattctgagttcggaatctcaatgctgcaacttattcatgcttggatggtctccgaactcatagtccgttccgttgcttcctggtgcctctaaatcccatatgtatttagccaaggcacatgctagcgaagcagcgaacctctaattgtcatggcaatctcatagagaaagttatcagttgccttattatttcttttttttcccctccaccctcgtttcgttttatgtactgctgaagtagcaatgcactaagaatatgtttatatccatttgaaatggtaaatgatacatggcaaaagttttgaaagtaaaagttttggcattgcaaaagtactagttggtgttta

SEQ ID NO: 91671 - DNA, 809 bp, Oryza sativa
ccctccccaaacctcgcaggcgccattaatggcggccgggtctcccgcgcccgttccccatcttccggccgccctctctcactcccaaccctatataaaccctccccgagctccccaccaccgtttccgccactcaccgccctctctccccgccgaaatagagctcgcgccgtcgctctctctctccacagtcaccgccgagctccggtccgccgccgtcgtcgccccggaccacctcccacctcggcgccgcctccttcggcttcgccgcgtccccgccgacctcgtccacctctccgtttcggtcgccgaccgccggagcaccgtcgaccccgtccacccgagccgcgccgccgtcttcctccgctccggtcgccgtttccgtcgtcgccgtcgaaccggggtgagccgtggaccgccgcttcgtttccccctttccctcccctctctcggccgctgctccgccgtgcctatggccgccgccagcgaccataggggcgcgggcgcgccgcctcccgccgctgcgccggcgtggccgccttcgggcgcaccgagcggctgccgcgtggggcccggccgtcagccgcccgcgccctcgggtgcggctgacgcgtgggacccacggcgccggccggtgcgagccccggtgcgcccggtccaccgtggaccgtgaggctgccgcgtgggccccacccccgtggacccggtctgcgcgccccctcccctcggctgacgcaataaaccttttttttaattaaaatttaaatgaagaaattcgcaaatattcatttaaagagcatataaacttc

SEQ ID NO: 91672 - DNA, 1246 bp, Oryza sativa
acagagagaggaatgtgaaaagcctgttctaaactctcgagctctaaaaagctttgacaggagatgtccttattcttagcaaaagagaatagggagttcatttcatcttgtaaaaacttgccagaccagttatctttccagaaaagggccgtgtccccattgccaatagtgatctttgagactgctctgaagatgggaatcaatctaaaaatgtccttacaccaaaaggatcctttttatgtgtgagcatgaggagagtcagacaaagagtattacttgttccatattagttttacctagggcaggtcttttttgttgaagaacttgtccagatgtttggtcagaagggcaatgttttacagttccaggtttataatgcccaaaccacctttcttctttggctggcatactaggtcccatgtagccaaggagtggatcttagtgtttggatcatttgacttcctccaaagacagtgtcttcttgctctgtctatgtgttgaatcactttttttgaagcttaagagtgcacatgtagaaattagggggagcatatagaacaaaatttaccattgttagtctctgaccatgattgagaaaagcagctatagatgggagccatctctccactctgtcaaccagaggggcaaagtcaataatctttggttttgtggtccccattagtaaacctagataagtgaagggcatctccccacttgtgcagccaaaggttctagcaagaacttccattttttgactgtcaacatttatcattcccatttcggaggctattctgatttatttctagggatggaactttctgagacaaaccgatatcgatgtgccatttcagagtttaataaaataacagacatttatcattattacattcaattgtgtgcatataatattccaatgactaaatcccttctttataaagttatgacacactaaatgcaattaagaccctaaatctcaaacctcaatgttccacgtcatcatcaattctcagccgttggatcactagattagattacattttaggcgttggatgaacaaaacgcaatagccaccacatgaggcccatgtaccacgtgaagtacttagggtttcttctttgattagtagggtctccttgtggagttgtggtgctagaggcagctggttttctccattgatggcaagtggtgccctggcgtgcctcgcacgtggtgtggcactggcctgatgaaaaaacaacatgcatta

SEQ ID NO: 91673 - DNA, 635 bp, Oryza sativa
atcccacttttatttggcattgtcacttgggtcatataaatgagaaacgcatggagaagcttcatagagatggacttctacactctattgattttgaatcatttgagacatgcgaatcttgtttacttggcaaaatgacaaaggcacctttcacgggtcaaagtgaaagggcaagtgaactattgggactagtatatactgatgtatgtggaccaatgagctcaaccgccagaggtggttttgggtactttattacctttaccgatgactttagtagatatggttatgtctacttaatgaggcataagtttgaatcgtttgaaaagttcaaggaattttagaatgaggttcaaaatcatttgggcaagacaatcaagtatctacgatctaatcatggtggagagtacttgagccttgaatttgccaatcatctaaaggagtgtggaattgttccacaactcactccgccaggaacacctcaatggaatggggtgtctgaacggaggaatcgtacattgttggacatggtgcgatcaatgatgagccaaactgatcttccgataagcttttggggttacgctctagagacagctgcgttcacactaaacagagttccatcaaaatcactgaataag

SEQ ID NO: 91674 - DNA, 553 bp, Oryza sativa
atatatatatgtacaattcattttctcactagctatagctacgacttcgacgccggcgttacgtcagaagaggaaggaccgacgttatgaattgtcgatccgtcgtagtagaattcaccatcgggattaaagacttcttcgttgatgaaccccattagttgttcttgaacagtcgtgataaaatccttgtgtgggagattttccctcatgtgaatacgctatcattcgaaaaataatgacatatcaatatatgaaattaataaacaacttaacaaatcgatacacaatgaaattttgaatggtttatgtatacgtacatcgagctctcgtgtggtgtatatttggtttgataggcagtgggcatactcgcatacgtagtagccgcataagttagttccctggtcctgctttgcacactacatgagaaacgatgagagatttaatatactctttatattaactataattatagattcaattcaatataattttggatcatgcatgtactcactggaaaataaaacctccgtcaagtttttctttccaagtcccg

SEQ ID NO: 91675 - DNA, 631 bp, Oryza sativa
accccaagctagaatttctgcagcttaagcacaatatgttctctggaagtattcctgacagcatcaccaaccttggaaagctttctcatttggatctagccagcaatggtttatcaggtcccctgcctcagcatttgtcaaatttaacaggaatgatgataaaccatgataccacaaaatatgaagagagactatctggatgtgactacaaatcttttgtgaacatgaagggacaggaactacaatacaaccaagaaaaagtaacagttgtgacaattgacttgtcttcaaattttttgactggtgtaattcctgaaggcatagtttctcttgacggaattataaatttgaatttgtcatggaacaatttgaatggaaaaattccatacatgattggggccatcaagtcattggaatcactcgacctctcgaagaacaatttctatggtgaaatcccacaaagcctatctgatttaacatatttaagttatttgaacctatcttataacaatcttactggaagagtaccatcagggacacaactttgtagcctctatgaccaaaaccatcatctgtatgacggcaatgatggtctttgtgggccacctctccaaaaaagttgttataagta

SEQ ID NO: 91676 - DNA, 1060 bp, Oryza sativa
ggcggccgcgctgggaagacgccgggagaaccggtggcgatcgccgggcgggggctgcagcggccaggctggggactaaagatgggtacctttaatcccggattcgcggtcccggttgtataaccgggactacatatgggggtaacgaaccgggattaaaaacactttctaccattctactactctaccttcccatcatgttggactgtacaacaataatttatataattcaagataaaaattgctaagcaccgtgctacttgttgtggactctcaattagtatccttgttaatgaataaccaatttttgaagtgttaattgccaaatcgtgtctatcacgactcattattaatcttagttattatttataactaatttcataaatcgaagttaacaattacaaagcatgactcagcttggagggccaattttattgcttcaattacgtaatttttctagaaaaatcgaaataacataaatatgaagtcattccggtcttatattctgaatttaattattgtattaatttgatcatagcgaaaattcgagatcagtaattgacagtttgtaattagtatggtgtttttgtttaacctaagccataatttgtaatttctaaatagtacagaatgttatttatttacctcgtgactctctcattatgtttgctatatatattcagtggattatgcatgactggggcgatgatgaatgtgtcaagatactaaagaactgcaagaaagccattccatctagagatgctggaggaaaggtaatagtcgtagacatggtggtcggagtagggccacctgatcaaaagcatttagagatgcagaccttgtttgatgcatacatcatgcttatcaatggtgtggagcgagacgagcaagagtgaaagaaagttttcgtcgaagccgggtttagtgactacaagatcatgccagttttaggctccaggtcaatcattaaggtttacccttataaaaaccaatgattatggccaagtgtcagtgtaaaggcacttttcaaatacatttgcaatactatagaggcatttta

SEQ ID NO: 91677 - DNA, 3620 bp, Oryza sativa
ccccacctatcggcgaccccggggaaaggaggaagccggccggcctggatgggcctcggcctgcggccggcccagcagggaggagggggaggaaggagggaatgggccggcggcccattcgaaaaaaggaggaaaaagagaagaaaaagaaaaggaaaaaagaaaaaggattttccctggaattaaaatattgcttgctcaattttaattggttaaaaattatttctagagctctgaaaattccactaaaaatcctgttaatgaatttcgacatgtagaactcaagaaaaattccacatgtcaaatccgattattatttgcattactttcttagggttttctcttgatttcacctgcattttcttggggtcgttttagaaattaaattttaggcttgggaggagaactttggggtgtgacaaacctaccccccttaaacagaatctcggccccgagattcggaggagctggtgaagaggtgcggatgggcggctttcaactcatcttccctttcccaggttgcttcctcttctgaatgatgactccactgaactcggcaaaatcgggtgaccttgtttctggttctcctttcactggtatcaagtatacgaaccggcttttccacgtatgttagatcctcctggatatcaatgtgttccgaatcagcctgttcttcaggtaccctttagcacttctttaattgggacacgtggaacacgtcatggatgccgatcatgttggatggaagttctaactgataagcaacttccccccttcgttccaggattttgtatggtcccacgaatcgtggtgccaacttgcctttcgtctgaaaacggtgtactccccggagcggagtgacacgaagatacacgtaatctcctgcctcaaaagtgagcttccttcgacggttatccgcgtagctcttctgtcgagactgggcaatcctcaacctttccctgatgattctgactttctcttctgcttccgctaatacctctgttccgaacagttgacgctcgcctgtctgatcccagaagagaggtgtgcggcacttccggccgtataaagcttcaaacggtgccatctgtagactggcctggtagctgttgttgtacgagaattccgcatatggcaaatttttgtcccaagctccaccaaaatcaagagcgcaagctctcaacatatcttccaagatttgattgacccgctcggtctgaccatcagtttgcgggtgataggccgtgctgaaatttaaacgggtccccaatttttcctgcagcttctgccagaattttgaggtgaactgactccctcggtcagatacaatctttttgggtactccatgtaggcacatgattctcgaaaggtaaagctccgccaaccttttgcccgtatatgtggtatgtactggtatgaagtgagcaaccttagtgagtcgatccacgactacccagatcgaatcgtgacctgacgatgtccggggcagtcccgttataatgtccattccaatctcctcccatttccattccgggatttgaagaggttggagtaaacctgctggtctttggtgctctgccttcactcattggcaaacatcgcagagtgcgacgaattcagctatttctctcctcatgctgacccaccaaaacttttctttgaggtcttgatacattttagtgctgcctggatgaatggagtactgggtctgatgagcctcggtgagtatcagatccttcagttccttgtcgtcaggtacacacaatctttctcccaaccagattgtgccatgctcatcttcgtggaaatcccgggcttttccgactctcatgttctttttcagctctgctatttcagaatcatttacttgagctgctctgacttgatccacgagcgtaggccgtgcctccagagcggctacaaaaccatgttcaacaattcccacgttgagatgctcaaactcctgccgcaattcctcacacatgccctcgatgcatagggcagtgcagtaacttttccggcttaatgcgtctgccaccacattggctttacccgggtggtagtgaatactcatgtcatagtctttgattagttccaaccatcttcgttgtcggagatttaggtccggttgggtgaagatgtatttcagactcttatggtccgtatatacttcgcagcggttgccaatcagatagtgcctccagatcttcaaagcatgaaccactgctgccaattccaggtcatgagttggataattcccttcgtgtggacgcaactgccgcgaggcatacgcaaccaccctgccctcttgcattaggacacatccaagtccgtggcgggatgcatcgcaatagacttggaagtctttcatctggtcgggcagaatcaaaactggtgcggatactaatttcttcttgagctcctcaatactcttatcgcactcagctgtccatttaaacttctcatctttcttaagtaactaagtcatgggtcgggcgattctggagaagttttcaatgaatcggcggtaatatcccgcaagtccaagaaaacttcgaatctgcgacacggtcttcggtggggtccttttggtaactgactctacgttcgacggatcaactgccacaccctgagctgtaatgacatggcccagaaatttgacttccgtcaaccagaagtcacacttgctgaacttggcgtatagctggtgctccttcaacttctcgagtaccaaacggagatgttgctcatgttcttcttcggattttgagtagataagaatgtcgtcgatgaacaccacaacaaacttgtccagaaattccatgaatactttgttcatcagattcatgaagaatgcgggtgcgttggtaagtccgaaagacataaccgtgcactcatatagcccgtaccgagtggtgaaggccgtctttggaatatcctcttcctgaattctcaactggtggtagcctgatcgcaggtctatcttagaaaacacttcagctcctttcagttgatcaaacaaatcatcgattcgcagcaagggatatttgttcttgatggtgacctcgttgagtgcgcaataatcaacgcacatcctcttcgtcttatcctttttctccacaaaaatgaccggagcaccccaaggtgaagtacttggtcgaatgtaccctttctgcagctgctcatcaacctgcttcttgacctctgctaattcgttggctgccattctgtacggtctcttgtaaattggagcggttcccggtgccaagtcaatccggaattcaatctctctcttgggtggcatggtagtgaggtcttcggggaacacttctggatactcgcagactatgggtatatattccaatttcctcaagtttttctccacggtgtcgactgggatttccgtctcaatctgattcaaagagaccccttgctttggtgagactagtgatttgtacaccacggtttctcccttctcgttggtcaaggtgactgtgtgattcgcacaatcgatgacccccttaaacttggtcagccaatccatcccaagaatgacatctaggtctttggattcgagaagaatgaggttggctagaaatggtgatctttggatttctatt

SEQ ID NO: 91678 - DNA, 5401 bp, Oryza sativa
gttgagtaactgcggtataaaaggatttgaaggtatggggcatataatcacgtgcacttttgcctaagcaaaaaatgcctaagtccctaaaagaacgtgacaggccacacctaaaaatatgggctgcagacatattaggcctagacctaaagtatgtctaccgatacccttaaatatgacgtatagaacacgacaattaatatgaccccgagtgataaatatcttgggtgatgtagatcatgcatatctcatctgagtggcttctgatccgagtaattatccctcatggagaataccaaagtagatgtgataattgaatcccgactagcacaagcactcagctaatggccctcgtggggaataatgaatagttcaatcgttgggcatgagaaatcgactcgtaatcatgaatccatgatgaatgtatccggaacaagtccaaattaaaaatataatcctcgtgcttatgttgatgagctcctaagcatgtagcatatccttctgctgtagtaacaattgtccattggtagtaactgacgcagttggcatgaagatgaaatgaccactatgaagatgatatcacccatcaaagctgatgaagatgtttgtagtggtaaagacaacggcaccaatcaaaggtcatgaagtcgcatagccatggaggcgaagaaacctgtctgcagcaaataagtcagccagcagtgaagatgaaggcgctcagcaacggcgacagagttgtgtagccatgatagcgaaataatcagtcgataacagacgaggcacccggtgaagaagacaaagacgccaatcagtagaggcataataagccagccgtgaaagtgaagacaccatggacgatggcggaggcaagccggtggtgaagacgcagacgctcaacaatggaaatggcgaaatccatcaatcataaagatgaacaaaaaagacggcgacggcaaacgcatccgacggtaatgataattagcggcaacagagatggatatgatgacgaagttgcccatcaacggcagcagagtaggctatgttgaagaggcttgacaggatattgataaagatgatgatatcgttgatccagtagtgtagcaatcaatgataacgatgaggtctcccataggcatttgcgtagtaggccaaccgtgaagacgaaataacaagtcagcgatgaaagttgatgatgacagaagcaaccgaaggcgaagacattgtcacccattagcaatggcggagacgttaaggccgatgaagtagaagtgctggtgatgatgtcagtgacaataatccgtcaatctgttgagaagatatcgaagctcgagcaatttccttgatgcgagcgtgtgcataacgaagattgatgcaatgccccttgatttataaagatggcagtagaacttggtgttatagctgttgtagatgcttcacttggaggaaagtagaggctgttgtacaattcattgaaactgagctgattggttgataactgtaaactcctggatatgtagattaaatctcgaactaccagctaaagtaaaatgtcggctctgaagcgaagacgaagataataactcccagagttgactcgttgattgattgattgcttcatcttgacataaaacttgtcgaattttgagtcttatatttgtatagcccccgactctttggtcagtcaagaaacaactgaacatagagtcgagaactgtagcttcttgtcgtcgagtagaattcttgaaaattggagaaccacttgtagtagtagattaacacgacgtcaaatttggtagtgcaagccgagatgtcgaggctcttgtagacgtcgtggttggtgaaataacgaagctcgtgaagtagaggcattatagtttgccggtgccaaagataataaagatgaagtcgctccaccatggtgacaaaattgcatagccgtgatgaagtaaacacgagtcggcggcaacagaagcaaaccggtagcgtagacgcgtagttgtgaagataaaaacaccagtcagcggcggcataaccagtcggcgacggaagaagtagaatgatgacaaaagcgaagacgtccttgaacggcggcaaaataggctagccatgaaagtgaagacaccataggcggcagtgaaggcaaaccggcgatgacgatgacgccagttaatgatgacgaagacgtgcaaccgtggaggtgaactagccagtcggcgtcaggcaaggcggccagaaataaagacgatgacgtccatcagtagtggtagtggtataaaccagctgtagaggcaagggcactagtcagcagtagacgagacgaccggcggtgaaaacgataaggccaatcaacactggcagaatcaggcagccgtggaagtgaagaaaccagtcagcagtagacatagacagtttgcgttgaagatgatgatgcctattagcgatggcggcgacgtagccagccgttaacacgatagcaccagttggcattatacgaggcggccggtcagtgaagatgtagacgttgaacaacggcggcataataggccaggcatgcaggcagagacaccagtcggtggcgacgaaggcaagccaatggtgaagtgatatatgcccaacaacggtggtatgaccaaccaaccgtgaaggcgagcacaccagtcggcggcggcgaaggcaaaccagtgttgaagacgtagacgcccaacaacagcgggacaataggccagccgtgcaggcggagacactagtcggcgacggcgaaggcaagctggtcggtgaagacgtaaacacccaacaacagcggcataataggccagccgtgcaggcggagacaccagtcggcggcgacgaaggcaagccggtcggtgaagatgtagatgcccaacaacagcggcataataggccagccgtgcaggcggagacaccagtcggcgacgacgaaggcaagccagcgatgaagacgtagacgcccaacaacggtggtgtgaccaaccaaccgtataagcgaaaactccagtcggtggtggcgaaggcaagccgacggtaaagacgtagacgcccaacaacggtggtgtgaccaaccaaccgtatagtcgaagacatcagtcggcggcggacgaagcggccagtcggtgaagacaacgatgtccaacaacagcggtgtgagttgtgaccacccaaccatataggcgaggacaccagtcggcggcgacgacggcaagctgatggtgatgttctgactgatccattcttggagcgtaagagataagcttaaagccatgaatccgttttatgcatatctagatctggatcctgcagaacaaacatataggatgagtagtatctaatgtaaatataatactcgaggaaaattcaagtattttaaaatatttataaatatatatttctcctgttgtcaattttgatttccccgagtagatgacttcttacgtttaaacacttagcccaactagtcatagcccccaagcaccgggagtcagcctaggcacttcccaaacatgcatatgagcgacatgagttcgtcattaatggaacaaagtttcacgaatcagaatttactactcgagtacttttgcaattgttaagagcataagataaatttatctcatctctatgcttttgatttattccgagtaatacttagcaccttgcgttactcggtccatccaacgagcccccgggtgctaggaatcggcccaaaggcaactatccgtcgacaaaccaaatggaaagcatagaaagatagaactccataactcgataggtactttatctttacttggattatatcgcaagtaatcaagataggcattatgaacaatgttgaaaaatatgatataatatctgtagcccccggctcacttgtcaacgttgatgtagtgaggcagaggaaaaggaaaataccatatataaaaaataaaacaatgatgacttagctttttagtattcccgctggtgatgacagaactagccgatgtgggaataaagtcgtccatcaatggcaatgaaagcaccaaccatggaagcaactgagtcatccgtcaaccgtataggcgaagtccgccaaccgtataggcgaaaataccagtcagtggcgacgaaggcggtcgatggtgaaatatgatgatgcccatcagcagcagcataacaagccagccatgaaagcgaggacaccagtcagcggcagacgaggcggccggtcggtgaaaacataggtgcccaacaacggtggtgtgaccatccaaccgtgtaggcgagtacaccagtcggcggctgatgaggcggctggtcggtgaagacgtaggtgccaaccgaccgtgtaggcgaggacaccagtcggcagcagataaggcggccggttggtgaagacgtagacgcccaacaacgatggtgtgaccaaccaaccgtgtaagcagaaacaccagtcggcggcggcgaaggcaggccggcagtggagacatagacgcccaataacggtggtgtgaccaaccaaccgtgtaggcgaaaaaccagttgacgacgacgacggcggccaatggtgaagacaatgccgccatcggcaacggtggcggagtacgccaaccgtggaggcgaaggcaccaatccatggctgcgaatgccacatatgtacgtgcatacgaaaataacagatcaaaaagtaattagagatctgtgaattaaatgactagaaaaatcaatagtttaatctggtttacataaaaaaaattaaaacgatagacctggtgaaggtttatgatcttgatgcacgtatgttgtgacacgtcctattttggaacttgcatgtagatggataatttatccgtaaccaatgtccggttcactgatccaatggtaacctcaatgattggaaacgcatactgtgtagcagtagtctaagcgctgtcgctgtgcgatcaggagcatacacacgtgtagataatttcttccagatttcttgacatgtggtgtgcctgttacatgtatttcatcatcggggttgatctatggtgtaaattccagattagtctgttgttgctggactccgcttcggacttcagttggagaaactcgatctcaccaaggaaattaaatcgatgagatgacaaacattgaaagcttttttcccgtagtaggatgttcgcagccattgacattagctcgtaatcaatcttgacgggttgctccgttcgaagatgtcgaggaatctgacgatgaccggatgaggttgaagtgaccttgagcccccccaactggtttgagtcccagtcagagagagtctgctagagtattcggcgacgaggaggcaaaaaatctaccaaagcgaagatgaagtgagcgacttacgaagttgattccatcgcacttttcgacaggaaactcg

SEQ ID NO: 91679 - DNA, 1146 bp, Oryza sativa
agagtggattcttctagccaaccatatacgaagatactaaagaattcattcgaatatgttggaaatgccagaagcatggagatatcaccactcaagatgcgattcccttgacctacaactttcaagtggagttatttgatctatggggacctttcccaaagtcccatgattgtgagtatatcttggtgcccatcgactatgtgttagagtgggtagaagcagtgccgtgctaagtcgctgacaccaagcacgcccgttggatattccacgaaatcatcttcctccatttctgaacacctcaaatggtaataagtaatggagggtatcactttattgataagatcttccaaaaccttttacaagagttagaggcacaacacatcattgcaatttcatatcacccccaaacaaatggtcaaagtagaaacctccaacaaataaatcaagaacatactgtaaaagaccatgcaaggaatggggaaggcatgaaagaacaagctaccaaatgcactctaccaagaacacccttcagcatgtcaccttcctagctcatctgtagaaaaatgtgctattttcgtatcgcgctggaacacagagcacactaggccatgcggatgtggaattgaaaaggcggacgacacaaacaaatgctgctgtcggagctacaagagtagagggaaaagaccaattacaatgacaaaatatatgaagaaagaacaaagagatggcatggtaagataataaaagggaaggagttcatggcaagagataaagtgatgctgttcaattctatgtgaaactcttcgggcacgaaaaacttcgaagcaaatggatgggaccattcaccatcattgacacctctgcacatggagtagttatgcttcaagacggctgacacaatctttaatgcaaatggtcatcgtttaaaagttttcctagaattaattgctcgaaaaccaaaataaaaaattacacgtggtaaatttagtcaattttgacgcatttaccaagaccagttatcatgactcctgagctgaggaagaagggagccctccatggttcggccgaaccccttgttcgttcgacccatgggttgggccgcccctacacagccttcgtgcacgtagtccccaggaggcctccttc

SEQ ID NO: 91680 - DNA, 1788 bp, Oryza sativa
ggcgcgcggcctttcgagccgcgcgctaccagcagagcttccggcgctaccatcagcgctacgtccgggcccgatcactatgcgtcgacgacctcgtcctacgccgtgtccaaacacgtgctggactgagcaaactctcaccaatgtggaagggtccgtatcgagtgatcggcgtcccccggccgggctccgttcggctggccacgggcgacggcacagaactgcctaacccgtggaacatcgaacaccttcgtcgcttctacccctagtgggggtcgggtgtcaggtcttgggctcgggccaaccccgcacccccccgggcgtgcagggttggccgggggcttatcttttttctctttcgtatttcaataaaagcattttcgatttcctaaaggctgtgtctgtgcttttgtttccttttgaagaatcttgacttgaaataggtcactcgtgctcaatcctaccctagggggctcgggtcggctaaaatcgccaaaaggggcccagaaccgagccgtgccccgggacgtggtgaactccgggggggaatcggcaaaaacccacaatcgggtcacccataaccctcggtcaccacgctcccggcctggccagtctcgacatgtggatctccccaggcactagccttgacccgcgccgtttgaggctgggacctgggcacgagcccttgttcaagccaagacacagaaggaccgtggcacagaccatcctcgtctcatacacagaacaaatgaaattgacacaaaaatttcctctttatttgattgcagattaaatcagcctataacaagaagggggcccgaaggcctcggaagaagaaggaaaagctattaagattggcggaggcctgggggctcactccgacgtgcctgggtagccggcctcgccgtcactgtcgtccgcaccgtcgtcaccgcactccttgtcggagttgaaggcaaacgcgaagccgaggggccgctcattattgtcggtcggttttcccttgctgatgcgcgcgacttgcgaccgccgggattctgcccgaagagagagagagcagggaggagaggcccccgagccgaacggtggcccaaggcccccgacggccggagctggccctccgcctgcttgtccgacggtgccaggcgcccccgacccccaggatggccccgaggccactgcgggaaggccgcgcctgtcgccctctgaccccgaggtcgtcggcacagaagccgagtgcgccccgcgtggcctctcggatggagagcgccctggagatgtggcccctgacgaagaagatcagccccgccgaaaggtgcagcggcccgtctacttcgttagcgaggccctccgggacgctgagacccgataccttcaggcccagaagatgctttacgctatcctgataacttcgaggaagttgcgccattatttccaggcgcatcgggtcacggtggttacgtcttatcccctcggccaaatcttgtataaccgagagggtactggactggtggtgaaatgggcaatcgaactctctgaattcgatttgcgctttgaaccaagccacgcgatcaagagccaggccctcgccgactttgtggtggagtggaccccagctcctgagctcgtctccgcccccgaggccagctcgagcccatcgcagctgcctcacaccgccctctgggtgatgtagttcgacggcacctgtaggaaccggccccacctgtcaccaggccttagaagtggcgtcacgcccgaccgcttccctcggggagggcgatcgccctg

SEQ ID NO: 91681 - DNA, 1981 bp, Oryza sativa
ttagccgatgattccaaaagagaaaaggtagaggagatctcgggaaacatttcccctctattgatttcaccggagaaggaaagacgcggccgaatttggaaagagacagcggcggcgcacgctagggtttcgggcggcggcggcggcgcgaggaagacgaagactgacaggtgggacccacctgtcagcgacagcgagcgcgcgcgcgcggctgcggactggactgggccgacttgggccgggaagagagagagagaaggttttgggccgactttcggcccaaagccaaaagagacttttaaaaacatttttcaatttaaattattcattaaatgcaattccatttattaaaaatacttccttagctcaaataaatcccagaaaaatctaggaattatagaataaagcaaagtatttaatgaaattttatctggccccattttatattggaatttattaattaaaattagatcttctgttctagacttttaaaatcatttctaaaaattccaattaaacaacaatttatacatttaggatttttagggtgtgacacgggggttccggccgtaggtggggttgggtcggtacttttgtctatggctaggatgggttggaaactatgtcatgtcttccgtctgtatgccgtggtggtatgtggcacgtggttacacgtgaggaagatgtgtcttgtgggtaaagatgtacacctctgatcagagtataacctattcgaatagccgcgccctcggttatgggcaagccgagcaatgtacctatgttagtgttttagttcttgaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaatagtattgtatagctctaggatcgtgtttacaaaatagctttgagcaactaagtgtcttttaatgctgtttactgcaaaccctaaccctttgtattataacccccttgtactcccttgcatttattctgcacttatgggtgtgtcttgttgggtactgtggttgtaatcagtcttgctcaatttttcccaaacccagaagaggagcgcctggatgatgaaggctttggtgtttagctcgtgcctgccgtcaagcgcctgtggtcgtcgcccatgtaataaagtaactatttacgctgtttcccgtttgtctttgtgtgtgctgggccttcgccgcccatgtaataaagtaactatttacgcttccgcttgataaactccgaaatgtatcaactttttgtgtaccttgtctcctgggacaaggaataatacactcacgtaaggaacacccgttgggttatttccggtcggacgaaaccgaggagcggccggggcggagggtgatgctacgacgtcgacgaaggagacggcgacgtcggccggcgctttggcgcggcgaccgggacgactggaggcggtacagtggcggcaacgccactgtttgccggcgaggatgcgcctccggtgatatccgcgcgaaacggaggcaacgccgggggaagaggatgcagctgaggcgccgaggatggtgatggcacggccggccggcacgtgggcgaggcggcagaggcggctggaggtggccggcggcacaggagagagatgagggcgacggggagaggtgctgcggccacggggagacacgggaggaggctaaaacgagagaacggaaggagagggttccattttatagcagaggggaatgaacgggccacgggagaggcgtggaacggtggcggaaatggcgcccggcggccatggaaggtggccaggaatggcgcgggcgttccgggcaatggagggtgccattcaagggggaaattgggggaaatcaaagaggatggaagggggattaattccccccaatcaattttggaa

SEQ ID NO: 91682 - DNA, 5241 bp, Oryza sativa
actttgttctctgtggttttcttcctccgccgtctaaatttattctattggtgttgaatttctatggtctttccttgctccatttgaaccccaattccatcgcctttctgagtatcttttctcatctgtgtgaggcctacattggggtagagccgtttcttgaccttttccgcttctactatgagttgcgctagatagaacctaaaaaagtgtccgggtgtgttggtttctgacatcgggatggcctgaagtcacgatacatccccttccagtgcccctcatcttgcagcaaatggcgggggaggtggttctatcttcagatagaggattcggatccggtcttcattgttcctgaagaacaaccaaacaagattccatcctggaccaccaaacccgctttgatctcctcccttcagtctttcatcgatgtcattaatgaccttcgagaacaggggttgtcggggtatgaagtcactgccgacttcattggtaggtggattcagccgcttcacgctcgagcccatccagcctttgattattctaggccggaggacgcgacccgggtttctcctcggggtattttcctttttagttaaattgacccccttatgcgcgtgttcttcccgacttattggattctggtctggatctacaggcttggacagtgcaaccgtggagcgccgcgtcagtcaactggtgatcagtggcccgacaacggcgagcaacgtccccgtccccctttgcgagaagggggcggccgagcgtgatgctgccatcaatgtaagtgtactcagcggtccttttccttttttcttccgggattgcattgtgacttcatgacacgtaggctctccctctgactgatatcatcgggccgctcgtggaccatcaggtggcggcgttgctgaaggagaaagttgccaaggaggcgtctgacgctgctgctgccgctgccacaacgagtggcggcaatgttccgaaaaaggggaggaaattctcctctatggtcggacatcgtcggaagacacccaccccctcggtaagtttccctgttcttttattacgtagtcgaaagatttgcacctcacatcgcatcggttgtactctaggcctcggacgcgtctcctccacctccgcgacggcagcggctagtgatgcttagcgagaagtaagtggatgattttgagatcttgtcacttcatcaaactgttgcagcctgtctcagttccatcttttcgcagggcggcacgggcgaaggtggcgcaagacgggtctggagggacctccagcgcgtctcctgccatggcctcgacggatgtcgtggtcgtgcccaggagtcgcgaggcgacacctagcggcccaatcagcgatcttgccgctggtcggggttcgccagctgccgttctcacctgggaggagctccaggtcgagatggggcgccttctcgaggctagtgctcgcggaggcaagggcggcggcagcgtcgtcggcgaatgagcgcgccgaccggctggcgcgcgacttagcggaggtttgcgaggacctccagaagatgcaggagctggtggctggcaatgagcgacaacggcaggggctcgagcaccgtatgtcagagctcgagaaccgcttgtcggagatccgcggctccctgcgtgtcacctacaccggcctgcaccagctcgccggggaatacggcgtcaaggccaccatcccggcgaaccccgacgagttctcgttgacgtcctcacttgaggagctggcagcggcgatggaggcgatcccctccaaacacgcggccagggtcggagaggagacgtccaacgggatctataccggggcgtgccatgtccttgcgtgtgtgaggctggcatcctgaactcgatctgcagaagatcttggatcagggggcggccagcgatgtgcgcaaggacgagatggaggaggtcggtgacctgggagagtccgtcctccctctttttgaagagtagggtcttagctctcttgtactctttggccatgctttgtaaaacttttattggttccaaccgcctttgtgtgcgcagtcatcaccttagcgttttcagcattttgatcttgagaactttgttgtcgtttgtagagatgttgatgtcgaggatgtccagtagcacgggcagtctgagttgccggtagtcgttccattacttgcgttcgagccacatgtgccggagggcgatgtagctcaaaattcgcccatcgaaacgagcatggcgacgactcccttaggttggttgtctttgttatcatttcctttgcccttccgtctggatcgacttgatttgttgtgttctcgggagagaagagcaacttgacttagtcgtttccatgctgagcagatctcgagagtgcacttgctgaccaggatcatcgcatccagtactggaggacgaagtttgaggtcgcggaactcaagaggactatgctggaagtgagaaaggaccaggccgtagagacactccggggtcgtgaggtgtggttcaactcgtatctgaagagttgctgcacatccatgtcgagagtctgtaaagagctccgagtaccccgcggggatcccgaggaatcggcggccggatatatctcgtggctgaatggcgctagcacccagctcgaaggcatcggtcaacgtatcgacgaagccttgaagcaggagtgtcgtcggtcgagccgatatgccggggggcatgtgttggcttgtatacgagatcatcgtcggcgagctttatttgttatctctttctaagaatgtgaatgttgtgtcctcgttgatataagaaaacaagaaaagaaagcgaactcctgatgtctcatcgaaattatggcactgtcgtttaggccatatttcgagggggagaattgagagactagttaagagtgtaattcttcctccattggagttctcagatttacaacaatacatactcaacagcgttccaagcaaatcggtgcccaaaacaccgtatgagctatggataggaagagtaccctcactagctcacctccgagtgtgggggagtcctgcagaggctaaagtatttaacccaaaccttgggaaattagatcccaagacaataagttgccatttttttggctatcctaaaagatcaaagggttatgatttctactgtccaaacatttatacaaagtttgtagaaacgagacacgctgtcttcttggaagacgaaatgattagggggagctcggttgttcgagaaattgatcttgaggagagggggtgtctgtacctgctccgtcgattcaagagcctttcttctctctacttgctgatgttgtgcctgcaatgcatgacgttgcggtaccaacacctgttgttacctctcctgtggcaacaatgaatgaaagtgaggaacctgttctacaggattcaaccgaaattattgccacaccagaggaggagctgcaacagcctcaaacagataatgtgccggaacagcaggcccctagaaggtctgaaagagttagaagatcggctattcgtgatgactatcaagtttatagtatagaagagtcgcatatggaggctgatcccacctcatatgaagaggccatgagaagcgctcgctcatctgaatggttggaagcaatgtaagatgaaatgaaataatgaaactaaacgatgtttgggatttgaaagaaattcctaaaggagccaaaacagtaggttgtaaatgagtctacaaaaccaaatatgactccagagggaatatagaaaatttgaaggcgcgacttgtggcaaaaggcttcacgcaacgagaaaggattgattacaatgagacattttctctagtctattgtaaagattccttcaggataataatggcactggtggcacattatgatttggaattacatcagatggatgtaaaaacggcatttctaaatggagatttagaggaaaaagtatacatggcacaaacaaaaggttttgtcatgaaagggaacaaaaatatgggatgccgtctaaagagatccatttatggattaaagcaagcttcgagacagtggtacttgaagtttgatgggactataaagaaatttgggtttcaagagaatgtcgaggacaactgtatttattcaaaatttaagaatggaatattcattttcctaattctgtatgtggatgacattctaccatctagtagtgatgtcagtccactgcaggaaacaaagaaatccttgtcctcaaactttgacatgaaagacctcggtgaggcttcatatgttttgggcatacagattcactgagatagaacaaagtatgcattgggactttatcaaaagacatatatagaaaaggtgttgaagaaattcaacatgtacagatgcagtgcttcacctgctcttatagtcaaagcggaaaagtatggggcatgacaatgtcccacaaatcagtatgagctcaatgaaatgaaaacaaaaccatatgcgtcagccgtgggaagcctacagtacgcgcaagtgtgcacacgccctgatttagcatttggtaccaggttacttggtagatttcagagtaatctaggctcagagcactggaaattggtaaagaaagtcttgcgctatttgcaaggaactaaaggcctcaagctgtcttacagaagatcagaatcgctccagatagtggggtattctgattctgactttgcaaaagataatacaaagtcaacatcgggatacgtgttcaccctggcaggaggagctatttcatgaaaaagctcaaaacagattatcactgcagggtctactatgtatgccaagtttatagcatgctatgaggccactaggcaggtgaactggctaaagaagttcatacccggtttaaaggtggttgatagtattgagaaaccactaaagttatactgcgataacgaacccgcagttttgtacgctcacaacaatcagtcaagtggtgctgccaaacagattgacataaagtactatgttgtgaaggacaaagtctgggatcaaacaattagtctcgagcacattagaacagaaaggatgctcgcggatccgctcacgaaaggcctatcactcaacgtgttcaagaaacatgtagtcggcatgggtttaagggaagccttatgaatcctggactacagggcccaaaagttaaagtatctatatttgaatagagatgtgtatagtggatgtcgaatccattggtgattgaccgtgacgatg

SEQ ID NO: 91683 - DNA, 950 bp, Oryza sativa
catgactacaagatggctgacaaccgttctgtagtcgaacaggctcatgagatataaaccatggctaaggaatttgaactccttaagtgtgtcttacccgacaaatgggaggtcgggtgcattattgcgaaactaacttcattttggagaagtttcggtactgcactcaaacataagagacaggaatactccgttgaggggtgataacgtctcttgatattgaggagaaagctcgggaaaaagatgccgcgtctaagggcgatggtgggcagtccagtgccaatattgtgcacaaggcccagaacaagagcaagggaaaatacaaagctcagcagaccaccaacttcaagaagcagaagaagaacaataacaatcctaatcaagatgagaggacttgctttgtgtgtggccaacttggtcatctggctaggaagtatccacagcgcaaggggatgaaggcacctgcagggcagacttctaagtatgctaatgtgaccattggcaagactggagatggaagcgggtatggtaatttacctactgtttttttagttaatcagtctacttattggtgggttgatactggggccaatgtacatgtttgtgctgacatctcattgttttcttcttatcaggtcgcacggggttccaccgtcctattggggaatgggtcacatgcttctgttcatggtgttggcacggtagatctaaagtttacttcgggaaagatcgtacagctgaagaacgtgcaacatgtcccttctatcaacaggaatcttgttagtggctcccgtctgactagagacggatttaagttagtttttgagtctaataaagtagtcgtgtctaaacatggatattttattagtaaaggttatgagtgcagaggcctattccgcttttccctttctgatttctacaataagtctgtgaaccatatttgtggcagt

SEQ ID NO: 91684 - DNA, 766 bp, Oryza sativa
tgaaacctgaggtgtggtgtgcttggttagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccttagtgtaatcttttgaatttggatagtttaggtggatggctgggcctgtcgcaacgtgggatagcgttggacagcggatgattaatattaattaattattacaactgtttaaatctttcaatttctgtttataaatgctcgctttatgcaaatgaaccacttcagctcttctttgatgattccctgcatcatacccctattccggtatgacttgctgagtacagtgggtagtactcagtcttgctctacttttcccaaccccagagtttgagttcggggtcaaatgaaggtttcttcgaagagtaggctttgtccgtgccgtcgaggatgcctgtggagtggtgttcccgctgcagttttagtcaaggcttagctcctgttgtctttttttttcttccgctgcatttatgtaagacttttatgatgtttgtaagacgtggatctgaatgtcaacattgtcgtttgtgtaccccggccggtcctggacggggattttaatgcacattctgcttgaaattctattcgggaatttttgggcgtgaca

SEQ ID NO: 91685 - DNA, 625 bp, Oryza sativa
tcctaggtctatagtaagcttcctagaagattcacccaaaatctccatagactgcgaccaacagtcaagctcacaaaggtgagttctttcaagaatgctctgcaggacaacatcttcgctaattaaagccaacagaacacattaaggcatagccaacctgccttacagctcacgagagtacatgcatcttcacttagagagggtatagattggtactctcctctagtttactaatggtttgttcttcccagattctaattcacgggatctccgatcacatagactgggttaccaccatagtataactcacatgggtctcaaacccatctccttcgatacattgtttatcacatttcgttatagtcccttcgtgaagggatttgccaggtttctagctgtttggatgtaatccaacgttataactccggagtttcttaatttcctgatagatttcatattatccttagaactattcactttaacaattaccgtttgattgtcacagtttataaggatagccggcaccggtttttcaacaataggcagatccattaatagaacatgcagccattctacctcaacagtagcagtatccagtgccgtcagctctgcttccatggttgac

SEQ ID NO: 91686 - DNA, 1620 bp, Oryza sativa
atgtaatccaacgttataactccggagtttcttaatttcctgatagatttcatattatccttagaactattcactttaacaattaccgtttgattgtcacagtttataaggatagccggcaccggtttttcaacaataggcagatccattaatagaacatgcagccattctacctcaacagtagcagtatccagtgccgtcagctctgcttccatggttgacctcgtcaaaatggtctgtttgcaagacctccatgaaacagcaccaccacccagtgtgaagacatatccactagtggctttgatctcatccacatcagatatccagttagaatcactataaccctccagtaccgcaggatacatagtatagtgaagccccaattccacagtatctttcagatagcgcattactcgctcaagcgcacgctagtgatcatatcccggattagaggtaaatcggctcaacttgctcacagcaaaagagatatcaggcctagttgcactagccaggtacatcatcgagccaatgatttgggagtattccagttgattcctagcaattctcttgttcttgcgaagcaacaaactaggatcagaaggtgttggagaaggcttactatcaatgtagccaaaaccaattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaaggtttgtcccaaatatcagtatgtcatcaacatacaagcataaaataacttcctcacccccaccatggcgatagtacacacatttatctgcctcattgactgcgaagactgcagatgtcaatgttttgtcaaatttctcatgccattgcttaggagcttgtttcagaccataaaaagacttcaacaatttgcacaccttgccttcttgaccttcaactacaaacccatcaggctaatccatatagatctcctcatccagctctccattaagaaaagctgtcttaacgtccatttgatgaacgagaagaccatgtgaggctgctagggaaagtagcacacgaattgtggtcaatctagcaacaagtgagtaagtgtcaaagaaatcttcgtcttctttatgagtatagcccttagcaacaagccgaaccttgtacatttcaatagtaccgtcaggcctaagcttctttttgaacacccacttgcatcccacaggtttacacccatagggtcgctctgtcacctcccaagtcccgttagcgataatagaatccatttcactacggacagcctccttccagtagtctgcatcaggagatgcatatgcttctgaaattgacttaggagtgtcatccacaaggtacacagtgaaatcatcaccaaaagacttagctgtcctttgtctcttactccttcgaggagcttcactgttatcttgctcagtgacatgttcatttgtatgttcagtttgttctggtggtgtgattgaactgggaattatttcagatggttggctcgaactattatgtgtatccttcattggaaaaaagct

SEQ ID NO: 91687 - DNA, 2496 bp, Oryza sativa
acgctccgtcactcgggctcggagagagagagaccgatccgaatcgacctcgaatcaaacactttccaagcgattttagccgatgattccaaaagagaaaaggtagaggagatctcgggaaacatttcccctctattgatttcaccggagaaggaaagacgcggccgaatttggaaagagacagcggcggcgcacgctagggtttcgggcggcggcggcggcgcgaggaagacgaagactgacaggtgggacccacctgtcagcgacagcgagcgcgcgcgcgcggctgcggactggactgggccgacttgggccgggaagagagagagagaaggttttgggccaactttcggcccaaagccaaaagagacttttaaaaacatttttcaatttaaattattcattaaatgcaattccatttattaaaaatacttccttagctcaaataaatcccataaaaatctaggaattatagaataaagcaaagtatttaatgaaattttatctggccccattttatattggaatttattaattaaaattagatcttctctcctagacttttaaaatcatttctaaaaattccaattaaacaacaatttatacatttaggatttttagggtgtgacaaacctaccccccttaaacagaatctcgtcctcgagattcggaagaactggtgaacagatgcggatgagctgacttcaattcatcttctcgttcccaagttgattcttcttccgagtgattactccattggactttacaaaaacggataactcgatttctggttcttctctcatctatttccaagatacggattggtttctcaacataggtcagatcctcttggacttctatctgttcaagattagcttcttcggtaggtacccttaaacacttcttcaattgcgacacatggaacacattatggactcctgccaaagattgaggtaactccaactaataagcaacctctcctcttctactgacaatcttataaggtcccacaaaacgcggtgccaattttcctttggtgtgaaaacgatgaactcctcgaagaggcgtgacacgaagatacacataatctctttcgtcgaaactcaaatctctgcggcgattgtcggcataactcttatgacgagactgggccacacgcaatctttcttgaatgattttcaccttttcttctgcttccctcaggatatccgtcccgaaaacctgacgttctcccgtttgatcccacaaaagtggagtgcggcactttcgaccatacagtgcttcgtacggagccatctgaagactagcttgataactgttgttgtacgagaattccgcataaggtagattcttatcccaacttccaccgaagtctaaagcacaagctctcaacatgtcttccaaaatctgattcaccctttcggtttgtccgtctgtctgcggatgataagcagtactaaagttcagcttagaacccatctcttcctgaagcttcttccaaaaatttgaggtaaactgactgcctcgattagacactattttcttagggacgccatgcaaacacacaatccttgccatatacaattccgccaaccgacttccggaataggttgtctttactgggatgaaatgagccactttggtaagtctgtcgactatcacccaaatagagtcatggcctgatgacgttctgggtagaccagtgatgaaatccataccgatttcctcccatttccattcaggaatcttcaaaggctgcaacaaaccggcaggtttctgatgttctgccttgactcgctgacaaacatcacatactgctacgtactctgcgatttcacgcttcatacttgcccaccaaaatctttccttgagatcctggtacattttggtactaccagggtgaatggaatataaagtatcatgagcttctttcagaattgcatcttttaaatctttgttgtcaggaacacagattctctcgcccaaccatactgttccttgctcatcctccaagaaaccgatagctcttcctcttctcatattctttttgatttcttgaatatcaggatcattaatttgggcttctctaatttgatcaattagagtgggcttcgcttctaaggctgcaacgaaacctctactgacaattcccaaatttaatctttcaaattccttgcataattccaatggcaactgtcgtccttccgtagcattgcaatagcctttcctcctaagagcgtctgctacaacattaacctttcctgggtggtaatgaattcccatgtcataatccttaattaattccaaccatctcctttgtctcatgttcagatccggctgagtaaagatatactttaaactcttgtgatcggtatacacctctgtacgagtaccgaaaagataatgacgccaaatcttcaacgcacgaactactgcagctaattcaagatcatgagtagggtagttcttctcatgcggacgtaactgacgagatgc

SEQ ID NO: 91688 - DNA, 654 bp, Oryza sativa
cctttcacttgtctttagatgccgcgctacaagcctgagtacttgtttggtgttgagggatttgtccaggagttgcgtacgatgtcctttgccacaggatttgggactgcccctttttatgcctagattcctcatgatcgtcatgaagagaagtgccgagtcaaagtcactttgaacagtaatagtgaagatatcccctcagtgatgttcgaagctggaggaagaaactacatccatgcatgtcaggaggtagcaaggatcgccataggcgagctccgcgatcgctacagtgatcagttggccgacactgagtatcgctaccattctcgtcaaccccagggaagtgaccgtggcagctaccttgagactgagggaattgagaatgatgctaccacaaggcatttggttgagatgctgtgggctatggatgaaacccgtgcagagactgtgttagcagctcaagatcgtgaagatcggaatcgaggtaagatttgcaagctagaggacaaagtggatcgattggagaaggaactagccgcgttgaagggagaagcaccaccgcagaaggcccagatttgtcttaccgcaaggaagagagctctatttgtccctcgctatcaattggcaccaaaggtccgtgtggtgggaaaaaga

SEQ ID NO: 91689 - DNA, 760 bp, Oryza sativa
tcatacacaaattgtgtcttagagtctgtggtacggttggctatagatttataacccactgttcttatttctcttcttttatcttctcgatatgcgcttatagctggtttatagtctgctgttatacctgttgtaagccgcagggttaactagacaaaccatacggtcgtactgttcttttatttacttttaatagatagctgacggagctcgtggctcctcaccgggagaccgcgcaggcccccctttgccggttcggccgggggcttagggtgaagtctcaagctctctcagtatgtgaaaagatcgccagctaggaagaaacgcgagacacgggcgatgtatacaggttcgggccgctaagaagcgtaataccctactcctgtgttttggtggatctgtgtatgagggagctacaaagtgtgagccaacctcttacttgttctaagttccgaatctggaaaagatcatccccctttccctatgggcaaggtcctccttttatacttcaaggggataccacatgcacccctctctttccaaactggacttttcttctcttcataaatggacggagatttgcacggttgtcctccgaacatccttctgacgggacggcacacacctacatccacttctgccgaagacaggcgcgtcgtgggaacgtgactgtctgccgacgacatgaccagtgtcagactggtcattcttgtcctccacgcgtcagttcaacaatctgcatgttcacccttcttcatac

SEQ ID NO: 91690 - DNA, 4288 bp, Oryza sativa
ggccgcgcccttctcgtcgcgggggccgaacaggcggagcagggggatcctcaagcccgacatcataggccccggagtgaacatcctcgccggcgtccccaagatcgaggacttggcgctcggggccgaggaagtgatgcccaagtttgacatcaagtccggcacctccatggccgcgccgcacatcagcggggtcgccgcgctgatcaagaacgcgcacccgacgtggtcgccggccgccatcaagtcggccatgatgacgacggccgattacaccgacaacctccggaagccgataaccgacgtggacggcgcgccggcgacctactacgccatcggcgccggctacgtgaacgcgcggaaagccatcgacccggggctcgtgtacaacctgtcgtcgctggactacatcccctacctctgcgggctcgggtacaaggaccagaaggtgaactcgatcatccacccggggccggcggtggagtgcgccaagatgcccaaggtcgatcagaaggatctcaactacccgtccatcacggccgtcctggacatggagccgtacgaggtgagcatcaaccggtcggcgacgaacgtcggggcggccacctcgacgtacgccgtggaggtggacgtgccggcgacgctggcggtggaggtgaacccggcgaagctggagttcagggcgctgaacgaggtgctgaactacacggtcaccgtcaagacggcctccggcaaggcgccggccagcacgatcgaggggcagctgaagtgggtgtcggggaaaaagtacgtggtgcgcagcccgatcctcgtctgtgccggcaccggcggcaagagcgccgcctccatgggggctgcaccggcgtagagcactggtcgagcggagcctaagagatagcagcttgatgatgattactagattgccacgcgtgttaacgtttgatggtgctttactcttcgctcggtaggtttaggctcatgtatgtggaggctagcgaattaatcctttcctccgcggaagtggggtgacgggtttttcttgctgtttttaccactagtgcacgcggctgatcttgaccattcattgattttgtactccaggggacgagatgtgatttcatccccggccccttaatcatgatatatgttcatttattctttttttcctgtttctcaaatagatgcagacgtgacactcctctcaaatagatgctggtgtgttatatatgctatatatgctgtgattatattttaaagttgatgtgaaaatttaaaacatataatcattattgtagtttattttgccaattgaattacgaatagagaaaatatattatccaactttcattatttctcctattgtttatatttttcataatattactgtttgcaacatcacgaatgccaagtggagcttaataaggatcttgagttgaagcagtttgccaagacaccaaaatactaaaataaagctgttggaccaaatgaggttccaggatccatcccaaatgccaaacggaccggagcctaataagtactccctccattccataatataaggcacaactatttttattacatgtttcataatagacatacatgcaaacatgcaattaactatgatatcttctacattaaattattacttttttaaatcatccactctcaagttatctaatcatattggatgcatgcattaatatttattaggatgatccaagctacaatatgataataattatttcttggtctttgggttaagggtggttgtcccttatattttggaatggagggagtatcttgagctgaagcaatttgccaagacaccaacatgtggaagggcgggctagctccgcatctattttaagtttgaacctgggaagaaaagattagagctagtcttctagtttttcttttcggttgttctttttcatgtttctcaattatgagttttagaatgtatgcactcgtgtaaactttgattgtgtatatccactttggatatagaggccgaattttatccattatctaaaaaaaaagacaccaacatgttaaaaactatatattgaaccaaatgagattaccaaaatccaccgctaatgccaaacggagcctaataaggatttcttgagttgacatgttttttttttacttttttttaaaaaaaatctttttccgtccccattcttgatcttgagtaaaactcaataaatgaaaatcatgaacacctcgtaagtttatattgtttgttctttctttgtagtttgtacagaaaatactactcttgtatcttatcctgccaattcttttcataatttttcagggctatttggaatgtagctgagaagtaaagtcacattttaataaaaaagataccaaattataaccgctcatattaaaaggagacccgtgtggggatgaaccttaatagtatagtatagtacttaactatatttattaatttcgatttcggaattactatacggctataccaacaaaacaaactaagaatccaaagatgactacaatttggtatttcaacaccagaactgtaagtttaaaatttcaacaataagtactgtaagtaagaaggatcccaattgaccgagaaatcacaatgcgcgtaacgcgtgataatacctctgtctcataataagtgcagcaatgagtttttgcgtccaaatttgatcgtccgtcttatttaaaatttttttataattagcatttttattgttatgagatgataaaacatgaataagactttacttgtgacttatgtttttaaatttttttaaaattttttaaaataagacgaacggttaaagttggacgtggaaaaccatggctatacttattttaggacggatgaagtattaccgtctctgaatctctgatatatgatcaggcgaaggtgacagagaccgggctccgtacggtgtgcgtctccgaaacccaccgcactgcgccctgcaccacccttgcgccgccctgccccggccacacgaccaccgtgaaatccttctcctggttcactccggtgaaccgcaatgtcctcgggaacacgcggacggtcacggttgtgtccagcatgtcgaccgccgcgtagtactccgatggcacctccccgacgttcttcgccgtgcgcctcacgagcaccggctccgacgagttccacgcccgcgggaacctgaccgagatcgacgggtagttcagctggtgctccgggatcgccgcgacggcggagcagttcaccggccggcgcgcgatcaccgagacctcctggctcgtgtacaggccgcagaggtagccgacgtagtcgcaaggagcaatgtcgtagaccaggccagggtcggcggccctctccgggttgacgtgaccggcgccggtggcgaagaagttggccggcgctcgctgctcgtcgagtatctggttcccggagcggtcggtgatgtcggcggtggtcatgatggccgacttgatcgccgccggcgaccagtgcgggtgcctgctcttgatgaacgccgcgacgccgctgaggtgcggcgtcgacatggatgtcccggagatgatgttgaaggtcggtccagggaaaacctgcgccgacgatggcccaacctggaacggccatgcggcgagcacgttcacgccggggcccgtgatgtcgggcttcaggataccggggttctgaacgctaggcccacgggaggagaagaaagccatcgccggagcaggcgtcgtgccgagtaccgtgcccctggggaggatctgcgccaccgggttcgccgtgctgttgatgtacgccttgatggctaagccggcgacgtagtcaacatgcgacgccgggaggacgtgcgcctcggccaacgtagtgtagccttcggggaagtgattgggaagtatcatgccggcgccgccggcgctctgcaccaccgcgcctttgatgatcctcgtgatgttaggaccaccaccgactcgcagacgacgatcttgcccctgacgtcgaagccgtcgagcgagccgttgccgcagaactcggcggacggcttcccgctcgcgccggcgtagaccagtgggtagaaggtgctcggcgagtcgttcggctggtacagcgactcgccgtcgaagtagagcccgttccctaagcgcaccgtcgtgcgtatcgaccggtccatggtgctcgcggcgacggtgagcatccacggcgcgtcgttgatcacggagctcacgtttgggccagcgttgccggcagccatgctgacaaacacgcccttctccatggctccgaacg

SEQ ID NO: 91691 - DNA, 2861 bp, Oryza sativa
ttatagtatggatgaacatttgttgaagtccaggaatttattttgattgaaatttttggattcttcttttgcaggctgttatcaactatgggccctcatggtatgtaacctatctctcgccatgtgtcacttcatagtttacgatccagcagatgtgaagattatatattacgaagtgcaaataacggttcatcaatctctggattatttggtaacttcatactagtattcatatttgctgatgtgactatttgagttcaattgagtaatcagcagctgttaggagttagcggttgtcatttgagtatgtatgcacaagtatgagtatttaaacctgtaatattgattatcctgatggactattggacatttagctgcctaaggagttaggactgactagatttatgttatgcattggtttgacctcaatatgaccacctaacagctatagaaaatcggtcatcatttgctgtatattaacatgtgtaaagtcaaatttgtttagcccaggatttttttcctagcaatcctgtattggttaacaacatataggatactgtatctctttaactctgtgaattactcattccctccgtttatgcaggtgccgtgtttgcagtcagattcttccacccttctgcaggttcagcaatgaattcaagaatcttaccttcatttatgctgatattgacgaatgcccagaaacaacacaaaacatccgatacaccccaaccttccatttctaccgggatggagagaaggtcgatgagatgcttggtacaggagaagagaggctgcatgaccggttatggttgcattcttgatagggatttgccgggctgttggtctcatgcacaatattttctctctctcttttatcctactttcgtgctttgttgtcaacctctgagccaattcaaggtttatgttggtgtttgtaatgttgatcatggtcatctttagtgacatacaccattatatatcagaattggtgtaccggtttttctctcatgcttatgtcaaaactgagaaagaataccgtcgacattacgatgcaaacatttttagtatcgtccagtttgtacgatggtgctgctgcagatttctgctaatcatgtgtcgtggaaatggactggccacttattatgtcaacagtaacgcatctgtgagtacctgagcagagttccatcgcttatactcctgcccggagctaagaatagaagacaattagacaaacacctcacttttctttctttttttttgaaacgaaggtgcaaatatgtttcattcaatcaccaaatcatttacatcagcttaactactcctactacaatttgtgaatccggtaatcttcactataagattcttcagtaataagtaaatagtttgactgccgatacaagcaggttttgctaccttcgcatacccttcagatgcaggtgccatataaatctgggaaatctcaaaaatctaactagtaccgttgtatcatctaacaatcaccaaaaatgtgatatcagaatgttctgggacaaagccagcgctcagtagaagcttcatgcgaacaaacagcatgattaccaggtagaaacacgattgacaggataaagaaaaatcatgcggtcaagcttctaaatcaaagtatcagtaactctagatcataatgcagctaattcaggaactcaagatttagatttagggattccaatttttaattttgagggcctagttttagttctactgctgttccgctctgccttaatggatgcaatcacagcatcagcccccggaccaagacctttcctgccaactaatttcacaccaagcttttcacagaggtaatgcagcctcatttcatcacctcctctaacctctcttagctccatagcctgctgtcgtgatagtaatgtgtagacataaagttgttgttgctggttgaaatgtgattggagttgctgaaacaacaatttatttgagtggtgctggtccgcctttcccccttcagttgcacctttctttctagggccacctagttccaccttcagaatggctggggactttggatcagaagcttgtccaccaaaaatgacagagaagctgccaaattccaaatctggttgcctaaacaagtccatgagtagagcagcacaggcctgtgtatttgttgatggacctttttcaactttgctctttgctgctcgggcattggcatggagagtgtatttgcagcctcccgcagaccactgatgaaagcaccatgcattgttgctggataacgtctcgtggtggcctctccagcgaaaaacaaccgcccatctccaacactttcagctagtatgtcatagtcatctccagatgctccaacagcaacatgagaatacgaacctagactgaaggagtctgtgccccatctagtacaaacactctgcagaggatctgggacctcaataccttgaggttcatagatacctgagatacacaacattcaccttttagacaaaaaaccaaggttttaagcagtcgaacctattgtaacaacatactacatacatgtctacatatatttcagtgcagttgcagaggtatgaggttaatggaacaaagagtctgttgcaacttgcaaagagtcacttgggtgaggcatattgaagtaccaccttatgcatatagtcatatagtgatctaaaatacgatgatagattttacatcgctagatgaccatttacataaggtagtaaaaaattctgatggtagcgtattaaaaaaaaactgatgataggagataaaggtcttacctctcagtatcttgagaacagaactgacagcatcagtagggggtgtggtttcaaagttgtgggcag

SEQ ID NO: 91692 - DNA, 6714 bp, Oryza sativa
atctcaatcatgaagtctattaccattttcttggaaccgatcagtcagaggacctgttgtgctgggaggaccctgaccatcccaagtacatttacacccctgaagtttcagaagatggcaaggtatgcagctatggccatgagtcgatcaacttaggacgaagttttgtacaactctgaatcttttctaagcattgacaaacatgagctactcctgagctgatatctcatcacttcacttgttgcagtatgtgattctgtcagtcgcagaaacttcagaaccggtaaacaagttgtactactgtgacctctcggctctccctgacggcctggaaggcatgaagggaaaccatggcaatgccatgcttccttttgttaagcttgtggatgaatttgaagcatactacgcactcatcgccaatgacgacactcaattcacatttctcactaacaagaatgctccaaagtacaagctgtcgaggattgatgtcaacgagccacactcatggatggatattctccctgaagacgagaaggctgtcctagagtcggcttgtgcagtccatggtgataagcttctggtaaactacctgtcggatgtcaagtatgtcttgcagatgaggagcttggttaccggggagttgctccatgacatacccattgacattggcagcgtcaatgggatctctggcagacgtgacaattcagaggtgttcatcgagtttgctagcttccttactcccggaatcatctataggtgtgatgtcagcaaggagactcccgagatgaacatatacagagaaatctcggttggtggttttgatcgcacagattttgaagcaaagcaggtaattttcaatagcattacgagctcttagcacgatacctgaactttgtagaagtacaatgcattttcagagttgcacaattcctgtttgtaattcagctagcatttctccctatttttttcctctccatttttttcaggtgttctaccctagcaaggatggaaccaagatcccaatgttcatcgtgtcgaagaaaagcatcgttcttgatggatctcacccgactctgctgtacggctacggtggcttcggcatgaacatgacgccccatttcagcgtcacccgcatcgtcctcatgcggaatctcgggttcgtgtcgtgcatcgccaacatccgaggcggcggggagtacggcgaggactggcacaaggccgggtcgctcgcgaacaagcagaactgcttcgacgatttcatcgcggctggtgagttcctcgtctctgcaggctacacgaacccgagcaggctgtgcgtcgagggtgcgagcaacgggggccttcttgtagctgcctgcatcaaccaggttttctcactgtaacctcttcagttttttcagttctctgcagaagattgagcaagaactcactgtggattgtgcattttttttacagcgtccggacctttttggttgtgctctggctcacgtgggtgtcatggacatgcttcgattccacaagttcaccataggttctgactcatccctgaaacccatatacttgaactttctttttcgttgaaatatttcatctcaccaatgtgctcggcaacacttgcatgcaggccgtgcatggacctgtgatttcggctgctcggagaaggaagaggaattccactggctcatcaagtatggcactagccctctctctgaccaccaaggaattcttaatccttttttccttcagtcacatcataagttaggaatgccaaactactgacgcgcaggtactctcccctccacaacgtcaggcggccatgggagaaaggtcaccggaggcagcagtacccttccaccatgctgctgacggcggaccacgacgaccgcgtcgtgccgtcgcacacgctcaaattcctcgcggtgcgacccgtgatctctcctcctaccttcgccgccattttctctggattctgatgaattttctctgttgattgggggcagacgatgcagcacgtactgtgcacgagcgtgaaggagagcccgcagacgaacccgatcgtcgcgcggatcgaccgcaagagcgggcacggatgcggccgctccacgcagaaaatcgtaggcgaaatctttgctcgtctgtgtgtgtcacgtttttttctgctgatttaactgaattttgctccgtccgtgggtggcagatcgacgaagctgcggacaggtatgcgttcgcggcaaagacgatggggatctcttggatcgactgaacaagcctccgagcagttggtgccttggtgggtgctaatgggtttaacttcttatagcatataaccctataaaatttgagagttggatctagaatgagatgaacacaacttctgtatatttttggcttaaaaatatttatgggctagatatggttgtgaaaaaaatccatgggtctcaccaatatttagagattggttagttggctatggtcattagataggtgtctaaaaaaaccgtgatgtgagaaggataaaatttattccctcttacactcgccataagaaggtgagactcaaacctgggtgaatgtattcacaaatatgtgcgctcaccacggtttttttttttagaattacacagtacaacacaggtagtcataacgcacgcacgcaaactttacccctacgagcatcttcgaagattgggccgacaaatccatcttggagattgacgaagtcaccacagaatttgtaatgtaattggttgggtttttatagtgattggcatggtaactttgcatcttctatcttcttatgtagttcgttgaaaaaaaatagtgattggcatggttgatactcgatatgtacatatattacggatttcatcacctattcctagatggaaaacagttgtgaaactatgaatgtataaaaggagcttgatcatgattttctacccatatctgggagtgccgaagtttctctaatattttgaagacgtattcattctcctcccaatcctaacctaccatgcgcagcgtgagaaaaccatgtaaaaaaccaaaccagcccacccactgcaccccctaggctcccttccccgactgtgtgagagaaaaaaaactaacagcgccttatcgttggcatattttctgatatttgcaaacgaaaatcaatttgtgaataaaactttttatatatatgtgtgttcttagcgatctaaaagtaaaggctgaaaaataaacttcgataaaaaaaatctcaaaatcagctccaaatttaaagttgaaaattcaaattttggctgataagcatatgaatatgcgagcccataaagcaccatgtcttcttctcgctagaaaaaccatagtttaaataaccaacagaaataccgcctaaaaagcaatccaatagtcccaccgggaatagacatctaaaatcagtttgggcctaaaagacaagtatgacagttgattttatgggtctattgcaatgcaggtccatttaactagtggggagaaggagaaagagagaagggtgtgttcaaagtaaaacaaaagaaaagtggccaaattgcgagcataattattcaaagctagattaaatcatactatttcatatggtaactgtagttgatatacaaccctcgctagagttatggtaggcaagattacaactattttttatatagatcaatatcaataaagtataattgtattcgatatacaacactcacttatatggtttaaaagtacaaatgtattttgtatatacattttatataccaatcaatcaatttcaatcaatcaatttctgttgttataatctaatagactactactgcatctatttcaaaatataataatttttagctatatatctagataagaatataattggatggacaatttattactatattttaggatattttaggatgtatgtagtaacttatattggatggatgatttcaggtgaacttgaacatataaacattgctcaaagggcactaccgtataaaccgaaacttggagatgcccagctcaatatgcaattcaggttctcaaaataaaagaaaatgcaattcagtggaaaagatctagaaaagtggtaaccggcacgcgaccacgcgtacagagtaagctgatcgcacgcgtacactatccgggcaccaaaaccgctgctcaaaccaacaaaccctcccggccccggaaatcccacgaatccgcaaaccagttcgccccccaaatccgaccgccgctcaagccccacgccgcgccaccggccgccaccgccgccgcggacagccgcgatgccgaagaagatgggcgtcaactccaaggcggaggcggcccgcgagcgccgctccgtcgcggaggccgaccgccgggaccgcgtcgagcgcgccaaggaggaggagtactggcgcgaggccgagggccccaagtcccgcgccgcgcgccgccgggaggaggacgccgagaagcgcgccgaggccgccgcccgcaaggccgagaaccgccgcctcgcggaggccgaggccgcctccgcctccgcctccgcgccgtccaagacggccgcccgcaaggcctcccgcgtcggcgccccggcgcccaaggtcaccgaggccgagctcgcgcgccgccgcgaggacgagcggctccgcctggagcgcgaggcagaggccgccaataagcgcgccgcgcgcaccgccgaggaggaggagtacgagcgcgtcgtcttggtcgccaacaccaacagggacgactccatcatcgaggcgaggtcggtcgacgaggccatcgcgcggatgtcgctggttgactcagagggagccttgcccgccgacaagcaccctgagcgtcgcctgaaggcatcattcaaggtatagtgaccaaactttgtgcttattttaactcaattgctgcccgatagtgtggaatcgtgtttacttctcaaaatatgttgcttgaagacaatgaattgagcacctcactactaccatgtatgcatatgatacaatggtagtcgttggttgtagacttgtagtttctactttctactgtgattgtaaatcacaacaaaaatgggaaaaaaatcacaacagattgaagtctgaatgcaggttagtatggcatgtattatttttcctctccactttgtgtcgtaacttaattatggaaattgacatgttatcccattttgtaatagaatgacaactgctaatatggtacttcattagacaatcttaagtttgatgtagcacaaactcggttagatttgattttcccatatgattatttcattatttgacttactaggatgtttgatgtgcaacgattgaacattcggcgtttgaatttatttgtgataatcttgatgataggcatttgaagaagcagaactccctaagttgaaggaagaaaagccaggcctaacactgaatcagtacaaagacatgatatggaagctatggaagaagtctccagacaaccctcttaaccaggtttgctcacataaagatatttaatttagcttgttcctgcttacacataatccttgcacattctaggttattgttgtgtattttaatctgcatgctctaccactaaaacattttattcaaaattatgttcccttaatgttgtgaactcaaaaagggttacgattgtcaattgtggtggtctactcgaatgtacgaagaatggatgcaatatgggtatcgcattaaagttaaggttttcacttaacaccacatgtttttacattggattgggctgttctgctggcttacgatcatcctagaggcgagtaggcagcagcctgcagcttctcttaagcaccggcattcatgaccccgccggagttgttgcgatggtgcagaacatgggcaggcaacaaccaaggaaagagggacctagggcaggcatgtgtggtgaaggcaaagtgttggtgagcagcatgtccatgcatgaggagaagaagagcggctccggggtgaattgtcatggatggtgggaatgtgcagagacgttggtgatgacggtggctaggacgcggacagggtgaatcctcgacggtggcagtggtggtggctggattgtgattttctgacacgaaggttagtgacggtggcagtcaggaagcgggcgtggcggcagcagcgtggacacagggaaggactgagaagatggccagttcatgcttgcttgcgttgttgcgttgatgggttggcccaaataaccaaacccctggccccgtccaaggtgcaatggaatgcaaaatatgtggtgttaagtgggaatctctagctagacctagtccagtgttaaacttaggttaaaaagatggcccagtgtgaaatttactctttctaatatttgctttaactaaggaaatcagaagtactatgattcttagatacttgtatcaattgtccatcatctgactggtatttatatttaggctgcagagtgatgatgcattcctgctgaattgtagaatttccaaggtaagttttcatggcatgaccagacacacattttactgtcaacaattttcttgaacaataatgcactaaaacacactttttcttgatgtgcagacttccaaatgggtcagaacttcatcagatgctcatggactgaatgtgtgggagatgatcagcttctcggctaataatttacaaagtgatgcagtatatatcatgtgagctcgtttttgttagagat

SEQ ID NO: 91693 - DNA, 571 bp, Oryza sativa
agtcagcctaatgtttcaggcctaatcctcgctggttctgctgattttaagacagaattgagtcagtctgacatgtttgatcaacgacttcaagccaagatacttaatgtggttgatgtttcttatggtggcgagaatggtttcaaccaagctattgaattgtcagctgagattctagcaaatgtcaagttcatacaggagaagaagctaattggcaagtattttgaagagatcagtcaagatactgggaaatatgtctttggggttgatgacactcttaaagctcttgagatgggtgctgttgagactctaatagtgtgggagaaccttgaaaccaacagatatgtgcttaagaacagtgcatctggtgaaactgtgatcaaacattttaacaaagagcaggaagctgaccagagtaatttccgtgatccggctagtaatgctgagttggaagttcaggaaaaaatgtctcttctggaatggtttgctaatgaatacaagaagtttggttgctcgcttgagtttgtcactaataaatctcaagagggatctcagttttgtagaggattcg

SEQ ID NO: 91694 - DNA, 878 bp, Oryza sativa
acgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggggtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgccttcgcctacacggctggactattatgccgccgttgttggccgcttatgccatcaccaaggggaagcctccgtcgccgccgagtggtgcctccgcctacaggctggtttattaagccgccgctgttgggggtttacgactttaccgccggcctgcctccgttgccgccgaatggtgtattcaatggtaatgaaggaagactttggttccaca

SEQ ID NO: 91695 - DNA, 785 bp, Oryza sativa
agatgtcaatggcacggtaaagtccgtcatctattgggcgggcataatctggtatagcagcagccaaagaccgaaactttggcagctttaggttgacatctggtgcaacttcagctaggtagccatcaatcaacttagcgaccattgttataggcataagtgatggtgaagctaacatttgtgcatcttcaccaaggccaggggaagccccaccagtttcttgatccattgccaagaaatggtcaagaatcttgtggacacaatccacatcatagagcgtttcaacagactcagagatgtttggaatcagaagatcttccagggtagccttatcaagctgcatacctatccgtctctccaagtttgacacgcaagaagggctggcttttaggatgattgctgtccgcagaagaccaaataacagcttgcaagatgtgacccccctttggaaaggtaacagtctatcaatttcctcaagtaggtacttttgttcctcttcagaagggattgatgttaaagatgatattgaaaggcaactgctgacatcactgatgcttttacgccgattcaggccaggtaaacgccttttggcatagtggttcaaggatccaacaataatatcctgattgattcctcggtattccatagctgagattacttttttgtataatggaaggcttaagcatgaaacatcatcataccaccaatcagggctgctatgtcttggccttgctccggtgctaatgccattccacaagacgcttcctcctggactctgcatgggg

SEQ ID NO: 91696 - DNA, 767 bp, Oryza sativa
tcctgcagcccagaaccataggagcatgtgaagaagcaatcatcttagcacgacgacacaatgtacaaaccagatcaagatctttcttaagtttagacaaaccacgaacaagatccaaaccacttaacctcgtgagatgatcaaatccaatatgtcgaagtttacgatgcgaaaacatcgcatccttattaaacttagaaaccaaacatgttatcataggtaaaacagaattttcaaaatcacctttaaacactcttccatagcgagagatattcatcataaaatcaccacaagaatcaaatactttacttacaattttcttaaagtgaacctcaaaattttcatcgacaatttgtgaaactaaaagcaaattatactttaagtcctcaaccaaagctacatttttcaattcaaacttgtcatttaccttgaccaaacctgtggcatgaacggcactagtagaagcatcaccaaagataatcgattcagtcttggatgcctattcgagggaggagaaccaatttttattaccggtcatgtgccacgaacaaccggaatccatgatctacatgttcttcttcctcgccaccaaagcctacacacaagaagatgtcgaagccttagtattggggctagataataaaaatttaggaatccagtactgagatacacgaccattagatccaataggcatatatccctgtcacgccgggaatttctatccaaaattccaagcgcttacatgtgtgttaaaccctcgtccagga

SEQ ID NO: 91697 - DNA, 604 bp, Oryza sativa
tgccgccgctgttgggcgtctacgacttcaccgccggcctgcctccgtcgccgccgagtggtgcctccgcctacacggctggcctattatgccgccgctgttgggcgtctacgacttcaccgccggcttgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgttgttggacgtctacatcttcaccgccggcttgcctccgtcgccgccgagtggtgcctccgc

SEQ ID NO: 91698 - DNA, 612 bp, Oryza sativa
tactttgcttatatggccattgacagtctacctggcaaccagttttgggaaagaataagacttatattcatcccatcaagccgacgctacaagtaatatctctatctgcatctgtttaccccatttgaacaatgaattgcatgcttgactacttgcggtgcagcctatgtgcctccttttggattaatcgtaagataatccattttttgtcaaaacagtgattaacagctcacactatgcttcaacatttgcagggttttggagggtccccatgcgtctttcatggagtcagtgccttcaaaaacaattactgtcttcacgatcttccagttggtttacctcttgatatgcttcggcataacatggataccaatagcagggatcctgttcccgttgccattcttccttatgattcttatcaggcagcatgtcctcccaaagttttttgagccaaatgaccttcgggaattggatgcagctgagtatgaagagcttgaaggtgtccaccacgatcacacgctggtataaatttatctcccattcttggattatttacttgtcagtgatgattgtgtttcactctttaattctccgatgggtaccgagctcgaa

SEQ ID NO: 91699 - DNA, 622 bp, Oryza sativa
tcctgcacgggaaggttctacgacgacggccagctggtggtggcgctgtccacggggtggttcgacgggaggagccggtgcgagaaggacgtcgtcatccgggcgagcggcggcgcgtccgtgacggccatggtcgtcgacgagtgcgactcccagcgcggctgcgacagcgaccacaacttcgagccgccgtgccggaacaacatcgtcgacgggtcgccggcggtgtgggacgcgctggggctcaacaaggacgacggcgaggcccagatcacctggtccgatgcttgacgacgacgacgacacacgtagtgacgtagacgccatgtaacacggccgtataatttcccattaataagcttatatatattccctaacagtgatgtatcgtaatttttcttttgtaaaattaaacacctcttgatatatcaagtaataaagagggaatactaaattatactaagagaattgatacctcttggtacatctcagatactataaaaatttttcttaaattttatcattctttggtgacagatgaagctctaaaagaaaatgaaggatggagatgttgtaaccgaacacaacacataccacaccatatttatatatttatattgta

SEQ ID NO: 91700 - DNA, 627 bp, Oryza sativa
cgagctggccgcacgtgagttcggcgcccgggtgaagggcgtgacgctgtccgccgagcagctgagctgggccgagcggcgcctgcgcgacgcgggcctgcaggacagcgtgcagctgcgctaccaggactaccgcgatctgccggcccagcatgccgccgagcccttcgacgccatcgtctccatcgagatgttcgaggccgtcggccacgagtactgggcgggctacttcagcacgctgagcgcctgcctcaagcccgggggccgtgcctgcatccagagcatcaccatccgcgacgacctgttcccgcgctatctgcgctcgacggacttcattcagcaatacatcttccctggcggcctgctgcccagcccctcggccttcgaggcgcaggcgcgccgagccggcttcatcgtcgagaaccgcctggccttcgggcgcgactacgccgagacgctgaggcgctggcgcgatgccttcgtcgagaagctcgacgccgtgcaggggcagggcttcgaccgccgcttccagcgcatctgggccttctatctggcctactgcgaggccgccttcgataccggcaacaccgacgtcgtgcagttcacgctgaggaagccggggtgcag

SEQ ID NO: 91701 - DNA, 5922 bp, Oryza sativa
cccggtggtgccaatcgagctgcttcgccccccggattcgagggttttgtaaggggccgcccctcatccgtggcggccgtggaataataagctgggcctcctccccctccttgaggggttagggttaggtttttgaggaattgcgggtggattttctttggtccggcctgacgcgtgaggggggtttgcgcgcaatgatggggaagacgcagaagttctccaaggggcacccgctcggcttcgtgccggattaccggcacggcgtggagacggtgggggagtcgaagggctgtatcgggagcccggagcggatcgtatcggggagctcgtgtgctgtgccgaagaggaaatgcggaatcctgaagacagaggatggaggggagcttccggggttcaatgtgccgcgggacgtcttcatgctgccgaggatgtcgccttcggataaaaaggacctcgagatgaggctccgcaaggagcttgagcaggttaaggccctacagagtaggctgtttttgaggccggctgcggtgagcatgaatggcggggcggcgtcagcttctggagacgtagttgcaaagagaaacgatgcgaagcttaaacggagcaattcagtgcagtctggcagaggagtgccaccatcagcagccacacctgtggtcaggtctgcaaactacgcagaagcttttaaacaatgtggcaaccttctgaagaacctcttcaagcatcagtgggctggtccgttccttgcgccggttgatgttgtacagttgaacattcctgattattttgacataatcaagaagccaatggatttgggtaccatcgagaaaaagttgaatgcaggcatgtactctacaccttgggattttgctgcagatgtgaggcttacttttgacaatgccgtgacttataacccagtcggtaatgacgtgaatttaatgggcaaagctttgacatgtatttttgaaactagatggaagtttatcgaaaagaagcttccttcactagatgatagattctctgtgagaagagagccatctcaaaagggtgcagttaagaaagataccattgagaaagattacccttctgagaaaaagcactcgacaaaaggtgtacacaagaaagatatgtttaaaaaagaggatgcttcaactaagccagctttgcaaccaaagaagagaaaagcttctcccttggttcagggttctcttgaaatacctgtagtagaagctgataaggtcattgatgatgctcaagtggtacagccttctaaggtgattgatgatgcccaagtggtgcaggcttttaaggtgattgatgatgctcaagtggtacaggcttctaaggagattatgacggacagacaaaagtatgagctaagcgtaagacttcaatcatatggtgggttgattccaaatcatgtagttgatttcataaggagccaccttcctgatgataatgagggtgatgaagatgagttagagcttgacatgaatgtcctaagtgatagtacattgtttgaacttcagaagcttcttgatgactatgatagggtaaatcagtcaggaaaccctacaaaagatgagcatcgtgaggttgaggtgggtgctgttgtattatagttatctttttcatcggttaattagctgattactgttttccaatctgtttggcagtttgaaagtgaatatgggcttagcaactcatcgatgcatcatgaagaaggtgtacatctcattctttgattctttatgataattattgcttttgtggttttgaacttttatatgcatgtttgtaggtaatgagctcgttgaagaagatgttgatattggtgggaatgatcttccacctttgacgtatcctcctgcagtatttgaaagtgaaactgcagaaagaagcagcaagcatagcacttctagcagttctagtagtgattcagaatcatcctccagtggtatgttgtttatgcaatctattattgttttacagtcgctaactttctgtcttcacttctcttctgatgctgagttcagtaacatgttttcaacagcctgggctttataaccttcttaaattctatgccatgttgcgtgatacaaattgatggccttgttgatactgtcatccttattctgtgatgctgttttagtacttggtctgtacatgtatatagtttacaaagtagatagaagttcaaagtcttaactttgagatcttattgatatgtctggactgtttgattcttgtttagttcagactcatcccgatgtttaatatgccgagtgttatttattgcaatcctgtattagctattggactgcaccaaaaagaacctaaattctcatgcgtatgtgctgcaaaagtggacaaacaagtcagctgaacattcatgtcagtgggcaagtattgcaatttttatttggcaattgacattgactcttttgactgtttcctttaggtgcaagttggtaatcatccttatacagtatttagattttttgaaattctgtgtttcttttataatttatttcgcaactctatctctcagattaatatggtatgttcatgatctttgctctatgagagtccttcaattcatgtttctttttgttcacatcgatgatcacataccttgaacatatatttgcttgaatctagaccataaggcctggttatttcctccttgtttccccttctgtttgcctgtgcaattttgtaaatgctatcaaaccacaccattgtgtaaatcatgttagtcttgaacaagtgattctactccctctgatctcaaatataagtcgttttagccttctcaactctttactaaatataagtcattttagaatttctagataactttcgactacttttccttgttttcccttggtaaataaatgatatctccctaacaaaataaagcgattcatctttcccaatgcaatataaatggagagcaacaacgtcatttgattgttttcttaattcttgtgcccatgtctaaaacatccatatagtacagttcccgtgcgtgcagctattctgaagttaaaaaaaaatacaaatataactatccaaaacttaatagattgcacacgtaatattcaattaaccggctgtcaatatatacacatttcaatcaattgaacccttattgtttcccccttgaagggaaattgtattttattttatagtttcttgtatatcctgtctgtcctgatgaaatgtatatataacacttcattttttgttccatttaaatagctaatctaaatagtcattctttaccggaccaacagatttattgatgtctttatgactgattattctggtgcaagtttactgaattcagctctgaaccatcaaaatacaaaacttcgattaaaatcatatattatatatatggaggtgcctaagcgtctcttgttatgattctccctctagttacaatattgattgtttggacattgacatggcctataaaatgcaacttcgtccagtagcatctgttggtcaaatcctaggataccatggtattacggaaacacattttaagacaaatctacgtatatcatcttttataatcccagtatataaatgtccatataaataccgatagttgaaaatgtttgactgcatgcaatactaaaaagacacatgcctatgatcccttgccccttggcgcatgagtcatgacatcattctttttctctctcttttcattttcctaccctgtttagactttcatgtccaatgcgtttatgttttccttttccttctttacctcttcagattcagattcaagtagctcttctggaagcgatctggatgtcaatgttcctccatcaacaagtggggccaaggtgcttatctcaaaaatcttggggacagtgaatgtcttagaattttgggacatgagttgaatttctcaatggttcctctctttttcacatgcaggacaacacgcaatctgcggttaggttggatcaggaaaacggtatggtgcttaccctagtattccccccgtcccaaaatataattacctttagctatgtagctaaaggggctatattttgggacttgagggagtattttggagccgaacgcatacacttgatacagttgcacagtccatcctttaaaaattaacaccaataacctatttatgttattttgggctgaacaggcaaacgaaccgttattttctactatctcaagtgatcctaagtgctacatcactatgcatatatactggatccatgctggccaataaaatttgttgagaaaacatgtctgtctttagccaatttattcagacttgttttaacacaccaaatatcaaactgatgtggccagcttacatgctgggtacattattgtgacccaaacaagtctaactcctaaattcattttaactatcacatgtcaaacaattagaagtagtagttgatatagactgcatttcatgtgttctaatgttgggtgtagtcgggtaggacagtaatttaacctttcttatcccaccaaatatcacactttctgggaaatgatttatccagatatcattacacaggctgatcgttggatgtatgtgttacctttggtcaattcatttaaatatcttttgtaaaccatttgcactttgatgtaactgtcatagatattggagcatttataggaacagcgtgagattcagcaggccccatgtctgcttaactttttatgcatagttttctttgaacttctgcaattctagaatagctatttgtgtcttgtgtacttcaacgtcttcctcttatgattacagatccactgagctcgaccaatctaccacaacaaagtagtgatcctgtacctatttctgccgaagatgagggtaagcatggaatttcttaatggtctcattaaatacccaaagccttatatatatattcatctaaatatttcaggggagaatgtgtctgagaaacaggtcccccctgcaaagcaataccgagctgctgttttgttaaaccgctttgctgatacaatttttaaggctcgtgagaaaactcttgatcaggtatgcattggaaacttttgattgagagcactgttgcctgggcagctgatgacattgttagtaatcttcacatgatattattaatatcaggtcgcgaaaaaggatcctgagtgacttcaacccgacatggaggagcttgaaaggttacgaagagaaggtgagaaggaattgataacttttggctgataagccaagtacacttctgtgtattgaggcgcggtcttccttacagagagagctcggatacaagctgaggcaaaagcagctgaagatgctcgcaagagagctgaggcagcagcagctgctgaggctgctgcagaagctaaacgccaaagagaacgtgagagggaagcggctcgtaaagccttgcaacaggtaaatcatggatgagattctggccagaagcactatactctgttaacgtacatacttagtgtgaatgctattgaccctgcagatggagaaaactgtagacatcaatgaagggaacctctttttgaaagatcttgaaatgcttggaactgttacatcaggtgaacagtttcccagctcggttggtgagacgagtccaactcatacgcctgaaggccttggatttcagctaggtagcaaccctttagaacagcttggtttgtatatgaaaaatgatgatgaagaggatgaggaaggtgagtctgcagatgaaccaacgattgatgttgaggagggcgaaatagattgacatcttatagaccatttttggatacataaggaggtcaagcatgactggggcggatgcttctaacgtttcctgtctgcacagaaatttgtgaactgcactaattttgggagccaaatgataggttggcaaatgtgtgtgg

SEQ ID NO: 91702 - DNA, 630 bp, Oryza sativa
ctggtgcttccgcctgcacggctggcctttaggccgccgttgttgggcgtctacgtcttcaccgaccggcttgccttcgccgctgccgactggtgcttccgcctgcacggctggcctttatgccgccgttgttgggcgtctacgtcttcaccgaccggcttgccttcgccgctgccgactggtgcttccgcctgcacggctggcctttatgccgccgttgttgggcgtctacgtcttcaccgaccggcttgccttcgccgctgccgactggtgcttccgcctgcacggctggcctttatgccgccgttgttgggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtgtttccgcctgcacgctggcctattatgccaccgttgatgggcgtttacgtcttcaccgaccggcttgccttcgccgccgccgactggtgtctccgtctgcacggctggccataatgccgtcgttgtggggc

SEQ ID NO: 91703 - DNA, 717 bp, Oryza sativa
attcctgcagcccctacttcatatggtcagacattagtcatatttatcctttgaaacgttaagctgattgtcaggtgagccactagtgattctcaaccatcagtccagtgtggtttagaaattaggcaaaactggctacaccaatgtaacactaaggatccatgtcattactcaaaacacaccttaaagtcatgtgcatatgctactatgctaatggattgcaatggccaccagcaaacaaaactatgggcaaacagacctgatcttttagtgtgtatcggcaacaaaagagtatctgccagcagatatagctaattttgttttgtgattgggagttaacatgacaaccaagtacagtgctctatagacaattttttcaaaggattatgttccaaagatgttgtagatctgcaatgacctgatgtgttggatctactgttgtcttacgaaagatacttcatacttttatcaattctgatataagagctttgtcttgtagaatatgaatgagcatcctgatgcttggccattcaaagagccagtggattcacgtgatgttcctgactattatgacattatcaaagatcctattggtatgctggaatgatttaggggattattttcccttcttttcccagcttggcgaagctatgttttgtgccatctaagctattcagtttctgaacactaagcttgtctgcagatttgaagacaatg

SEQ ID NO: 91704 - DNA, 658 bp, Oryza sativa
gacatcctgcttgacagtttgacacacatcagaaattaggttggttcatgagaaacaaagactcagagtttagctggattacatacctgagatccaacctttccaggaagtgactgcaaagcctcctctccaaaacccggtgtccctctttttttttcagatgatagtgagatgatgccataagcttaattgatcagaactgtagaaatgtttcagcaaacttaccgataatttacaataagtaggttaaatccaagtgatgcgaggaacgccgatgttttcgaatagcttgatacagatactgagtgtgggccaccatgaaggactagaatagttggtttgtgcgaactgtccttgcaggacacaaagatagcttcaaatggaagcttactgcctgcaggatataaaaaacatttgcttggtgaatgatgataagccacatatgatagtctaaaatatttgtgtccatgactataccatcagagaggtcatcagaggggttagtgactggaatttttagtatgctgaattggtgatgtgacaacaaagcctttacctgcagcagatggtaatgtgagaatgaaaaaaaaaagcctgatttagtaaattacattgttcaaagcatcaaagaacacctaagtatacttcaaattgtaca

SEQ ID NO: 91705 - DNA, 1157 bp, Oryza sativa
aattaaatctctcatacctacgaacatggggctgtttggccaaggtaaatgtacctatagccaaaaagcggaaacttggaccaaaaactgttgattgtgtgtttcttggttatgctatccacagtgtgggttatagattcttaatagtaaactctggagtacccgacatgcatgttggtacaattcttgagtccagagatgctacattctttgagaatgaatttcctatgaaatatacacctagcacttctagtaaagaaactgtcatgccccatgagcactttgcaccgatagaacacaatgatcaaacgcctgaggaaaatcctgaggaggacaacattgtagatactcgcaagagtaagagacaaagggttgcaaaatcctttggagatgactacattgtatacctcgtggatgacaccccaagaaccatagaagaggcatattcatctcctgacgctgactactggaaggaagcagtatgcagtgaaatggactcgattatgtctaatggtacttgggaagtcgttgagcgtccatatgggtgcaagcccataggatgcaaatgggttttcaagaaaaagcttaggcctgatggtacaatcgaaaagtacaaggcaaggcttgtggccaagggttatacccaaaaggaaggcgaggacttcttcgacacatactcaccagttgctcgcttgaccacgattcgagtactacttgctctggcagcctctcatggtcttctcgtccatcagatggacgttaagacagctttcctaaacggagagctggaggaggagatctatatggatcaaccagacgggtatgtactagaaggtcaggagggaatggtgtgtaaactattgaaatccttgtatggcctcaagcaagcacctaagcaatggcatgagaagtttgacaccacgcttacatctgcaggctttgttgtgaacgaagctgacaaatgtgtatactatcgctatggtgggggagaaggggtgatcttgtgcttatatgtcgatgacatactgatctttgggaccagccttaatgtgattgaggaggtcaaagactatctgtccaagagttttgaaatgaaagaattgggagaggctgatgttattcttaacatcaaactacaaagaggagatgagggtggg

SEQ ID NO: 91706 - DNA, 908 bp, Oryza sativa
atgagagacggcgggagacggcggtgcaggagtgggaagaagcacggccgccagatccacgccgtcagtggggtgggggtgggagaggagggggcgggggagtcgctgctatgcacgtgggagctgagggagaggaagagagagagcggggaaggagaagaaaaagtggtgagaccagcttgaaaagaaaaggtgatgggcccactaaagctacgagtgcactgtagagaggggagtttcgactgcttttcttcctacgtggatatttgggctcctcaataagacaagccgcattgctattgccctatagcagcgatgcgatgctggttttactcagtgttatagacaacattctgttagagctagacgactcaaattatttttactttctaaggttacaatataaatatataaatatggtgtggtatgtgttgtgttcggttacaacatctccatccttcattttcttttagagcttcatctgtcaccaaagaatgataaaatttaagaaaaatttttatagtatctgagatgtaccaagaggtatcaattctcttagtataatttagtattccctctttattacttgatatatcaagaggtgtttaattttacaaaagaaaaattacgatacatcactgttagggaatatatataagcttattaatgggaaattatacggccgtgttacatggcgtctacgtcactacgtgtgtcgtcgtcgtcgtcaagcatcggcccaggtgatctgggcctcgccgtcgtccttgttgagccccagcgcgtcccacaccgccggcgacccgtcgacgatgttgttccggcacggcggctcgaacttgtggtcgctgtcgcagccgcgctgggagtcgcactcgtcgacgaccatgtctgtcacggacgcgccg

SEQ ID NO: 91707 - DNA, 652 bp, Oryza sativa
gtgctgccaggacggcgtccagtacatgacgtacgcctgctcgccgcccgtcgccgccggcggcaccggcaccgcggccctcctcacgctcaacagcttcgccgacggcggggacggcggcggcgcgccgtcctgcacggggaggttctacgacgacggccagctggtggtggcgctgtccacggggtggttcgacgggaggagccggtgcgagaaggacgtcgtcatccgggcgagcggcggcgcgtccgtgacggccatggtcgtcgacgagtgcgactcccagcgcggctgcgacagcgaccacaacttcgagccgccgtgccggaacaacatcgtcgacgggtcgccggcggtgtgggacgcgctggggctcaacaaggacgacggcgaggcccagatcacctggtccgatgcttgacgacgacgacgacacacgtagtgacgtagacgccatgtaacacggccgtataatttcccattaataagcttatatatattccctaacagtgatgtatcgtaatttttcttttgtaaaattaaacacctcttgatatatcaagtaataaagagggaatactaaattatactaagagaattgatacctcttggtacatctcagatactataaaaatttttcttaaattttatc

SEQ ID NO: 91708 - DNA, 741 bp, Oryza sativa
acggctttgaaatcgcttgcaccctgtcttgccttgctcgctttcccaaacgccggcttcaacttccacgaagagcggatcctccgaagctgcagcgtctacacgaccaacggaaaagaaaaggcttttactctaacaaactccatataaaaagcattaacaaagcacaaaaatgggttcttgacttcttaaggaaaaattagagacttgaacggtccaattctgagttcaaatggccaagttatagccatttgaagtttatatgctctttaaatgaatatttgcgaatttcttcatttaaattttaatttaaaatcggatttattgcgtcagccgaagggagaaggcgcgcggaccgggtccacgggagcggggcccacgcggcagcctcacggcccacggtggaccgggtgcacgcggctcacgccgaccggcgccgtgggccccaggcgtcagccgcaccccagggcgcgggcggctgacggccgaaccccacgtggcaaccgctcggtgcgccccggggggcggtcattgcggcgcggccggcgggaggccgcgcccgtgccccgatggtcaccgccggcgaccaccggcacggctgaacagcgaccgagagaggggagggaaagggggaaacgaaacgggggtccaccgctcaccccgagtcgaaagcgacgacgaaaactgcggccggagctgagaaagcggcggcccggcctcgggtcgaccgggtccacggcg

SEQ ID NO: 91709 - DNA, 706 bp, Oryza sativa
ctgccgaatctgcatacgacctccgttttcggcccgtgagtacttgatggaaagctcttggagtcctctttccaatggatccagcctcattgcgaaattccatcttattgagccgcaattgaagcaacaaggtgctgcgtcacctataatgggcctatgggcttgtaacttcgtctgggaccccggcccaggtggggcccatgtggggtgcgccccagccaggtggagcacgaccctaggcacccctaggtcgtcctcccacccctatttatatagttaggtaccccttcagggtttcttgggttttgttagattaaagtttagccattgctatttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcagcaacccgcggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcaagatctagtgggaaatcgagggaatcgatgatggggcgaaa

SEQ ID NO: 91710 - DNA, 2133 bp, Oryza sativa
ttgtaccacatcctacccgattgttttaagccataaagtgacttctacaacttaacacaatacatgttatgatttaccttctaattcgggatgtcgattccatcaggaaccttcatgtaaatatcaaaatcaagtgacccataaagatatgttgtcactacgtccatcaactgcataaatagacgattttgtactgccaatgatattaaatatcggaaagttataccactcataactggagagtatgtttcattggaatcaacgccaggtttttgcgtaaaaccttgtgctacaagccttgcttcatatctcaccacctcgttattttcattccgtttccggacgaaaacccatttgtatcccacaggaaagataccacgaggagtaggcattacagccgagaatacatctcttttgtaaagcgaggctaattctgcatcaattgtgtccttccatttgtgccagccagagtgcttttggcactcttttatagacctaggtcttccgaattcctagtcccagcattgtgcaccaccgagctaggttgcagactatcacgatctgcttgatatatagtatcaatttggtgtgtaccaactaaaggttggtttgcgtttaccgtctttctttgcttattacaattgtttctcgctgagtggccatacttcttcctctttttttagtgagtggaagttgagtggttttatttagtacctccactcattctggcgcattctgagcgggaatgaaagatttagtcacacctttataattggtaaatgcatctagcatgctatttgcaagtctttgcaaatgtataattttctgaactcgaagttcagtttcagtagtacgtgggtctgaggctggaataccctaggcatcccaatcaatttcctggcattctttctggtacttgaagtctccccctaatgccaggaaatgttcctcatcaaagatagagtcagcgaaccgggcagtaaatagatcgcatgttaagggttctaaatactttatgatcgacggagatttgaatcccacatagatccccactttcctgtgtgggcccatagcggtacgctgtggtggtgagatcggtatgtatatagtacaaccgaacttacgcaaatgggacatacttggaggatttccacgtactaactacattggagaagtttcatgatatgcagttggtcgtagttggacaaggtcagcagcgtgtagaactgcatgaccccaacacgacgaaggtaatttgcaattcatcaatactggtcgagcaataagcttaattattttgattaatgattcagccaaaccattttgtgtgtggacatatggagtgctgaacctgaattcccaatgccatacaataatcatcaaaagcatggaatgtaaattcggcagcattgtccatacagattgattgaatcctatgttcagggtaatttgccttcagccttataatttgagacattagtttggcaaagggatggtttcgtatcgatagaagacacatatgagacaatctagtagatgcgtcaatcaaaaccataaagtacctgaacggtccagatctgggcacaatagggccacagatatctccttgaatgtgttcaaggaatttaaatgattcggctctgattttgagataagatggtctcaaaatcagtttccagtagcacatgcagtgcatacgaaatcagaggatttgggaaatttgtcaatgatcaaatgatgaccaatagagttgcgaataatttttctcatcatcccgataccggggtgcccaagtcgatcatgccaagtgtggaatgaatcaacattttgaaaaattactttgtacgcaacatgtgcaatgggcttaatgtatgtatagtacaatcccaatgtgagagatggaattttctcacaaatgcgtttgccatatccgttttgtttggttaagagaagaaattcttctcgattatgcatatgggtttcaatgtgaagcccattttgacggatatctctataacttagtagggtacgggttgaatcaggatacaataaagcatcctcgattgtaatttgtgtacccattgggagtgtaatagttgctcgtcctgaaccaactatcacagtatcgcgccc

SEQ ID NO: 91711 - DNA, 549 bp, Oryza sativa
caggcggaaacaccagtcggcggcagcgaaggcaagccggtcggtgaagacgtagacgcccaacaacggcggcataataggccagccgtgcaggcggaaacaccagtcggcggcgggcgaggcggccggtcggtgaagacgtaaacgcccaacaacagcggcataataggccagccgtgcaggcggaaacaccagtcggcggcgggcgaggcggccggtcggtgaagacgtagacgcccaacaacggcggcataataggccagcgtgcaggtggaaacaccagtcggcggcagacgaggcggccggtcggtgaagacgtagacgcccaacaacggtggtataacaggccagccgtgcacgcggaaacaccagtcggcggcggacgaggcggccggtcggtgaagacgtagacgcccaacaacggcgacataataggccaaccgtgcaggcggaaacaccagtcggcggctgacgaggcggccggtcggtgaagacgtatacgcccaacaacggcggcataataggccagccgtgcatgcggaaacacca

SEQ ID NO: 91712 - DNA, 1371 bp, Oryza sativa
cggcctgcccgttagcttatgcataatatggtgaagaatttaataatttgatacccatgctatcggcaaactgaacaaactcatcagacacgaaaattgaaccttgatcggttgtaatagtttgaggaataccaaatcggtagattatatgctcttgaacaaactgtatcgcatccccagaatcaacattcttcaaaggaatcgcctctacccatttggtgaaataatctgtcgccaccaatataaacttatgccctttactcgatggtggatttatcatgccgatcatatcaattcccaaacctctgaatggccatggcttaatgataggattcatagccgacgccgatgctcgctgaattgctccaaatttctgacaatcttgacaccttttgtaatacctgaaacaatcttccagcattgtcggccaaaaataccctgcacgccgaagtaaccacttcatcttatgagccgattgatgagtaccacaaattccttcatgaacttcgccgattgcaactttggcttgattggcactcaaacacttaaggaatactctatcaatcatccgataataaagctcatcatccaataaagtgtacttcaacgccttatatcttaatttcctagaagccgattgagatggattttgtaaatattgatgcacatcatacctccaatcatcggctgtcattgctgcaatttcaaccttaacatctttgatcatcggcttataccccgacgccccttgggccaaatcattagcttcaatattttattctcgggatacatgctttaaagtaaccagccgaaattccttcatcaactcttggcacttctcattgtaaaccattaatgtatcatttttacactcatattctcctgccaattgactgattaccagcaaagaatccctaatgattgcaatagcatcggcttcaacctccttgagtaattgcaaccctttgaacactgcctcatactcagcttgattattagttgcataaggtttaatagtataagcaaactcgaaacatgccccctaggggaaattataactaagccgataccacaaccatgagtacacaccgatctatcaaagaataaagtccatggcacaatttcgaccgagccgattgaatcatcacgatgttccacaataaaatcggctatagcttgtcctttaatcgctttcggcgactcataccgaagatcaaactcagttaaagagaatattcactttccaacccttcctttcaaaattggagccgataacatgtatttgacaacattggccttgaatatgacagtacactcgttggatagtagataatgcctcaaccttatacttgaaaaatataagcacaagca

SEQ ID NO: 91713 - DNA, 4872 bp, Oryza sativa
tgtctatgttgcctcttgtggaatggtctctcaagaaatggtggcgaatatctatatgtttggttcgggaatgttggacgggattattggctatcttaatggcgctctcattgtcacataggagtgggattttggacacattgaggccatagtctctcaaggtttgcttcatccaaagaagttgagcacaacaactccccgccgaaacgtattccgcttcggcggtggatagggcgacggagtttttcttcttggaagaccaagaaacaagggacctaccaaagaattggcaagtacccgatatgcttttcctatccactttgcacccggcataatccgcatcggcataaccaatgagatcaaacctcgctcccttaggataccaaagaccaagattaggtgtgtgcactaaatatctaagaattctcttcacggccacaaggtgacactccttcggagcggcttgaaatcttgcacacatgcacacactaagcataatatcgggcctagatgcacaaaggtaaaggaatgagccaatgatggaacggtataccttttggtcgacgtctttaccttgctcgttgaggtcaaggtggccatttgatggcatgggagtgtggattggcttcgcattctccattccaaacttcttgagcatgtccttcaaatactttgtttggcaaatgaaagttccttccttgagttgcttgatttgaaggccgaggaagaacttcaattcagccatcatggacatctcaaaacgcttggtcatcatcctactaaactcttcactaaaagagttattagtagaaccaaatataatgtcatcgacatatatttggcacacaaaaatatcattttcatgtcttttagtaaaaagagttgaatcggctttcccgatctcaaaaccgtttttcacaagaaaattgcgaagacactcataccaagctctaggggcttgcttaagcccgtagagtgccttgtggagtttgtacacgtggttgggatattttggatcctcgaagcccggtggttgctccacgtataccaactcgttgataggcccgttgaggaaggcgcttttgacatccatttgatatagcttaaaattgaggttagtagcaaaagcaagcaatatgcgaattgactcaagtctagctaccggcgcaatagtttcaccgaaatctaatccttcgatttgggtgaacccttgagccactaacctctccttgttccttatcacaaccccggccttgtcttgcttgttgcgaaagatccactttgtgtcaatcacattttgctgaggtcgctccaccaaagtccacacttcattccgggtgaaattgttcaaccctcttgcatcgccatcacccaatccggatcattaagagcttcttccacccttagaggttcaagagaagacacaaacaagtaatgcttacaaaaatttgcaatacgagaacgagtggatactcccttgttgatgtctcctaagatgttgtcggtggggtgatctcgttggatactttggtggattcttgggtgagctagatttatcggagagggtggcacttgctcgccttcttcaccttgatccaagcttgaagtagagagatcgtcggcttgggtcgatgtaggtggctctacttgtgttgaggaagaggccccttgttgtggctccctaggacgtacgtctccaagagctgaccttttgattgcttcgctagggtcctcctcttcacctaacacatgtgagtcagccgttagtttcgtcaaatgtcacatcacgcgcgatctcaacaataccagaggttttgttgaaaacgcggtatgcgcactcatttgacccatacccaagcaagaacccctcatccactttaggagcaaactttgaggatctagccttcttattaagaatgtagcacttactaccgaaaacacgaacgtaagagacattaggtttgttaccggtaagaagctcatagggagtcttcttaagaaggcggtgaagatagagacggttgatggcgtgacatgcggtgttgacggcttcggcccaaaagcggtccgatgtcttgtattcgtccaacattgtcctcgccatctcgatgagagtccgattcttcctcttggctactccattttgttgaggtgagtatggagccgagaactcatgcttgatgccttcttcattaaggaaactctcgatgcacgtgttcttaaactccttgccgttgtcgcttcgaatgttcttgatctcgaggtcgaactcgttttgggctcttcttgcaaacttcttgaagatagcttgcgtctcactcttgtcatgcaagaaagaacacccacgtgaagcgtgaaaagtcatcaacaataacaagaccatatttgttacctccaatgcttagataagcaattggcccaaagaggtccatgtgaagaagctccaacggtcttgtagtagtcattacgttcttaaccgggtgatgtgctccaatttgtttcccggcttgacatgcactacacaccctatctttctcaaattgaacatttgttagtccaaggatgtgatcgtgctttagaagtttgtgaaaattcctcataccaacatgggctagcgtccgatgccaaagccatcccgtgttggacttagccactaagcatgtctcatgtttggctttagttgaggaaaaatccacaagataaagttttcccttgagaacacccttaaagactaccgaggaatcatcccttctaaatacggtcacatcaacatcggtaaaaagacaattgaatcccatggaacataattgagaaacggacaatagattgtaatttagagattttaccaagaggacgttggaatggaaaggtcatttgaaattgcaatcttacccaatccaattacctttccctttccatcgtccccgaagatgatgttctcttgagaagtggcatttggatcaagagatgaaaacattgattcttctccggtcatatgattagtgcaaccactatcaatcatccaacttcttccaccggagacatattcctacaagagatcaatttctagttttaggtacccatacttgcttgggtcctctcatgttagtaacaagtgccttaggcacccaaagcactctcttgatagaaatatttttgtcccttgggccaacatacttagcaacaacacgaccactagcattcttcctaagaacataagatgcatcaaaagaacaatgagaagcataatcattaggaatgatacatttggccttaacaaagttgctaagaccttggggcttcttgatcatcacactcttgtccacctttcctttaggtggaggaacatacccaagactttcatggttgaagttgtccctttgatagcctaggtactcctttaaggccttactacccatatggcacttaagtagaccattatgaaggagtcccataagcttctcattttgcttttgcaaagcactcaaagaagtagagttagtagcacaagtttcaatataaatatctttgcacctcacacatggttcattgcttgggacaattttggagcacgatgcctcgctagggagagagagactgttctttaaggtttcgaacttctcttcaagagagaggtaagctttgtccaagccatccactctcttcttgaagttgagcgttcgccacctcaagattagcatgagattctttggtttgcttgtaaagccgtaccaaagcctcatttttctctctctccttagcaagttcactcttgagttcatgagaccgctctttctcatgaatgagcaattcctcttgcctctcaagggttgcatattgattctcaattctcccaagcaactcactcaagtgtggtatggattccttggctatggatttgaacaactcgtcatccataacctcatcctcaacatcttcctcctcatcactaacaagatcaacattaaatgacttgaggggagagggtaccttaggctcctttgccatgaggcaaatgggagcatcctcatcacttgagtagttgaagagtctcggtggtgatgaaggcttgacggcgaacgtggcaactccttcttcatcacttgagcttgactcggagtcggagccgaagatcatcccaagatgagcttggccatagcaatcatgtttgctatgcttgtgcttctccttcttctcaagcttcttcttgtcttccttgaagtgggagcaatccttgatgtgggggcaatccgcaatgaagtgcccgggctctttgcacacatagcatacccttgcggagtgtcttccacttgacttgttggaggaatgcttggacgaacttcccttgaagaagccgctttgcttcatgaacttgccgaacttcccttgagagccatctcttcatcatcgatcttcgccttgctcttgctcttgtgactctcttcttcttcttccttcgccttcaatgccaagtcttccttcttgatgcttgtggttgaggtttggttgatatattggatgacctccttggactcttgctcgagcatgtcatgggcaaggatacgcccgagcaagtcatgaggtgtgagagtcttgtagtccggacgctcacgaatgatggtcaccaaggtagagttccttggagtgattgcccgaaccatcttcttgaccacaacctcatcggtcatgtccttggagccaagtcctttgatctcattaacgatcttgctcaatcgatcatacatgtcccttgggctctcaccatccaacatcacaaaccgctcaaattgccctttgagaatctccaccttggactcgcgaacactaaccatgccttcatgcaaattccgaagcgtgtcccaaatcactgcg

SEQ ID NO: 91714 - DNA, 1433 bp, Oryza sativa
ggcctcttagagtcatcaaatttgattttgcctccttcaatagccgcttggatctgctgcctgaagaccttgcaatcattagtcgtatgagacccagaattatgccacttgcaataccttttcttgcccaactcttcagccgatggaattgtgtgaccgacaggaagttgaatctgcttctctcggagtagcaagtcaaaaattttgtcagccttagtgatatcaaagtcatacctttcctctttccctgtgttctttacccattggcatggtataacctttttacttcttacccattcggctgcaactatctcagaatcatcatcttcatcgtctgacccatatatataaggacagacatgattaaccttcctggaattcttcctagcctctgcaaacctttgttcatgcaaggttaccttctgtgtaagatgggacaagctttcaaaatcctcagatgagaatttctccttaattggagcaatcataccctgaaaagccaaatcggctaactgggcatcagtcaagcttaagctgtagcacttattcctcatctctctgaatctctgaatatactcatgcataggctcatcatgtctttgcttgatcgatgtcagatcggacaatttcatctcatgaaccccactataaaaatagctgtgaaactgcttttctaaatcgacccaactgttaattgatccatatggcaaagaagaaaaccaagtgaaggccgatccagacaaagataaccggaacaacctaacctttaaggcatctacagccgatgcttcaccacactaggcaaaaaatcggctactgtgctcataagtcgatgtactatcttgccctgaaaattttgaaaagtcaggcaccttaaaccgattgggtagaggaaccctctcaaaccattcaggatagggttgtcggtacaaatttccagcatctttcggcctaagcccaaactgctccttcatgacatctgcaatcaaatcggcccatggtcgttgttgaggtgttccttgaggttgctgtggcataggctcgaattggttgtattgaggaacaaattggggttgagccgatcctgcctactggtactgaacttagggtgatggcggctgatactgatagtttaaattgcccccccctggtaattttgaagatccggctgaatattgcgcaccaaatgttcaggaataacttgagggatcactatgccatctggttgtacgtgatgaaccaagtgctctggaacaacttgatttgcagcatgctgcacaggctgaccaccaggtgttgcaaacccaaccgatgtattcattgaaccttgctactgaatcggctgaacaacctgctgccttaatggcgtttgctgaatcggctgcaagacctgtcgtcctggtggcgtctgctgaactggttgcacaaactgt

SEQ ID NO: 91715 - DNA, 731 bp, Oryza sativa
gcataataggcccagccgtgcaggcggaaacaccagtcggcggcgggcgaggcggccggtcggtgaagacgtaaacgcccaacaacagcggcataataggccagccgtgcaggcggaaacaccagtcggcggcgggcgaggcggccggtcggtgaagacgtagacgcccaacaacggcggcataataggccagcgtgcaggtggaaacaccagtcggcggcagacgaggcggccggtcggtgaagacgtagacgcccaacaacggtggtataacaggccagccgtgcacgcggaaacaccagtcggcggcggacgaggcggccggtcggtgaagacgtagacgcccaacaacggcgacataataggccaaccgtgcaggcggaaacaccagtcggcggctgacgaggcggccggtcggtgaagacgtagacgcccaacaacggcggcataataggccagccgtgcaggcggaaacaccagtccgtggcagcgaaggcaagccggtcggtgaagacgtagacgcccaacaacggcggcataataggccagccgtgcaggcggaaacaccagtcggcggctgacgaggcggccggtcggtgaagacgtagacgcccaacaacggcggcataataggccagcgtgcaggtggaaacaccagtcggcggcagacgaggcggccggtcggtgaagacgtagacgcccaacaacggtggtataacaggccagccgtg

SEQ ID NO: 91716 - DNA, 1974 bp, Oryza sativa
acatgtgctagagcttcagatcatgtatccatgaacagtaccaatgaattgcacagagcttctctatccaaaatttctacgctataaggaatttcttgtttccttagtgcaagtccaaatcttaacctagacaacttcataattaaacaccacgctgtatggataactcttgttataatggatagatagaatgaaagaatgtgaactacacaagttcacgataccctctcaataataatttatcaactgacctgatctggcttcttagcagcaagtagtgcattggtcagaccacgtaaaacttcaaaatcgatattctctgacgcctgcttcatgaagtgttagcattagaaaaccagtatgataaactagaatatatacaacatagaagtgcatttcaattttcttacagataaagattttctgtatgatgaagaactcccatcataatccttgagttcaaactttacttcacccaacaaacggtatgcttcaactttgtcagggatcacctatatcaaaataaattgtgtttcaaccatataataagtgcataagcaagacaaactctaaatgacaaatacaatgggcaccaagaatagcatgcagcttaccttaacaagcttctctaggaattctgaagccttctgatattcaccaagttcaaccaatgatactgccgcaccctgtgatgccatatgaaaattacattggtatttaaaagcgcagtagtagtcaaagtcaagcaatcagtaattagtgttgaagtattcagttacattttgtgattcccaaaaagattgattgcttttggcttggaatggaagtggatgatgtatcattgttggattcatttaagaaggtgataatcaaggtaccagtttaagtggtaaactcaatgtgcacttttccctcttttttggtctgttcaaatcttctcacattaaatcaaagaataatcttgctatatgcatgactaggtctagattgtgagccacttttaccatatacatgacttagattgtaatcatctctacatttgttctactttgtggaaactagattaaatcattcatgtgacttcattgatgaaaaagaatggtaatgcctgacaatacttttagaactggcccaaacaaatcaatctacagcaaccagataatacagctaacatctccaagtagataggatcatatctcaaaatatgcctagataagatatgctactaaaagataagatatcatcggcatctaatgttctaatcaggtgttacagtgcctacttactgtttgtgaacatgaacagtaaaccctgcatgtgacaacataaaagaatattcttatcgtgcaagtttacatcaggttgatatacagggcaatttggttacatatgccagactttgccatagttttgtcaaaaaaagtgtgtcgcatgccatttgtggcaatatttggaaagaaactatctccatcttgtggccttatgaggtatggttttaagaaagtgttccatgccacaagttcagcaaagaactaaacattagattaacaatgtcaaacatttttaactcatgtagactagcttgtagcacgaacaaaagcccctaatcatgatagaatgatacccatttatgaaatttgtacattattacaagctcatttcaacatcagcctatgcaccagataatgtaaactacagcattattataatatcatatgtcaacaaaatgcagattgagaaaagaaatttattggggaaaaaacagtattaagacaaccagaagtacgttggaaataataactcacctcaagagcagtaggatcattaggtgatgtccgcagtgttgcttcaaaaccttctagtgctgtctaatcaaaagaattggcaatctcttaatataacaacaaactgtcaaacaagaataaaaaattatatgtcaaacatatgaaactaatctcccacagatatactaga

SEQ ID NO: 91717 - DNA, 12183 bp, Oryza sativa
  unsure (1)..(12183): unsure at all n locations
gagcagaaaaaatgaattaatggaacgctggagtttagtgtcacaattgctctagttgactcgacacggtaataggtatcctcgcacaaggtgttctcaagtggttgacaagaaattgatcccaatctcagagattcctcccgcattatttgcccacttgcgagaaacttctctgcattagtttgagcttccacatcccccctgatgcagaaacgtgtataatgcacagtaataaaatgcaaaataggtcaagtaacgatgacaacaaaaggaggttatcgtgtcatctaaaatcagaaagatgacggataaatccacagcaagtgcctacaatagtcataggatctgaccaggtccaccatccaagagaattttggcagttccatactaaaaattcaaacaattatttcagttgaaacttattaccaggatgatacaccagttacctctggttctggaaaataccatcaggaaccataagtcaattttataataaaaaaaagctttataaactgctattactccctagtataatccagcttggatttaagagtcaacgttaatatttagtgccactatggatgatttgattcactacaaaaaccaactgatgaaatgggaaaagcaatcactaatataggtaaccactaacaatttcctggcactaaccagggattcttttttttatccagtgcatgcaactcttttgatgaaatgtgaaaacagtgaacagagtccatggaagacacaaacaattcactaaagatggaacagttaacaaatttgcacagagaacaaacaaagcaacaaaattgaaaacgtgccttccgacaagtaaaagatagtcagagttttccatcctagctcgaccacgggactgtataaagctgcatactgttgctgatggatcaaagcgaattaccaagttacaacttggcacatctaaaccctcctccaaaatttgtgtggcaataattatatgtacctgcataaccatcattctctcatcagagaactatcatactatgacttaacagaatgcctatagcatacttaacagaatgcctatagcataaaatacaagtaccaatatcgaacctttccttttcgaaaagattcaacaatttctgtatgatttttcctgctctgagatagcaaaccaggacggcttcctgccatgtgcttaacattccacccagacatttgatgaatagatgaaagtaggtgctctaatactatgcttgtgataactctctcaacaaacacaatgcatcttaagtcttgcatatgcctgagagagagagagagagagagagagagagagagaaagagaggtgttacttattgaatgatcaaaagaacaaaaagttttagtacaagaaagtagaagcataagcatctcttacaatcaccaagttacttattgaatgtcgttttgcccgcgcggtttggtctttaatccagtttgcttcgaatattagtttacctaatagtacaactcatatgtttgggcattggataagaagacaaccacacaatttgagatctttggtcttattaggggcaactaccactatttggtctatttggctttgcagaaatgatgtggtttttgaaaggaaaaacatatcttcccctttgcaggttatcttttttattacacattggctctgctcatgggctatccttcagaaggtcaatttgcggggtactatcattgcggcttgtcaacacttggagctagtggccatggagttttctaccccggcgcatgggtggcgttctaggctacggttagagggctcctgaagttctttttgtccctgctattttggatgatgagtttatcttttgtttctttcttgttggctgtgtgcactctttgggtgcagaagccagaggtgctctcagaataattgtatcacttgatagaatttactgagattaataaagcttccattatctaaaaaaaaaactttagaacacatttttcacactggctggtatgtgattatctattccatggaacttacttacacttcaatatccatctaagaactaacctataaaagccagtaatagggaatggaagtagaaggtgaaattcaagaaaaaactgtatgcagcaggaaaataatagtggtactggaatgtatcatttctgtactacttatatgagttggtggtgatgggttgtgctctacacccccaatccttcaatcaacctttggtgaaacaatcagcatagacgtgtgtcattttactcatttgtacttctattgaaccaatatatagatgatttaattatgttcatatgtatgtggttgtcagttgatccaagttaaatattttaaatgtggggatttttttttggcatttgagtaagccaacttatgcgtgtttatctgagatttgttacaagagatgggcaaatatgctagttctcccagaaaaaataaacttttttttcttgggaactcttctttatttttttattcagattttcaaatgtaatccatggggcatgtacaaaaggcacatgcatattgtagaagctaatggctctttctctgtactggtcatccatgatttttcctattttctgattatgtaaaaccatgcatatcacttgatattaactcacagcagacaaaattcaaaagttgattaaaaaagaatgaaagaatacaccactatcgtccaccctatacagaacctttggtaccatttagtcgatgcagtctcaaagggagagaatgagaaatattaccaatactactataagaatagccaaatgaatgcaatctcaaaggatgtggctgtgaaatattatcaaaagaaaatatcagaagagtattttagcacctgtactgcagaagagttcgaataaggcaatgaactttgggtgtcaatatcccatcttgagaatcagctggaaatttttcaccaatatgacctgaaaaaaaaaagcaaagaatgaaataaacatggtatgacctataaattggaatttcggcaagtggatgccatctatggtttaatattcagttagtatcgcatgtatcataagtgaaattatgttaaaaatatcatagtattcataagtgaaattataaacatttttctagtatccagatagcaattcatgcagacaacagactagacaacattttatttggtaattgagaattccagaaagcaaatgctgtcatgcaggtaaccaagaaaagaacataaaaagcgcaacatgctagagaaggtatgtttgtaaaagccagagctgagtagtatgtaccattcttcaagaaacatgaaagttctctatgtacttcttcgctgtagtttctaatgaagccctcaacatttttatccaatgtttcaccccagaaggataggctgttttcctcgtatgattgtacctcacagcctgaaaatacaatgttaaagataaattgggattccagaaagtactataaatgtgcagtgaaatctttattcatacctttgctgccagccatactcctagattatataaacaatatacaaatgtatgatgcaattttgatatcctttgcttagcgttttccagagatgaaccatgtagttttctgtccagagcttctatatgctaagagaatgaaacaaaattgcattggtatctggtaacatatatacacaggatttgttaaaagaagttacttaaagcattacaaaaagaatgtcaatgcatctcaataaaaaaaaacctcctgcttaaaatattgaatgtcatattcagcccaagcacaagaagccatgaataacaggtccatggcatgcaatactaaaggtctggcacatgctctaactaaaaaaagaagtctaacaacaggcttaacagtctctgagactgataaatcatcactaaaaactgtctttttgacctaaaccgcattttagaattcacatacttctgtagaacactggctgtgctactgtaataaaccctaactttttattcttcatttatattctgaaagatgccattgataggtcccacgttttggcatgcaggggatatcatttggctatctgggcctgtttggcagagcttcagagcatcctggctataaaattgttagaggtcaagctagcggtagactggggtgttggtgcgccatcctgtttacatttcagcatagaccaatttattttagcctaagaactccatatttacaaaaatacaagagttggagctcaatccagctcagcatattatgcttcaaaattcttgaagctggaacctaaaagtaggtagacaggagtgtttaggtgagtcatcttctttacattttggactaaaagtaggtacttaaaccactttgttttagcctacaaaactatattctgcaacaacataggagttgggagctctccagaatagacccttactaggcttcctctcatttcacatttattctaagtttctaacacttctccccaactcaatctctgttcccttctgtaggcatgccgaaagtgccaacctctcccttgtatcttaccccaaattggccgccatgcctagtcttaccactcaacttcatgcagtacagtaagcaacttgtcggcaagcaacatgtaactgaacaatagaaagcactgtttaccaaaagggcaaacaaaatgtagaagaatgatagtacctttttattcaatctattcaaacaactgagaatattggcatgcagctcagatgaaatgttggaatcgtcaaagtccactatttttgtagaagcaaatggtatgtactccgacaaagctgattcactatcaacagtgtacaccttgaacaacaaatgcatcaatgcttatttcccaaagacacatacaggtaactaaattaggaagaatgattatcgtaactgcagggatcacgtaattaactgaaaattacatggcctgaccttggaattcatgagattctcaatctcagaaatttgctttgaataattgtgcggattcaaatctatagaaggaacagtgtgacagattagatgatcagagagcctgtgcataaaacataagggatgatcgtttcgcccttaccttttgaataaatgagcgaagcagacatcccaaatatccttggcagagggtctgacgcactagaattcaactgggggtgataaaattcctgcaagcgtcgaatgatttgtctaaattggtgatacagatcagcaggggaagggagacatcaaagattctgactgaaatagtaaatgtggcaaaaccaacgctgcatgttccaattatattggcactagtatgtaagttagagcataggtgttcctatgttgatgagacgaaaatggaaaatgagagctactccactactaaccccacccgatcaataaatgtgaagggaaaatacgaaagggcgcaatacggcggcgggtgtaaacttttgtaccttgaaaatgcaggcgtacggcgtattgcccctggcgtggtgacactcgtcgaagatgagcagcgcgatgtcctggaggcggaagaagctgtggcggaggttgtcgagcaggatctgcggcgtcatgacgagcacctcgccgtcctccagttgggatcgccaggtggcggcgtcccagaagtcgacccccatctcgccgcagaactgcttgacgacgaggtcggtgtgctgctagacgacgcgcgcctgctggcccacgaggacgacggtggggaccaggaagacggcgaagcggggcgagttcgggctccgcacgcggtgcgcgtacgcccggagcagcatcaccgcgatgagcgccttcccgctcccggtctccaggaacgccagggtgttcccccgcaccggccgctcctgcgccttcagctggtacctgcacgccacgcgcaatcacaaacccccaccaccaccattagcatccaaaggggaggggaggacggcgaatcgcgatccgtcaggcgcgcactggacaccccccgggcctcaccatctggccattgtcttcgggtcgggcggcggcggaggccggagcggttccaccgccttggcgcccccatctcctcgacctccggcggcggtgagggggccacccatggcgacngcggcggcggcggaggaggaggaggggtttgggggaggaatcgggggaggcggcgggatgggggtgggagaattnggtggnnccnncncttggggcggcttcgtcttcggcttctttggtgcccgcaccgttcccaaccgaattcttacaatcgcgcgcgcgtgtgttgggctcgaacaatgacgagagataaatgatcttatgggggggaagcgggaggaggagggatgggaccaattggtagtgggaggcttcggggcgaaggattcgcccccgccggttcgttcgagtgcgccttttgagttgacgaggacccgaggagaggcgaccgggaccgcgggggaatgggcgcggccgtttggcgtcagatggaggggagggaatcacaggtggggtactgggggtatgtggaaggtcggggggcggtgacgtccttttgggttttggcttttgcaatggattaaatattttttagatgtcatgtcacatgtcacatcggatatttgatacgaattaaaataattaaacgtagactattgataaaacacattttataactctggattaattcgcgagatgaatcttttgaatctaattaatcattgattagcctatgtgatgctatagtaacaatgtgctaattgtggattaattaggcttaaaaaattgtcacgtgaattagctctcatttatgtaattagttctgtacgtagtctgtgtttaatactctaaattagtgtccaaacatctaatgtgacagggactaaagtttaaagtctagtccctggattcaaacaccccctcattgcaggtaataaaatctcgacaattccatgtgcattgctctttcaataaaaaagttcaatgctggtttgttttctaggatttgggttccttaggccatcaccaatgcgtactctcaagtgtgtccctgctcacagccgtcgccagtccatcagtttgccgtccctagcagaggggcgcgtcttcctccgctcctcagtcgcttttcgtcgagccacggagctaggggacacgttgggcgacgtcgtggcttgaggacacggctcccgcacctgatttttctccttccacccttggcctcttcgctgagaggcccatgtgttgataaaaaaacacacactggcctgggaggtctgcttaactccagtgcaggtcctaaatcttgctttcgggtttcgctgggaggagacagagttggcgacgacgaccggcgatgaccctgtgacggagacggctcggcgaccccgcgcgctgctgccctccgccaccgcgcccgtccccgcgccgcttgtcgtccgccaccgcggctggtgagagagaaggagaaaggtgacgatgagtggcgcaagagagagaggagagaggcgacggcgacgaccagatccgaccaccgtgcgctgcggcagccggcgaggacggagggcttcctcgtgcagcggtggcgaccagatctggcgcaggctgtcggcgcagtggctggggatggcgaggagggaggcgacgtcggtggcttgggaggtgacggcggtggctggggaaggcgaggagggaggcggcagtgagcggcgtgggagaaaatggcgagcgggcaagagagaggggagattggcgatgcgcgcgagagagaggagaagcgtcggtggggaaaaaaagtcatcggtgggctatggagagaggagggtagtataggaaaatacccaccgtgggctttttggttgggacacccattgtgagcttgagtgccttcacccagttatcttatattttgaggagcccatccaggggtatctctcattgtgagctgagtttctctacgagtgtcctcaattagtgaggacactctaggaatagctcacattgtagatacccttacagtaatatgttgtgtccaactcatacgacttctcattatctgtgttcgttccggtgacattgagggagaaaacccatcgttttccacgcgcacgcttctaaatatccaaaaattatgtcacatcaaatatttggacatatgcatggagcattaaatgtggaaaaaaaatccaatttcacagtttgcatgtaaaatgcgagacaaatcttttgagcctaattataccatgatttggtaacgtggtgctacagtaaacatttgctaatgacggattaattaggctattcatctcgcagtttactggcggaatttgtaatttgatttgttattagactacgtttaatacttcaaatgtgtatccgtatacgtcaaagtttttaaacctaaacaattaaacacggccaaagtgtcaaactttactagaagcagctgtgcagtggctatggtagaaattatatgttgctactgtagctactaactgccatctagtcataccgaacacgaatcacgtgtacactttttaaccgttaaaagataaatatattttatagaaatatactaagactagttgggtgcccgtgcgttgcaacgggaaaatatgtatcatttgaaacatacaatctatgccatatagaaatatgcacaaatcaatgaggaatcatttccttgatctgaacaaaacgaaattgtaatgaatctgattcatttgccaagttattatgctatatattaagaagtaaaacttgtagatcttcgaattcagcaaagaggaatatggacatgtgcacccacgtcaattctatgctttttttatataaacatggtttaatcacattccgtagcacacaaagaaaaatagtatgcatgcatatcaaaaggatcgtgtgaaaaatgagaaaaggagaggctacagaacatgggtactaacaattaactgatgaagcatgaatttgtgatattttcaaaccatgccaaaatgttaccatgcatttcttcaatcaccaaatccgcatacagagctagaatgagcatctctgaacaaatataattttcatcaaggaaattcgagttcaacaatcagataattctaattacaaactaagagagataacaaagaatgatttctatatcagtctatctttctggtcaatggtagcccgacacattagtgtctcaaacacgataaaatgcccaaacatagataaaataatgaaaacaaatccatttagttgttctcatgcccaaggtgcatgcaaagttttatatgggcatggtatcttaaataaagtttttaaggggttattgaccaaatggaaggactactgaacaaaaggacaatattaggtacctcaaatgatgtgtaccgtcagaacatttaaaacaaacttgcatggattcaaaaccttaagctgcttttcatctggcaaaataactggaatattcataaatgaacagcaacaaactgaatttcacgatcttagaggacacaaataattgaaggtgtaaagtattcagttaaaaatatattgtgctgaaaggttgaagccttcttttttcagagcaatacatgcttaaaacatgacaattcaagagcaaatgacatccgatgactttggttctaatttaagcagttactgattctgtttgaataagctgaacaatctactacagactctggtgcataaatcatgtaaatgtgcacgtgaaacccacgtcaataataagataaaacagagaataagcacataatattttcacgtctctaataagatgaaacagaaaataagctcctatacaacaatttaataattccacgtctctaataagataaaacagataataagctcccatacaataatttaatgaccatacaatactttgtatagataatctttccgatagaaagagcactgctacagaccaaaggatgaactgccccaaacgggcatagcatgagtacagcagacccattacatataacgttaaataaaaaatacataaatgaccgtcttcctattttactgccaaatgatgccttagaaggctcatagatggaggaagggttatataggcctcagtcctcagaagtacctttccatgaacccgagttaaatacaatagaggtgaccaacatcagttaaaagaaacacatgtagtagagagaataaactttatgcaatgtaaattatgaactaatgctcacggaatcagtgtcagctaaaaaaatgtgtggttatgtattaatgtgatctaaattagagttcgtaagtactgcagcctattctctgcaacgttaaatggatacggaaattgatggggcaaggcaaaccggcaaagtgttctctcgtactgcattccagataatcaaatgtgcagtaaacaatagtttacagcgatatgcaataatattaacaaccttccttttctatactcattaagcttaattgaaggaaatgattctgccaagatgcattgatagcagtaagatgactgcattggtaaggaagataatatacaggtaaagaaactaaccgtgtgagcatagatgatgcaatttactccatgactgaatcagggattagtgtattttctgctcgcatattgactaaatttcattgagtggaggtcttctctcacatttatagaattaaggtgtggtttatcatcatgaattcaggtgtggtttatcaccatgaattcccatcagcaattgcgctgatcatcagaacttaacatgagacacttaccatgaggaagtatatatataatcacatccaaaattttatgtctaatgtgagcacctagccagtaaaacaactaccaggatcatgaccaaacagtatgttaataccataggagaagtcgttatagtgatgagtgtgcaccacatgtaaatgcggcatcacagataaataaattgacagacacaacatagatcaacgatatttccattgcatgttaaaaaattgatatcgcagaaattaatcaagtaaaaacaggacaaacagaagaaactggtcttactttcacagtagggaagagtacccgggtgatgaaggaacctgacgtcctgaagaagagtgagcttgtgtccagtggtaagatttcacttcagatctacgccgtttgtgagataataatttaaataccatgggtaggtacaggatcaatactcttttttcgctggtagtactctcgcatcttttgaagcctagcttccttgtcgccagcactaagagcagcataccgctccctagcacgcttccgcgtaaattaaatcggagttaaattagtgatgccgccaagtgtacctgcagaaacttgtacagaaatcatttcacaacatagcaacagtacgaagcagcgagacgaaaagggagaaaacagataatgtccacaaatcagatacacattgtagatataccttcaacaggaaactgtttcttttacttaaaacgaaattgtctaacaggaaactgtttcttttacttaaaacgaaattgtctaagtgatactttcacatacattttgattacagctcgaacaaagcagtacagtgctaaaatcactttgaaaagtgaattggtttctggacatttgctcaacatatttatgaactttagttgatttgtaacttttctagatgggggatgtctagcaatcgaatgccatataagaaattttgtttaccttttgtagatgggaatgtccctcagtgatggaggggagacgggcgagtactgcatccacctgccgacagcatccagcgacgaccggaggactggcggccagcttccggtgcggcgcgaaagggaccgtggtggagatcgacggagaggagcggatccagtcgcgagatgtggcgtaggcgacggacttttggcgtggacgtgggctgcgcacggggaagcggagtcgacgacgaaggccgccgcgggatgggggtggtggtctagtgggaggccgggatgtggggggttgatgcagccggcctgcggaggtgaggtcgatgatgaatccggcttgtagacctgggaggtcgtgggcttgtggggcgtggattccacggtgatttggggacgtgggatcggcgatgggagaggagcgaggcggcgcggtggttgggcggggtggggaagtggcgtggtgaggacttccggcggcagggatcggtcg

SEQ ID NO: 91718 - DNA, 575 bp, Oryza sativa
tgaatggaccgctgaggagaagcggaaagatcgtaaggctctatcgctgatccaacttcatctatctaatgatattttgcaagaagtgttgcaggaaaagattgctgcagaactttggctcaaactggaatcgatctgcatgtctaaagatctaaccagtaagatgcatatcaagatgaagttgttctcgcacaagttgtaggagagtggttctgtgttgaaccacatatcggtcttcaaggagatcgttgccgacctagtgtcgatagaggtacagtttgatgatgaagatttaggtcttttactgttatactcactgcctagttcatatgcaaattttcgtgacaccatacttttaagccgtgatgaactaaccctagcggaagtttatgaggcgctccaaaacagggaaaagatgaaagatatggttcagtctgatgcgtcgtcctctaagggcgaagcattgcaggtcagaggcagatttgagcagaaaacctacaacgacagcaatgatcgtgacaagagccagagtagaggccgttccaagtccagaggtaaaaagttctgtaagtatt

SEQ ID NO: 91719 - DNA, 748 bp, Oryza sativa
gccggttccaagcaagtacttgcttcaaccttgctgggatctacttcgacaccattggaggaaatcacgtgtccaagaaatgctactcggtctaaccagaattcgcatttcgagaattttgcgaatagttgatgatccctaagattttccattatcaacctcaggtgttcagcatgttcttcctcgttcttggagtatatcaggatgtcatcgatgaataccacaacaaactggtccaggtattccatgaagattttgttcattaagttcatgaagaatgctggagcattggtgagtccgaaggacattactgtgaactcatatagaccataacgcgttgagaaagcggtctttgggatatcttcagatctgattttcagttggtggtaacctgacctcaagtcaatttttgagaaaactcttgctcctttaagttgatcgaataaatcgtcgatccgtggcaacgggtacttgttctttatagttacttcattcagggctctatagtcgattaccattctctcagagccttcctttttcttaaccagaagcactggggctccccaaggggatgagctaggtcgtacataacctttactttccagctcttcgatttgtcttttaacttctgctaactcattagctgccattcggtagggtctttttgcaattggtgcggtgcctggtgccagttctatggcgaactcaatctctcggtctagtggcattcttgttaattcttccggaa

SEQ ID NO: 91720 - DNA, 554 bp, Oryza sativa
atactccggttcaggtggagttgtaaaggtatcgaaaggttctctcgtttatatgattggtgatatgaattctgtaaacttatatgtccttagaggaagtacattacatggttctgttaccgctgctgctgtttctaaagatgaacctagtaagactaacctgtggcatatgcgtcttggacatatgagtgaacgtggtatagcagaattgatgaagaggaacctgttggatggctgcactcagggtaacatgaagttctgtgagcactgtgtttttggtaagcacaagagggtaaaattcaatacctcagttcatcgcactaaaggtatacttgattatgtacatgctgatttgtgggggccttctcgtaagccctctcttggtggtgctcgttatatgcttaccattattgatgattactctagaaaagtgtggccttatttcctgaaacataaagatgatacatttgctgcttttaaagagtggaaagtcatgatagaaaggcaaactgaaaggaggtaaaagtacttcgcactgacaatggtggtgaatt

SEQ ID NO: 91721 - DNA, 617 bp, Oryza sativa
aggatcggccccgccgaaaggtgcagcggcccgtctacttcgttagtgaggccctccgggacgccaagacccgataccctcaggcccagaagatgctttacgctattctgatggcttcgaggaagttgcgccattatttccaggcgcatcgggtcacagtggttacgtcttaccccctcggtcaaatcttgcataaccgagagggtactggacgggtggtgaaatgggcaatcgaactttctgagttcgatttgcactttgaaccacgccacgcgatcaagagccaggccctcgccgattttgtggcagagtggaccccagctcccgagcccgtctcgatccccgagccagcacggacccctcgcagctgcctcacaccgcctactgggtgatgcagttcgacggctccctgtctcttcagggtgccggtgcgggggtcacgttgacctctccgagcggagacgtcctcagatacttggtccgcctcgactttcgagcgaccaataatatggcagaatacgagggactccttgccggactaagagtggcagctggactggggatccaccgcctcctggtgttaggcgactcccagctggtcgttaaccaagtctgta

SEQ ID NO: 91722 - DNA, 619 bp, Oryza sativa
tatagggcgaattcgagctcggtacccgtcatagattggctggatctacggttcagtcacagaggatatcctgactgggtttaagatgcactgccgtggctggcgatccatctactgcatgccgataagacccgcgttcaagggatcagcgccaatcaacctttctgatcgtctccaccaggttctccggtgggctctcggttccgttgagatcttcctcagccggcactgcccactctggtacggctacggtggtggtcgtctgaaatggctccagagattgtcctacatcaacaccatcgtctacccgttcacctctcttcctcttattgcatactgttgcctgcccgccatttgcctgctcacaggcaaattcatcattcccacggtaagatgcctgtctctatacatgtttttggtttgagttctgatgttgaacattgcttagtgacattattcatttgtcgttcttaatttcagctctccaacgctgcaaccatatggtttcttggcctcttcatctccatcatcgtgacgagcgtcctggagctgcggtggagtggcatcggcatcgaggactggtggcgcaacgagcagttctgggtcatcggtggcgtct

SEQ ID NO: 91723 - DNA, 649 bp, Oryza sativa
atggatggatcagcaggcagggaggccaggccgagcaggcccaagacaagacgacggcccacggcattggcaccatgcgcgggcaagcgcgggagatcgcgcgaggcacgcgcgcgcagtggacacgcggcggcaaggaattcggcgcgtgcgggcgtggggtccacgctgtttcaagtggctcggaggcgggagttgtactgggacccacgcgcgatttcgcgagcatgcgcgggagcagctcggcgggacgcgtggaggctttggactggatgcgcgcaggtgagcgtgggatccacgcggtggagcgcgcgctctcgcatgctgaggcgtgacgtggcggctcgtcactggtttggagagggagcacgcggatcagtgcggcgtggagagtttggatcaacgacgtggcaagcatccaggaggcttccttcggttctaaggaagaatgggtggaccagatccattctgagttagggtttcgccctaggggtatttgagacaatgtcttatgggtcttagcctataaatagagagatggatgcaagggtggaggttgcttctttggaatccttttgagatgctcggtgagagagtttcagtttgagtttggagtgtgtttgcccgagaggctttcggggctgcagga

SEQ ID NO: 91724 - DNA, 547 bp, Oryza sativa
cacgacgcaggcgcgctcttgcagcgccatggcgcgcgcctcaagggcctcttcacgctggcgggacgccgattcggtctccgacgcccgctgttctcgggcagcagcagcatcaagcaccccctgggcggcggcgagcttcttacttagctccgcctcccagctcccatattgaaggcggagggtgtcctgcgcctcgttcatcacggaggtggcaatgagggcagccccccgctcctccttcactttcttggagatctccgccagcaccttcttacgggtttcaagctccgagacgtgccggcggtgagccttacagcccacctgcaccatggactgcaccgagcgtcgaccctcttcgacacgcgcccacacggtgtcgagctacggccgctctgactgcaagacctccacctgggcgcttaacccatccaacaccgtggtgtttgcggcagccaaggcctgcagaaggggctctgcgttcaatggggcgatagaaggcgtggggcaaagccgccttggaaaggatgccacgcgggtcgggccg

SEQ ID NO: 91725 - DNA, 720 bp, Oryza sativa
agggcgaattcgagctcggtacccaacacaggagatgagtctgctgttcgagctgctattgaagagttctcaactgatgttcaacctgatgaagatagtattttaaacaagttaagaactgatgtccttttccaaatgtaacttgctgcgcatgcatttattattctattattgaaataaattgacactggaatgacaatcttacttcgataggctcccaactatcaacaaatgtttctctgctgagactatcgaggacatcataaaagcttttgtaaggattctttcaattacttgcttgaaaagtgttgagttcctcagactatagaatattcatcttggtttcatgctacaaaataatctaaacaacaataagtggacagtattcatcttatgcccaaaatatatcatcgtcaaccaatagcttctggaaaaactagacacagttacacgcaacaatggtacatcatccggcagcaagtacttaccgtgcaggtggaactcgagcgtcttgttggggacgtactcgtagacgagaaggcgctgctcgccgtagatgcagtagccgacgagggagacgaggttcttgtggtgcacgcggctgatgatctccacctcggcctggaactcgcgctcgccctgcccgctgccggaccgcagcttcttgatggccacctcttgcccgcgcaccgtccccttgtacacctgcccgaacccgcc

SEQ ID NO: 91726 - DNA, 515 bp, Oryza sativa
ggacggtgcgcgggcaagagttggccatcaagaagctgcggtccgccaggggcaagggcgagcgcgagttccaggccgaggtggagatcatcagccgcgtgcaccacaagaacctcgtctccctcgtcggctactgcatctacggcgagcagcgccttctcgtctacgagtacgtccccaacaagacgctcgagttccacctgcacggtaagtacttgctgccggatgatgtaccattgttgcgtgtaatgctggggcttgcttgggctgacacgagtggttggtttctgcaggtagcggccggccggcgctggactggccgcggcggtggaagatcgcggtcggctcggccaagggcctcgcgtatctgcacgaggactgtgagttccaccttgtgtttcctccgaaatctaaggtggtgtttgggaatctctaacaaaaatataagtccctatgagagagacttgtgcttttgttaaaaggattaaagtttagtcctttcttcctaaacacca

SEQ ID NO: 91727 - DNA, 4224 bp, Oryza sativa
ctgtttcctcattcttatttcacaggatttcaaggggttctgggagtccagattcgggggcaagaaggagcaggagccggagcagaacgggcacgccaatggggtggcgaacgggagcgtcaggaagaggacgtccgatttggcggtctacgagcagttcgagcagcaggtatttccgtgcgttagcgatcctcttttggtatggaatggtttgcgtgcatgcaggtgttcttggacaggcgtctcgtctcttgtgtagtccttgatcctcgatcggtgttgctgtttcaggccaggcagacggaggtgcgcgccgcggcgattcgcgatgggaatgctgatgcgatgtgaggactcttttcagttcattgttttctcttttttcctgatggaatctcgaagcaatgcatgtgtgatagagcatctggctggggattgcttattagattagatctgaacttttaggtttgaattagcctcgtttttgtaagaaagggattttgattcgctgaaaattcagagagatctaaccatcgtactactttggactggaatatgtaaccattggcacttcatacagacaagatgttaagttccttgaatcatggatgtgtgatcctgttcttcaaaggagtagcatcagaggaaccttagagctagaaaaaggttgtgtaaggaaaaatccctgctgatgaacattggtgaaattatcctggaaagataccaagctgataatttggtttggacttgtggcttaagcattatatctcaccctgctgatgaaggctagattaaattgaattagggcgtgcaggctttcttctgccttgtcaaaagcctatacaagattgacatgcagtttatttgttaaaggaaatagcatcaatcatctttaaatatgcttaaagtagcacacaacaaagtggcaaactaacatatgaaaaatcatagatactaacactctaaagtctcggtgattcattactggcatttcaagacacttattcctgaaataatgcttttctcatggccaactttgatttattaagacattaactcaataaaattatgctctcaaacattacgattttggagttttcttttgcagccagaagcccctcctaccttcgtttgagtcagctgaaatgcgtaatcttgcagagacattgttgcggtaattcaagattcacaaactttcgaaaaataggaaagcacaaatttggccattgactatatattcttgccttcatctttcagggacattattcgcggcagtccagatgtgaaatgggaaagcatcaaaggactggagaatgccaaacgccttctaaaagaggcagttgtcatgcccataaagtatcccaagtaagttagctgtttcatgtttattggaatagaaggacatggtctcatactgtaatttacagctgtacaataattcagcctttcactagcggtagactggtggtatccagtatttagaggccagttatctagctctatattgcaaatgtacaaaatatgttttgtgtgacatacagataatcaatcaatctatcagttattcataatcatattttggactatttcagatacttcactggtctcttgtcaccatggaaaggcattttactttttggtcccccaggaactgggaaggtttgtatatgcgcttgattgatatgttacttctgctaattggtcgagtacatctatggagtatagcaatactttcttaccttttcctatatttgaatgcaacctcttaagtaggtgtccctaactacttatctagtttataaagtacaataacatataaccttaactccttaagatgtttaacctaatagcgtatgacctaaggatttgtgaaccgacaaactcatttaatgattggcaagctacctctaacaactgacattcaccactggcgatggggtaatttttttttttatgaacatacatcgttattttgtcatgctatatttgcattgtgagtactttgaaattttctgattttgcaatatctctgtctattactatatacttcggtagtcagtttcaagcaattcctatttgcagacaatgctggcaaaggctgttgctactgagtgtaaaactacattcttcaacatttcagcatcatcaattgttagcaaatggcgtggtatgtttctttgaacacctggtcctgaccccatctttcttttattgcacagaaaacaagttgtttttagctattcttttttgtagagttgtcctagttgttctctctttgaccatttagtttctatgttcgctgatagtgataagagggcaagaggcagtagttaattagtgagttcttgttgtcatcctctttttcatcaaagacacagacatcctggtcgttgttgaaagttttttcctcctgtgctcccacacaattattttgatcaatctaattcaatcatggaacttaaaacttttgatcaatagaagtatttaaatatttaattttaatgttggtatttttctgtgtgcgcgctaatgcaggggattcagagaagctagttaaagttctgtttgagcttgctagacatcatgcaccatcgacaatatttcttgatgaaattgatgctattatcagccaacgtggtgaagctcgcagtgagcatgaagctagtcgacgcttgaagactgagctactcattcaggtttctgcttgtttgaacatatcaaaattaagcttgctagtgtagcactccaagtcacggtttcctacttcataatctttcagcttgaaactgtcccaactcccaacaaacaatacgtcagatttcaaagtttctatatttctgtcaatgtttactgcagatggatggcttgacaaagacgaacgacttggtatttgtacttgcagcaacaaatttaccttgggaactggacgcagctatgctccgccggcttgagaaacgggtacattttttttacattccggtactatagtccaataagtaggggcgggattaaatttgtaaatcttctttgtaatagtcatttgagctttgccttggatggattttcttttcttggtgcatactttagcctaaagaaacttattttaggacatttgataatgctcactaaacatttgaaaattttgttgtaaccttggtgcctttggtcgtcagattctcgtacctcttcctgaggctgaagcaaggcatgctatgtttgaggaacttttgccatcaactacctcaaagctagaggttccatatgatactttagttgagaagactgaagggtactctggttcagatatccgtcttgtgtgcaaagaagctgccatgcaaccactaagacgtcttatgtcagttcttgaagccagagatgagctggtgcctgaggaaggttagttttggttcttttctcagtgatgctatttttttttctgatgaaattataccactgaactgaaaaaaaattcatgctattgttacacatttttatgtgataccttttctcttgggttgcagaattgcccgaggttggtcctctcaaacctgaagacatcgaagttgctttgaggaacacaaggccgtctgcgcatctccatgcacatcgctatgagaagtttaaccaggattacggaagccagatccttagtcaggagcaagcctgaacttctcaaagttcagacataccattttcaggacgcaacattttttctgcagcagtttaagttgtgaggcgaacgttacaaacggatgttgctgctgcagcagttatgaaataaatagcatcatgaatatcgaacgcaattgcctccttttatatgtgctccgcatcgtcgaagcagaaggctggatcctatgctgccagttttcctttgcaccggctaataccactagtatggtacgaccaacgtccacatgatccatcccatttataacggacgaccagcgatggagcgcgcaaacaacatgacatcgcaaaagcggccattggcacataatcattccattaaaggctgatcacacgcagaagtgataatatcacacgagaagatgttttcttcacaaatgaacaggcccggcgtgaccgatttccagttcgttacatgcaaaataagataaccaagtgcattcaatcacaacgaactggctcagcagagccaacgcttcgggcaaactcaaggtaatcccctcactgaatcggcggtcttcccagaccttgcat

SEQ ID NO: 91728 - DNA, 1251 bp, Oryza sativa
ggagatgttctccgggctccagtccgcgcgcaaggaggcccgctccaccgacgccgccgttctcgaggcgcagctccaccagatgctccgcgagtggcgcgccgagctcagcgtctcctcctccccggcctcctccctccaggcaagcgcatcacgcccctccccaccccccaccgtcctccatttctaggcttctcctcggctcacgctttcattgggggggcggatttcggttagcagcaggggaacaaccgggagctgtcggatccgccgtcggagacgctgcggctgctgcagctggcggcggccgagaaggaggaggacgacgccaccagcaagctcgtcgagcagcagcagcagcacccgccatcggctaaccaggcccacggccacccgcaggcgcagggcggccaggacatgaagccggagccaccggaggaagcggtggcctccccggctgatctgacggtgccgcagcagccgcagtcgccaggtcagggagttctggcgagtggtggagggatgctggcacctgccgctgccgcggtgttccatgatcaggtataagattttttaactttttattactagtctgtcaaacggaagctccaatctttatgcgaactatggtacaatggcaccctattagtagggtggatgtggatccttggaaacgtgagtgtttcttcagagatgtgagcggcttggcttttcggttcggtgtgattttgtgcctgtggtgtgcttttctggtttatcaattatatttgtctactttgttgtgtttgtagagatgttcaatgaagtccttgttgtgtgcgtttagttggatataatgtgatctgcaaaaacagacccgttaaatcatttagtgggagtttctgcttttcttgtgtagacaaacttcatgtgcacttgtgcttgccctctgttggtaatgcaataggcctcaccgtaaccacaacaggaaagctttggtttcgcattgtaatggagatttcaaatggacggcgctttgatctaggtgtattgactatttttagataaaattaagcttattatatgtgtgacataaggtagaaactgaacgttatatatgcgctgtaccattcaattcacttctttgaggcatgggctacttatggccttgtttcagccagcatctttttttttgggggggggggggctcctatagcttgttgatgtggcgtttattgctatcagtaggttattatgctccaatatagcaac

SEQ ID NO: 91729 - DNA, 654 bp, Oryza sativa
cgggaaggccgcgcttgtcgccctctgaccccgaggtcgtcggcacagaagccgagtgcgccccgcgcggcctctcggacgaagagcaccctgtatcgactcgacccgggagagagcagggaggagaggccccgagccgaacggcggcccaaggcccccgacgaccggagctggccctctgcccgcttgttcgacggtgccaggagcccccgacccccaggatggccccggggccactgcgggaaggccgcgcctgtcgccctccgaccccgaggtcgtcgacacagaagccgagtgcgcctcgcgcggcctctcggacgaaaagcaccctggagatgcggctggcgaagaggatcggccccgccgaaaggtgcagcggcccgtctacttcgttagtgaggccctccgggacgccaagacccgataccctcaggcccagaagatgctttacgctattctgatggcttcgaggaagttgcgccattatttccaggcgcatcgggtcacagtggttacgtcttaccccctcggccaaatcttgcataaccgagagggtactggacgggtggtgaaatgggcaatcgaactctctgagttcgatttgcactttgaaccacgccacgcgatcaagagccaggccctcgccgactttgt

SEQ ID NO: 91730 - DNA, 644 bp, Oryza sativa
agctaggggcgctcgaaggcaaacgaggtcctgcgagaatggaacatcaagttacgacggggtgatgtttttgtacaaaaacagaaacaaaacttaagaaacctctgggctgagcagtaccgtgcgaaacaggtaccgtaggtcgaggtcctgctccgacggtaggacgcgcgaggccgtggttgtaccggaccagctggaggtacgacgtccacggcgctgcgacaggagaagatgcgcatgaccgcacgcatcttctcctgcatccggtcgaaggtcatcctctgctcaacgtcagtcaagtgcaaacctctgttcaacctcacttggactgcggtgatatcggcactgatatcccgtgcagcatcagcctatgcaagatggaaataaaaaattcagtagttgtcctatattatgcaagataaatgaaataattgtaagaactaatacaaattcgacgtacccccacgaagtagtctcggtcacggtgcgtgggatacgcgtccgtcacagcggcaacgtgcggctctggggcgtctggagtgaaggtcacacgcgcacgagtgcgaggaaggtaccagcgaaggtagtcacggtagttctcctccgtgtgtgggaagagctcgttgatcgcctcctctgta

SEQ ID NO: 91731 - DNA, 941 bp, Oryza sativa
aattcctgcagccccgatttgttatcttttctttaaacaatgatcatactctaatgatcataaaactgattttgtattgctgtttcagtattctgtgtgaggatgagatgcaagcagtttctgttaagagccaattgcaacagattgcaaggccaatgtacagcaacccacctgttcatggtgcactggttgtctccataatccttaatgatccagaattaaagagtttatggttgaaagaggtcaaggtaagaagtcttaactacgtaagttcctaatagattaatctatgtgaagcatggaaaggagtttaatatcgccactgggttgtctcagggtatggctgatcgaatcattggaatgcggaaggcactccgggaaaatctcgaaggcctaggttcaccattgtcatgggatcacatcaccaatcaggtaaagaaatcatgaaaatgtaccatttctgaatatgaattcagtgacatgcaaattataccagttcaaagtagttgccagcatctccaaggcccacaatagatatagtcaggttgtaccataaacttgttggagtttggttcattgaggtattagttcatgtggactgatgtactctagtgctggtcctgttgcttgaacttccagcataattgcaaactagtcaaagtggattttgtatcataaatattgtgttctaactcgaggccttgtcaaagtggttgtcttgagtcccaactaatcaattagaaatggataattgtacaatagctattaagtcttgtctgggtatagttgattcggtaagtaacagtgtcagtcaaaaactagtaagaaccactagcttcactcgttctccttgtaagcttacaagtacagacatatccattttgtacgattgatatatgttgggcaagaattatgtgcaacttaaatgtccatttacccat

SEQ ID NO: 91732 - DNA, 597 bp, Oryza sativa
ttgaaagtgttctcacacccttgggcacttagtttatctagtgaggtgttagagagtgagttaagccaatccaagtgcattgcttcattgttatagctagtgtggtacttgatcatcctcggcaagcatcctagacttgttactcttggaggttgccacctcctagatggcttgtggaggtgtttcccggtgatctctccgaggagattgtggaggaggcccgacgccgtttgtgagtgatttggagttcaccaccttcgaagtgaaggaataactaccctagtgatcgaggcttgggtagtcctctccgtgggctggctcccaccttgcccaccccttgatgaagggggcgtgcggtggcttcatggttgagcggtggagttggactcgcctcaacggggattaggaaaccggcgagtttctgaacctcggtgaaaaattccttgtctcttgtctcatttatttgttgcatttacatttgagcaaatttacattcatagagacatatttgagcccatatcacttaggtttgcaaaacttaacttagttgcttagttaaccttgtacctcaccttgcctagcaacttaggttagttt

SEQ ID NO: 91733 - DNA, 532 bp, Oryza sativa
ttgtagacgaagcaatctttcgccacgtgattggagttgggatgatgcggacattgggagttcattatcttgtcgaaggtgttgacgcgggaacgttgtcgggaagatggagaggttgttgccacaagctcttcgggcttacgcttgcgatccttgtggttgttacttccactccctcctgcggtcggctgcatcggatcccatataagaagctcgctctttacccgatcattcaaacattttgtgggcggcgctcctgctctattgttgcgtagcaatacaagcctgctcatgctgcttcggcggcgctttttcgccttctcttcgctctggacaggagccctaatggacacggggagggagcaggcgaagcgtatccttttttggcttccaagtggtgcccgactgcttggacgccgtaatagcatcttcggctttggcatactcattggctttttcaaacatctgcttgaccgtcttgggaggtttgtgtccgaacttgccgactaggtcctcgtggcgaatgccttta

SEQ ID NO: 91734 - DNA, 1177 bp, Oryza sativa
tcatgtagtaatgggtatacccacgggcacagataatctcatgggcatgggtatgggtaggcactacctgtacccatcgcgcccaattgccttcacaagttgtgaagaacaaatgagatggcagacagatagagataaggcataagatctatgttttagccacctgtagggggataatatataaaaaattttggtcttaatccttgtgtggtgagatgctgatctttcatactcaggaccacaacagctagagaaatgaatcaactgcatcacatagtacaaacactgttatacaccaaactgactgaaatcgtcagatagaaactagaaaacatcatccatctagcaatttcatccatgttgtatctactactatattgaataacccaatatgaacagtaaaaccatggtgaatcaacactactactgtcatccattcccatatctctgaaactcaacatcctggccatcagcccttcagctacctctgaatctggcgcaaacatcgcatgggtgatcccaacaacaccagggttctgactgttgagtaccgaaaaagttgtcgcaaggccaaaaccatagttcatgatgaaatggaccagacctctggggaagatgaagacatccccctcagcaagggtcttctgaaacagcttccccttggtgtcaaagaagcctgccaccacacttccactgtgaacaaacatcatctctgaagctcttgggtgggaatggggaagcaccgccccgctgaccgcgatgtcggtccgcgccattgaaatgccaagggtgttcaggccagggaactcggtggcggtgatgatgttcgccgatgaccggaccatgttgtccaggtccccggcatggttgagcagcaatgtcttgaaatcagaggccattatggtgcttgggctcttgcagaagaaaccattcatgaagagtttcctctcaccctggggtgccatagggcatacatcctgaagaggagggctatctgatatgatttctggagcaaagagaccaaggagaagaaggtaacaacacaggacagtggagagcttcatgtcatggaattgttggacaaaaatacagtgaagcagaacatgggttaaatactgtgttgagacaggagtgcaaccaaagtcagaagactgagtatcctgtgcaacattcttgg

SEQ ID NO: 91735 - DNA, 526 bp, Oryza sativa
agatcgggcggaatccgctaaagccactggtaaatagttcgccatggccttgttgtcacctcctgctgcgcggattgcgagactgtagacggtaagccacgattcagggttagtggtgccgtcatacttctctattccagtcggtttgaagccggctggccaatccactcgacgcaggtcgtcggtgaaggctgctactccatcaaggtcgtcgtcgtggcggtccggcgagtgatggtagcctcgagctgctcggcgctgtatgattgtgtcgcgaagatcgatggggcggcgacgaggtggtgagcgaggccgttccactcggcgctccctatgaaagtcgggaggtgagtgaacagaccgctcgtcgtgacccctgctcctgcggttggatcctgcgccggtgatgctgaggcttggatgacggtagtcatgagatcggaagtgggggactcggctgccagtcggcgtgtggacgctttcggagttaactggaaccgaggccgcaatcatggtctttgtctgg

SEQ ID NO: 91736 - DNA, 1076 bp, Oryza sativa
catgattgaaatacacagaacatttatggaggaatcatttatcactattataccttcagcacctggaatattgatcaaaggatcgttggctttaattaaccaatctttcgcacaaatgagagcttcaagcatttcaggtgttaacgaacttcgtgtgtcaccaagtatcctgcccccacaactgaatgctgattcggaagatacagtgctgaggggtattgctaggaaatctctggccatagatgacaatactgggaatttttgagcatgtctcttccaccagtccaaaacatcgaaactctcactatcctcctcaacatcttcttctaaatatatggcaaattctgatttcgtttgccgtgcagttctccttcgagacttgtataaagcaaactcttcctcgagttttcttttcccaagaacaggtgatccaacactgttgctgccttcacaagaatgtgaaagcatgtgttcatcatttcttcttacaaacccttcgtatttttcataataatccttcaaccaatcttcagcagaacccacttttttgacaatctctgtcacactgttagatgttttctcataaaagaaattcaaataatctccttttcttcttggatctaacattgtggcaatgacaagtgcagagttaaacccactgtcccaatatttgacaaactttgagagcatagctgcagccaatacctttaaaatatcactagtctgccaatcagggtcattcaatgcatgacgaatttgtagcaccaagggcaagaacctatgtgctgttggtttcctatctgctgacaccgataatgtagcttcttcaaaagctttaagaaaagcacaaattgattcaactttctgccattctagttcagtaggtgcaacttcaccatgtagatttgcatagctatccaggacagatatgtacattaatccttctacaatcattttataggtggaattccatctagtcggcgtatcaaaagaaaaactcaacttcgaaggaagatttttcgagtttgccatagaaatgaaatcttgcattcttgatactgaagaatctaaatgct

SEQ ID NO: 91737 - DNA, 651 bp, Oryza sativa
tcgtgacctgaagcctggaaacatattgctcgacaagaactacgtcagcaaaattggtgatgtaagtcttgccaagctcatatcagatattgagccggaagggctcacagagtacagagatactgcagttgccggcacactgtattacatggatccggaataccagttaactgggacaattcgtccgaaatctgatgtttatgctctggggatcatcattcttcaactactgactggcaagcgcccacacgggctgatacttagtgcagaagaagcgataaaaaaagactcaatttccgatgttcttgacagttctcagattgattggccaatcgctgaggcagagatcttggcaaaattggcggtgcggtgtacagctttaaaatgtagagacaggcctagccttgaatcggaggtgctgccagagatcgagagcattctgagcagaattactgcttctcccacattaagaagtccaaacgcagctgtgccgagccacttcatctgcccaatattgcaggtaaaatttgctaactagttgagtgcgccagttctgattatctccctagactaaatagaaacaatgacaattttggtgcatgaggtaatggatgacccttatgttgctgctgatgggcacacctacgagca

SEQ ID NO: 91738 - DNA, 504 bp, Oryza sativa
aatattactagttacagtagtagttagctattgcacaaatattacttcttctatatctggaccctcttcttgcatagactttaataacttattagtgatgaagttctggttgaatgtggttcctcacttcctcctgttggtgtgctactgacttcatcaactgatacaagtttctgcaccacacattccatggtaggtcttctgactctatcttcttcaaggcatgaaacagccaattccatcatcattcttgcttgtgcgctgttgaattggccattcaatcgggtgtcaatgaagtcggcaatccaaaactgatcgtcgccatctgacttaagttgctctgagcatagcctgattacccttcccagggccattttcacgtcctcatcatcattcttttccaattctgaaacacgagctcccttcagcaattcgaggagcacgactccgaagctgtacacatctaccttcgctgttattggcagactgtaaacccattcaggt

SEQ ID NO: 91739 - DNA, 1801 bp, Oryza sativa
tgtgacatacacagctgcaaagaggtcaagtgtgaaccgtcctgcagggacaatcgagatgaagcccattgagtcaatcacaaaggaggtaatccgaagcttcatgatagaaaaggtattgccagctgttcgggctaagtggcctcgtgaagacgctggcaaacctatatacatccagcaggataatgctcggcctcatattgcaccggacgacagaatgttttgtgaggccgcgaagcaagacggctttaacatcaaacttgtttgccagccggcaaattccccatatttgaatgtcttggatctgggtttcttcaactccattcagtccatccagtacaaatcagcctcaacaacaacagaagaacttgtagccgccatcgatcgagcatttgaagattatccagtgaggctatcaaacaggattttcttgtctcttcacgcatgcatgagggaagtcatagaagtactcggtgacaactcctatgatcttccacacataaaaaaaggagtgcttgaaaggcaaggtcgccttcctttgcaactaaggtgtgatgctaagtcagtaaataatgctaacaattatctcaggtaaactactttggttatattttattttcatgaaaatcgcttcatgtgcctaactagtttgatgtgtgctaattagtggcattctttttactccttttcaggaccatggcagatacctgatatgaatttgtttgttgctgcagcagggtgcggatatgaaattgctgctaagctaatctgaaatttttggtgttgctgctgttgctgttgctgctgttgttgatatctgaaattgttggtgttactgctgttgctgatatctgaaattgttggtgctgttgttgatctgaacagaatgaattggaggctttcttttttttctctctttttctagaaagtagcccatgtgtgcagtcattctgtgcagaacatgtcctttgatttttgagaaagcaggaggatatatggacctgaatatgtcctttgatttttttattagtatttttatttcacatgaacacattagctaagcttatctaagatcaatggtgtgaactgtcaatggtcctttgatataattacagactagctatctcaatttacaagaaatagcaactgggatggcagcagccactttacaagctctgtgtctgaatactctgtttacagactagctatctcaatttacaagaaacatcagctgggatggcagcagccactttacaagcttggtgtgcatctctgaatctgtatctcaagttccaatttttgtttccaatttctcattataacatccaaaattcccacgcatattacatcactgacagtactaagcactaatcatctgatcaaatacacaacaatcagtccccagtgaacacgaccagaatttcccagaaacagaaaaatttccccttcgatgaacatcaaatagccaagcaaatgcaatgtgcattctctaaaaaacgaacatcaacaatcaacatacggctaaccaaatcagacaatctgcaggccgttcagtagcttaatctgcaatcaagtgcacagctatcttaaccggatgaaataatcaggtaaattctggacatccagctgaagaaagaaaaaagaaaggaggagacttgtggcaatggagcttttcgaagcccggcgatctcctgcaccaacgagacgtgcaccagcaccgtcctccacgccatgtatcagcctgcgaacccgccgccgccgcgagcagcgaacgaaagaatcagggaaaagccctcgagcc

SEQ ID NO: 91740 - DNA, 968 bp, Oryza sativa
cccagaaatagaagactccaacattgttcaaccggcttcatcaacagaaacaagcatctccaccacactttccatggtgggtcttctaggctctgtcttcttccagacatgaaactgcaagctccatcatcactcttgcttgcaagttgttgaatcgagtgtttaatctggcgtcaatgaagtcagcaatccatgactgttcatccccatcagacgttagattctctgctagcattctaatgattcttccgagaaccatttccacctcctcatctttgtttgtttcaaggtccgaaacacgagctccttttagtagttctagaagcaccactccaaagctgtagacatcaacctttgctgttatcggaagactagaaacccattcaggcgctaaatagcctctagttccttggatccgtgacacgtttaaattggatcctcctctatgtagcaactttgcaaggccaaagtcagctatctttggctccaaattctcatcaagcagtatattttcaggttttatgtcacagtggatgacccactccaagcactcgtgatgaagatatgccaatcccttagccacacctagagcaatcttaaatctttgctcccattctagtaaggcttgtgattcctgactgtcaaacaatattttatccaatgaaccgttctccacgtattctgaaatcaatatcctgtgtggatcatcagaacagaatccccaaaccctcactagattcatgtggtagatcctgccaatcacactcagttcatgcttgaattcttcttcgccctggtttatgtctaacaactttttcacggctactgctctcatgtcctttaagatccccttgtatacaatgcctgatgctcctcgtccaatctcatcctgaaactttctggtggctatcatcagctctctgtaggtgtatctacggaaatggtttgttaccatttcatagccaacc

SEQ ID NO: 91741 - DNA, 659 bp, Oryza sativa
cacggatgcttgcaaaggtttcttctagatccgagagcaaatcatccttttgcttggtcttgacgactacatcatccacataggcttcaacgttgcggccaatttgtgttgagaaacatctctgaatcatacgttgataagttgctcctgcattttttagtccaaacggcatggtgacgtagcagtatgcaccaaaaggcgtgatgaatgaagtcttcaagcagtcggattccttcagtcggatctgatgataccccgagtagcagtccaaaaaactgagaagctcacagccggcggttgagtcaactacctggtcaatgcgaggcaacccaaaaggatctttgggacaagacttgttgaggtcggtataatcaacacacatgcgccactgtcctgtctttttccgaaccaggaccgggttagccagccagtcgggatgaaggacttctttgatgaagcctgctgctaacagcttggtcaattcctccttgatcgcgtccttcctatcttgtgcaaatcggcggagtcgttgtttaataggcttggcgtcttctttgacatgtaaggagtgctcaatcacctctctgggaataccgggcatatccgaaggtttccacgcaaagatatctttattattttgaagaaaggtgatgagcgcg

SEQ ID NO: 91742 - DNA, 679 bp, Oryza sativa
ttctcaattgaagaaatgcttaagagtgctcattgagcaaattggcctggatcagatcgagatacagaggatctgacttgtggaaagaaatccatccgcatccaaaccagcaaaagaaacacacaaagacgagtggtcagttttacaaggccaaatgaagcaatcattcaaagttgaggctacatgggaacgagaggataaattgaagtccacccatctgcacttcttagccagcacctccgaatcttagggatgagatttcatttaatacgggtagatttgtaataccctgagtttttcccctaagtaataattccattaatagtacatttctagaaattgccaaaaaaatcttataggaaaatctacaacaataaaacccttaaataataatctattctagttgggtgtaattttcttaaattccccatgctttaaattactcacagtatttttgcttgattttttttagagaattggagctacttttaataacccataaacaaatatcataataaataaattcataagagcttagaaaaaactctcatactcttgggtccactctcggtgcatccttcctccccttccgcccgcgcatgctagcaagtcgccatagccatatcctcttcacactcatgccagcctagcctcccatgtagtcgtcaccctaggacac

SEQ ID NO: 91743 - DNA, 2166 bp, Oryza sativa
  unsure (1)..(2166): unsure at all n locations
ataaggtcagaagtcaggatagtggtacctcaagctcccgagtgaatgaagcaccagacaccagtcgtgtgacactggtccaacacctgattaaccagaaccgattgcttatagagatactacagtagcatcagacgccaatgctgaacctgaatcaaatacaacctcaagtgcagttggaggcagtccaagcactcaccccacaagtcagcatgccgccagcatcccgaaggacccatgatgacgtgccacctgttgacccaaaagaagcaagtaacatttgctttacgtgtgatgagcaagtgcactatgcaagggagcgtcctcagcagaaaagaaaaacaccaatgggaaccgaagatgaagtccgtaagatgatcattaccagcacagaatggcctccaccaggaatgacaagacgtcagagaagaaataccttccgaggtgcaccacagttgacagagcatcttttagctaatggaggtagagtatctgatagtgcagattcagatcaagtctcgtcagatgatgaagatgaaatggaacgtaaggcatgctctcgttgtggagaaatcggtcatgtcgccagctcgtgtgccactatatgcgttcattgcgaggaaggccatccacccgacaggtgtccaacgagcaggatcacttgtttcttttgtgaaggaactgatcatgtaccaaaagattgtcaattcagttttctgccgacgaagaagatggccaaccaacccgccagttccaacggagagaagcatcaaggcaacaccaatcctcgccaagattacagtttcagcctaactccagtgtcaggacagaggaatcaaatgagaaaagaaaatgccgagtccgggaagatatctgttgcttcaattgtcaaggaatgggtcatttcgccgacaagtgcccaaaaccgagaaacatagctgccggcatgtcagtccacgcaaccccctgcaatcagaagcttgctcctcaacgaattgtcatccatgcatccagaagcagtcctatagcccgcgttgcaacagctccaattccaatgaatgcactaccacaaggtgtcaatgctcaatttcagccccagccaccagctgacaagacagaggtcagtatctgtgttgtacctttggaagttccaatacagcagctgagaaatcaagtacaagatgaagaacccgagtgtaagaaagttattgtttgttacaactgcagtgaagaagggcattactccaaaaactgtccccaaccaaggcaaaatcggcctccacattttcgccaatttacaggaagcaaccatgccaatcaccaagtagtcagtggagcaaatgcagtacctgttaagcctagtgctagtcagaagcaaccataatactcttgtatcggtgttcaagtacttttgttttatagctgttccccgtcaatcatgtaataacagagaaacatgagataatgcgtgagattggcaagtttatgtagggtccatattaagattgcaagtgttgtgtgatgggtacatttggttgatgattaaggaganttagggtttcattttcgtaagctcatagtgtattatgaatcaagtaattaagggattgatggggaagaaaatcaagtgatcaataaaagagatatttgtttggattaagagtatgacatgtgtcttattcggattaaaggtaggtatttgttgtggaaaaattggatatgttgatagtatgtgtcttattaggtagtcagctctaatagtaaaattgttatgttaggaatttgtattcaaaattgtaaaagnttatatgtgtgtgaatcttcgtgtaggaattagttgagggatataataagaaattgataatagagtataaatattagtctaattaataagcgaatagaatgtcattacagaggtagatagttcctttcaatcaataaagttgtaagtaggggaaaataaataaatggcgcagagggttccattccacaggcagtttgaccaaggatacacttaatctccacaccttcagcctcattgtagaattcttcttatgatgaatgattgcaaggtgagtatatgacatactcagcaagccacgcagcaaatatgcaagtgcacaggataccaaaggatggcataatagggtttcatctgcaaaagca

SEQ ID NO: 91744 - DNA, 581 bp, Oryza sativa
tgtgattatgatgaataagatcaatgaccggcttcggccaataggatgtagggttattacctgataattcaggggcccgaacctgtataaaaatcatcgtctccatctcttttacctcagtctcgcgtatatcttagtaccaacgatccccatactatgcaaataccggaatcgcgacatcaaatgtcgacaatactccatccgtattttaatgtatgacaccgttgacttttcgactaacgtttgaccatttgttttattcaaaatttttgtgtaaatataaaaatatttatgccatgcttaaagaacatttaatgaatcaagtcacattaaaataaatgataattatataaattttttacataagacgaatggtcaaacgtcaaacacaaaaattaacggcgtcatgcaaggtagtcctacgaacggagtttccataaaaacacattccttacaaaccttgactaggattgaccttcttcttcttttttttctaatacagagaatggataccgtgtacacaacccaacaaccgtccatccactcgttcaggcgctcacacccccgcaatccattccgat

SEQ ID NO: 91745 - DNA, 601 bp, Oryza sativa
tccagcgtcgccgccacctcctccacgccggcctgccctccgtttcgcgaggtgacccccggagctgcgtttccgccgtcgcccatccatttcctccgcgccggccgcctccagtcgcctccatctccctgcctgcacgccggtcgacgtcgccaccacctccctcggctccacgacgccgctctcatccccggcatcacctcctcctcgcccgaacatcgccggaacaccgtcgcccgcgccggcctcaccttcctcctcgtcgacatctcctccggctgcccctttcgccatgcccgtgcatcagccgacgctgccgtcccctccctcggcatggtgacgtagccctccacctcgtccactcctcggtttcgccggaacgccatcgccgcgagcccctccatccgcctcgccggagttgttcggccgcccgtccctccacgccgtgcaccggtcggccacacccccatcatcttcggcatcgcagctgcgacgtcgtactcggcctcgcctcccctccgaccgaacaccgccggtgcccgtcgtcaccttcaccggtccctctcgcccggctcgtcgtttgcggcgccgcctccgtcat

SEQ ID NO: 91746 - DNA, 1300 bp, Oryza sativa
catccaaaccagagcaatccaaaaggtcgaatgtactgatgcagccttgaacgacgccgatgtaaacgatataattgcctgggccggcgaaacatcggtgcagccccgcgtcaggtgccaagtcccgccggacgataaaataaagtagaaaaggtaaaaggaggcgatgcgccgaattgtattgatcgtgaagataaattacatagacctcgggtgtacatatttatacccataggttgatacaagtccttctcggacaagaaagaaactttcctaaagataaaaggaaactaacaaactattcctaattaatagataaactgacatgccgcatccttcttgaactcggactcttctggataaattccctttagttgatccgactccatcgagaacacggttgctggcgatttgacgactctcatcggctgattccataactctgaaggcgatactgactctaagtcgatgatgactttgggctaaccaaatttcgttgttaacacaatgcagccgtccggctggacgtcggcgtggcagcggccagcgtagatgttgtcctcatgtatccgtagacgttaggcgtcgcggagctggcgacgcttgttcatgacgttgcggaggtcggcgtttagccgacgtcccacctcgatcttgtcgcgcaggtcgctggtgcgcagacttgggtgtgaccttcccgcttgagatgcctcgacacgccttgacccggtattttgtggcgggatggtctcttgccagaggagtcgctggcagtggaggcggtcagtggtacttcggtgtgctggacagcggcggcatccaccatggccttcacctgagcgatggtggtcttgacggccgggtcgcctggaatcggcatgttgtcgaggagggccttggcggctatcatgttgttctgtagcgtggtgaagacatcatgttctcccaacttgacttggaggatggcattttgggcgagacggccgcgctgtcgcagctcgtttagacgccgagtgaggtcctcctgctgctagtggatacggcgcttctcctcttcgtactcccttttctcctcgtccgtctcttgaaagacgatgaagacctcgcgggagtgatggcttgaagtccgggtgttgttggagcttcccgagtccgagtcggagagacgtacagactcatcaaggaaaccaacccagcaggatctgagctcccccgcagtcgaggacggtgacgcggagcggccgtggtgtcccgggcaccgcgggggtttggacgtgatcgggcggctggtgtcgaggtt

SEQ ID NO: 91747 - DNA, 1064 bp, Oryza sativa
acaatgtatcctgggaacagaacaaggcatatcccctagcatttcaatggaactcctttgttccaaacaggaaatttcaaccagaatcaatcaatgggccatatgctaagttacagcgtactcttggtttctgttcccaaaaccattaaattgtcctcctgaatctcatgttcaagttcacttagcattactactccattaactatcaccagtgtacaaaagtacgcttgtacacacaagattgcatagctgattagcttttcatcccagcagctcctgaatttatatattcttatacagtttaacagactaaggatgagagtttccaattttatttgcaattttcagttcttgaacctaccaaccacctttcaccccaaaaaaaagtgcaaacaaatcagtcttccttcggccgcagtatttctctaacatcataaccagattccatataaagcaaaaaaattccaacaattctacacagacaagcaaagaatctcgcaacgttcctcctcgaaggacacgagaaagcacaaatgccagcctattttttttcctccaacccatctccgatcatacgactctcatcacaattcttgtcagatcttctcgatcgtgcgaaacaggaatcaaatcagggcacgcacgaactgaacacggtatgtctagatctcgacgtctacaaatccctgctcaacatccaccacgagcgctacgagcaaccgaaacggaagcgaagaaagaggaggaggaggaactcgtcccgtacctcccgatccagaaggagagcgaggcgccgagcaccttggcggagaagacgcaggcgacacccgggaggaagccgaagaggagcgccgcggcgccctcgaacaggatggcgtagggcgggcacagcgccagcgtgagcgcgtgcgccgcgacgtacgcgggcgccgcccaggggcccagcgcgtcctccgcccccggaacgccgccaccgccgcctccccgtcccacccgtaccgcctccccaccgccaccgccgccgccaccgccgcgaacgccaccgccccgcgcgcccacccctt

SEQ ID NO: 91748 - DNA, 707 bp, Oryza sativa
caagggacggaggcagagcccctcctccctctgccgagacgcccccgctcccctcctcctttttccaaagaagcaagggacaagccccctttctctccccccttttctccctttttccctctcgccggcgtcacctcctgtcgccgttttggccgctagccggagcgccagctcgccggcttgaccgtccaatgtcggttcctctctcccaaaccgaccttgtcgcccatttaaacccaagctcctccccctccaatctccctcgttttcgtctctcgccaccaatgtcgcccctgttcgctgtcgccgttcgtcgttgcgcgtgtcggaggagccggcacgagcaaggacgcgaaaggggacttcggccgcgccctcttcctcctcttcctcggcccgaggccgaaacgatcatgtttcgcgccgtcggctctcgtcactgcgcccgcccgcacggtagtgcatctccccgttctccctcctcgttccatctcctccccttagactcgggtagtagcacgagtagcctccccgtagctagccggcgccgccccgaccgttgccgtcgctcgccgtgtgctcgccgccgtcgccgcccgagctcgggaacgcctctcgtcgccggcctccctcgaagcgtttcctcctaatccggcgcaagggacggattcccgtagccgcatagatgctctcgcggcgggaatcgg

SEQ ID NO: 91749 - DNA, 1457 bp, Oryza sativa
gctcgcgcgacctcgccgcgctgtccggcgcgcacaccgtcggccgcgccagctgcgtcaacttccgcacccgcgtctactgcgacgccaacgtgagcccggcgttcgcgtcgcaccagcggcagtcctgcccggcgtccggcggcgacgccgcgctggcgccgctggactccctgacccccgacgcgttcgacaacggctactaccgcacctcgtcgccggcgccgggctgctgcactccgaccaggagctgttcaacaacgggccggtggactcggtggtgcagctgtacagctccaacgccgccgccttctcgtcggacttcgccgcgtccatgatcaggctcgggaacatcggcccgttgaccgggtcaaccggcgaggtcaggctcaactgcaggaaagtgaattcctgatcgatactactagatagcattgccgcgcgcaaattgttcatagtacaaagtttaaagttatataatcagctgtcaatttcatgtattaagtgaattatgacataagaatgcaatagaaatgtcccaattttagacatcaatcactagtggataattcttccgtttgttcaattaattaaaccttgcttaattcagctaccatgtaactattgcgacggctatgatttttgcaatgaacacaagaactttacccgattgttactagtagtgatgttactgtgatagtactactgctgatcactatcacagtagtatcagtagacttgacaaatgcgtagcaacaaatcactggaaaaaaattcacatgatgtgttttgtgtagtcctgaatagtgagcggtgtggtcgtgactcgtgagtgatcagtttctgctcgtgatggaagaatattggcctactatatgtcgttttgggaagatacagaaaggaattcgatggatacaatagcaagagcgaccaaaaaatccggcaaaaatgcatacgtcgactccgtccggaacgatgtggttttgtggatggatctgaagatgttacgaaagggactaatcaaccaaccaacttggtgagcttgtctgtgtagcttacctgggcttgattggagaaagaaaaattttcgaaatcatgaggaggcatgacctgtttctcataaagtggtttctctaatgcatctgaattttgaacatgttcttttccattttaatagttgaagaacattctctgcgctcaacttatcggtggtgcgcatgtatccttctttacaatattttcagttgcagcttatgatattattttataaaacagaagatgacctcaatgataaaaaaaaaagctagttgttatccatatatatgcgttgaagagctccatgataccacttgctctaaagagtggctcctaccaacggataaaatcgaaagcccctctgctaattgctaaagcaatgaccaaaattgcagacaattggagcacatgaagttgggggt

SEQ ID NO: 91750 - DNA, 593 bp, Oryza sativa
attatttgtcctggatcacaatttttttacctagataaagaaagtaatttccccatctttgtgtggttaggtaaattgttttataggtcagttcatttctcagttgtccatcatcttctatatggctgtacccatgggtttgtgctgttatcattcatgcatcatatattttcccttgcaatattgtttttaaaatacttactatttcttggttagtacctttagtcttggctctctttgctaatgtatcttcttaaaattttcagggcaattttcagactctttacttcagcaatggattggctaaagagtaacaagtacttccatattgtggttaaaggggttgaacgtgatggctggaaatttgtgctacttgctagattctctcctctaccttcctacataattaactatgctctatctgccaccgacgttggatttttcaaagattttctacttcccacagttgttggctgcttaccgatgatcctacagaatgtttctattgttagccttgctggtgctgcagttgcctcaaccacaggatctgagaagtctcggatatactcctacttgtttccagtacttggtat

SEQ ID NO: 91751 - DNA, 640 bp, Oryza sativa
ccagccagatttacgcaaaaggaagttggtgtcaagtgatgacgaaagcgatactgctagaaagcctggagaccgagaggcaaccaagaaactgccaaagcaggctactccaaggaagaaaacatccagttgtcctgtgccaaagatcaggaagtcttccaggtacaaatcatataacgatctctcttgcattgatgtgcacccagtgcagaaataatactgacaaccaaacttgcaggaaaccatctgatatagatctttctgcaaaagactctgacccgactagcagggaaacaaacttaaaaggaatcgagccaactgacgaggatcagccgagtcacagccagccagcaaccgataatgtaggatctggtgatcaacccccgactgagaatgagtcggccgaagctggagccggagttaatcaggagcccccgactaaaaaccagtcggacactaggccaagcaagagattccagaagttggagctcgggcagacagccctcgtagacaagacgccagcaacgacccgatgccagggtctcccattaaggtgcaagagtcgactcgttcccgtccggaaatcatcacaggtaaacaccttgcctgaaatcgtgttgatccaaataactctgatcaa

SEQ ID NO: 91752 - DNA, 649 bp, Oryza sativa
tcgagttcgacggcgaggcgctctaccagccacccaacttcccgagcacgcagtggccgctgatagcggacacccgcggtgacggcacgtgttccgacgagcacctaatgaaggagcacgtcgccgggaagctagtcgtgtgcaaccagggtggcaacttgaccggactccggaaagggagctatctacacgatgccggcgccgccgggatggttctcatcggccctgagttcatgggctcaatggtccaacccaagtcgcacatcctccccgtggcgcaaatcgtctacttgtcgggggaggagctcaaggcctacatgaaatccacgaagagtccgacggcggcgctgatctacaaaggaacagtgttcggcgaccgcaagacgccggaggtggcgcccttctcgtcccgggggccgagcaggcagaaccaggggatcctcaagcccgacatcaccggccccggggtgaacatcatcgccggcgtgcccgtgacctcgggcctcgccacgccgcccaatccactggcggcgaagttcgacatcatgtcaggcacgtccatggcggcgccgcacctcagcgggatcgccgcgctgatcaagaaagcgcacccgaagtggtcaccggcggcgatcaagtcggccatgat

SEQ ID NO: 91753 - DNA, 604 bp, Oryza sativa
caacctcatgagccatgacggtcaaatcaagaagagaatgaaatcatcatcccctgcacatctcgtgcctctccccttgggcgacctcgccgccggcggcggcggcgacagatgacaccctgggcgtgttggttaccgagtagaacaccacgtcgctgacgcttctcctctgctgctgtaggtgctggtgctgcgacctcttgcagtgcgcaatggcgccctggatggcgccctcctccgacgacccggcgctgctactccgcttcagcgccggcgccgccgggaagaacctgctcgcgttgccgcaggacggcgtggacgacgacgacgacgaggtcgagcacagcggcgaggtccccggcgccgacgccgacgccgccttcgtcgccaccagccgcacccgccggatgatgccggagaaggacttgcggtggccgcagagctcttcctgatccatcacgccgccaccattgccgccgccgacgacggcgatgccggtcggcttggcggtggccaagaagagggacttgatgtactccctcgacgtccacctcttcatcagcttcaactcttggaccacgagtacttcttgggggctgcagga

SEQ ID NO: 91754 - DNA, 1409 bp, Oryza sativa
agcagcagttatagacttgtttgtacacttacttgtagacaggaaggatgctgctcagaagggaaagaagagcgaacgacttctctacacccttggcaggtttggagagcaacaagtatgaaactggtccaacaagtactggcacggtgtcaacgccgagctgcatgaagaacaattacatgagacatacaaacgaccagattacatcttaatttttaagaaaacactatgattttcaatccagaaggaatactacttaattcagaatttgatgcttaaaaatagaaatgttactattcacaaactggaacaagatagtaaattcaaccaaagcatgtttcaggtaaactcaccaattaagcataggtaaaatcagacaatttcgccacaaacaacatggacatcttttgagaaagatggaaacaacatatagtgctaaaaaaacattatttcataaatgtaaagtgaattttagtctttgcaaatctgaaattgctagtttcaaaatactaaacaaggggccaaaaatttgcttggacacgagtattaacactgaacttaaacaaactgtcacttggagggcatgtgatttacaggccatcaatctgaaggagtgacaatcttcaaaaaaaatcatggtaagcatgccatttaatgtacatcagaatttcttttctaggacaaaattattaagcaaatgcactataatagcagaaagcaacacgctaaactaataagtaactttacgaactaagacattaatgacaataagaatgtgttagcaacgcctatgtagtcaggcagagaaaacaatcatgaaccagacagagacgtaagatgtaatcctagtatcttaccgccttagcctccttgtattcattcacagccttgtgggaagagtaggagaacttggtgttgggaccaagttcagggacgataaagtggctgtaaaggcacaacagcagcagttagcaaaatgttgaatgtgaaatctaaataaaatgttactgtcagacagcttaaatggaagcaaaggacttactagttggtgtcaaaccacttggtcatctccatggcagggacagtggcattgcccctagccatcgagaagtaggtgctgaacccaatctctccaccagtccatgagtagcgctctgggacagcaccaagcatggcagccgtgtcaagaacctgatcatagtacgagaaggtgttgctggggatgtacttgatcccagcgtcagccatttgcttccagatgctggccctgaggtcggtcgcaaccttctccaaatcctcagcgctgctcttcccatcccagaaagactccagggcaaacttgagctccctcttggggcccatgcgggggacccaacaatgtgagacgccatctttctataaaaaaaata

SEQ ID NO: 91755 - DNA, 1460 bp, Oryza sativa
caggtttcattttgccctcctatcatttcccttgtttgtgttaacggggttgcagctactgactggttgtcaataaaattgtccaacttgcaggcgctccacattgacgctatgtctgaagtcgacaacaccacacaatcgcttctttcatttgtgggcaataagagtgttcatggtttatatgacttcttgttgaactacaagtaggttgcttaaaacctttgctgatcatcctattacaatactcccaaaattttctagctgtataacatgttcttgttgttttcaggtcattcttaaattctctatctgccacagatatcccggtgttatattccccggtgccgtttcaaaatggctgcctccatattccagaggtaatttgactcgtttcatttctgtcaacttaaaatttctccctgctatcatatggcaagtttcagtattctcattttttgtaccagttcacttcaagtattttcattaaaacctttctgaaaactatgtgtctaactgtctaaaggttgccctgtacaatagtaaagctgatttagaggtctgatcttctgagcacgcttttgcaggtgaaatgcaaggagatgaggaaggcagatataggcctggtttcaggtgggtttgatgcaggagagcctggatctactttcgcttctttaacgggcaatatctgctatagcatggaaataaaggatcccgtacttcctccatgggttgtttctggaatctgcgctgcaatgagctctgatgcaaatagcttcgatttaatgtacgtgccatcatcttccccgatgcagtttctccacctcttgccatgtgttaaataaatcattctcatttcctctttcaggatggcaacagagccttcgtcgatgggcttaaacgctgccttgagctgcgtaagctcaaattcccagtccaaggcacattcctctgaaggctgtgaatcattgggcatccctgaggccacattggttccctccttgcgatctgcatcttctctgcggcgcctcagctacaaggatggcgagtacatcgcatacacaacggtgtgagctacaacgcaacacctcgaagccatagctgggaagcaagacaagtactcctattccagtcaagtgcagccacttttgatgttctacgactaccaatgggggttctatctggttgagctcctcccgtcaagaagcctcaatgcctcgtccatgagacaagcaaggcaggcaggcagagaagctgttagctgctgctggttttgtggttttttttgcaaggcaatgtgtccagtatctggaatcatctaactgtttttgggtgagcctgtagattatctacaggacaatgagctgctcttgaatggtgcagtaatttatgggattgtacagtgtatttgatgcccttgacagtgcatccttcgatgactgatgggggggggggggggggta

SEQ ID NO: 91756 - DNA, 504 bp, Oryza sativa
cattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggctggaacgatcgaagttctggtactatgctcacggtggaacgctcaacccagctgatggctcactgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgttaggagtcgcaccaatcgaaaaggcggaagtgaaatacatgtacgaactcggtaaaccgcttgtcaagcctgag

SEQ ID NO: 91757 - DNA, 734 bp, Oryza sativa
ctctctttagtcccggtgtgtgtttccacccggtactaaagatagatctctcctttttttttttgcatggccctgttgctgcttgatttatatatatatatatatatatatatatatatatatatatatatatatatatatatatatatatatatatatatatatatatatatatatatatataaaccatgcatatatatgtttcaatacatatatatgcatacatatatatatgtatatatatatatattattatattatatgtatatacatgcataatatatatgtatttatacatatatatgttatgcaaatgcatatgtatatagatatatatatttccaaaatatatttacattatagaaaatgtgtacacatgcatacagaaacatatgtagtcatgtattaattacaatctattatatgtcctagctagctacgatttcgacgtagtagtactcgctgctagctcagaagctaaggaccggtgaattgtgtttccgtcgtagtagaattcactcttgggatcaaggatttcttcgttgatgaatcccatgagttgttcttgaaccgccgcgataaattccttgtgtgtggtcaggttatccctcatgcgaattaactatatgaatgtatgaaattgattagtaattaaacaagaaatcgctacgtaatgaaattttgaatttatttgtacgtacatcgagctctctttgtggtgatgatttggtctg

SEQ ID NO: 91758 - DNA, 615 bp, Oryza sativa
cgatgactttggaaatcacttcctctccgactcggattcaaaccagtctggaaggctcagaccactttgatctcatttggtctcccaaacaccgcgaaggcatgttccaagcttgttctctccgacacaggctcaatctcgtcagggagatcaaccttggcgagtttgatgattaaatctccgatgtcgctgcgtttttttcccttccaatttatcattgtttattagattgatttctaatcatggatgaatctattggtgttttttttattgttcatatataattccacggcactactgatgtgagtgctagcgattgtcgactcgtggtgtcactatgtagtcaaccggccatggggtcttccctggcatgcgtactctgtttgacctcgctttcacggctgctcgactccgccgctactgatggacaacctcgtattcaccgctggcttccttcactaccacagaccgctaacctcacaccttcacggttggcctactaaatcaccattgatgggcgacctcgtcttcaccgctggctgcctccacagccgtcaattggtaacctcaccttcacggttggcctactacgccgccattgacgggtgacctcat

SEQ ID NO: 91759 - DNA, 650 bp, Oryza sativa
catcactagatgtttcgactgagaacacacacagtcatggcctttttatacatatttatataggtacgtcagggatttgatgctggcgcaagcttcaacattgatgtggcaaggatacctcatgagcaagccaggattgtatgggaccacccacctattgtccaacactgcacctctaatttttacacgccacccatcatctctcctcctgtatgaaggatacaagtccttcccttgttgtgttgcttgacagaacggtcgaagaaagctgaagcgacactctctgtccaccatgcaggcgcactttttgtttagctcacctcacgggatgtgcaacatatgctttatgaccagatgatgtagcacagggtatttttccttatctggtatctctgcacagataactttatcataaccatctgggtttgttaacttactgcatggattcatggttaacaggatatgttcatgtaggaggccccgcttctgaaactcaataacatgagcatatgcctgaacctcactgaaatacttttcttggtgaacaagtctaacatgtatcgtagcttggccctaaatacccttgccacaaggtcccgcccatcttgcggctgttggctacaataaaaattttctgttatctccttcca

SEQ ID NO: 91760 - DNA, 528 bp, Oryza sativa
aatcatggcttaccgtctacgatctcgcaatccgcgcagcatgaggagatagcaaggccatggcgaactatttaccagtggctttagcagattccgcccggtcctggctccatggattgccccgtggtacaatcggatcttgggccgaattacgcgaccacttcatcgccaacttccaaggcaccttcgagcgccccggcacacaattcgatctctacaacgttatacagaagtccggagaatctctttgagattacatccggcgattttctaaacaacgcaataagatctccgacatcaccgacgatgttaccatcgccgcattcaccaaaggaattcgccacgaagaattggtcggcaagttcgggcgtaagcctcccaaaacagtcaaacttatgtttaaaaaagccaacgagtacgccaaggctgaagatgccgtcatcgcatcaaagcagtcgggctccagttggaagccaaaaaaggatacgccggctacgggagggggtggaagtaacaatcataaggacc

SEQ ID NO: 91761 - DNA, 654 bp, Oryza sativa
  unsure (1)..(654): unsure at all n locations
gacaaggatcagcatgtaaaggaactgtacattcaaaaatatattaaaaatgaaaaaaattacaaaaacgtacctctgacaggagcaccatccatcaactcaaactttgcaagagtttcagtctcaacatatgcactagagcctgctcctgttgattccctacgacgtacttctagttccatgtttttatctttattctgacaagaagaaagtagatcttcccaataatcannnnnnnnnnnnnnnnnnnnnnnnnnaataagaatgtttcaatgtaagcaaacgctgtggatgccacattgaggaacatgtcagaacagacagccaactaagcctatcttcttacttgcttttgctgtattcgaactcaatatgtaagcaatcctcaattccaacttccatctgaaaggaacatgcaagatcaagagttacataaccaaatatgtcttcatgtctttcacacacactaaataaagcatcactgtgaccatggcgaatagcatgttagtcaagaaatagaagtgccgaacagtgtatgttagtcaagaaaaaaaatactgttggccacaacggaataaaatattatgcagctaccatctacaggaatatcagaaaaacaatagcagctgataagcacaataaaaaggtacgatc

SEQ ID NO: 91762 - DNA, 606 bp, Oryza sativa
gaacactgacttactgaagaccggaatggaccaatgtgacattgactcaagaaggtttacaaaaaggccaactatagaaaagccagagctgactgaatgaaataccgcagttcactctgactccggttcggtacctactctatatctgaagattgaccacagcgtaatgccttaccgctttacaccttgctttccttatttagctactttacctcagaatccctctctagagagaattctctttcaagtttgaattgttccattaacccatctactgccaacacaactacttcttttctcttttcacaaataccttcttttctctctttgttggttaattgagtagggtattctagtgaatcgtacctgttttccgacaggaagctttggctgaaaggataggaatagctcttgcgcaaggaatataaatagcgtacgcgtactagtccagggaataaaaaatatcttacctgtgagggggaggcaaaagggaaaaagctagtattttgaaaagggtatagtagctggtattcggattgagcagtgccataaaaagaaagcgttgttgtttttcctgttcaaccaccccaacctgtaacgtataac

SEQ ID NO: 91763 - DNA, 11793 bp, Oryza sativa
caaagatatgctctgctgtttatcttttttatgctttgtaatctaatctatagaagtacagaatagccattactacctttgacattaactgcaaccttctgttatctgttaattttttgtagtttggtgcttagaagattcttttttttgttaacatttgtttgcttgatatcacacttttatgtgcttagaagtcatctcacacatgtcaacagttcctggaattaaaatggattcaagggctaaacgtcggaagcgggaggaagaggatgatgatatgattcttttccttttccctgctgtgcatcttttggatagtggtggtgggggagagagaaaacacctaggcatgcatcaacccagactggtgcagaaaaagtgacagaggtacttgaagggcatgtcatgaattgccttgtggcgtaccgtatggaaccggaggtcttcaaaagtactgcagaatttctaagaaggaagaacttggtccgtgacactaggggagttagagtggaggaaaagcttgctatgttcatgtatatgctatcccataatgcgagctaccaagatatgcaatatgaattcaagcatagtggggcgacaatccacctacatattagggcatttttcgatatagtccctactctcacccatagattcattaagccgcctcttgcaaaccaaactcattcaaagatcacatcaaatcctcgcttctacccatacttcaaggtgcaatactaacttggcattcatgtataataaaatattttatttctaaaattaaatcttcttatgtgtttatattattcttgcagaattgcttaggagcaattgatggtactcatgttcctatcactataaaccctgagatggcagctccatataggaatagaaagagcacactaagccaaaatgtgatgttagcatgtgattttgacttaaacttcacattcatttcttgtggctgggagggatctgccacggatgcccgggtgcttaggtctgctcaactaaatggttttcgcataccgatgggcaagttttaccttgttgatggtggatatgccaacacgccttcattcctcgcaccttaccgtggcgttcgataccatcttaaggagtttggtcgtggtcaccggcgcccatcaaactacaaataattgttcaatcaaagccatgcattattgcgtaatcacatagaaagggctattggagttttgaagaagcgcttcccgatcttaaaagtaggcacactacaccctattgaaaaccaagttaggataccagcagctgctgccgtatttcacaacctgattaggaggtacaatgggaatgagggatggttggatcttgatcatcagccacatgatccacaccatatatcacctgaagattttgttgatgttccagcgggaggtgatgagtatggcaatgatgtcaactcactgaataatcaaactcatcaaggaaatgttattagggacaatattgcaatggcgatgtggaatgattatgttcatgatcattctaatctagcatgatatgtaatgaaatgtgatgtaataaatgacttgtgtgttttcatgataagttcccgcacatttgtttttcaaaaggacaaattcaagataaagaaaaggagcttaagagagactacaggtgcttgaaagatgcaagaacacaaagtggggcatcttgggacgaaaaactcgggatgattattgctgatgatcctgcagtttgggataatattattcatgtaagtttcttgaactattgaattccgtgcaattgttgaattgtctctcctcatatatatcttgttatgttctgtcatgttcctttactttctatattctccttttgcctcataattaactcagtttctttttcatctctaaaacttaacagtctttccctcgagctaagaagttccgcaacaaaccatttccaatctttgaagctttaggagaactatatgatggtaatttactaattctcagatctatccataaaccattcgaactacttttcacttagttatcggcatgcatttcttttcttgaataggtcaaactgccgagggcctcttgaactttacatcccttcagccaacaaatacactagatcagtcaagaaacacagaagatgatattgttacacaagtaggtgctgatgatttgctgatggagaacaatcaagatgacctaaacaatgatgatccaatcacagcaagtgaacaatcaaaagttgaagtgtcaaatcagttaaatcaaagaagacaaactgtcagtacatcaaggaaacctcctgaggataaaagagagaagaacccaaaaagacataagcaaaatgggaatgtggctgatgcaatggagaaatacatagagctgtgacataaacaagctgaggaggaaatggtacgggaaaaagaggctacaaagcaagttgatgaattttcaatcaagaaatgtatcgatgtcttgagcacaatgaatgaactatcccctgaggaaaatgcccggtcatttagtgtttttaaggatgctcagaacagagaaatctttatcagtgctaatccaaccgctagaattttgtggctgaaacttcagatggtgagtaacatttctgattatgatattttattttcattagtgtcatcttagcatgctgtcttacttggttgacatttctgatcccctacttacctggttttcttgtattggcagggttgatttacatgagattgggtgcttttgtgaggtatgttctgcctaaagtttcatttatgttgatatacatgaatagcatgatgatagtgatcagccttttttcatttctcctgtagtcctgttgagcttgacattgttgtcatcagtccaacttctctatactttttttttatgctttactgtcggcattaagctaccatagtcctgctatgtcatatctttgtaaaataaacttatctgtgggccaacattgttctcctcctaatgtgctgtcattttctggatgctgttctacattggaagttttctgttgttgtgatcacctgtaaaaacttatcagagtcttgtttctggatgctgcaacagctgttctttggctgccgtgtctgtgtcttttttttaatcttttcttggggtcacaatgctcatcattttctcctctcaggtcatggagctaatattattaggtgaagatcaaatggtgtcaaagataggacaacagtgcatgcagttaccatcttcatttcttaaatttgtggacaaatcgattttggaacctgggaacctagtttgtggttgtactcagtgttctaggtgttaatgtcacttgctaatcactagaatttaaatgcgtggggtacattggcaactactatatatgcttgtaatattgtttggagggcacagattgacttaccacatgcgaatgtcaactgctacattgaatagcagtgttaactatcgtttaaaagcttgtcagtattttcattttctttatttaatgaactattttcttaattttggttttcttctgtacatgccattgtagaaattagttatcagctcttttttttttttgaaatttcgtattattttgtgtgattttatagtttgattctattcgtaagttgagatgtgctatctatgctcagtttttattcaaagagatgtgtttgccctgctttccctgcttttcccctgttttccccatccgaatagcatgggggtttaacacccaacgtggaagtggattgggtggtgggaggggatccacccaatcctggactggtggtgtttcccccagggaaatccctccccacgtgccgaacgaggcctaaccgatcgagggggcgcagccagtgacgggaagactccaccgccgcgccacgacctcgccgggatcccctacgaccaccactgccgcgcagcaccgtcgctgtcacgaccaccatcaccgccgccgcccatgtcaagcagagcgacgacaacgacgatggccgggacttcctcttcatccaacgtgtcaaccggtcacatccctaaaccctttcccttattctctattgttgttcaatcatccatcgcaaatagaaccacccgactagatctaaacctaggtgatctaatagacaacactaacaatggtatcagagcaaccctagtgtttagattggttcgggaaagaaatccaaagagaaaagcaaagaaaagcaaacgatccgacggaacgaaaagaaaaaccctaaccctaatcttacctcgtcgccggccgtcgttgacgccggcaacggaggggggaggggcaaagaggcaccacctaggagcaactcgacggccgtgcgcgcacccgcgggtgcacgcgcgtgccggcgaggggggccgcggcggcgccgccatctccttcggccgccgccctctttctctcacttcgcggtgggggctagagacggtggggggagaagagaagagaaaagaaaagatggcgccgccgtgtttccccatccaccgccgtcgccggccgtcgccgaagccggggggagacgagagggcgccgaccacaccgtcacaaggccgctcgacggcggcgcgctctgcctagggtgagcacgcgcgccggcgaggggccccgcgacggcgccgccacctcctccggccgccgccgatggcgccgccgctccggtgtagagagaggagggagagaggagaagtgaaatgtgcggctagggtttggccggttgggaggaagggtttttgtttccccgaactcggcggctgaccgtccgatcctaaccctagcaaatggatggccggatggtgacggtcggctggtggccgcgggccggacgggccagaccggccaaaagtccactttaggtccctcggccgaaagaaagaaggaaaagaagaaaaagaagtttaataaaagtccctcggccgaaggaagcattttcaatatgtttaatgattgtgtttatttctaagcaatttgaaccaacgtgaaaattgtttagagaatagataaatgtgagaaatgtttctgaacaggtattttgtatattttcatgcaaattacaatagaattttgaattgtttttcaagttttacctctgtttaaatttgaaccaacgggcgaatttttacagagagtaaacaacagagttttgttattgtttatatgaattgtatatagatcttccactgcaaatagatgaaattgatgaaaattagtgtttctaaaattaaatttcgaaccaacgggagaatttgattttaggaacattaattatgtgctatgatgttgtaattttctgaccaacgttgataattgcaatgttatagttatggctctatgtgttatgtctattttctgcccaacggtgatgtagacttaatacataataattttaatgttaattttgttctcacaatacatgattatcttaggtggctactccttgatgggttacattaaagatattccgaccctgaaaggagataactacgaagaatggaaaagagaactcgaccttgcttttatcttgggacaggtggactgggtgttgactaccccatgtcctatggaacctgctgaacttttcagaggtgaaaatgagtcaaatgctgaatggcaaaagagagagagggacaatgcttccctcatcatgtcgtatgacattgagcatacgaaatggtccttagccaacaagaactgtttggctacggtaaagaacacgattgagccaaccaaattgggctcaatcccagagtatgacaccgtctctatgtacctcgaaagtataaagagccagtttactggttcttcaaagttttatgcgacacagctgataaagtagcttgtgacagagagataccatggaggtggtgtaaaagactacattcttaggatgggcaacatggcttctaagttgaagcaaaaaagatgtgggcatctgagatgactttctggtccatctggttatgtcctctttgccaaagaactttgacaaccttgttgtcaactacaaaataaatccagaaaaatggaatattgaagagctcatctctaattgtgtccaagaggaggaaagactcaaagagaccaatggtggctcctttaaccttgttaaagataaggaaaagagccacaggtcaccatcctcaaaagaaaaacagcctcaacatctgcctcagaaacaacagttcacagttgagacaggatcagtgtctccactgcaagaagacaagacattccaagaaagatcgtcctgacttcctgacagtgatcatggcaaagaaaggtgagaacattattacatttgtaaatgaatctcattatgattggttattctagatccacatggtggattgattctggagtaactattcatgtgtgtaattgtttaaagggattccgttcaatgaggactacgcaaagaagtgaaagatccattagagttgccaatggagttgaagcaaaagttgaagctgttggagatcttcgcctagaactcacgaatggcttcacacttttacttccagatgtttttatgtcccttctttgcaaagaaacttaataataagtgtatccaaattggattttgatagatatgattgccattttggaaatggcaaatgtgaactatggtataataatgcatgtattggtcttgtgttgcaagatcagctttatttgttatctctttctgagaatgtgaatgttgtgtcctcgttgacaaaagaaaagaaagcgaactcctgatgtctcatcgaaattatggcattgacgtttaggccatatttcgagggggagaattgagagactggttaagaatataattcttcctccattggagttctcagctttagaacaatgcatacaatgcattggtgcccaaaacaccgtatgagctatggatcctccgtgtgtgtgggagtcctgcagaggccaaagtatttaacccaaatcttgggaaattgaatcccaaaacagtaagctgccattttattggctattctgaaagatcaaagggttatcgtttctactgtccaaacagttgtacaaagtttgtagaaacgatacacaccgtcttcttggaagacgaaatgattagggggagctcggtagttcgagaaattgatcttgaggagaggcggatgtctgtacctgctccgtcgactcaggaacctttcttctctctacctactaatgttgtgccagcaatgcatgccattgcggtaccaacacctgttgttatctctcctgtggcaacaatgaatgaaagtggggaacccattttacaggattcaatagaaattattgccacaccagaggaggagctgcaacagcctcaaacagataatgtgccaaatgtggaggcccctagaaggtcttgaagagtcagaagatcggctatccgtgatgactatcatgtttataatatagaagagtcgcatatggaggatgatcccacctcatataaagaggccatgagaagcgctcgctcatctgaatggttggaagccatgaaagatggaatgaaatcaatgaaattaaatgatgtctgggatttaaaagaaattcctaaaggagccaaatcagtagggtgtaaatgggtctacaaaaccaaatatgactctagagggaatgtagaaaagtttaaagcgcgacttgtggcaaaagttttcacgcaaagagaaggcattgattacaatgagacttttctccagtctcttgtaaagattctttcatgattataatggcactagtggcacattatgatttggaattacatcagatggatgtaaaaacggaatttctaaatggtgatttgaagaaaaaagtatacatggcacaaccgaaaggtttcgtcatgaaaggaaacgaaaatataggatgccgtataaagagatccatttatggattaaagcaaagcttcgagacagtgctacttgaagtttgatggaacaataaagaaatttgggtttttcaagagaatatcgaggacaactgtattgattcaaagttaagaatgggagattcattttcctaattctgtatgtagatgacgttctactggctagtagtgatgtcaatctactgcaggaaataaagaaattcttgtcctcaaattttgacatgaaagacctcggtgaggcttcatatgtttgggcatagagattcaccgaaatagaacatagtatgcattgggactttctcaaaaggcatatataaaaaaggtattgaagaaatttaacatgtatagatgcagtgctacacctgctcctatagtcaaaggcgaaaagtatggggcatcgcaatgtcccagaatcagtatgagctcaatgaaatgaaaacaaagccatatgcgtcagctgtaggaagcctacagtacacgcaagtgtgcacacgacctgacttggtatttgttaccgggttacttggcagatttcaaagtaatctaggcctagagcactggaatttggtatagaaagtcttgcgtgattacaaggaacaaaaggcctcatgatgtcttacagaaaatcagaatcgctccagatagtggggtattcggattctgactctgcaaaagataatacaaagtcaacatcgggatacgtgttcaccctggcagtaggagctatttcatggaaaagctcaaaacagaccatcactgcagggtctactatgtatgccgagtttatagcatgctatgaggcaacggggcaggtgaactggctaaagaagttcatacccaggtttaaaggtggttgacagtattgagaaaccactaaagttatactgcgatagcaaacccgcagtaatgtactctcacaacaatcagtcaagtggtgttgccaaacacattgacataaagtactatattgtgaaagacaaagtccgggatcaaacaatcagtctcgagcacataagaacagaaaggatgctcgtggatccgctcataaaaggccaacctcccaacatgttcaaggaacatgtagcatgcatgggtttaagggaagccttatgaatcctggactatagggcccaaaagttaaagtatctgtttctaaatagagatgtgtatagtggctgtcgaatccatcggtaattaaccgtgacgatgaaacatgctctatatgtaaatctgtgatggaatagaaaaagctaaaagaaatagtgagatcaagggggagaatgttagatagatctccctccccttgagccgttaggctcaagggggccttgacccgcgccctgatcgggggcgcccagcccaatggctgatggccccccgtcacactgtgccatataaagaggggtggaggacgggacgcacatgacacgaggttcgtcgccgtcgccactccaccccaaaaaccctaaccgatcgaggggcgcagccaatgacgggaagactccaccgccgcgccacgacctcgccgggatcccctacgaccgccactgccgcgcagcaccgtcgccgtcacgaccaccgtcgccgccgccgcccgcgtcaagcagagcgacgacaacgacgatggccgggacttcctcttcatccaacgtgtcaacctgtcacatccctaaacccttcccttattctctactgttgttcaatcatccatcgcaaatagaaccacctgactagatctaaacctagatgatccaatagacaacactaacaccccaaagtaatggattacttgatcgattgctccagaacagcataatacctttcattgttatgattatttcacctgcaataaaattgggcatcaggatttacctttacctcccccacaaccccacatagatagctgagtcagaatgcacatgcacaggaagaaaaagagagaaaatgttaagaaaattgcacatgtacaggcgtacagcacattgtgaaggaaaccaagattagagaaggatgggagccgcaggaagccaggaagagcaaaggcaggggacgatggggatatggatggtatagacgtatactccaaactccaaaatcgaaacgaaagagacgcacaactaagggcagaatgaaactctctacattactccctcgtggatttcaacattttgcttatactgtttgatcattcgtcttatttaaaaaaatttaaaattattatttatttatttttacttattttattatccaatgtaatttgagcacaacttttcgttttttatatttacacaaattttttgaataagacgagtggtcaaacagtaccagcaaaatgtcaaaatcccttatattatgggacggaaagagtacattagttagacttatttatattacactcatgccaagtaaactgtaaaactggtatcggcttacttaatgaagcatgttatgcatcactgcaaaacttcaatcatcactgcaaaacttcaatcaagtgaattaacaaagatccttgtgagataatacacataaggtcttcggacagattactttcaagaaacagaaataaacagggggaggtaatgcacatatactccacatgaatcaaagggtctaccataagcacacagaggacaagaagatacagaaacaaagaaatgtgatttggagagcagcactagtgaactgccgagctcttctggagtttatatacatgtaagtacgccattgccctaacctcgatgctagcttgtacaaaacctgagaatcgaaaaacatcttgctgctccagtttggaatctaggaagcctggggggtttctagaaggcgatacatggtgatctcttgctgcttgaagtacctcctatcttcctcatcaacaaggaccagattcaggtagtacttgacgctgaacttgttgtttatgttccgatacgaaggggtcagctcgtaaggcgtcaagaatagcctcaccgggatggattctcctggaaaaaaaaaaaacagttacctcaagttcacagcaaagcaatatccttgcaagcagagagatcatgcaagaagctaaataccgaatatcactactcactagaatgagaagctttgaacgttggcggtgctgaacgaaacggaatatgacggttataacttttacctctataaacatcggaaggaaatgttgatattactttatgcaccacacaatttgctttagtattaattaggatccttgcagccagtcctacttcaagtatacatgggatcaagttggaaagttctcaagtgaatgtttagctctactggggctgatatttcctaaatcataattaaagtatataggaattgtttcaagcagggaaagtgcacttccacagtgcatcgtgataattgagaagaaacccctgcaggatcactaaataactaaaatagacttgcatctacagatctaccagagtatcatataggcttgaaattcattaaaattcatgtgttttgctgttttgcaaacgttactaccaagctttgagtttaaggtaatcagcaaattgttgcaactatcataccacaaaaaagattcatgaaaagcatgcaaccatgtggtccacaaataagttatttataactccaaagcatgtcactttaaatatcaagcaacaagacaaggatcagcatgtaaaggaactgtacattcaaaaatatattaaaaatgaaaaaaattacaaaaacgtacctctgacaggagcaccatccatcaactcaaactttgcaagagtttcagtctcaacatatgcactagagcctgctcctgttgattccctacgacgtacttctagttccatgttttttatctttattctgacaagaag

SEQ ID NO: 91764 - DNA, 589 bp, Oryza sativa
gacacacatgcgccattgcccagttttcttccgaactagaaccgggttagccagccagtcgggatgaaggacttctttgatgaagcctgctgctaacagcttggttaattcctccttgatcgcgtccttcctgtcttgtgcgaagcggcggagtcgttgtttaataggtttagcgtcttctttgacatgtaaggagtgctcaatcacctctctaggaataccaggcatatcagatggtttccacgcaaagatatctttattattttgaagaaaggtgacgagcgcgctttcctatttacaatctaactcggcgcctattacagcagttttagtgggatcagaaggatctaggggaatttttttagtcttggcttcgccttctccgctctttgagaccttggtcgcgggcacttctccttcgcttgccgtggttgcagccagtcggatatcttctcgggcagacgccatctcgcgagtctgggccatctcgcaattttccttgtcgcatgtgacggcttgcttgatgtcgctccgtagagataggactccccggggaccaggcatcttcatcatcatgtaagtgtagtgc

SEQ ID NO: 91765 - DNA, 1696 bp, Oryza sativa
gggggtggaagcggtacgccgtgtcatggaagatgtagttgtggcgctcccgcagtctggccatcatcaagtaggctgcctcctgacaggcgtgatctgctgtgcctcctgacgcctcaactgccatgttagcgaggcaagtccccacgtagccatggacctccaagctgacacggtgaggaagctcgccactgagcggtggaatagtcgtgtactccggcgcgttggggtagcccaccaccagtgtcatgcgtgccaactctgccacaaagtcgatcatgccttctccgcggtggttgggtgggtgaccggccatctagagaagacaagtgagtaggatcaatgcatgctcaaatccaaatttaaacaaagcaataaagactcaaataagggaatcgaataagagcgttattttatgcatagatcagtttgcataagagcgaataaataagacagactcacataacgataaaataatgagaaattagatacatactaataataacaaacaaagcataaataccttgcaacccatgttactgagctaggacctaatgcatttcacccatcaaatcccaactgactgacgaataaatcccaatagttttactaaaaccctagactgactcgttttggcaaatcccacttaaatgagcgacaagatttttcccttgaaccacaagaacagatcccaattttcccggaacaaatccaattgcaaagaacatatgcaatgaaaaggattcagagggctcttaggtttttttccatttggcttgtcctacggtcaaggtcggctctgataccaacttgtcacgcccagaaattcccgaatagaattccaagcagaatgtgcattaaaatccccgtccaggaccagccggggtacacaaacgacaatgttgacatacagatccacgtcttacaaacatcataaagtcttacataaatgcagcggaagaaaagaaagacaacaggagctaagccttgactaaactttgactaaactgcagcgggaacaccactccacaggcatcctcgacggcacggacgaagcctactcctcagagaaaccttcatctgacccgaactcgaactctggggttgggaaaagtagagcaagactgagtactacccactgtactcagcaagtcataccggaataggggtatgatgcagggaaatcatcaaagaagagctgaagtggttcatttgcataaagcgagcatttataaacagagattgaaagatttaaacagttgtaataattaattaatattaactatccactgtccaacgctaacccacgttgcgacaggcccaaccatccacctaaactatccaaattaaaggattacactaaggtgaaactaatcacggtgaatctggttgaccgcccataaccgcgggcacggctattcgaatagttttactctgatcagaggtgtacaactgtacccacaagacacagccccacgacacgtttccgtgcgccgacatgtcaccacgacataccggaaagaggccgtgacaggaccattcgcatagccccctctaaccaagcacaccacacctcaggtttcacccccactcctcgcaaggcagcgggcagtcccctctcgtgcctaggtgaatccggaagccgcataggccatcgcaggacccatccaaactccatcacgcccacccttgcctg

SEQ ID NO: 91766 - DNA, 985 bp, Oryza sativa
aaaatcaaaaccggtgcggatactaatttcttcttgagctcctcaaaactcttatcgcactcagctgtccacttaaacttctcatctttcttaagcaactgagtcatgggtcgggcgattctggagaagttttcgatgaatcggcggtaataacctgccagtcctagaaaacttcgaatctgcgacacggtcttcggtgggatccacttggtgactgactctacgtttgacggatcaactgccacaccctgggctgtaatgacatggcccagaaatttgacttccgtcaaccagaagtcacacttgctgaacttggcgtatagctggtgctccttcaacttctcgagtaccagacggagatgttgctcatgttcttcctcggattttgagtagataagtatgtcgtcgatgaataccacaacaaacttgtccagaaattccatgaacactttgttcatcagattcatgaagaatgcaggtgcgttagtaggtccgaaggacataacggtgcattcatatagcccgtaccgagtggtgaaggccgtcttcggaatatcctcttcccgaattctcaactggtggtagcctgatcgcaggtctatcttagaaaacactttagctcctttcagttgatcaaataaatcgtcgatccgcggcaagggatatttgttcttgattgtgacctcattgagtgcgcgataatcaacgcacatcctcttcgtcttatcctttttctccacaaaaatgaccggagcaccccaaggtgaagtacttggtcgaatgtaccctttctgcagctgctcatcaacttgcttcttgacctctgctagttcgttggctgccatcctgtacggtctcttgtaaattggggcggttcccggtgccaagtcaatccggaattcaatctctctcttgggtggcatggtagtgaggtcttcggggaacacttccggataactcgcagactatgggtatatattccatt

SEQ ID NO: 91767 - DNA, 505 bp, Oryza sativa
cactttgttgtgatcgagaaggtgttttgcgccatagcaatgatcctcggcgacggcatcttccagctcgtcgcgatctcgctgaggacgatacacacggtgcgccaccaccaggtagcggcggagacgctcaggtccttctccgacgtcgacgccatgccgcggccggtgatgagcttcgacgaccgccgcaggacgcaggtgttcctcagggagcacatcccgagcaccttcgccatcagcgggtacgtcgtcctggccaccgtctccaccgtcgtcatcccgctcatgtacggccaggtgaggtactaccacgtcgccgccgcgtacgcgttcgcgcccgtcctggccttctgcaacgcctacggcacgggcgtcgcggagaccaacttctcggcgcagtacaacaagctggtgatcctcatgttcgcgtcgtggatcgggatcaagaacggcgggatcgtcgggagcctcgtcatctgcggcatcgtgtcgtccatcgtct

SEQ ID NO: 91768 - DNA, 781 bp, Oryza sativa
ttcctgcagccctgtgaagtatacaccgatcacaaaagtcttaagtatatcttcactcagaccgagttaaatatgagacagagaagatggttggaactaatcaaggattacgatcttggaatccactatcatcctggtaaagccaacgtggtcgctgatgcgctaagtcgcaggcctattgcaatatagctcaaatacggcctgaccaaggtcaactgtgcagagaattggagaagttaaggctgaccgtggtacagtcaggagtccctgccagcttgacagtacagcctaccctagaatcgcaaattcgggaggcacagaaagaagacgaagggataaaagagttaatagaaagaatacaggagaagaaagacaccaacttctccatagacgatcaaggcacagtttggtacggtccacgcatctgtgtaccggccaagaaggagttaagagacctcatcctaaaggaagctcatgagtccgcctactccattcacccaggaagtacgaagatgtaccaagatatcaaggcatacttctggtgggctggaatgaaacgagatgtcgcagaatacgtagccctgtgtgacatttgccaaagagtcaaggcagaacaccaaaggccagctggactgctacaacccttaccgattcccgagtggaaatgggaagagatcggaatggatttcatcaccggtttgccaagaacccccagcggatacgactccatttgggtaatcgtggaccgactcacgaagtcagcacatttcgtgccagtgaa

SEQ ID NO: 91769 - DNA, 771 bp, Oryza sativa
actgaattgatcacatgcactatttgggggcaatgtaacatatggattacctcaagtggagttccacaggcaacaagtttgactccattatcacgacagtagttcaaaaggggttcatactcctgccagcgctctggtgcccagtgagaagtgtacaaccttaagttgttgccatcaattctgagcaaagaatgaattttcataaggtaagtgcacttgatattatcataagcagcattcagacattaattcatggccatccgccatcatgcttgcaatgtagtaggtacatatcaattctagaaaatccatttggggtggccggttggaacttttacagtacaacatttgtttggtgatgttgctgcaaggcaattttagctagtattgtggcaaggtttccacaaagtttaacgctacaatctaatagagcctttaacgctacaatctaatagagcctaagtaatctcagagctcaacacaaactacagactgacaagtactaactgcacttgaatttgaaacgattaggactcaaatctctaaaaactcaaagctacagataaatcacaacaagagcccatcctgtatatagtcagtcagtcagtcagctagataactagactaataagtacaactgtagaagtgtagaacaaaacctcctgtccatgaactggttgagctgctcctggaggttgcacgggaaggcttcgagcgcaagcgagatgctccttccggcctcggcgcaccgtgccgccagcttcctcacga

SEQ ID NO: 91770 - DNA, 768 bp, Oryza sativa
ttcctgcagccccagttgtacagatcaccaggctgaccgttgatggtgtacgcgtcggagatgttcggcgcggcgccggtcctctgagcctccctgatgacttgatcgggtccgcgtcccaccattcccctgtccatcgtgccagtgccaacattttcagtgtcagttcagacgactgatctgatagttaatatgcagatctgtgtacaaaagtaggaaggatcaagactgaccgagaataagggggacttctcgcgcgggcttctcgaaggggtaggtcttgttctccctggggcggatgatgagcgcgccgtagacggtggccctgagccaggagctgtgcgcgtgccaccacagcgtgccctcctgcccctcgatggtgaaccggtacttgtagctgccgcccggcttgatcgggcactgtgtcacgaactccggcccgtccgcccaccccgtcctgaactgccggatgccgtgcctgcacgcgcgcgttgatcaccatgtgttagctagctagatctcgaccggcggcgcagaaaacaacaatcgtcgccgttgacgaccaggagcggaagtcgttagctgtttgattggtgtacgtagttgggtcgacgacacgtaccaatggatggtgacgttgtactgcgcgtggttgacgacgttgatcaccacggtgtcgccctcccggacctccagcgtcggccccggcagctgcccgttcaccgtgatcacgttgtgtgtcttgcacagcctcttcaccggcgtctc

SEQ ID NO: 91771 - DNA, 836 bp, Oryza sativa
tccggtgtttgcatagtatggggatcgttggtactaggatatatgcgagattgtagtaaaagagatggagacgcagatttttatacaggttcgggcccttgaattgtcaggtaataatcctacatcctgttggccgaagccggtattgctcttattcaccataatcacaccagtacaatatttggggtagcctatctaactgttgtcgacttggcggtctgaagttctgactcgtagtcgacaacagggtattcttccttctcgagttcgtacccagcgagatcagagacagcgctagatccctacggctggcctctgtaggtaccagatagggtcgatctaggcatatctctgatgtcgatgtccggcggcttgtcttggcgtatgttggcttgtatatcgatcttatgtcttgatctattgttcgtgtcccctctcatcctagggggccttgtatttatacccatagatgtccccttatccaagtagaactaaggaaaccaatatggatacaatccgagcagtccatgtcgtttctatgcagaactctattcatccttccttatgcggaactcctcctatatggtgggtcctgtcaagatttagtcaactactattattaggtatgtggtatctataaccctgacacaagtgactttgcgtaatctcatcattcatttttatttaaattggcaggcatgttatattgaggacattagatcaaatgaacatctacggacttaattgtatgcaaaaaaaaccataagtagtgtaggtatgattcagacaaaagtttgagcttacaaagtagggtaccgagctcgaattcgcctata

SEQ ID NO: 91772 - DNA, 512 bp, Oryza sativa
cgttacatcattggcaaggacaaaaggttcgtccaagtatccaaccttgttaagatcaaccgttgtcatctcactgcattaatcgttacgcctccaccagtcaatttaaaccagtggcaccggaacagagggaccttgagagatccatagtcaagttcccatatgtcctcgatggcaccgtaatacgtgctagttgtaccatcgtgtcctatggcatcgatacgaacatcactgttctggttcgtgctcttcatgtcttgggccctcgtgtagaatgtgtacccattgatttcatatccctggaatgtcgcgatagacccagatggtcccctcgccaggaaggcaagttgttggttaatcgtctcgttacccatgagatgttgtcgcagccacgcggggaaagtatcaatgtgatgccgtgtaatccatgcatcggacttaccgatgtttctggcgcgaactagcgccaagtgctcctcgatgtaaggagctaccaatgaagattgttgcag

SEQ ID NO: 91773 - DNA, 4142 bp, Oryza sativa
tcttgcttcccctgctcaatttctgattttccttgcacctacctcggcattccgctgtccattcgcaagttgccgaaggcgactcttcagccgctggtggacagggtcgctcatcgcctaccaccttggaaggggcgtctcaccactcttgctagccgctccgtgctggtccagtctattctctcctccattccagtccatgtgtctatggcaatcggccttcctgcttgcgttgttaaggccattgacaagaagcaacgcgccttcttgtgggcgggtacggatttggttcatggggggcagtgccgggtgtcctggacgaatgtctgtcgtcctaaggccttcagtgggttaggaattcctaacctcaggttggcagggttcgccctgcgcgttcgctggctttggcttcagcgttccgggcatccctatttgggatgtcttgaaggcctcggtcgagcgatctgtctccaacatgttcgaggcgtccaccttcttcgtgccgggggatggtgagcctatgctcttctagaccgaccattggattgatggaggctgctcagtggcctccttggctcctgacctcctcttcgctgtgccacagcgcctccattcgcgcacggttacttctggcctggcgaacaactcctaggtttcggacatccgcggggccctcactgtccctgtcatctcccagtttcttcttatctgggatgctgcgcttcgaattcagctctcgccgggtgtcagagaccgtcttgtttagcgttggacgagcgaccagcgctactctgcgcgttcagtgtaccaggccttcttttttggccagcactcctttgcctatgctgatcttctctggcacgcgaagggtcctgctaaatgcatgttcttcctctggtttgcatttcagcggtgctgctggacggccgacctcctcctaaagcgcggcttggatagtcattcggcctgccccttctgcggtcaagagcttgagacagcgaaccacatcctcctcgattgcgtgttcgctcggcaagtttggctccgtgtgctgtcgcctcttggttggactgccctctctcctccccggggtagctgggtttgcttggtgaccttcttctagggtttgcttgccggggcatctccgagccagtttcgattctatggtcctcctggtctcttggcaactatggaaagagtggaactctagagttttcgactctgcgttgtcattggtctcggaggtccttgagtccatcctctctgagggccacctttggtctttagctggtatcactaattttggggttcttctgggaaggtagtggctctgccccctcccagctatttggagttgtgtgtagccgtcacagtagtctttcgtctcttctttattttagtcttttttccccttttcttggcataagtcggactgactgtttgcgtcgtgtaacaaacattctattcttctaatatattgacatgcaatccttttgcgcgttcgagaaaaaatacacacctgttttcttgggggtggcaaatcgttggatttggaggtgtcaagaaaatggggatcgtaaaatttagctagctagtatcaagaatatagcgtgcagtacaattttgccaaaagaatcttcaaagcatacattattgtcatcgagttcagatcgactcaaaagattgttgatgctatatcgagcttaatagttagggagtgaaacaacagggtgagctatttatcacaaagagttacgtgcgctagctatgtgcaaatgacttaaagtgtactttaattttccattgatattgttttgctgcacagagaggatgagtgcttttttacttgtcccacttggaatctaaaatttatctagtggttcttctttaaccatgtaatttactatgtgttctaagcaggtattacgtccaaggtcctctttgcctgtcataaaaacacacatatacaaatcgtaatgaatgatctgctataattaacacatttattggtaccaatgtgatcagttgttacgttatagatacagttactttgttgcaatgccttttattgatgaaatatttatggattggtaaaaatatctggtcactgcatgaactggaaaatacaaacaaaatagaagaaaacaaaggtgaaaaaagtatcatgttgatgattttaatttgcaacaatttggtctttaatttgcagacaatttataaacgatgacaaagtaacagtctccagaacaatcattatcgtttacatgccgatatcatcgcctcatccataccaaccagttttgttcgtctggttatcggaattggaagcaccaggaaaatggagatggaatatggagccacttctatagttctatatattccattgacttttgatactataatattggatgtttcagtacgaaatgtggaaataaatactttgaaagtagtcacggcagcatgttagaagtgctaagcaagatcaaaattattctttgatccgcatcgatcgatccattccaagaaatatgatgaatcggaaagaaaatagaagaagaaaataactaaagtcgatctattacaaacatgctactggaaggattgttcttattatttctggttaagctgtctcttttttaacggactgctgatagtaataagctatttcaggtactatgcagtacatcatgaacatgaaatgttgagttaaaaccctttctgatttttgctattataatttacaaaccataactctagtcttagaaatgaaaaaaaaaagatgtttccatctccgagaaactacacagcagtcagataacaaaaacattcaccaccctgaattttgggaacctaatgcatgatccaccatcgattgatgtgtatatgctgtaaattttagccaccacctgtttgaattgtgtagctcccttagtttttgtcaatctttctatttcctcctgagatcgagtcacgcaaaagttgggccgatgatcaacagagaaatcatagaaagcagactaatacctatacataacaaaatgaacaagctgaacattacttggctcaatacatattacgatgcatatactttccacacttgtgtcctcttttacgctgctgctgtccttcttgtgctgctgcagtaggaggtgggaggaatctgaacaggggaagaatgcagaaagacggatcagtaggttggtttctcctattacgagttggtcccgattgaggtaattgatctcttttaatagttttgccagccctgatgacgcggtcgtgttgaatctaagaatcacggtactctgttttaattctgaaaagttcagttcagtttagatctattttttcatggtcttagaggctgtttatatatggagaaatgctccatacaaaagttgtagaaatttctttcaagtgtatgtttgattgtaaaaatatcccaggataggatttaaccattcaaattttcagtgtatttgattgattagcaagggtgaatgacggctgatacagcgaatattccattaagatgttgggtaagctcatccgtgaaaattgctggataatactatcgactgtagttaatcttgatcattactaataattaattagtgacagttgaatcatttcgttgttaatcagtaattaacactggtggagaagtagtttttactcccggttcgtaaccccctttagtcccggactacaaatccgggactaaagatagagccaaccaggactaaagatagagccaggctgatccccggctgctcttttattctattcttttcttcattgtttttaatatattgatttcactccatccccatccccaaaatcccaaatcaattatcacctccaaatcctcaaatcgatcatctccaaatatatcacaaaatattaaataaaaattacatcacaacttctacaaaattcatcacaaatacatcacatattcatatcacacacaaatcaaatacatcgatcacaaattctcaaaaaaaaaacaaaaaacaaaacaagccgccatcttccgcctgccgcccagccgccgccttccgccttccgccggccagcgccgcgcgccggccgccgcacgaggccggtgccgcacctgcagatcggggatgagtgggggg

SEQ ID NO: 91774 - DNA, 2288 bp, Oryza sativa
atttggtttgataggtggtgggcatactcgcatacgtagtagccgcataagttagttccctggtcctgctttgcacactacatgagaaacgatgagagatttaatatactctttatattaattgtaattagagattcaatgcaatataattttggatcatgcatgtactcactggaaaatgaaacctccgtccaagtttttctttccaagtcccgtggaccaattgacggaaccgagcccaagccgtacatatgcagttgcaagctatgattaattaattattacccgagatcaacataatagcaatagattccccgcgactttggaatagatggcattatattacctgtctatcacttggaagaccttgtcaaaaatcttctcctctttattcattgagtcgtacacagtgactctgtatgcgtccaagtcgaagaataacaggacacagtggaatctggaatatgcatgagatgagatatatatgaaaatgtacatgctatatgtatgggaacgaaatttgttcgaacgacaataaaaactcactctgtgttgtacggcagtagtatgtacgtcttgaaatgctgctgcgttaggagatggacaagattgtcctctgtgtctttctcgtacttgttgatcatttcggtgttgattttccgagggtcgatgaacccagtatcgtagaccctccactgtcaggccctttgaatctctattctacaacgatgaaaggaaattattattgcttacatatatgccaggagctaattattgaacgaaacaaatcgaactcaaagatactcacaaaatccatgcgctccgaagagagatgtcgagggcgtccagatggtatagatcgaagagatccttgaaatggatccagagaacatcttctccttgcaagaagtcggggtttctgatcctcgctccgaacatctctctacccttggcactcatttccatgtaccgtttatggaatttgtacatctgtgtcggtagggactgcagctgctcaggcctaacaagcggtttaccgagttcaaacttgtatgccacttccgccttcgggattggtgcgcctcgaatcagctgatccacagttagaccagtgtctgaaatgaattccgttatgccaaaatcttcgccggtcaccaacggctcgacctcttggtttggttgttctccaagctgagggactagtttagacttcttgtgataggctctctgaagtgttcggtcatagtctgatatctgtaaggcctccttgtttgttgcggacattcccttgaagaagttcttcacgctcgggtcaataggtatcatcttttcaggactccgaggcttgagttgcctcttcacttctcctgccacataagcatcaagctcctcttgactgcaatcgtatggtggctccttgtttttggtggcgtaaactttcgccttcttcgttgcccttgtgcgggcaggcgctggagcttggcaagaccttgtcttgggaggtgcaggcggacacggtggaggcggaggagacggaggagccggaggagatggtgcaggaggaagtggcggaggagccggaggagaaggtgtaggaggacgggcggaggaaccggaggagatggtgcaggaggagatggcggagccggaggagatggtgcacgagacgccgcttttcacccagggaggatgatgtaccgcttgcgccatagtataatggcgtggcttgtgtctcgtaaatgcgtctcaccgtctcctcctgggtagtccaactcgaagtcctcgtacgcggcttccaccagctcaacttcgaccctcgagtatcctgctggaatcggcctacagtggtaagtcccggaagggtccgttgggatggccattcccgacgccaccttcacgtgatgagaggttatctattagtaatcaacctaagcagcaacttgcggaatgtacaagtcaaaaatcatcaaactacgagcatacctttattgttcttgaagggaatatgcaactcacatggtgtccgctgcgtgatctcatcaacagggcaggtggtttcatcctgggtttgcatggcgtccattgaggcacagctgctacgattgcctgatgggctgaccattgcaggaggaatgtacggctggggatcctgggaccgatgtgcggccatacgttcaatcaccttccttgccacctcctcttgcatgctgagcttgtagctcgataccctgtactcaagatctgcaatcttcgcctcagtatctctcttgctcctcatccgactcctg

SEQ ID NO: 91775 - DNA, 727 bp, Oryza sativa
tcgccggggagtgcggcgtcaagtccacgatcccggggaatcccgatgagttttcgctgacctcctctctcgcggaactggtgacggcgatgggggaaatcccctccaacatgcggccaggattgcggaggagacgtcgaacaggatctacaccggggcgtgtcatgtcctcgcgtgtgtaaggctgtcgcgtcctgactcgatctgcgcgagatcttggaccagagggcggccagcgacacgcgtaaggaggtgatggaagaagtcggtgatctaggggagtctgttctccccctttttgaagagtaggacttcttgtatttcctagataatgtgtaaaacttgaactctgaccgccttcgtgcgtgcgattactatcccagcttactttggtatgctgacctcgggaacttttgtcctttctagagatgctgatgacgaggatgtccagcagcgcgggcagcctgagtcactggcaatattccggtactcgagtttgaaccacacgtctcgcctgaccatgtggatcaaccccttgatatagaggggatggcgacgacttcctcaggttagtagtcccttcaccccttaatgccctcctgactaggttagccatgttcccgaaagagatgtatagcttgacttagtggttattacgtttagtagatctcgagggtgcccttgctagccaagatcgtcatatccaatactggaagacgaagtttga

SEQ ID NO: 91776 - DNA, 708 bp, Oryza sativa
tcctttgttttcaatagatacacatagcaaaatctagtgcaatcatctatcagtgtcatgaaatatttctttccccctttatcaacacgccgttcatttcgcacaaatcggaatgaacaagttctagaggtgccaaattcctcgcctcagatgccttgtgaggcttacgaggctgtttcgattgaacacaagtatggcacttggaacctttgaccaaagtgaattttggaattaaactcatgttagctaagcgcatcatacaaccgaaattcacatgacagagtcgcgaatgccacacattagactcatcattctcgctaatatggttcacagcgttatgattattacacatgtcattcaaagaaaagcggaacaagcctccgctgtcataaccttttccaacaaaagtctcatatttagatacgacacatttattggactcaaacacaagtctaaaaccttctctacacaatagagagccgctaactagattcttctttattgaagggacatgctgcacgttcttcagctgcacggtctttcccgaagtaaacttcagatcgaccgtaccaacaccatgaacaactgcaagcgacccgtttcccatcaacaaggaggaacctctcccgacctgataagaagaaaacagagaaatgtcagcacatacatgaatattagcaccagtatccacccaccaatcaggtgaat

SEQ ID NO: 91777 - DNA, 612 bp, Oryza sativa
accggatgcatggcaacactaagcagattcgttgctaggatgggaaaacgaggacaacctttcttcgctctgttgaagaaacaagacaaatttgtatggacacaggaagccgaagaggcattcattgcactcaagcgctacctatcaaaccccctgtacttgttgctccccaacctaatgaagaattattcctctatattgccgccacgccatattccgttagcactgtcattgttgtcgagagagagagagaaagtacatcgaccagtttattacgtcagcgaagctctccacgacgcaaagacaagatacccatagatccaaaagctgctttacgcagtcatcatgacatcaaggaagctacgccactactttcaagcccacagagtcacagttgtctcctctttccctcttggcgaagttgtgacaaacaaagacgttgtcggccgcattgcgaaatgggtagtcgagctgagccagtttgatgtccactttgtgccacgaacagccatcaagtcccaggtactcgccgacttcattgccgattggactatgccagataacaaatcagacaaccaaggcgacaatgaaacatggacaatggcgttcaat

SEQ ID NO: 91778 - DNA, 1879 bp, Oryza sativa
tcgtgcccgtctgctaccgaaagtaagtactcacgtgtctatatatatgtaacgtgatatcatggatatttacgtgctgatcgatgtcatgctcacatcgtactaacatcgtcccaaaatattgctaccctagttctcgataggacatttcaaatccagtcttattataaagttataatccactaattctaatactcaacatgtaatcatgacacctcatcatccgctagcattaattaaaaataaaacttacgcaagcatgcaacattatctataattcattgaactctacaaatcaacatccaatcatcttcactcacattattcttcacaatatttttaacatatatatatatatatatatatccattatttttataatacttaacatatatttatccatataatcaatgtgcggaatatcatatttcatctacaaatctcatacagagtctactatgtattaatctcttaccatatagtttgacaaaccaattttatttgttgttaataactaatataaattttacttttagctcgattattaaaaaaaactttaaaagctctttattaattttcgcagcaaagtgcggggaaatgttccatcggaaactagcgcttagtacctagtattatatactacctccatattttaatgtatgacaccgttgattttttgtccaacgtttaaccattcgtcttattcaaaaaatttatgtaaatattatttattttattatgacttgattcatcataaaatgttctttaatcatgacatacatattttcatatttgcacaaataatttgaataaaatgaatggtcaaacgttggtcaaaaagtcaacggcatcatacattaaaatacagtgggagggagtattgaataggtctgctacctatatttcatgctcgcatactctctccggtttcattttaattaacgttttggacaatgatatggtctacaagatacatttttgcttatttttctattataatatatataataataaatgcatgtttacttttattatagcctttttaaaagccaatttaaaaaaggttatttaattccctttaaattaaatatttttaaagttattgggggccaaagttataaaaagtttgacttcaatcttgtctaaaacgtcaactaatatggaaccggagggagtaccattttctcaacgtcatcccatgcgctagcactcgtccttgcgtaataatccctttgtattactcgatgattaatttgcacatcggtgtgcgtgcatgcagggtggcgtgcgtgaggcagggcgggataaagtacacgataacggggaacccgtcgtacaacatggtgatggtgaagaacgtgggcggcgcgggggacgtggtgaagctgacggtgaaggggaccaagcgggtgaagtggacgccgctgcagcgcagctggggccagctctggaagacggaggccaacctcaccggcgagtcgctcaccttccgggtcatgaccggcgaccaccgcaaggccacctcctggcgcgtcgccccccgcgactggacctacgacaacacctaccaggccaagaagaacttctagctgatcgatttttttcaacttatttacttataatatttttacctctccctccgttctctccctacttaattgatgaatttttggaagtgaaaactaattaacactgaatttttttcttacgaattaatcctctgcgtatttactaatttgagtttgaaagaattcgttgatagtgatatttgatggatattcatgtaagctttggaatcttaaattttgatgtactggtcgaaaatgccattagcattgcatttattctggttttattattattattttggcttcaaaga

SEQ ID NO: 91779 - DNA, 781 bp, Oryza sativa
tgtgtgtatgcagatcctactccttggaacagttgagttaatgtgcacttttgaggcgtgtctttcatacaaagtcatttatgcgagtctacttagggtgtgttcggatgcccccttttcctaaccctctttcttgttttccacgcgcacgttttttaaactgctaaacggtgtgttttgtgcaaaaagtttctataagaaagttgtttaaaaaaattaaattaatccatttttgaaaaaaagctaatacttaattaatcacgcgctaatggatcactccgttttccgtgcgttactgttccggttgggatctggagatagcgaacacagccttaggccattcccaacccaatgactaggatgatgtccatagcattaaataagctgtcacgtaggatgaaagatgatatggaaagtgcataaatgaggatagaggagaaaccaggtcttgcatgagacatggtttctacacaacattcaagatatcatgtgagataagtagtatttaatttaagtatgaaaaagtggtgtttgtattgtaagagtagtgtctaatactaatttcttgatgatgtggagtttatgaaaattatgtctaatgtcttgggttgggactggccttatcatgctctataaatcttttcctctcatctctcttcttttaaaattttgcaacacggctaggcttttgagcatgatatgcctcttgtgtttctctggcagtactctttgttattaggtgtgcatactactagcgcaggctgtgcagtgggattagccg

SEQ ID NO: 91780 - DNA, 733 bp, Oryza sativa
atcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctggcagatcagtttaccaaggggctaccacgtaatgtgatagacagtgcatcgagggaaatgggcttgatacccacctaaggttgcataatagtggaaacctgtccattgtgatcggagatcccgtgaatttggatggtgaaacaaattattgtgtgactgagagaagagacccttgaaaggggctcattttcatgatgtgcttctcttctttcctgcatggtaggatggcttatgtcttaatgtgatccgagtggcttttccaagcagagatgttgacctgcagaacatctcagaaggaacacacctatatgagttcgactgctagtcacagtctatgaggtttgggcaatctctagatactcatgaaaggcctggagtttgacttatatgctccaaacagaggggatgcgaacggcagcccagtaccagtcaaggttctgagtgaaacctgatcacacaaaacttacaattcaaggcatagtccattgttcagttgtggtctgatgtaactcatttcctaggtggaagttcaacttaacagtctccaccaaaaccctggtatatcaaacag

SEQ ID NO: 91781 - DNA, 1051 bp, Oryza sativa
ctgcagcccgaataatcgtgttttggttgagatggctagaacgatgttggatgaatataaaactcctagaaaatgaggggagggaggcaattaacactgcttgttatatttcaaatcaagttttcttgagatctaaacttggaaaaacttcttatgaacttcgatttgggcatcaacccaaagtttcacatttgcgtgtttttggttgtaactgctttgtcttgaaatctggaaatttgtataagtttgaggcatgttctaccgatggattgtttcttggttaccccgcacatactcgtggctatcgtgtacttattttggggactaacaaaattgtggagacttccaaagtttcttttgatgaggctagtccaggtactagacccgatatttcaggtacactatcacaagttcagggggaggatggtcgtatttttgaagacgagagcgacgacgactacaacgacgaggtcggctcagccggtcagaccaagcgccaggccggtcagaccgccagcacacctccggtcagaccggcccatgaggagcggtcagaccggccagggtcatcggctgagggttctgttgatgctgatcgagatggtcctccggaaattactacttcgaccagtactgatacagaacgtggatcaacttcagaagtcaatgctcctttgcacattcaacgacgacatctgccggaacaaattattggtaatatatgtgagcggactacaaggtctaaggtaacgactcatgatgtttgtgcaaattcagcatttgttgcttcttttgaacccaaagatgtgtcacatgcattaactgatgaatcgtggattaacgccatgcatgaagaacttgaaaattttgagagaaacaaagtttggactttagttgaccaccttctacacataatattactggaacccagtgggttttcaaaaataaacaaaatgaggatggtttgattgtgagaaataaagctagacttgttgctcaaggttttactcagttgagggtttggattttgatgaaacttttgctcctgttg

SEQ ID NO: 91782 - DNA, 757 bp, Oryza sativa
gaaaattttgtagaaatgccatcgaaatttgtggttaaacctggtttctgctcaccgtcagagcatacagtattatctttgttttcacatagaagggaatcccaggagtatattatgtttaatcaacgactgctaattctctcttatgtgcacaggagcactacaaggatttgaaggaaaaacctttttttcccggtctgatcgagtacataacttctggccctgttgtttgcatggtatatatatttgtaaagaaccaaacatatttgtaactctgcactttgatcagtaaactgttttcaattaaatttattgttgttctgttctgtaaggcttgggaggggaatggtgttgttgcatcagctcgcaagttaataggagctactaatccccttcaagctgaaccagggaccatacggggcgatcttgcagttcaaacaggaaggttggaatcaaacaacctttcatgttttaacattattatatctaccacatctttcacattttagcggatatctctgcatatatatctctgtcaaagaaattaaatttcttatggactctgctttccaggaatgttgtccatggaagtgacagtcctgataacggcaagcgtgaaatcggtaagttctactccttttcccagtagtcatggtataacaatataaggtgcatagaatcatgagttttaagtactacgaagaatgaagtagttgacacagtgattaggatcatgttttttttttttaaaaataat

SEQ ID NO: 91783 - DNA, 664 bp, Oryza sativa
  unsure (1)..(664): unsure at all n locations
cgttccgcctcagggagcggcggaaccggctcttcgtcgtggggtgcaacctgcaggccgtcctcctggacggcgacgacatcgccgccgcgtgcaccaccatctgcggggcgccggcgccacctggccagcagcggccgacggcgagctcgcggattactcgtgcgcgggcgttggctgctgccaggcttccatctacctaggcctcacgtcgtacggcgttcggctgtcgccgttcggcacaagcaccgggccgncgtcgccgtcggcgaccttctncggcttgtcgtctaaccaatcggattcggctctcgtgttcgtcgcggacaacgagtggttcggcgggaacgcgagtaagctcggatcagcagcagcgacgatgcgaccgggcggcggcggcatgccggtggcgctggccgtgctcgactgggcgatcgggaagtcggggtgtccgccgcatgggcccgacgacacgggctgtagcaacagcaacagctactgccgcaactctaccaacaccttgcttggcgctactcgtgcagtgcgacaacgggtaccaaggcaatccgtacgttgcaaatggatgtcaagggaatttggtactccctacttccctaaatgttggatgccggtgactttttaaaacatgtttaaccggtcatct

SEQ ID NO: 91784 - DNA, 523 bp, Oryza sativa
tgttgaggggaaggtcttcagaatcaacaatgcccttgacaaagctgagccactctgggatcaactcctcacagttgtccatgataaacacccggcgtacgtacagcttgatgttgttttgcttcttcctggtgtcaaagaggtcaaatggcgctctctttggtacaaacaggatggccttgaattcaagctgaccctccacagagaagtgcttgacagccagatgttcctcccagtcgtttgtcaagctcttgtagaaagcagcgtactcttccttggtgatctcctctggcttcctcaaccaaatgggtttctgcttgttcatcacgttccactcgtgagagacttccttgatcttcttctttttcttctctttctcttccttctcctcatcaacatcctcaacctttccctcctcagcatccttctttttttcctcggcttcatcatcagaaatctccttctcagttgtcttctcagtccatagggagatagggtagctgatgaactcagaatgcttctt

SEQ ID NO: 91785 - DNA, 595 bp, Oryza sativa
agcatgatcttcattgacccatcctgtagcagaaactactagtagttaacttgcctagctaaaaaaaccgaagtaattaatcaacctcaagagttaattaacggcagagaagacacatgaataatgcacccgtttcttttttcttccatggagaggaaagctaaagaaaggtagtacttggaacagcagagaaaatgcctggctttcccttgtatgccgcattgcagcgccggccgtcgaccgaaaaccaccaccaccatcaccatcaccaaaactcccctccatatttcttcgcctatatatcgatcctccctatatcctatcttggattcagctcaccggccggccatcccagtgtcgccggcgactcctgcgatcccaacgatggcattgggccgttgctgctgctgctgctgctcctcctccacaccctcctcatccttgctcatgagagtagcgaggccgtggaagaagaagaatggtctctctctctctctctctcgttttctctgcgattttatgattgctgctgctgctgcattggaacctaaaatcgcagagaaaacgagagagagagagagagagagggctgcag

SEQ ID NO: 91786 - DNA, 510 bp, Oryza sativa
acgaaaggcaagttggcaccacgcttcgtggggccatacaaaatcctggaacgaaggggggaagttgcttatcagctagaacttccatccaatatgatcggcatccatgacgtgttccacgtgtcccaattaaagaagtgcttaagggtacctgaagaacaggctgattcggaacacattgatatccaggaggacctaacatacgtggagaagccggttcgcatacttgataccagtgaaaggagaaccagaaacaaggtcacccgattttgccgagttcagtggagtcatcattcagaagaggaagcaacctgggaaagggaagatgagttgaaagccgcccatccgcacctcttcaccagctcctccgaatctcggggccgagattccgtttaaggggggtaggtttgtcacaccccgaagttctcctcccaagccaaatttaatttgtaaacaaccccaagaaaatgcaggtgcaaatcaagagaaaaccctaagaaagtaatgcaa

SEQ ID NO: 91787 - DNA, 592 bp, Oryza sativa
catccggtagttgccaaaggcttggtagatcccttgtgtcatggtcatccaagaaacaaaactccgtagccctctccaccgccgaggcggaatatgtttcggcaggtagttgttgtgcccaattgctttggatgaaacaaaccttgttggactatggcatatctttcaccaaaacctcactcctatgtgacaatgatagtgccataaagatagccaataacccagtctaacattctagaaccaagcatattgacatacgccatcacttcttaagagatcatgttgccaagtgtgacatagtcattagccacataagaaccgaggatcaactagccgacatttttaccaagcctcttgatgaaacccgcttttgcaagttgaggaatgagttaaatgtcatagacttctctaatatggcttgagatggtgcaccatggttgcttcttttgcatattgtatatttgctcctatttgttcttatgctttggatttattgtcatttggttcttcattgcgaaaatggagcatgtcacattaaggaggagtcttgcactcttgcatgtgttccacttccttttatatgtgagcaaat

SEQ ID NO: 91788 - DNA, 560 bp, Oryza sativa
cccgaggtagggcggcgaccactccttcccagagactggatggaggaggctgccctccaatgccacgtggtactcccccgaggggggtcgggcccgaggtagggcggcggccactccctggccgagactagagggagaaggccgccccaggcgccacgtggctccccccccccccgaggggggatcaggcccgaggtcgggcgtcggccgccccctcccatgactaggggtctgttgaagaaaaaatcgaacacaccggcctgggagatctgcttagctcctgtgcaggtccaaagattaatgagatgcgggcgtgccagtcagtttaatcctgcaactgacaagatttgcaaataatagatcaaacagccgatcggctgacaagccgatggagtagttccagccgatagccgataatagccgatgccgataccagccgatagcgatagggtttaagcaatcggctatatgtcaaatgtagatactgatataaaggcaatcggctaatgatgatgtaatatagcaatataatcctgtataaaccaatcggctaacaatat

SEQ ID NO: 91789 - DNA, 539 bp, Oryza sativa
tccgtcccttggcggcttgcgcgcggagtggcgggggccgggcggtgacgacggcgatgacggcgggcgatttggagcggcgcgacgacacgggcgacagacgcgcacagaggctgacggcggcggcgaccgggcggtcggccactcggcacgcgcgcgcggcttgcaacgggcggcatccgcgcgggcgtgcgcacgcgaacacggcgcgcgggaagtggcagcgagggagcggagagggaggacttggctcgtctcgggcggcttacgcaggcgcggcagagcgaggagaggggaagggggcgctcggcgcggtggctcacgcgcacgcgcgcgggcggagcggaggaggaggagcactcggcgcggctcttcgcgcacgcgcgcgcggcgcgcgggcgaggcggagcggaactgagcggggggggggggggagcggaacgcgccggggaggggagagggccagagagagagagagagagagagagagcgcccgggaaagggggagagggagccccccgggagggaaagggcggggg

SEQ ID NO: 91790 - DNA, 615 bp, Oryza sativa
atcaagttacattacaatattctctctctcctataatataagcatatattcttagagttgaacacaactattaagaaaatagatataactaaataggattaggctacgattagatgagaagtgaaggtatgtgagaaaattaaatggtagaggattgtaattggttgagaagaaaatgctggtatataagttattatattttgagacaaattctaaatgttaaaagttgttatatttttaggacagagggagtaaatgataattacattattttttaataaaatgaatggttaaatatatcttaaaatatcaatggtgttatatattaaaaaaatggatgaagtataccctaattagtggcagaattaattaagctcgatcgatctcatcacatcactctctcttccgtgcatggtgatcaattaaactgcaaagtgagcctgtcgtgaccatcacgccgacgatcaccgtgacggagtacaagccggcgccggtggtcgcctacttctcctcgagaggcccgtcgccgcagacgcccaacattctcaagccggacgtggcggcgccgggggtgaacattctggcggcatggatcccgacgtcgacgcttccggc

SEQ ID NO: 91791 - DNA, 521 bp, Oryza sativa
gacaaaattataaatagtagacatgtaaaaaaaaatattgctgcaaaactgttgtgcttcaggctgccttggccagctccctgtccacagccaccttgaggaagctgccttcctccaccaccatctgaacaggcaggaacccgagcccattggcgacggcgagcatcacctccttcatctcggcccggaactcctccaagtccaccgtgccattgccgtcgtggtcgaaccgcgcatacaagccacggtacatctccacgagttcatcggagctcatggcggcctcatcaacaccgaaatgcttctcaaggaccctgaggctcatgagctcctttgccatctccgagtaggagaggaggccgtcacggttggtgtcgagggcggcgaaccggccatcgacggaggagttgaaggcgccctcgtcctcgacgaagcttctgatggtcttgccgtcaaggatttctacactcatgttgccggctctacaaaatgtggcggtctcagagatgtttttggtgtgt

SEQ ID NO: 91792 - DNA, 548 bp, Oryza sativa
atgtgaacaacatacttataatcagcacacaaagaaatagtagaacagttgtggcatggatataagtgaaacattatcacacaactcttctttatcacaaggaacaacaagtaaatcaacttgtgacaaaggcaactcagcaattgattccactaatggttgctctactatagcatgaaaagtggacaagtgtagctcaccttgagaatactcaccttcatttctctcagcaccatttaatttaccttgcgaacttttttcagacatcgcaggtgcttcatcctctttcttctcaagtataccattctccttttcttggatgtgctgatcttcctgcaaaacgttagtaacaggggagacaaaagattgctcctccaatgtttgcacatcatcattacataagtatattggggattcagaaataggagataaatcacattggtcatgcatcctcgcctttgatatgatctgactctcaatgctacgagcaagcatgaataggtgcccaatatgattatatgggtaccgagctcgaattcgcctatagt

SEQ ID NO: 91793 - DNA, 517 bp, Oryza sativa
tgaatcttcttctccggcgaatgggcaggtgctgcagtcgcagcggggaagcagaaggccgccgccaccgccgccgccggccgacctggtgcgagaaaccggcaagccctcggcgatatcggcaacgtcctgaacgcccatgtggtcgacgggtaaggagcagcacgacatcatcgtcgccaaccttccccgattcgttcttcctctcgtttccttctctgaaaacctcgtgttcttcttgcaacagcaagatccagctgccggaggggatcaatcgcccaatcaccaggagcttcggcgcccagcttctaaagaaagctcaggagaacgccgttgcggcgaacaaggtacggagtgagacacaccccccttctgtttctcgtgttcttcttgcgaattcagagcggttgatttgatccctgatttttgattttggtcgcagattgtcgtgcagaatccggccaagaaggagccagctacgaagccggcaaagaaggtcgtacccgtccggagaacg

SEQ ID NO: 91794 - DNA, 2341 bp, Oryza sativa
cgcaattttggccgcccataaagagcttgcagccgtacttttttcatctgggtcccttgccgccgacccagatgaaaaaagtacggacaaaagatttttctatgttatgttaataataaataaagaagtatttattggtaaaatttgttaatattgttataaaaatgtattgaagttggttgtcgcgcaatttcatatgttaagtgaggtattattttgtaccttattcgacgtattagtactcggataatttatataggcctatcgcagtctgggtcgtagaaacattatatggacttaaacaaggagaattatgtaacatgaagaaatagtagtacaatttgaacatgatacaactatttgcattgcggttacatagatgatattagattcgaactaggagggaggtaatgcaatagttgaacacaacgacgatgtagtaatgggacaaggaagcatgacagtagaaatttcaatatgctaagttgtccgataatagctaacccctacgtgaggatccctctcctctctcaaaccgcgctttagtaaccctgtattgctctggtagttcaagctgcacaacacggctaggtggagttagaatccttctggtgtctatccattctctgtattgttatctccttggtggttcctgggaggaaagaatagatgtaaagcaagcaaagttagtaaatgttgtgagaaaataaggattcatgtaatcaaaatattcttaccatgaaatcatcgtcaagaatatttggacaaacaaagaaccttcgacccaatgttgtaggatttatggaacgaagaagctgacaacgatcaccacacctgcatcttagacaggcttcccatggagggagtgccgtagttagcacccgccagtcgctctgttgttcacgacattgtcgttcataagccgcttttctctgtaagtattgctcagtactttcggatgcgaaataccagcgaccttcttataaacaagtggttaggtcgagaacgggattttctgtatcgacccactcgatgtatgcgcaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgttacgccagtttggatcctcaacaccccggcgtctagccattgatgaaagccggtcggatttgtaatgaagcaagtggggaagagagtactgaatgtgactgagttctgaaagattgtgagacctcactcgttaaggcgacttatataggcgcaaaaaatcgagtgatacccctgacatgtgaacgtggtggggtatggtgggtacgcctgattggcgccgaaagttacatgcatgattggcgccgaaagttacatgcatgatcggcgccgaaagttacattggtcgtatgcgccaaatggcgggcaaatactcgtatcgcacgcgaataaaggaggctgcatcggtgcggcagaaagtagtcgtgcatgcgccgaaaggtatcgtgtatgcgccgaaaggtatcgtgcacatataacaacaacgtagtcattacacaagcatacagtattggaaagtgaagcaaataaacaaagagaagattgctctactggccctgccccgcgccgcaaccacgcttggtcctccgggcctgtgctcacacgtggtcctgggagtaggtgaaacgatccggtggcacagcacgggtagcacgagtgtcctacggaggagtggcctgcgcctggtcctgcgtctgcaccggcggtgcgcctcccagctgtgaggggccgatgacgtcctctgtcgagcctgaagcgaagtcaaagtcagtgatgtcgaagagcaaggtggaaggcagcaagcggtccgacgaggtcccagcatggtccagtggtggaccctgactcgacgtgccggctgcctgtgacgaagtcccggtgtactgccagaactgcgctgagtgcgaggtcgacgcagttgcctgagacgctgaccctgcagcctgggagaagtgggcggcctgcgtcatagcgaactgggcgaaacctacacatcgacaacaggacccttgtaagctaagacataaaatgcatgtaaattgattgtcgaagtaatgttgtttttttaagtacttgtggggggcacaacagaaggcctagccgaggaaggcggggtgctgaacggt

SEQ ID NO: 91795 - DNA, 699 bp, Oryza sativa
cctgcagcccgccgagagcgtcagcgtgtcgcgcacgaggttgccgtcggtctgcgactggtcgccgtactggaccgcgtaccggcacctgctgtccgacgagcagcccgacgcgtcgagctcctggcactccggcgcgccgcacgccacggcggcgtacgtcgacgacagcgacgggtcgaacagcgggtcctgctgctcgtagcagtcggcgcagggcttgcactgcacccacgacaggtcgctgccggtgtcgaagatcacggcgtactgcttcgccggcgtcccgagcccgacggacacgacgtagttgccggtgccgagggagatgcccctctgcgccggcagcgacacgccctgctccgaggcgcgtgccgggtcgaccaccgacggcgcgcccccggcgccggcgaccttgcggtggatggagtcgaccctggcctggtcgcgttccaggatctcggcgtgggtgacagcgccgccgccgccgcgaggacgagcctgcaccggcgagcacggcccgtgccggtgcacgacgccgagagccgacgagttggacgccgctgcaagaaaaacagaatgggaaaatgagaaatgcaatttgtgcaaatgcaactcgaagcaaagaaagggaatgttcagattgtagctaaaataaatcttacccaaatttggcaagatggtaagatggtagtattg

SEQ ID NO: 91796 - DNA, 3051 bp, Oryza sativa
aaagataacttgcaaaattatgaaatagtaataaaatcatgagaataattatgtacaacaagagtacaggctatttaaatatagcaaacgttactaatggtacactccgatgacgtgcaatttaacatatatgtagagctcgataatataacataacattacgtgtcgaagtccgacatacatcagcatacctaaagacgttaggcgccttagtccgacgttacatcacgagaccaaaagacatgacatgccgaagtctgacattacacgacgaaacatagaacataagaactacaccacgtagccagacgtggcacgacgacgcctaggacgtggtcgagtggaggtagtgccttcacccgtagggcgagctccgtctgctgctgatcctgatagtcctgcctccgccgcacttggtttctccttgtctttaggacaatgcttgtaggtgtgcccttgttcatcgcatttgctgcaacgcttcaccctgccagcctccgactcgtccatatcgttgcggatgcgacgagtcctcctccttccagccttgcctcggagctacgatgggtcaggaatattgagtacttcatcgttagtctctgtgaactccccagctatgcgaacccataaatctcgccgctccatgtatgatatattgcttgcttactgaagtactgtgacacatatactgcatatggtatgccacactccgctgcggcagcaatgacatgggtgcatggcctgtggagcagcttcggctttgcacaagagcaatgacatgtgccgtcggctttgagaacacactcctgcttcactctcttgcggtagatacccctgcctgccttatcttgacatagtatctcaaacctgtgctgttgggtaccttgcactagagctcgatgtttcatggcctttttacgcaactcctctagctttttctgcatgaaagctccaaacaaaatgctgttgttcagcatagagggaagaactgccgggaaccgatccctacaatacctgcatgtcccatgtaaaatgaactccactatgccaactagtggcagtccacggacaccgcgcatcacccagttgtaaacttctgccaaatttgttgtcattattccatatctagcaccacttgtgtcatacgccttggcccatttctcttttggttcatgcagaatccactgaaaaaatttccgaatctccaatccagttcttctaaccaatgttggactatccgttgggagaggtccaagagcttgaggagggtcagcaacggcggtcgatggagccgctgcacgctgatcactgcatttggctgtcaactcatctaatctcttccaaagctcattaaattttttctcctggttctgattgcacagcctcttgaacatgttcatgagctccttgttcttgaattgcttgaagaaattagctcccatatgacgcatgcaccacctactctgtacatcttcccaaacaccggggtatcctcgttccatactcccaaactgcaactcttctatcgctcgcagaatgccagcgtgcctatcatgtatcaggcacacatttggcctcataccaacaacttttattttaaccaatttcaggaaccagtaccagctgtcggtattttcactctcaacaaaagcaaatgccaagggcaatacctgattgttcccatctacccctattgctgttagtatctggccctgatactttcctgtcaagaatgtcccatcaatgcagagaacaggacgacagttcacgaatgccatcttgcatgcatgtagaactaagaacgccctttgcagcacactcttgctaggatgatcaattgaggggaatttcttcacttcgtaagagctcccagggtttctttcctcgataacaccaagcaggcgtggcaaattgtcatacgaggcttcgtaagttccaaatctcatctctattattttctgtttggccctccaggctttggcatagctaatagtatacttgtatgtctcttcgatgtgtcggattattgaccttggttcatatgtgagattatcgataacatgcgcatacatctcagatgcaacaaatgcacatgtaatgttcctgtggtatttctgaacaccaggtagaaaacatgtatgcttggtaacgactgatactgtccaataatccttccatttccccttatacgcgtgcactctccagggacaaccatctttttccttaaaacaccgaactttatattgcgaccggttcgacttggcaatccaaaactctctatgaagtgacactgcaaaatgttttactgcctcctttatatcttctgctctactataaatcgctccctgaataacctcattttctttgtactcccatctcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgccactggagctactacgcccccgtcctctcgtgcgttgacctcctccacagaagtctcatttacttcagcacttggtccctcgccatcatccatgttcatctgcacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtggatcaactctgaagcccctcattaaccatccttttatagaaggtacactcctctcagccggtctatcaattcccctttctgatacaataaaatctgacagatctaccctagttggcccgtaacggacgtttcctggtccatggtaaacttggaatatttgtttgttcgacatatctgtcaacgaaataactagatcatattact

SEQ ID NO: 91797 - DNA, 2325 bp, Oryza sativa
cgctctccgatcgtcgtcctccgccgccgccaaccgtcgtcgtccaccaccgagaccgacgtcctcggccgccgccgaccgtcgtcgagctctctgccaccgccgccgccgacccctccaccgcgcgcccgctccaccgccgccggctcctccaccgccgccggctcatccaccgccacaggctcctccaccgccaccggtctctgccaccgccaccggctcctccaccgcgagcgcggccgtcggtggcccctccaccgccgccagcccctccaccgccgtcggccacccctccaccggcgccggccgtcggcccctccaccgctgtcggccacccctccgctcgcggccgaacggcttcatcggccgatcgtcgtccacgagcgaagacttcctcggccgaacgacgtcttcggccggtcgtcgtccacggccgaacctcgtcgtcggccgttcgtcgtccacggacgacgccggtcgtcgtccacggccgaacctcgtcgccagcccttccttcgtcgtccacgaccgaagctcgtcaccggccgttcgtccaacacggacgtgcgtgcatgtgggtgtttccttttatatgtgtgtgcatgtgggtgtgagggggtatatatgtgtgtgcatgtgggtgtgaatgggcatgaggggtgggtgatatgtgaataaggggttatatgttgattgtgaatgtgaatttgggaatgtgggtgatatgtgaatgaaattgggagggtatgttcaattttgcaggatatgtgaatttgtcaaattttttagataacatgttggagggtatgttaacaattttttttaaaaaaatgtagaggatatgtttgccttttccattttttttagtcaacatgtcgatgaaataagtaagtcaattagtgcactacttgataataacatatcaaattttgtacaaatttgttttttagtaattaatttagcataatagtaagtagtcattagtttcgctatttaaatttgtttgtactaattaatttagcataatagtaagtactagttaaatttggaaatctcagagaatttaaatttgttcatacgatatattgttaatacacagtttatttttgtactaattagtttgtactaatttgagtaatttaaaatgtggacaacattgactacccgactgcagatggtgtatccgtacttggggatgcggtcgatcttgtaattctctggcacaagaatgacatatcctttggattgggcactgacgctggggaaaaacctgtgttgcctaaaccggggttgggaaaacctccgaggcctcctaagaggaaggtgactgataaggcggatgatctagagatgcaaaaggaaaatccagtgctggaagtgccaccggatattgcattgccggaggcagccatggagattgcaccgccggagacagccatggagatttcagtgccggatgtgcccatggagattacagtggcagaaccagaggtggaatttgtggcatcggtcgggtcagacaaagaagaagtaccaggattggaatgggacggtacagagccagagatatttgaagacccttctcctgcgaaagaccccgaggtgccacgagtgcttaggagccacgactccaagtccaaagatgcgagcaaggagaagttcatgctaaccgtcttcagagggggtaaggaacgtgccaagctcagagatgacgacccccagaaggcttctgaactagccgggccaacatacttcgcaaccgatgattgcccggaaaagtacgaacatgggaaagcactcttgccggaatgggcactgaaagaagcaccatgggagatgagaaggttacataacttctacatggaggccagcaagaaaggcttgggcaatataacagctcgatcaccggcagattgtttcggcgaagaaggttacgtatggctagatttctcatatctctacgccatatatcgtcgggataagatggatgtcaactacgtcggtgtttggtgcatgtgagtatgagttttaattaattagatgaaaaatatgtacaatacaaatccatgtgattgttactaacaaacttcttctataggatgcaatacatggatgctaagaagaaaaaagaacccatcgacttcttggatccaactcggatctgccaaacacagcataccgtgacgctagcaccagggtcagaccagctgaagggtaagaatccaaaagagatagcagaatacaagaagggcttgcacaaggagaaattgattactgtcgcacagtacattggacgagccttcttgcactttcaaaataagagag

SEQ ID NO: 91798 - DNA, 1149 bp, Oryza sativa
caaacctaataatgctaatatttaaatcacttgatattaagtgctgcttatgcttttcattaatgaacttttaggaggctaactatgcttccttgtgcaaataaacaatctaattgcaggagtatgcagctgctggtactgtcaagcaaaactacgtcaatatcctgctgatgcttttacggctcagacaggcatgtgatcaccctcacttagttcgaggtcatgagtctacttctagttggatgtcttcattggagatggcaaagaagctgcctgtagaaaggcagcaatcgttgctggtttgcttgcaatcgtgttctgcgatatgtgctctctgcaatgtaagtgataaaagtgaatgtgctgcctttttaaaccacacctaatatgatatcgtttctaccttcattctttgctctaacccatgttttgtgttattgttgcactgtactttgatattatctatccagctgtggtgtggattgtggattgattattttcaaagttggaatgcattttttgagttttctcagtagcacatagactgccttaggttactatcagaacatgagattcttataataggatttataagtgcattgctggggattgatcgtgagcttcctttcctggatgcttatacaatttctaaatccatagctaagtaccaaattatatcttgtggttagcatacaacatgatattatgtttgcatggctatcagcggcttgattttagtgaagaaataattctttgttgttcatgcataccattttcctagcatccacttctgattcattgatccgtacaccataaattgtgcaggatgcgccagaagatgccgttgttactatatgtggtcatgttttctgcaaccagtgcatactggagcaacttaccggtgatgacagtgtatgtccagtgtccaattgccgagtccgactaaattcaacttccttattctcccgaggcacccttgaatgtgctctgagtagatcaacctgtgagtttctgtctgatgattcctgtgaagacatggtgcaagggaagcaacctagatttgattcgtcttatgcatcttccaaagtgagagctgccctggatattcttctctcgttgcctaaactggatttaacccatatgggtgat

SEQ ID NO: 91799 - DNA, 717 bp, Oryza sativa
ggctttacctacttctatttgctaaaattattattacatatcgtactggcatgcaaagtaatatgaaatactcattcaaccacaacaaaatttgaagtacaattacatgatcaaaataatttcttaatgtgaaattcctgaacaatgtagccaagaatgaaaaggaattcgtcagtaactatagcttattgaaatggttgcttgtgactgaaccagcacaagggacataacgcatagtttccttcagtgacatgttcgattatgttctattgacttttttggagaactggggacatacttgagccaccaactgatgttctagctactcaacaacatttgacgtgaaaaaagagtgacaatgcgagaattttgatcaagtttaagatgtataaagtttatagctcatttttggggcctaattttcaatatctttttgagcggaaaattttaacttgaaatgagggctattattttactagtgtgatgtctcacgaatttgaagtttgaaaagtagaaaacatgatgatatgtagaaagaagcatgtgaggatgccaatcatagtttgatatttatattcaggttcatctggatgatgctctttcaaatatcaaacttcaactgttcgctttaattgcgaggcagcctgccgccaaccagctacgaactattgagcagcttggctatatagcagatctttatgtaaggtacgtagcaga

SEQ ID NO: 91800 - DNA, 779 bp, Oryza sativa
ataataagacctgtatgcaaaacagcagtgtccgtgtggagacaattgatgaagccggggaaaaacaatcatacttcgggtttattgaagaaatatgggaaatcgactatgggcacacaatgcaattccccatatttaagtgccagtgggtaaaatacccgaacggggtcaatgttgataagttcggtcttacttttgttgaccttgcgagtatgggtcacaaggatgacccttgggtactcgccaatcgcgtggcacaagtgttttatgtgaaagacccttcaaatttgaagaaagatatagtgctaccagggaaacaaaagatattgggagtggatggagttgaagatgtcgaagattacaaccaatacgatagtatgccactttatagtcagtttgtatagaagattaagaatgtcgagacatctactcagaagaccgtgaagccgtacatgcgcacggacagtgtgggcaaaaatgttaaagggtaatgattgtggagtggcatgtaagcatctaagaagtaattagttatgtaatggtcgtatgtaaggtgatgtgtgatcatatcgcaaattgatgaacaattgtactcaacattttgcatattaattagttcatactaatttttatgtgcaattaccatttgaagtgtaaaaatttagttaaaaaatttaaaattagtaatatttgaaaagtgtaattatttttatgtgcaattaccagtttgttaaaaagatcttcgcaggcggacgatccgcttgcgaagatagtaaaaa

SEQ ID NO: 91801 - DNA, 685 bp, Oryza sativa
cctgacacagcaactattaccgtcaacaaaatttataggatggataagatagtcaacagatggttttatccaactatacttatagagaaacacaaccctccactccagtttgcaaccttttacataatagcttattctcttttcgcaaatgttgatacttcccttttgcctgtttagcaccttaaattgttcggagttcctgttccaacttatgctgttgtcagaagagaataccctaaccaagagttaaagtactttgttgagcaagatgattttattgagatccatggaaagcgattttacaagccttttgtggagaaaccaatcgatggtatgttagtatcagctcttgatagaaaaaatattttcttaatggtttttccttctactagttcatgcctgttcttctgtctcccactagaataccaactatcattttatatctgcggaatacatgtacgccaaaacaaaaaaaaagaaagaaaaagaaaacctgcactaggtctgattgattaagcttctcatggaaggctgcttcctagtatcaactatgagaagtggcaggttacaaaagaaaattgcgagccttccaaaaactggcaaaatccattccgtattgtagggtacaactcaaaacacaaattaatggtccgattgggtggtgataatacatctttaatggaca

SEQ ID NO: 91802 - DNA, 2185 bp, Oryza sativa
ggctatctccgagaggcgctgggcgaggcccccttggttggcggcgtacttcgcagtccgcccgccccagaggcccacttgccggccggcgcggtctagacgggagacggcgtcccgaagcatgctgggccctacctcgcctgccaagcggagggcctcgacctccccggcggacgagtctagcgcgccctgcagatcggcgatggtgtgttcggcagctgcgaggcgagcggttaagtcgctttcgcccgcggccgccccgccaatctgtgccctcgcgtccagctccttctcccgcgcctcgagcacagcggcccgctggttcagcgcggccctctcggcgcgggcatcttccagaatacggcgcgcctgttcctcttgcgaagcctcgcggagggacaggctgtccgccagccgttgcgccgcggcctcggcctcctcgagagctcgctcccgctcggtgagcgcgtcctcgcggaggcggagtgcggactcttcttcggcacaggcggcttcgtgcaccgctagtgtgacctcccgaatagcaacggcggcctcgcgatccgccaggttcccctccacggcgcaggcacgctcttccagcgccatggcacgggcctcaagggcttcgtcgcgtcgccgggatgccacctcggtctccgccgcccgccgttctcgggcagcggcagcgtcaaggaccccctgggcggcatcgagttttttctctagctccgcctcccagctcccgtattgaaggcggagggagtcctgcgcctcgttcatcacagtggtggcgatgagggcagccccccgctcctcctccacctccttggcgatctcctccagcaccttccgacgggcttcgagctctgagacgtgccgacggtgtgccttgcggcccacttccaccatggcctccaccgagcgtcgcccctcttcgacacgcactcatgcggcgtcgagctctgcccgctctgcttgcagggcctccacctgggcacttaacccgtccaacaccgtcgtgtttgcgacggccaaggcctgcagaaggggttctgcgctcagtggagcaacagaaggcgtggggaagagccgtctcggtgaggatgccgcgcggctcggcccgccgatggacgtgccggactctgggatatcccccggacctagcttgtcctgagcgtcgcccgagggattgggcccaagcgatgcgcccgcggcctcgtcgcaagctgcctcagaagttgtcgccgcctcggcctggcgaagtctggcctcttcccgagcggcttcttcagcttggcgagcttggacggccacctgaacagcttcctcggcttctcgaaggcgatccgcggcctcttgccggtcagtttcacgggtcgcctcggaggatgtcgtcgcttcggcctggcggagtcccgcctcctcccgaacggcttcctcggtctggcgagccagggcggcctcccgagcggcctcctcggcttcccgaaggcggtctgcggcttctcgccggtcagattcccgccttcgggcctctgtggtcgccgggtcctcggcctcagactggccggacttggaatggcgggagggacgcgacgggatctcgctgaaacagaagaaagaccagaagacaaaacaagatggatgagtgaaaactcgcgttaaaggaatgaatacggccatgatgggcgtgggacgaacctgcgagggggtcggttaaacgaccaccttggaggggaaataaggtttccccgggatggttctgtcccccccatcttgcggggccgtttcttcttccgctctccctcgggctgcgacgtcggcgtggccccctccgggcgcctgctgctggcacgcgccgccccgccccctcggggaggagataggggaggggttccttcctgcttcctcttcccccgggcgtcggcagggtggccgctccccgggcccccgtcgcgaggcccagaagcacgaccccctcccggggtagatcgttcccccctgcggctcccacccgcgccatcgtggcctcgaggagcccgctcctccgacgccccgaccgcctgcatgatggtcaagatggaggcacggtctggatcactgcagagggggaggactccttgaggaatgagggatgcctccacggagctgagattcagcacccgttggaccactatcttga

SEQ ID NO: 91803 - DNA, 1279 bp, Oryza sativa
ttggatatgacagaggtagtatttagcaggcagctcctgtgttgtgcgggaactggggactctttgcgatgtctgtgttgcctggaaagtgtgttattgccttattggcccattcgcccaaggtctagcagtctgagctgatttttttttgtgtggaataagttcactttgactcccttaactggcgtccgaatctgatttgtatccttgaactgcaataccggatatcgcggcccataaaaccggtgtaatttgactccctcggtggttttggatggtggtttcgttgacgtggcgtccacatggcagtgttgacctggtctataacgttgatgtggcgcttaggcggcattagagttaaaaacatgtatgtaggactcatttgtcattcacacaaaaaaaattatggagcccgctgacatgtgggccccacatgtcagcctccatctatttcttcttccttcctctctttctctttctcggtagagagtgacacgccgtcgtcgccttgacggtagcggtgggggatgaatgagatgagtggcggaagaggaggtggagtcagagggggaggcatagtgaggtggaggagggcgcgggtggtggggatgggcgaattggcggtgaaggtgtgggcatcatcaacgccgaagccaagttgctaccacatgctctgaggcggtagaagctggtgcaccgaaactccgcgacggccggagcgatggcagcgacatccaagtggtaggggcgtggctccgcctgcacgacgacgcgccactgcttgttgacacagggcgccatcgcctgtcctctcacctgacgccgcccttcaatggccgagggggaagagtgcgctgatagaaagagagagagagggaggaggaggaataagggaagggaacagagagaggctaacatgtgggcccacatgttagtggggcccacctttttttttgtgttaatgcaattgggtcgcacacatatttttaaaactataatgccacgtaagcgccatgtcaacctcacgtgaaagtaagattgggtcaataccgccaccgtaggcgtcacgccagcgaaaccgctcttcaaaaccaatcagaaagttaaattgtaccagttttaatagttggggtcgagatatccggtattgtggtttaggaatatgagttagattcggcctctagttaagggagttaaagtgaacttattcctttctgtgttgctcggcgttcttcgggctggtccacaaactttaacacaaagtccggtccatcaactt

SEQ ID NO: 91804 - DNA, 560 bp, Oryza sativa
tatatttgaagaccaagccaatgatgtcttccatgtgttctgaaatcattgcatgtgcacgcaagaggcttaaataataacaaaatgtgcttaaaacaaaatagccatgttagttataattaaagatagaagctgaccatgaccagcatcagtgagcctcatgctaattgaaaaaaaaggagtattgggcactgtcactgccctccccggccgacaaattcatagcccatcctaaagtagtcaaaattgagcatatttcacatgtagaaagaataaactagagtgactatgagtagataagggaggcaaaagagttgtacagcaatcaactggtgaatgtacttgcctagttcctttatgatatggaagatggatccctcgccttcatgctcaattaagtgactcaaataatgggaaggaccttctttgtaaaagtggatgttaggtgtaacaggccatgatatgtttaggtaatcgccttcagatatcgggatagctttgataacaagctgcacagcaaatttcatgtcatctaccatcacacacacacacacacagat

SEQ ID NO: 91805 - DNA, 697 bp, Oryza sativa
aaacgggagatggtggcttctgcatttggggaagacaaatctggtgcccatcaaactagattgacggtggaagacttgaactatttgtttatggtttagcatttctcctgagattggacacaattttgctcgtgggatggtgtaacttgcatctataggtgaaatatctgtcaggagatagcatttctctaggcgtctagtgtttctagtttgtacaggtgctcagattttgtagttaaaggtggcattgtggtgcgattcattttttctccgtgcaagtggcaactcatcaggtaatttttcgatgagctgcagtggtgtcttttgatcatgaagatacaaaggagaacgtcattagctaacgccatatttgtacatagttttcaccagcaatcttaactcatcttgagcttcgcatttcagccgtatggttgtacatcataaaccatgtaaaagattaagctgaacttgtcttcgacaatttttttcagttgatcaaacatgatagtttatggggaatgaaatttgctcaaaagttctaatgaatgtgtggcatagctcatcactgatgtgtgtatgtaggccaagacgtgtgcattcttttgttctttcaagtccctagtcatccttgtacagtttattttagggggaaggggggatgttggtggtgagggttgagatgaggaagtcggtgaag

SEQ ID NO: 91806 - DNA, 565 bp, Oryza sativa
attttcagctccgcgagattcggcggcgcgctcccggcggcgaaggcgaccaccttgttgtccacttcaatccagctctgccccggattcttcctcaatccggcctccttcgtcatcaccctcaccttcttggactcgtcccacatgccacacatggcgtacaggttggtgatcagcatgtggttgccggtgctctggtcctcggattgcaggacattggcaatggtggcctcggccatggctgcatcaccatgaatcctgcaggaattcagcaatgctccccacacgcacaggtcaggtctcaccggcatcgtctcgacgagctccgacgcgtcccggagcaagccggcgcggccgaggaggtagaccatgcatgtgtagtgctccatggatggggagatcttgtgcgctctcaccatgcgatcgaacaggcggcggccctccgtgacacgcccggcgtggccgcacgccgacaggacggcgacgaaggtgacgccgtcgggctcaaccgtagctccggccatgtcggtgaacagagcgagggcttcgtcgcacaggccgtgca

SEQ ID NO: 91807 - DNA, 655 bp, Oryza sativa
tccccgcggggtgtttatctagaccagtggatcccccagtttttaagttttaagaccttaagggtatacctcatgaattcattaatattttccaggctcagctgatcgaacagttaagttttgggatcttgaaacttttgaattgattggttctgctggacccgaggtacttgctttacacatttttgtaataccaggctaattgttgcgtatgtttaacacaatattttggtaaaccatagagacaaattataacaatcattattttgtacgcatgcatttgatttcgttggtgcccatgttttacatccattgtctcctttctatttagcaccactgtaacttcacgaaagatgtgctagggataaattttgtttccaatccttaaaaatggtttatgacctcccttgtcacatttttcaatgggttggttcttttagagatttttaatggatgcttttacatctagtttaaactttcttaccctgttccctgttgttcctgtattcaaacatgcatgacgggtaaatgcatctttctgttatgatattctttacattcttctcttccaggctactggtgttcgctctacggtctttcacccagatggaaaaaccctattctgtgggttagaccaaagcctaaaggtaaatct

SEQ ID NO: 91808 - DNA, 586 bp, Oryza sativa
tggaagaatctcctgcctcgagtttgtatcatgagggaagacttgagtatgcatccatccccacaatcgcacaaaggacggtcacaccatggtggaaaccaaccagcaaaaggatcgcttcgccagttgagacgctcaaggaatggcgcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatatcaacaggcagcgccgaaagttgatagtgacaactcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtccagagaagtcctcatttgcccaatcagtggccattacatcaccttcctcatcggatgatgcgtcgtcgtccgcttcctcatta

SEQ ID NO: 91809 - DNA, 719 bp, Oryza sativa
gtggatcccccgctttttattgaatcaagctttcgtgttttcaaatttacatgacacttcctttcttttctcttcctgaagtgctcacatcatgttctttcaattcttcttcattttggggtaaacttccacatgcataattgtatacaaaatttggaggggttgtaatcgataaaagaacagggatatatgatgcattatagttgaatttatctaaatttgttctttgcacatcaatgtaaaatcacttaatatgacattctttttgcagaggtatgtaaaatcacttattgattcgaaactggagaagtccaaaaatttgtgggaggaatccgacttctattgggcagagattgaggcaggaactctccagtttgatagaggaaggtctgaggtaagtgctctgttttcagcaaatagttaattgtttgatggtatcgaatataatgaaaacaggttattaagcacaggataacttctcaaagaaaagaaaagagttgtgcgatatacctcttttgcaggtatctctcctaagagagctcaagaaagaagaattcatcgaattttttgatcagtacataagaattggtgcacctcaacggaagacattaagcgtacaagtcttcggcggcaaacatttggcagaattcaagaaggctattgccgaagctgatgcacccaaaacttaccgaatcactgacatattcggcttcaagcga

SEQ ID NO: 91810 - DNA, 749 bp, Oryza sativa
tccccagcatgcagggagtacacaatgtcaaaattcaacttacgtgcattaggtaccacagaagaagaggaacctaatggtcctaaaccaaaggtaagatgcaggcgatattacgctcagatacatcatggacatgtctaaaaaaaaagatacatcatgaacatgcagattgcagaaaaggggatgatttaattgccgaaatcgacagtcccgcgagccagactagcaatgcatgggcaggagcatggtacaaagtacaagaaacaggcgacgctgggcgcaggcagcggcgaggcgcatgagccggcattgcatgcaggtccagtcatgggagcaagacgccacaaccaaagagatcaaacaccacccgtgcaccgacgcgcgcgctgacatgaaatcaagaacaacgagacaaacaagcaagcaagcaaaaaggacgtggtgtactgatgatgcacagtggcgagcacggaccttcgcgacacccgggcgtgcactcgcagctgacctcgaggtcgccggaagcgtagacgcggaggcggcccacggcgtcgccgtagcggtggctggtgcacccgcacgtcacctccacgaaatcctcgcaccggcgcaccccgctgacgtcccgcagctcctcctcgctgaacagcgccgcgccacctccgttcgccgccgcagccatgcctccaaccaagaacagcaaacacaccgcaacaactcaaaataaaacagcgccagacgggggatcc

SEQ ID NO: 91811 - DNA, 584 bp, Oryza sativa
ggttagtgtcatcaaatcgaacaattaatcgaccttgatatctttctgcaaagtacttgttcaaagagtgcagccttggcatgacctatatggaggtaaccactgggctctggggcaaagcgaacacacacctctcaaaattttgcaccagggagatcaacttctggagctgaaggatcctttgagtcattaacctttttcttaaggtttggggcaggggatttcccaattcctcgtttcccaacataagcagctataacctcatccaatgtgtctttgaagtctgaatctatgccattgaaccaacggacaagattttggtatttctttgatttccgtagactctcccatcgttgaccaatccctgaaagagaagatatacatcaattgttagcgcacattatgaagcataggagaagcttgagagtagaaacgtgaaagaggcccatggctcaccagccagatttgaccatacagtgatatcagcaatcgtttaaacatgacccaccagaaaggtccgagacatccagtatccatccaccaatgagcaggcacctccaattttgatccttaaaggaaagtgg

SEQ ID NO: 91812 - DNA, 784 bp, Oryza sativa
tgggcctcgcgtcggcgctgctctacctccacgaggagtgcccgcagtgcgtggtgcaccgcgacatcaagccgagcaacgtcatgctcgacgccaccttcagcgccaagctcggcgacttcggcctcgccaagctcgtcgagcacggcagccagccgcacaccaccgtgctggccggcacgctgggctacctggcgccggagtgcgtcatcacgggcagggccagccgggagtcggacgtgtacagcttcggcgtcgtggcgctggagatcgcgtgcggccgccgccccgcggagctcgacgaggaggacccgagcaaggcgaggctggtgccgtgggtgtgggagctctacggcaagagagccatcctcgaagccgcggaccagaggctcaatggcaagttcgacctcgagcagatggagcggctcatggtggtaggattgtggtgcgcgcaccccgaccacgcgcaccggccgagcatcaggcaggcgctgaacgtgctcaagttcgaggcgccgctgccgtcgctgccgcccaagatgccggtgccgtcgtacttcccgccgccggacttggtcgctccggtgtccgtcgaaggcacgtcgagcaccgatggcccaggcgtcagtgagtgtggatcgtctgggtccaatgccggaggaggatcggggatcaatgataggcttctcgatccatgagcaagatttttttggggctcaattcatcaactgtagctatgccaaaaggttttctcttttttttttccctttttgtgtctgatttt

SEQ ID NO: 91813 - DNA, 654 bp, Oryza sativa
tattcagaattccagataattctgtagtatcattttgaccagctactggaaatttctttggttaacttttaggggcttagaggtgtaaaagcatataccaccagcaaatattaagtgatgcttttttagtttttattggcttgaggcttgttgcaatggatgctcttctggtttaatgactttcaaatttggaaattttgaacttcggatgaaaatgagctcatccttttttttactaactaagattaatatctttgaaattcaggttcaggtttgcatacatttgttctgtatctgggccctcatattgccctcttcactattaaggctgttcaatgtggtcggattgatttgaaaactgctccatacgataccatacagcttaagcaagggccatcatggctggacaagaagtgttcagattttggaccaccagtgtaccaagcatcggctcattctgtccggatcccagtctttgaattactccctcaggttcagctggaagctgttctttggggcattggcacagcgcttggggagctccctccttattttatatcacgagctggtaatatggcataacgcttatttcttaagtaaagaagcttagctatatgctttacactttctcacgtctcagtactggtgaaccta

SEQ ID NO: 91814 - DNA, 693 bp, Oryza sativa
catcacgtcggccgagggtcactcgggcaaatccacggtggctctgggtgtcctcgacgccctgagtcgcgtcaccccgcgcgtcggcgtcttccggccgatcgcgcgctcgaccgccgagcgcgactacgtgctcgaaatgctgctcgaccacgacggcgtcgacctcgcctacgacgagtgcgtgggcgtcacgtacgacgacgtgcgcgacgacgccgacgccgcgctcggacgcatcgtcgagcggtacaaggcggtcgaggcccagtgcgacgcggtcgtggtgatcggcagcgactacaccgacgtcggcagtcccgccgagctcgcctacaacgcccgtatcgcggccaacctcggggcaccggtgctcctcgtcctcggcggccgcgcgcaacagggacagggtgagacgctgggactgtcggtcgcccgcaccccgcaggaggtcgggcagatcgcggccctcgctctccccgagctgctgcacgagcgtgccgaggtgttcgccgcgatcgtcaatcgcgccgatcccgacctgctcgacgaggtcgtgtcctcggtgcggcacgtcgtcgacacggccggcgcaccgcgcagccgacggtgccggcgtgggcgctccccgaggaccgcttcctcatcgcgccgtcgatgcgcggagtgctgcgctcggtcgaggggtgcagg

SEQ ID NO: 91815 - DNA, 614 bp, Oryza sativa
agctgcacgccggcctcgacgacggagagcgacggcagctcacgacgctgctgcggcgcgtggcgttcccggactgagccccgcgcgtcggcccggggcgtgcgccggcccgccggtcgggtagactcgtgtcggctctccgcgcggcggcatccaggccaactcccccaggacggaaacgtagcaagggtaaccaggctctaccgggtgcgcggagagtcttttctttgcccgcggatccggatgcctcgccctcagcggcgcgcgaacggcccgtcgatcaccgcccactgcagcagcatgatcgtcttggcatcctggatctctccgtcgcggaccatctgcagcgccgcgtcgatgtcgtactcgaggatctcgatctcctcgccctcctcgaccaggcctccgcggtcgccctcgcgcgacgccccgtcgtacgcggcggcgaagaagtgcaaccgctccgtgactgatccggggctcatgtacacctcgaacaccgggtgcacctcggtgacgacgacccccgtctcctcctcggcctcgcggcgaatggcggtgatcgggtcgtcgtcgtccaacagcccggccgcggtctcgatgaacatcccgtc

SEQ ID NO: 91816 - DNA, 650 bp, Oryza sativa
attttgcacttctcccatatgagtgtaatgtgaaacagaagaggaagaaacaagagaaaaatgtcagtgccacatattttctttgaaagggatcagtgccacatattagtacctaccgacaaatgttagaggaacgttctgctttgtgaccgtgttgatatctgatgaacggttattccttacaaaattgatgttctgctccacagtgtagttatcaaacatgctgttatacaggttatagtaatgcacatcgataaccgcaccaaagagactgctggctactgagagaaactccgttggatcccctgacattcgagttgacaggattacataggcttgcaaagtgtattttcttacagcattgtatgcgtcttgatagtattttgttaatgtatccacaggtacatctggtgccagtggttcgttgagtaattctattgctaggaggcttgaacttttggcatatctgcattcagaggaaaaaaataagttaagaacatttcagaagttctgttagatggattgagcataatctgagtacagttgatttgccaattttttattattgacctggatgcaaggaaatctatgacacccacagtttgtgcgatgtttgcagcagaggtgccccactccaatgagccatccct

SEQ ID NO: 91817 - DNA, 538 bp, Oryza sativa
cttgctgcaccttggtcccgaacctgcacttcctggtgaggaggctccacgatctcctcggcttccccagccgccggatctcctgcttcatgctcatgcactccttctccagctccgacaccctcgccttcacgtcggtgatggcctcggcggggagctccttccccttcccctcgtcggcctccgcgtcggcgtcggactgcccggccgccgccgcgcccttaggcacgatggcgctgccccccgggtgcggctgcggagcgccgtcgccgcccgccgccgcgttgccggacacgaagaaccagcctgcgatggacgtgcggaggcggagctgctcgaagaagagcacctgcaccaccacccgcagcggcaggcgctcgttctgcgccgcgtgcgtgcacgcctccagcgacagcttctggcagttcatcagcctgcacagctgctccctctccgactccgacagccacgggtgcgactgcgtgcatggacgccgtatcatcatcgtacgtgtgttgatcacgagatgaaatcgaaa

SEQ ID NO: 91818 - DNA, 2161 bp, Oryza sativa
agtagaatggaatttttggtacacaggccattttgcaatatatataggttttgcaatgaatactcgctatggctttgagaagaaagttagcagcctcaccagcactccaacagttgtaaggtggtgtttgaatacagaaacttaactttagcctatgtatttagacactaatttaaagtattaaatataaactacttacaaaactaattatataaataaaagctaaattgcgagataaattttttaagcctaattaatccataattagaaaatatttactgtagcatcacataggataatcatggattaattaggttcaatagattcgtctcgcgaattagtccaagattatggatgggttttattaatagtctacacttaatatttataattagtatccaaacatctgatgtgatagggacttaaaagttttagtcccatctaaacagctataagatgattggcaagagtcaggaggtatgtggtagatgtaaaccattagtatcacattgagtatatgggatatgacaaatagagaatatgttgaaaagaagcttacccaatacccatctttacaagagatttagggcgtttttttttgggggggggaggggtggagagttgggagtacgattcactaccaaataaatatgcatggcacgaagtggtgaagataaaaccatacttcaatagttggaggacacaaccgttaacctagagagtcggctagcaatcatcaaagtagtccttcctacatcggtttcttcctctctttttctctcgggggaaattgatatgtgttaggctactttgaaaagaaaaacttctcatacatatcataatctcgcatataccctcgaacaaccttacgtatagtttatacaaaagcccaccatactattatagcaggatctaatggttgcttctcatatttatatttatagtcccaaaaaagacaaaaacatgttagaagagaaaagaaaaatatatctttcatgcatgagtaaatacaagatgatgtgttttgtaaacaatctagacatatgctcagaccatcttaaaatacttgcatgagtacactcaaagcatacacctagtagaaataaaaataatgatgagtagtaattttacagtagggtaacttggacttcattcgttcctgggagatccgggagattgagagagaaaaacatctcgttttccgcgcgcgcgcttccgttttttgcaaaaaaaatttctataggaaagttggtttaaaaaaaccatattaatctatttttgaaatttaaaatagttaatacgcaattaatcatgagctaatgactcacctcgttttgcgtatattcccaatctcctcaatcactttctcctcaaactcaccttggtataaggtgtgtttgcaagagcaagttcccaatactctcctctcgttttccgcgtgcatgcttttcaaactgctaaatggtgtgttttttgaaaaaagtttctatacaaaagttgttttaaaaaatcatattgatctatttttgaaaaaaaaagctagtacttaattaatcacgtgttaattgaccgcttttttcgtggataggagatgggttcccaaacacccacctccaaacacagccataagcacggaccaaaataagcgaaagcacatatatgatggtgtgaatgggcacttgcatccctccttgataacggaaacatcaaaacggttggtattcggtactcccaacccaccacccttaatctccataaatacggtgttactcgagagttggcatgagctggcccatagatgccaccgcaaccggtatgaacagtggcagtgtgcaaacaccataaaacctcagcttggcctaccggccgccgcccgccccatggacagggcctacgacaagcacaaattgattactctatccgacttgtttggtaggtcgaggagtcaatgtgccgtccggtgggaggtcgctcgcgttcgcgggcatcatcaggcagcgaaaaaaacgactttcccgatcccaaatcctcctttccccttccgtcttcaggcgagcccacacgagcatcacgccgcggtgcgctgcaagcctgcaacggaataatgcaaagcgaagggaagcggacgcgcgccgcgtacgggccgcggggcgtggcacgg

SEQ ID NO: 91819 - DNA, 1692 bp, Oryza sativa
gagtgatacccctgacatgtgaacgtggtggggtatggtaggtacgcctgattgaacttagcaattaacttaacaatacgataagatcgatgcaacgtacctgacgacggcaccacagagtacccatcgtagggtagtcgacctctggtcgctcctcgtacagtgactcctcgtacgcgtgctggtccacctcagggcggccgatcgcaatcctctcagctgcctagatagaaagaaagagagggcacccaccaaaggtcgcgctgggatccgtcttcgtgcaagactcacaaagtgcacggtacagagccgccaacaacgcggaaccccagctccactgaggcacctcgcctaccgcggcgtcggcgatgctcctggcgtagtgcacgagtcccttgtcgaccgcgtgcccgtgaccgccatagaacatcacccagccaaaaagccagagcaagtacgcctccaaacatcggctgtaggagtactcgtcggcctccgcctgtagctgctcaacctgcaagccgtcgataaaatgttaggcaccttaactgcggactaaatatgtaatacgattgtcatttcggtacaaaaacactcacggtgaactgaagcagccacctcttcgtaggtccggtgttgcggtggtgtgccaacggcttgagcgggaggtgcggtgtgcgctgtactagtgcgaaacgtgccgtcagatcgtcctgccagtccacagccgtggtcactggcccaacagcgtctcctgcaagcggtagccccaacaagtacgatacgtcctgtagggtaggggctacctcaccgcacggcaagtgaaaagtgtgcgtctctggcctccatcgatcgaccaaagctgctaggagggacctgtccacagtccatcgtctggccgggtccgcgtcgccggccgcagcctccaccagccgacacatcggtaggaggccggcctcacatagcctgcaataacaaattaatatgtcattataaaaaatattacagtgcaactaacttatagtaaaacactgttcgtacctctcgacaaaggagtcgtgaaccgtgagtagctcaccgcacgttcgtgctcggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaaatagtaatgtaaaacaaaagataacttgcaaaattataaaatagtaataaaatcatgagattaattatgtacaacaagagtacaggctatttaaatatagcaaacgttactaatagtacataacgatgacgtgcaatttaacatatatgtagagttcaataatataacataacattacgtgtcgaagtccgacatacatcagcatacctaaagacgttaggcgccttagtccgacgttacatcacgagacctaaagacatgacatgccgaagtctgacattacacgacgaaacataaacacatcgataagttcgaaacgaattacaagcaaatccacatgccgacatagaacataagaactacaccacgtagccagacgtggcacgacgacgcctaggacgtggtcgagtggaggtagtgccttcacccgtagggcgagctccatctgctgctgatcc

SEQ ID NO: 91820 - DNA, 4598 bp, Oryza sativa
ttgttaggtattctcttgggagccagtaagatgtcatgacgttgttgacatgggatggagcaatttggctgaccttagtatttatgaaggaaaactcttgggatgctcctaccacgaatgccgagttggtgtttgggttgctgatatatcggtgagttttactttttgtctcataggatgtatttcttctatggtctaatcaatatctttcatccagctcattgggccctatgctcttggtgttttgcccaaagcaaatttctttgctgagctggtacattctttagacgacaatccttcgaaaacgattgataccactgccaagtccattcctgctctagcaacgacacatccaaaaaatctgtacaaggtcaaggaaacagggactggtactgcttcaaacacccatttgtctctcattatgtataatgtattgaagtacctttacttcgatacttcacactgatgctctctctctctctctctctctctctctttctggtagtagctgaaagtggaattcgtggctcaaatttgactccagcaagtatggataaaaccaagagagataagagtggtgcaactcctcgaagacctgattcttctttcaaatcatctattcagagctctactccaatgaggcgcatgaaagctgctgatagtccatacacaaatagaaaaacagtggagcgcaattttgcacagagggatgcctcgctagcatcccgtacgggaacagctaataattcttcaactgttaaaaaaggccatcttgctgagtcagtatctgtaaaagatatttacactacaccacagactgtttctgtgcctgtcgttatgcctagagacattttagaggacaaaacagcaggcagcattagtggaggaatcagagggagagctgcagttgcagatgatttccatgctcctgttcattcaaggaaactttcagttaatagttttgtgggtgatagtgttaactcaacaaaatccatgctaactgatcctgatgtttgctctgagggtttctctggcttaaaattctcttttggactaactccatattacaagaaagaagaatatgataatgtggataaagttgatagtatggataaaggtgataatacacaaatgacagaaaaattggacagaacagtgtcgttggagcatcaacttcagtcaaatgatagtaagtcttagagatcctttcctacattctaagtttgcactctgcagttctgttcattttggcaaattgacgatgaaactctttcctgctacagcctctgagccaccatgttctactacagaaacaaccaaggtcaaatatgtcagaggaggtgtgtgtacgttaagagattgtctcggtatctacttgtgctaaaattagttctttaatggtacttttaactccttttgcagttgctgtgccattaggaaaaacaaagtctcttgttgagagatgggaaaagagagaggctactaatgttgagtgctcaccaccaactggttcttgtggtgaccgtgcagtgagatctgatggtccttcctccttttcagtatgtacccataattttaagcccaattaatttcaaagcaatttgaccttattatctggttggttggtgcattcatgaatgcatgaatgtttaagaactgtacttactattttcctaaagtccttggtgataatctcaaacatttttcttaaaccaatttatctttctgggacatgtcatacatactcattcttgcatattatacaatgtaaatttctgtattcgtttttccccttactgcgaagtacattctatctggagatagaagtagaagggataaagtattgttagaaaccagattgtcataaatcataatgtaatgttttgtggacttaagtacttctgggagattggagtattttcagaaataaaatcagaatatgggctagaaaaatatgactttacctttgctccatttttatttgttcatgctctctagcatttacgaattttttcggtactcaaatcattatattttgcaatggttgtaatggacaggcagaaccaagtcaggcatatgagaaggacttgtcaacaattgatgaggcgatgattccaatcaatttgatgcagaaccatgatgaatttataaatgccgtaaaatctcggctgacaaagttagaggtgtgtcctgtctctgatctttttacttgcggacttctgtttgttaccagctcatgtgcaccatagaattccttccttgaccttttgtatccaataaacagggaaccaatcttgcatgccattgcatgatagattatacatatgatgaagctcttctgtgttctttaggctattcagtacagggaaaatggcttatcgttgttagtctattgagtacaattagacaacttagaattgaacattacctttttctttgatacttgcgttaaatgatttattggcattttcttaaagacaattggtgtggacacacctataaattgaaggtgaagtcagctctagtgaagattgttgatcaatcccgcaacaccctaaaattaatcagctagctttgaatccattatttctgatagcctgatataagatgagagtgatctacacttgtatgtaaattatgcattggcatgcacttttcccaccatctactaattatcctacaagtggagagtggggaatagtcagtgaggaaagcatttgaaaactagtaaaagttgcatatatcatagccatcactccatcagcatatgatattaatgttaactgtcttcagatgatgcgtcatgtctttgaccaaaatggtatcaaaggagcgattgctgcagtggcaaagttgcctgacaatgctgtaagtattctcaagatgccgtgcgatattcttggatgtacatgtacttcatattttttagctgctaatggtttgacccttttttttacaggttctagctgatgttgttagtactctgaaggggaaacttgatctcttcaacctagacattttcttaagctttctgcctgttcttgcggggttactgaccagcaaggctgaaaggtgatatattggatgtctctattccattgcatgttggttcttgtctgactggaccaagtgatacatagtaacttaagcgcacatgctctgtgcacacatgtagacacaagatgctgctgttaaattgaattgtctatcctcttgttagtctgttcattctattgcaagcaaggtcatggatctattttctttacaaaaccatggagatattggcatcttacattagaaaatgtttggtttagtagtaactttgtcttatggttactttgcctttaatttcaatttgtaggcatgccattgtttctttggaattgttgttggatcttataaagatctttggaccagttattcgttcaacattgtcagctcattcagcagttggagttgatattcaggctgagcagaggtacgtgcattaatgttattcaagggaatgctatttaaaggacgccgcaaaacctgcaaattgcaaagagacactggatgtgaggtgacaagtgggttctgtccctgcacttcagttaggaaccattgttttaaagaactgcagtgtttgtagcatcctataacctattgctctgcctatgccaagatgaactggactgttgctgacttcgttgatgtcacaggttgcaacgttgcagtcggtgttttaaccatttgcaaaagattcagcaagttctacacccgttgattatgtaattcctttccttcccctccctgtatgagatgctttatcctttactttatcagactattgttttcttaagcttgctgacagttgttcgtgtgcaccatgttgtttatttttgttgctacccacgtcatttgttggagctacctttcctgacattctgtgatggtttcatattttgctggtgcaggcggggtggtcaatcagcacaacttgcccaagaactgaacctgtctttgcaagacttggtggtgatctgaaacaagcggggaggttcattcatactagtacaacacagtgagagtagataactagacatcattctttttggcaaaaaacgcgccagcgccatacagtttttgtagcttgttgccatagctttgcaattgagctgtgtaattgtgttttgacttggcttttgattcggcgtagtcccctgttgtacatgtgagcttggctgtgcataatctgtaattaacatttgttacatggacagccccggatgagggagaagcaagttcaaaaatggttgatgtcagttcaacgtggtgattcattctcttctttcatgtaatgaaactgttgcccgtgtaatctggaatctggtgataattcaattcaccatcaacgaagtggttgaagttttgaagacagagtttggcacggtttgaacgcattacccattccccgtttgacttcaaattcaaaccagctgggtgctgatgactgtcttgtcatcatttgattatttcctaagccctgtttccttcgttcttaagaaaacactcgtctgtatgtttttttaccaattctgggggatccactagtctag

SEQ ID NO: 91821 - DNA, 1633 bp, Oryza sativa
aataacaaagtctcaaagcacttttaagtcatagccactaagacactatccagtgctccaatgttgctgcttaaataaaatgtatgtttagttaaataaaataacagaacacttacgccagagactttcctttgaaaggaaatgggggagccacagcagaccagatgcagaacagtatatggatctgaaagggggcaaacactgttagcactgcacggaatatctgcaattttgcaaccaatagtgtggcaaaccattaatcttatactagatcattttaaccttacagttaccagaaggtaagggtcttaccaagtaaaacaggaaaaaccatccaacttcaaagcactctcagtcctgcaacatacattgtaacaatacactatgtcaaatataagaagaaatagtgtgcagaaataacaaaaacacaagtatattcacaacctcatcgcattgtaaagggggcgataccataacacataggctccaggtacaccagatataaagtagataatggctagcaaccagatcataacacctattgaattgaaccgcaggattagtttgaagtgtcagtgcagatggcagctgatccataagataaatatatagtaaggtactcagtcagccatacctgcccctttaatccatgctgctgtagttgcaattatgttccagaaaagacatgccgccaatcctgcatgacatcaaagtttgcacaataagaagcagctttgtagagcaatgctacaccaacatgcaaataggtactagctctcacaaccaaaattcagtccactaaatagtgcttctttttacaagatgccaagtattgttagcgttgctttgaaaatctttttacagaaagacatttagcccagctacaaaacagggtagacaccacatgcttatgcttattaggcttacataattactgcaccaagaagataataactatttttctcaaaagacacaggttgcaacttctatttttttaaaaaagaatctcttaattggatatataagtcaagattagagaagttcattgatatcaaaatgtctcaaagtaggcacgtttttctcatgtcactactcacttctggcattgactcagcagaaattcattgattggacagtaaatgtagtgattcaggcagtattttattcacaatgtttaagcaaaaggatataaagaattgtggttccaccaggtattttagttcttgtgacagctttcccaacatgagggaacaaaaagagagttaaaacttaaaactaaaactaacacttacccaacaatgaagaaaatgcaaggtattgcatcctttgtaggtggattggtatctcatttgaaatgtcatgatgaataataggaagaagggtgcccagtttttctcttcaatgcccatcccagctgaaaaataaaagaaagagttgaaaggcagaagccgcaactaaaatggaaaatagattgcaccagaccaaacataagcgcaaaattagcaagaatagccttttcaagaaaggcgaacacaatgtactccctccgtcccaaaaaacgaatctacgactggacgcgatatattctagtataatgaatctagacagagatatgtccagattcgtagtgcta

SEQ ID NO: 91822 - DNA, 2458 bp, Oryza sativa
gacagaagctgatttgcagccattcaagtgcttcttccttgaaggttggctgttcttcggattcatctatcctgttgttccctaacagaagaaaccatgtagggtttgtcattcgggttgagctcggaccacctgatgagccccgtggggatcctttgctgagtccggtgacgcacacaccaaaatctacggctcagcatcaaacctcggtcttgtgccgtttccgtggaggcagccgatggggattaacggtttgtcaagcggactgcacatcttttgaggcccagggtagcagtcgtcgcggcttcgccgcagatccctgtcgacttgctcctttttctgatgttaggttatttcaggaaggttgctttcgtagttcagttaaccctcctttcttaaggatggctcttttgcttggatatgtaatggggtttattccctagatctgttcctgcttaataaagttgatgtgttttcaaaaaaaaaaaaaaaagccgtggagtggaggagagaggaggccatttctgggaaaagggaaaaggcctgtggcgcgcgggccccgcgggcgctgaggctgacgaggaggagggttggctggcggtgtggacgtttgtttacgaaaggcgcctgcacccggcgtgttgcagcgcagcgcagctgcggctgcagcatatgactcgtgtgacatcacgagccaggttgttttcgtcgcgttcctcgcatgcagtgcaggcttttgctagcagcttcccccgccgtctcgcgcacgggagtttcgccgggcgcgcggcccggccggccggctggctcgatcgtcttctgcgccgagcgcctctccatcccgcgggtttccgccgggcgaggaggacgcgcgcggggatcgtgcacgcgagtcgcgcgcggtggagtttgcgcggccaaatcccggtaatcgtgggtgactcggtgcgggtgtgcgtggtgatcgactgatccgcgctagggtaggttggacgtccgcgcgcactcgatgtggtgtgtcacgcattgggggtgtgctttggtgagatcgctgctaacttcctggcacaaaagaataaatcgtggtagtgagaagtgtaacacgacgtcctaacaagtgtcggaggtagcgcgagctgtaccccttcgtggtagtgatacacggcccaacattgttgtgaccgcattaaatattaacatataatcagcagttttgagctgcttaatgatgagtggagcgcagaggattggtgtggtagtatgagcatgagccacagaaagtgctgttgtgtgaccgcattaataagccagttttactcctatactactccctccgtccccaaaaaagacaaaccctagatttttgtatccaaaggttgaccgtccgtcttatttgataaaattatgaaaaaaaataaaaagacaagttacgcataaaatattaatcatgttttatcatctaacaacaatgaaaatactaattataaaaaaatttcatataagacggacggttaaacgttggacacggaaacacaaagtttatcttttttagacagagggagtatatcagaaagtaaatttagtacttcctccgtttcacaatgtaagtcattctaatatttcccacattcatataaatgttaatgaatctagataaatatatatgtctagatttattagtatcaatatttaatacgagaaatactagaatgacttacattctgaaatggagggagtacgtctgcaaaggctgaatcacgtgcttagatccctgacccctcacgataggagaagctaggcacatagtagtggactttttcatgcatgcatgcagaaggagctggcagggtgaatgaagcaatatcgcatgttcttcatgaatcatgaggcaagataatggaaccagaggactttcaacttgggcagcaaattgatggtattgttattgtgtttcacgctaactcgactatttttttaatgtaatcatttgacatacccttttttttcaaacataatggaatataaatacccaattacgacaaaccggagtgttttttataaaaaaactttaaaaaaaaactacgacaaactggagttcaatccatcaatgatgagctcaaaagcaaggatctgattaaacttactagcagtactactagcttttgactgctaattgtgccgattagagggcaaaacacgtgccaaaacctaacccaataattgggcaggagtttcgttgcggcccggaagcacacacataaagattgattggtcgatcgttcgatctaaacaacccgcaaaagccaggccggagaagagagcgacgccccgggccgcacaacccgacgcgtagccgctctctcgcccacccgcgcccactggggcgttgctatagctgccaactcgaaaacaccccgcgagtcgccaactcgccaccgcgccgcaagccacaacagac

SEQ ID NO: 91823 - DNA, 655 bp, Oryza sativa
cggagctgcgcggccaggacatggcggacaatttctcctggtcctacaaaaggtaccgataatttcataacaggaaggcgattcatcaatcttgcccgccttatcgtcatcgtccatgatgatgatcacgcgtggttatattgttcggtgtttctttttgcgttaattcctaaatcatttttagcatgttcttgcttacccgatagatttagcaatttaggaatgtttataattgattcttgattaggaagtacaaggctgggtatatatggcaggacctgatgatggacgacgacctcatcacccccatctccgacaacgagtacgtgctcaagggctgcgacgtccggcgagccaccgaatcgccaaaggagaagtcgtcttctttaggtgcggtgatatttttttctggtcttctttttctcgttcgacgatgacgatggctcgtgattaacaaattcacaaaatttgtttgtgatagctgaagagccaaagaaactggacagtcaggaagtgaaggtcgcgtgcgatcagaagcaagtcgaggaggtgacgacgacgacggcgccagattccgacgagagatcgccgaagacgctgccgccggtcgacgaggactcgcccggcgagccggcgagccgtagtacggcgccgt

SEQ ID NO: 91824 - DNA, 1585 bp, Oryza sativa
aaaatagcgcgatgccacctgacgaaggaggacacgacggcggtagtgcagcgccactagaggaagatgaagcattccaaggacaccagcgggttgtccagcgactccttcccctcgccgtcgccgccggcgctggcggcgtccgcaatgctgggctcgccgtcggcggtcatggcgtcctcttctggctgcggaggtggtggaggcgggggctcgagcggagaaggaggcgcttcctgcacccgccgcggcgacggcctcaccgggacgggcggcttccgctggagggacggggctgggctcgcggcgcggcgctgctccggtgtacgcttcgctgccggcgacggcgacctccgcactgagcggtcccgttgctcgcgccgcggcggaggggacgccgaggcccgggcgctgcgggagcggacgccgtaggcggcggcggcggcgcggtcgcgccgggaaatggcatgggccagctcgccggagacggacaccgggcgcttcctcctggccggcttccccggcgaccgctctggcccggtcaccgagctggtcgcgacggacgactcggacgccgcctcggacctatcgtcggtggcgagcgacatgcagctaccaagatcgctcaccgtgacatccgcatcggcgctaggcttcggcgcctgcttctccgcctccggctcctccaagacagccacattggcgacgggcttcgcctcggccctgaccttagcgctcggggtctcggagagcacctccttgaccttctcctcctccggcaacggcggcgggggcggcgggtcgcgggcctcggccggcggcttgcagcggcgggagaacacagctgcactggccagctgcttcctgcgcttcttgctgaagcagcagcccatgccttccagctgccaccggcacactagctaggcggccatctccggtggtcgagaccagcgcgaagggtagtgtggttggttgtttgtgtcgggaggaggggtcttgtggctctctagtgtgcttcgatttgggcgaggtggttatggcgatgcgaggggactgaaactgaaggactagtgtgcagcgagtgagtggcaggttatttatgagtttgatggtgttcgcttaaaatggtggtaataggtacagggtacagactacagtacctgtgtaccactctgcctgatcgtaatcacacattatgcattctgtgtttctgtttggtggagtggagacggtgaaagcctttctgaagcgggtatctttggaagttctagcaaggcagtaaaatcattcggttgtgattttgtgaaggcaccgttgatcgttatggatagcaccattatcggttcagataaagatacacgtgtaccgcccaatgaccagtacgagagtacgagtcaacaaaccaataccgtaccgactcgatctagagccacaccgagtcaccgacgcagtcgtgtagccatcaggccatcacccatgcttcgtaccgtagcagcaagcctactcatatcacgttgatgtggaaatacaacgccggcgagacgaaactgcccctgttcctcggatgctaccacatcctattcct

SEQ ID NO: 91825 - DNA, 601 bp, Oryza sativa
aaagaaattgcagaaatataaaatgcaagcagcttgtattttgttaagtggataagaaactagacttaaaacatattagtttttgcattccaaacttagaagataaactcgagtgttgcaccaaatatctccgtgctattttctgcacaaaaccttgaaaaacacctattgttatttagtcaaacaaggccaatgtacctatagttatttagttggagaagaatgcccaatcccagtaaaagctgcaatccaaggaagcccactccttgtgtaggggttagaatgcctgatgcaaaaggcctgcttttggtgcgctcaacctacaagaaaacaaatacttttctgtcaaagatcaagatgctgaaatcccatcagagagtaaactgctttatgttcctggttgaccattccactgaattgttcttggagcaactggtgatatggtgatgacatttaatatggttattggttttttaacttgaaaactgcaacagtctgaaaggcatttctcttaacaggagaaagtacaacgaaacggaaacgattaacacaaatcaccttgttatcaatgtctcgatcaagaagatcattgaccgtgcat

SEQ ID NO: 91826 - DNA, 687 bp, Oryza sativa
tactgttgccactatcgtcgagaccagttcaacccatatttatgttgcggtcgtttgtcctcccaaagtcaagttgatggttttgtgtgttttgaggagggtagattgacatttatagatgaacaccagggcgattttagatgcgaacacgttcaaggcattgcagatgcagtcgccaaaggttgtttagacggtaatagtgttggtaagcgacgaattctccctgcaagtttcactggcgggagaagatatatgtaccaaaattatcaggatgcggctgctatttgtcgtgtgtatggtgcccctgatgtgtttaccacttttacttgtaatccgaaatggcctgagattgaagaagcattgcgcattgagccagggcagcgttcgacagattgttctgacattgtttgtagagtttttaaaatgaaacttgatgagatgtttctgatattatggctggtgttccatttggtcgtgtgcgtgctggttagtgctctttttttgcccttaacttagctgtgctctttatggtctattgttttattgatttttatttggttgttttgcctatgatatgtttgtagttctttatagcgtggaatttcagaagaggggccttccccacgtgcatatactggtgtagcgtgatgcaccaagcactgacgccacaccatttgttgtggatac

SEQ ID NO: 91827 - DNA, 605 bp, Oryza sativa
aaaataatacggcatcatatttagtgacatatgccgaggtgtcgaaactcttgtagtcgtcgtggttggtgaagtagcaaagcttgcgaagtagaagcaataaagtttgccggtgccgaagataataaagatgaagtcgctccaccatggtgacaaagttgcatagctgtaatgaagtgaacacgagtcggcggtaacagaagcaaaccggtggtgaagacgcgcagttgtgaagataaaagcaccagtcggcggcggcataaccagtcggcgacggaagacgatgatgtccatcagtagtggtagctattagcggtgacggtgatgtagccagccgtgaagaagatagcatcagttggcgtcataacaggccagccgtgcaggcggtgacaccagtcggcggcggacgaggcggccggtcggtgaagacgtagacgcccaacaacggcggcataataggccagccgtgcaggcggaaacaccagtcggcggcggacgaggcggccggtcggtgaagacgtagacgcccaacaacggcggcataataggccaacgtgcaggcggaaacaccagtcggcagcgaacgaggcggccgctcggtgaaa

SEQ ID NO: 91828 - DNA, 2875 bp, Oryza sativa
  unsure (1)..(2875): unsure at all n locations
aggcgacggtggctcgcgcggcgcggcagcgggatgccgatggtgacggcgtggcagcggcggcgcgtggctcggagcgacgatgggacgtgacggcgacggcgcgcggcggcacggggcgcgagacgaagggcgcgcggagcgaggtggcgcggcgcagcagcggcgcggcagcggcggtggcgacggcgcgcggcgacgcgacggcgacggcgacggcgcggcggcggcgacgcggggctcgggtcgtggccgggcgcgcggcagaagagggtctagggctaggggaccacgtcgagcacttagagtgtaatgaacagtgtctttttcctatttctctcattttagtctatttcttatataaatttgcacacatacattttactcaatatttgtgttatctcaactaatgaattcaccctagattaatattactcatattttatttatataatttatttgaatttttaattagggttaattcttattccatcgcattttaaatttaattgatccaaaaatggttgcaataatattttatttatttctatccacacctaatctttactttaatttatatttattttaccagtttgtttttaaggtttattcctaattaactatttttactcacgattaatgaacttcgaaatcaaatccaaataaaataggtgaataagaccggcatggtgcaattaatttaaaagctttttggaatccgtatttttagagttttgattttgtcggtcgaattttcaggatgttacaaacctaccccacttaaataaatctcgtcccgagatttcttaccagttttctattatatgcgggtattccgttctcaagaattcttcactttcctaggtggcttcatcctcagtgtgattactccattgtaccttgtacatacgccacactttgctcctagtcctcatttcggcttcatccaatatccggaccgggtgttctggatacgtaagatcattgctaatgtgaatctcttccagcggagcttattcttccggcactcgtaagcatttctttaattgagacacatggaaaactgggtgcacatcggcgatatttttgggtagctgtaactggtaggcaacttctcctcgtctagcgatgatttggaaaggtcccacatatcttggtgctagtttcccgtttaccttaaaccttttcgtttccctcatcggagaaacctttagataaacgtaatctccctccttaaattccaggtttcttcttcgggtgtcggcgtaactcttttgtcgtgactgtgctacttttagacggtcacgaatcaggcgaaccttttcctcggcttcttggataatgtcaggtccaaatactgcccgttctccagtctcggaccacatcagtggagttcgacatcgtggaccaaacaatgcctcattgggtgacatctttaggcttgcttgaaagctgttgttgtaagagaattcggcgtagggcagacatctctcccagtctttgctaaaatccagagcacaagctctcaacatgtcttccaagacctggtttgttctctctgtctggccatctgtttgtgggtgataagctgtgctaaacgcaaggtaacttcctagggcttcatgtactttcccccagaaatgcgaggtaaactgtgtgcctcgatcagatataattttcttaggtacaccatgaagacatactatcctggtcatgtataactcggctagcttagcacagctataatttatcttaacgggaatgaatctcgccgtcnnnnnnnnnnnnnnnnnnnnnnnnnaaatggaatcatatcctgttgcggtcttgggcaatccaacaataaaatctatacctatctcatcccatttccattcgggaatcctaaggggttgcaacaaacctgctggtctctggtgctcagccttcaccttctggcatacgtcacagagcgttacgtactcggccacatctctcttcatattgggccaccagtacccttcctttagatcctggtacatcttcgtactttcggggtgcaatgaatatgctgatttatgagcctccttcagaatcaatccccttagtccaccctgttcgggtacgtagattctctttttataccacagtgtttccttctcatccattgagaattctctcgcacgaccagcggctatgcgctccttcacctcctggatctctccgttgtccttctgggcttcctctatctgggttctcaaaaggggttgaatgtccagggtgtttatccgtccacgaggtactatatgtaggttcagctaggctatttcctccctaagctcaggggccatccctttcattctcaggtgattgcaatagctctttcgactcaaagcgtcggccacaacatttgctttgcctgggtgatagtgaacctctagatcataatccttgattaattctaaccaccgccattgccttaagttgagatctgactgggtgaagatatacttcaggctcttgtggtcagtgtagatatcacaatggtttccaatcaaatagtgtctccaaatctttagcgcatgaaccacagctgctagttccaggtcatgggtagggtagttttcctcgtgtggtcgcagttgtcgcgatgcataagccacgacctttccttcttgcattagtactcctcccaatccttgccttgatgcatcacaatatataacaaagtctttcctattgtcaggaagaactagaataggtgcagaggttaacttttccttgagctgctcaaagctttcctggcactgttctgacccacacaaacttcttttccttcttgagtagttgtgtcattaagtcgagctatcttagagaatccttcaatgaaccttcg

SEQ ID NO: 91829 - DNA, 1237 bp, Oryza sativa
tcgcccgaagcatcagaccaattatcacccatgacttctggggttcgggttagttacctatctcaataaagtatatgattggtttgaggaacgtcttgagattcagtacgcctgacggaactcttctttattttttaaatttgcattagagccagttgaaaaacgaagaacctttttttgttgttacagttccttaagcataaccagttacgaccactgatctatatatatccagccgatacgagggtgactgtctgactacctaaagttgcatatccaagtatagatccctagagaagagaagcaaaggtataagccaagaccctaggaagcattactcttcttttcattccaaattcttcaataagactgtgcgaacaagcgatgaatctatcatatccgagaatactatagatattgaacgaaggcgttcattttctgtctcagaaaacataatccagtgtcaagtccagtcaaattgaaaatctttttttcatgaaaaaattttaaacttgacgtagaacattgtataaaaaacgagacctattcctttatggtagagatagatttatgatagagataaatttttttatagtattttattagtaaaaatggttccttcttctctttctttctttggttaagcgaaaacaatctcgagaaaattccttacttttccatttctttggaaagctcctactaagattagaaattccccaataaagctagcgatagccttgtttcggattttctagcgatgactagccctttgacggctcctatccctagacaccggcccccggtaccaatactagagatttgcccccgagctagccctcctattaatagggttgctttgttcacgcgcaccacgactcattcaaaagagagagtaaaaggaaggatttcccagaattcgtaccaactcggcatttcacgagttaccacacgagaaaatcctatctttcaagctttctctaactaacttcgccaattgtccttcgctccagatggtcaatgtctttagactagccatcagcccgattcaaacctgcagtcttcaggtcatgagcatgatgagttgaccaattcctccggctgttctgttcttttctttccttttgggttggcggagagagtaagaagttctttcattcctatcccgtgtctatatatatatatatatatatatatatatatatatatatatatatatatatatatatatatatatata

SEQ ID NO: 91830 - DNA, 1204 bp, Oryza sativa
catgaaagcgggcactattgatcattgaactttccataccatttacttcacccttttttaccatatttagaagttcttccctgaagcactattcatccttgaactttccataacatttaatttttacccgtttgatcatatgtaaaggtgtttccatgaaatggtaaatatatatgcttctggaggaaaagtttagggatgaatagtgtccgattttgatatttagggatgaactttacactttcttgaggttgtggatatgaaaaataataattttccataaattcataaataatattggaaatgattatttaaattattcatattagatttaaaaatgataagatgtgagaaataataggaagagtttgtagcaaatctgcaactgtattttcatatgcgctttcaattatttctatctattatttactccttttaaaagaatattttactaacaactccttcatgtttgtacctactctttctttcatgtgttttaatattacaaaatagtcctttccacatatgactatcttatttcatttctaaaacacatgtttattatacaaagacacatatatcgacgaaattgtgaaaatcacaaccaatttgttccaagcaatattagcacacatataatttattttaatccaagcacgagtatttatctagttatataaaaaaaatcaaaacacagtgaaaaaaatccatatatcaagctagagtttctatatcaattagagctatatgtacttaaatatcgtctccgcttgctgttaattttttagacaattagaaagtatttcgccagtgcacagagttcatgcagtcagctttcatattggcatcaataatttacatggaaaaatacctacgttctaaacaattccttatatgtgctatactaatttcttcaggcaccaaaactaactttcaagaaaccaatagggagcatctgtatttctggccacaagtttattggatgcccaataccatgtggtgttctaataaccaggttgatggatatcaatcatgtaatgtccacaaacattgagtacatctcttcaaatgacacaaccatagcaggaagcaggaatggccatgctcccatctttttgtggtatgcactgaagcgtatagggtacaatggtctttgcaagacggttgaaaattgcttaaaaaatgcccagtaccttgcacttcg

SEQ ID NO: 91831 - DNA, 959 bp, Oryza sativa
gtgtgggaaaagaaagaatatatagaaattttgtttatttgctaaataaggttttataaaataattgagtaggaaaatatagtgaaagttaatcttaaataaaagaaaacaaactaaattgaaaactaaaagaatttaaaacttaaaaaaaataaataagaattatttggtggaatattttataatttttgtatgaataatgatatgtcattattgtatgactgttgaaagagtttgtgattattttgtcattattgtatgattgtcattattgtacgaatgattatttgtgtacgattttttttgcatttcatgtagatggatcggcaatggatgtacactgaccggcggtccaaagagtttattaacggcgtgcattattttttgagagtggccgaagctaacaagcagaagggttttatttgttgtccatgcaataagtgtaagaatcagaaggagtattctgcatccaggactattcatttccacttgtttgagtcggggttcatgccaagctataattgttggacatcccacggagagcaaggggttgaaatgaaagaagatgaagtggaagacgacaatattccagactttgctcagtacgctgaatttgaaggaaatcaaacgggcgaggaggacatagatgctgattataacgacgttgcggatgatcttagtcagatgttgcaggatgccaaggaggactgcgaaagtgaaaagggggcccataaattggacaagatgttagaggaccacagaacgtcgttgtacccaggttgcgagcagaggcacaaaaagttggataccactctggagttcttgcaatggaaggcaaaaaatggtgttagtgacaaggcatttggcgatttattgaaactcgtcaagaacattcttccggagggaaacaaattgcccgagacaacgtacgaggctaagaagatagtctgccctctagg

SEQ ID NO: 91832 - DNA, 1352 bp, Oryza sativa
aagccgggcggcggctggaggaagaaggcgacggcggcctgacgcgtgggccccacgcggggcgcgcggtcagcgcgcgcacgtgcgcgctcgggcgggagggcgccgctcgggttgggccgggcggccggcccaggaggggggggggaaggaggcagcccgggagagagagggggggaagggagctgggccgagaggggaggaggcccaagaggagggagagaaggagagggagagaaagagagggaggagggaaggacttcgggctgggcttggcccaaaggaggaagaggagggatttttagtttttctttttaataaactttgatcaaggttgttgttgcttaataattatttccggtgctctgaaaattcaagtcaaatttgagggctctttttagaccaaggagaatttaacaaaaattctccgggccacattggaatttttcttgtacgtattttagtgtttgccaatttcttttcgaattttaattaattctattattccttttagcgaatgatttttatttcgggatgaatttatcaggacgtgacaatgtgatccttgggatgaattggctggcccaattccaaggagtagtggattgcgcgagacgcactgtcactctgtaccgagggccggaacaaccggttgttttctttgcacccccaacctctgtcagaagttcagaactgcatcagatagggctgtcagaaatccccatagtcagagagttcggagacgtgtttccggaagaactacccggtatgccgcccaagcgagagattgagttccggatagatcttgctccaggaaccactcctctgcacaagcgaccctaccgtatggcagcaaatgaactggccgaagtaaagaaacagttggaagagttgaaagaaaaagggtatatacgtccgagtacttccccatggggtgctcctgtgatttttgtggagaagaaagacaaaacgaagaggatgtgcgttgactacagagctctcaatgaagtcaccatcaaaaacaagtaccctcttccccggatcgatgatctgttcgatcagcttaaaggtgccactgtattctccaagattgatcttcgttccggatatcaccaattacgtatccgtgaggaagatattccgaagaccgcattcaccacgcgatacgggctgtatgaattcacggtgatgtcattcggtctaaccaatgcacctgccttcttcatgaacttaatgaacaaggtgttcatggaatacttggataagtttgttgtggttttcattgatgacattctgatatactcacaatcagaggaagaccatcagcaccatctccgtctggtgttgggaaa

SEQ ID NO: 91833 - DNA, 2271 bp, Oryza sativa
ccgcagtttcttaggtttggcaggatactaccggaggttcatcgagaacttctccaaaatcgctcgacccatgacacagttgttgaagaaggaagagaaatttgtgtggagcccgcaatgcgagaaggcattccaaactctcaaagaaaagctggtctcctcgccagtgttaatcttgcccgatactcgcaaggatttcatggtttattgtgatgcttcgcgccaaggattggggtgcgtgctcatgcaggacggtcatgtggtagcctatgcctcacgtcagctacgacctcatgaaggcaactaccctacccatgatttggagttagcagcggtggttcatgctctaaaaatctggcggcactatcttattgggatacatcttcacccagtcagatctgaatcttcggcaaaggagatggttagaactcatcaaggattatgatgtgggaattcactatcatcctggtaaggccaacgtggttgccgacgctctaagtcggaagagccattgcaacactcttaacgtccgtggcattccacccgagcttaatcagcagatggaagccctgaacctaagcatagttggtcgtggattcttggctgcgttggaagccaagcccaccttgcttgatcaaatccgcgaggctcagaggaatgatccggacatgcatggactcctcaagaatatgaaacagggtaaagccgctggtttcactgaggatgaacacggaaccctatggaacggaaagcgggtatgcgttcccgataacggagaacttaaacagctgatacttcaggaagctcacgaaagcccttattccattcacccgggcagtacaaagatgtacctagacttgaaggagagatactggtgggttagcatgaagcgggaaattgcagagtttgtggccctatgtgatgtgtgccagcgtgtcaaggcagagcaccaacgaccggccggactcctccaacctctccaagtaccagaatggaaatgggatgaaattgggatggatttcatcaccggacttccaaaaacccaaggcggatatgattctatatgggtagttgtggatcggttaaccaaggtggctcgattcattcctgtgaagaccacctatggagggaacaaactagcggagctctacttcgctaggatcgtgagtctccatggtgttcccaagaaaatcgtatctgataggggaagccaattcacctctcacttttggaagaagctccaagaagagcttggtacccgattaaatttcagcaccgcgtatcacccgcagacagatggacagaccgagcgtctaaatcagatcctagaggatatgcttcgcgcatgtgtcctagatttcggaaagacctgggataagagtctcccctatgccgagttctcctacaataacagctatcaagccagcatacaaatggcaccttatgaagcgttgtacgggcgtaaatgccggacaccgctattgtgggaccaagttggagaaagccaagtgttcgggactgatatcctgagagaagctgaagctaaagtcagaatcattcgggataatctaaaggtggcacagtcccggcagaaaagttatgcagataaccgtcgccgtgacctggaattcgcagtgggtgattttgtatatcttcgggtcacgccattgcgaggtgtgcacaggtttcaggcgaaagggaagcttgcacctcggtatgtgggtcctttccgtatccttgctcgtcgcggagaagtcgcttaccagctggagctgcccgcctccttgggcaacgtgcatgatgtgttccatgtgtcgcaactcaagaaatgtcttcgagtgccatccgagcaggccgactcagagcaaattgaagttcgcgaagatttgacctacgtggagaggccagtgaaaatcctggacaccatggagcgcaggaccaggaaccgggtaatccgtttttgcaaggtccagtggagcaaccacgccgaagaagaagctacttgggagcgtgaagacgagctgaaggcagcccatcccgatctcttcgccagttcttccgaatctcggggtcgagattccgtttaaggggggtaggtttgtcgcgtcccaaaacgactctaaaattcatcctcgaaattgtgcaaagaataattaaaattcatgtgaaagcctccaacaattaaaatgtgcaaagataaaagtcaaatgaggcttggaggatttttgtatatttcctaaaagcctaaaatgtgtaaataaattttagtgg

SEQ ID NO: 91834 - DNA, 517 bp, Oryza sativa
ccgccagcacttttttaatcatcctattgctgacattgcctcatttacggatgactttttagaaacaaaactatccgatgcaggcttaattcgtcacttaggcaaactcaaagccattcgtgataatgcaattgcttggcaagcccttaaagcccaagttggtgatgtttctaaatggctttggcagtttgtagatgccactcctcaacacaatgatgttgtagattatcgcaacgcccccgctcagactgagctcagcctaaaactttccaaaacgcttaaaaaaaatggtttcaaatttgttggtccaaccacctgctatgcgtttatgcaggcagtgggtatggtcaatgaccatgaaaatgattgtcaatttaaagcttcctaacccaccagaacggttcaaatccgcttaaggagtttccgatgagcaataatacgattcaggcttatgctgcaatgcaggcaggtgaaaaactggtcccataccaatttgatgcaggtgaattacaaccgc

SEQ ID NO: 91835 - DNA, 1206 bp, Oryza sativa
aaatgcaagaagacatgccaaaaaaacctgttatggcaagagcagtgatagctgatgtcaacacacttgaggagtttacattatcccagtaggagcaattagaggctgagggggaaagagttcagctaataggcagtgaagaaatggaatctcaggagttagggggagataacatcaaaggtaaagaagatcataagagtgaagaggaagctgaatttgaagaaggaaagaagaacaagaggctcagagataaagaagataagaagatattggaaatggcgatggaaaggaaggaagcaaaaaatgcatttatcaacaaaggtaacattcacattccttcttttatttctgagtccaatatttcgctagttcaaatggcacaagtgataggagttgatttgggttgttctattgatgctatagatgctaacacacaggttcttagagacctagaggtagccagaataaatttgtataagaaaacgatgagggaaaaggaaaataatggagagctcttgcaaaaaacagggcaacttgaccctgaagtaactctagatgtagaagagactgatgaggagaatgatttggactttgatttagcagaaattttgatgaatcatcttaagactccaagatcagggaagaaaaaggggagaaaaggaaatcttaaaatttgcaagggaacccccaagattaatagagacttgggaaggaggaaaacaagaaaataaatgaaaggtttaatctggaacattaaggagatgtgggatgatgagaaactgcaacatctaaaagaggttttacagaaagaaaaaattgatttcctgggcttgcaggaaacatgtaagaaagattttactgcttcctttttgaacaaaattaattcctcttatatcactaaatggatgtggtctccttccaatggaaggtctggagggatcttggtaggtataaatgaaacaatctttgaaattatggaagaggagtatgagaatttttttgtgagagtgttgttaagaaataaggaagataattttcttggatcttgttgtagtttatggtgctgctcagttggatcagaaaagggcattcttagcaagtttagcacatgtttgtcagaagaacaagggccctatcttgttaggaggggactttaacataattaggaaagagagtgaaaagaataagaaaggtggatataatagg

SEQ ID NO: 91836 - DNA, 653 bp, Oryza sativa
attcctgcagccctgacgtgtcagcccagtcacaaaaatacaggtgaagcccacatgtaagtgactaggaaaaatatatagaaagtgggacccacttttcatccctcttctccttctctatcttttccccaacaagcagcagagcaagaagcggtggcagtggtggtgtgggcagaggcaacagaaacagtagtgacgttcctgtgggtgctatgcgtgtcgacactgcgggcctcaatagcggtagtcacctcctacctcaacatctaggaagggatccactacgctctctttgtcaccgtttgccacctcttcgtgctcctcttcgcctttaacttcctttgtgacgtcctcaacggcgccagcttcaaccttaccgccatcgccaccttccacgccaccaacctcgattggcacttgggcagggtgcaagggcagtgggtggagcgctggcaatctcagagctgatgccaacgcagtacaagcacatactcgagggccatcctcaaggtggatctccacactggtggtgccgttgagttggtgctcaccgcaatcgagctcgtccatggcgtcgccgcgacggtggggagaggaagggccgccgctggatcgaactgcaagagccaccaaaagcagccccaccgtattct

SEQ ID NO: 91837 - DNA, 1666 bp, Oryza sativa
ccaccctctcgtcggacccatttatggatggatgcgtggtcgccggactcatcaacgatcaagctcccatacccggctaccgccgccagaagattgcgttctggcaaattgaagatagggtggtcgtcggctacttctacatgggtgaagcgtgctgggatgcggtggacgtcgtgcgccacaatggagccttccatttcctcaccaagggggaggacatcatcgtgggcaatccggtcttcgctgaagcgggtgcgccgccccaagtgcaatgggagtatcgctgcttctcgtcgcaggggcgcggctacgacgggcagcacgtcgtggcgcgctacctcgtggagtccagcggagaactgctcatggtcgtgaggtgctctcctcgtcctggagagttcacgtcagcgttcaaggtgttccgaatggcacaacccgaggaagacgacgacgcaccctcactggatggccggacgatgctgttcgtcgggcgtccctgctccagatctgacggcgatgtggttcggtacatctggagggagctgccctcgctggaaggccggatgctgttcgtcgggcgcggctgctccagatcctacgacgcggatcagtaccctggcttcgagggcggcatctacttcttcgatcatcggatcgccgggccgctcggcgacgcgccggcgcagtacccctgcagcgactgcgggaaatggacgggaaaacctgcactccaggtggaccgcttcttcccggagcaagacccatcgaactacacctctcaagtttggttgctcaacgggtaagctagtttttgatctgtctaacaggtgcttcgtctgcattgtctttgtttctttttgctgagtttggaagtttggatggtattgtagtgctgagattgtagtttctgatcagtctccaactgttagaagaagcagaacacctttttctagtagaaatctctttgctattgcagctatgatcaatacaccgtttgataatttctgcttcccacttaattgcatgattcaatcattagtatattcctgttgcaactgattttcagtgcggacatgtgcgtatggttgtgcttatattttctttgtgaagtgcacatcgttttgactgatagatggtgttgtacctttgccttgcacgaattggatttctatggattctgatatttggttatgtagctctgtcagggcttttcttgaaaagccactgaatgaagtatgaatatcgaggttataaactgaatgaagaacccagaatggttggatcttgatttattttgtattctttaccatgatggatttatcaaatttcagtcaagctttgttatgcctctctggtgcctgcagattctgctggcttagtcaaatttcctattgacaaatcaattctgcagaattgcaggctatatttttcctctttggaacctgctgattctttatggttagcaggttacctgatatgtaatacacaagacacctctcaaaaagttgtcatacacagacgcaatgcttgctaattaagttggcatggtatcttaccctcatctgttttagggctcatgttcaacccgttcattttgttggtatcgtattttagtccgaggtaagtagtagctaaacattctcataaaccatggggctgcaggaat

SEQ ID NO: 91838 - DNA, 558 bp, Oryza sativa
atatcaactttgttgaagcagggtaatgggagaatcgctacacccctggtcgaggaccgggtagtagccgtaacccgaccacttgaagtggaaatagtgggagaaacgctacatcgctggtcgaggaccaggcagtagtcgtaactcgaccacttgaagtggaaatagtgggagaaacgctacatcgttggtcgaggaccaggcagtagtcgtagctcgaccacttaaagtggaagtagtgggagaaacactatatcgttggtcgaggaccaggcagtagtcgtagctcgaccacttaaagtggaagtagtgggagaaacgctacatcgctggtcgaggaccaggcagtaatcgtaactcgaccacttaaagtgaggcgagagagatcactacgttttactggttcgagaaccaggagtaggagtctcttaatcacctataggggcgctaaagttggtttattacatgtgcatatcatgtggccagcatgactcacacacccaacttatagcatatccggatgtccgttcgcaatcatgtcgggtgatcaagccgacg

SEQ ID NO: 91839 - DNA, 584 bp, Oryza sativa
tcctgcagccctgagagaatcgcggtcgtatcgcgtccagtcggtgacggtgttgcgcgaacgggaaaaacgggtgggcgtgccatcggtggtgacgatgggtacacccgccatattggcatcgtcggcgctgcgattgagataatcgacgcccgcgcggagtagctggtctcggtcaggtcggcttccaccgtgccgtagaagatgctgcgatgcgatgtcgccctatcgatgttgagaccgccatcctgataggcggcaacgacgcgcgcgcgtacccgcccgtccttgtcgagggggccgcctacatcgacctgaccgcggacatgatcccagcttccgccctgcgcttccagctgtacctgccagtcgcccggcgcacgcttgcggaccagattgacggttgcggagggattgcccgatccgttgagcagtccggaggcaccacggatcacctcgacacggtcatagatggccatgtctgcataagcgtccccgaatccgtaggccgtgggccgggcgatgccatccacctgccagttgttgatttcgaaaccgcgcgaataaagcccgctctgatcgga

SEQ ID NO: 91840 - DNA, 954 bp, Oryza sativa
attgaaaagtacaaggctcggcttgttgctaagggctatactcagaaagaaggcgaagatttctttgacacttactcacctgttgccagattgaccacaattcgtgtgctactttccctagcagcctcacatggtcttctcgttcatcaaatggacgttaagacagcttttcttaatagagagctggatgaggagatctatatggatcaacctgatgggtttgtagttgaaggtcaagaagacaaggtgtgcaaattgttgaagtatttgtatggtctgaaacaagctcctaagcaatggcatgagaaatttgatagaacattgacatctgcaggcttcgcagtcaatgaggcagataaatgtgtgtactatcgccatggtgggggtgagggagttattttgtgcttgtatgttgacgacatactgatatttgggacaaaccttgaggtgataaatgtggttaaatcattcttgtctcaaaattttgatatgaaagatttgggagtagctgatgttatcttaaacattaagctaattagaggtgagaatgggattactctcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacttctaatccgggagatgatcactggcgtgcgcttgagcgagtaatgcgctatctgaaaggtactatggaattgggacttcactatactgggtatcctgcggtactggagggttatagtgattctaactggatctctgatgtggatgagatcaaagccactagtggatatgttttc

SEQ ID NO: 91841 - DNA, 1514 bp, Oryza sativa
acctcttcttgacactggcggcggtgcccacggcgagtgtgagctccagctccgccgccgccgcctcctcgtaatcgttggtctcctcggcgtcctcctcctcggggctctgcgtgtactcgaccgccagctcgaccgccagcacgggccacgagccacgggccgaccgtgagccacgggccgccgttccttcggcgacgccgcttcgcctcgcgcctacgacccgtccggccccgtgcaccactgcccaccggccccgggcaccgccgccctccgcccatccgccgccgtgcccgccgctgccgctcgcggtgccgcccacatcctcccctgcaccacccagtgaccgtgagagagagagagagtgaagagagagaggaagaggggaagggcatgtaggtcccacattttttaaaaaatagaaaatgctgactgggttgccacgtgtacgtcacgtaggacaaaaccgctctgaattggatcgaggggggtaattcgtctggtattaaaagttcagggtgaacaatatctgcttttcgagttcagaggtgtaattcggtcgaccgcgatagtttaagggggtaattcgtaatttttcctttaattttagtcctatgaagtttctactacacatagaatcggatgtagtataatagaatcagattcactagatttaaagaaatgaatggctcacaaacattttaagggtaccttaaaaacctaccattactacatactagtactttatgcatttaaaaaatattcttttcttaaaaaaattaaatactactccaatccctctatccctatttgacaatcaaatctgcaaaagatgctgagaccaagacaacaaaaacccctttgttcccacagtaaacctcatatatagatcaagagatgtgatgctgtttaagtgttgcgtgcatgcaaaggtgaaggtgaaggtgaaggagtaaaatgcaaaacgcgcgcggatgcatatatacgcgtacacaaataaacgaggagacaggcagcgatgccatttgctcgtgcataaatgaacaaatagatgtcaatcagacattgatcaacggggagggatagagaaagcattatatagtaaggctgtgtttagatctaaacttccaactttttccatcacatcaacctattatacaaatacaacttttcagtcacatcgtactaattttaacccaaatttttaactttgaaaggaactaaacacagctaactggttgctcggcgaatgatttattcagctaaggcttatatataaactgaaaacgtacttaaacaatgattttttaaacaaagtggcataagacttttatttttttagtcgtaaagaaaccaagattaaaaaaaaactccgtataacacaaatataaacctaagttaatttgaaaattttaaattcaaatttggcctcaaaataccgtcccaagcaacttcgcactctgcagaagctatcatgaagcagggatagcagcagcacgaatattaaatactgt

SEQ ID NO: 91842 - DNA, 1472 bp, Oryza sativa
ggcattgccaattttttgttctggttggtttggtcaataaaccaaacatgccatcagaaaatcacaatcaaacatacaattaactgccactggagatagtctacacttacatttgcagaaataaagactggtgatatttacatttctggttcacagtaacagttgcagttttccaattgatggtgttagttgaatttattcttcctccagactcctttctccatataatcaggttgatgctcaagatttaaaatccatcttttttatgaattcaaaatcagctcaggttagagtctgcaagcaaagtatgtgaagttataaatgcatccttatttaggtaagctacttacaacttactaactaatatgggagtcttaaaatagattgaagaaaaaaatattttagtagccaaaggctcaaaggtacagagcatcaactgttaagaatatcatattgtcattccttgcacgaaatctttgatgcttacctctagtgggatgaccgtgattaagaatatcatactttccaaggtcccccttttctacaaaaaagataaaccccctgttcaatggttcattgattatcccatcactcacaatatcatcataacatatcttcaccaataatctccacaggtgcagtttccgtgtgtaagtagatgaaatcgatttttgtccctaagggatatctccctttcataaacttttgaaacaaatttggcaaaattatggcaatcaacacatatgcgaagattcttcataacccggatagtcaatcctggaggagtgttcatcaatccaaaagttattgccagcttctcactgtgaccaagaagcatgcgttctttttgctcatcatcaacatcatgcagcacacaactcaagtctggaacaaagcccgctgctttgatatcgacaaatatctcttttatcttggcatttatgtctttcttactgggatggaaccgctcacttgaatggaaggggtgaataaccctgtcaagaattatccagctctgccctggttccttggtcactgtcttctccaacattagcttcctcactttgaaaacatctttccacatcccagcagcagcataaatgttagaaagtattacataattgccagcattttctggctccatttccagaagcttctgagcaacaagctcaccaacatgaacgttagcatggactctgcaagcaccgagcagtgaaccccaaattgatggagttgactcaaatggcatattttctatcaaatttaaagctttctctagtcgtccagaacgtccaagaagatcaataatgcatccatagtgtccagtgtggagaagtgcactttgctctttgaccacagtatcaaatatatcaaggccctcatcaaccagcccaccatggctacaaccagataaaacagccaacaaagtcacactgtcaggcttcacctctttatgcaaatctttgaagaga

SEQ ID NO: 91843 - DNA, 1394 bp, Oryza sativa
tagactgttggctgtcaaggcaaagtcaaaagcacgaacaataagtttcacagaaatgcacactctccttactagtacaaaatagtgcaaataaatgatgggaagagataaatttcagttttcagcagaggccaaactactcagttacaaaataatttaaaggagagttctgggccaaagaaatcagctatggtctatgaatcactgatacttccctaaactgccatctcagtatccaataggcaactgatacggatatatgcgtattggcgaatatcaaagcattttccagtattaaaaaaaaaggtcgatatgtgggcaagaagggagcaatacatatacacaggaaattgttgttgtaaatccacgcaagctaaacttgcagaaatcttcaagaaacagtatttgtcataatggtacctccgtagtcaagaagttgtctagcccaccaaagtcgaccctcggatttacagctgcgagcctcattgacaagtactgaaacaatcaaaattaccaaacaacaatgacatgagtgaacatcttaaggtaaatgggttatttgggacttaaggtatcataagcaaaaaaaaaaaaaaagaacagttacctcaacttgcctttgaagagattggacatgattgatgatctcatccagtaccagtgctgttcctgatacctgctacaaaaaacagatcaaacaactgttgtcgataaagtaattacttttcctgagttactacaataaaacaatgaatctcatgatggaaaaaaaaaacaattcaaaactatgacaaaaccacataaagtttaacctcagttttggatataaagaatggagctaccactataaaacaagaacatgaaacaaaatagcagcagcagtttggttgcagaatccaagtgcagaagttggtgcatagtactactcttcatttttttcaaagtttgaaatgtgatcttaaaataggcctgtttacgactgttaagttaattagttagagaagctctaagcatatacaacaaaaccaccagcttatattggcagtaatgtactggtttgtttaagacaatggccctcataaatcccacagcggattgaccaatacaatcattcacagtgatggacacctccagcccaaaggctgctgtcctttcagtaaaaataatagtcaaactaccgcaccatacaacaggctaatcacttccacatgaattcatagttaatgaagaccaaccaatactccccaatggtaaactaccctcacagccttacttccacaatccaacacccagagatgccaacccataagcacacattattgcgtgtgcaatagggatagcaacattccaaagtgagagagagagagatggagatatggagatggactcattgc

SEQ ID NO: 91844 - DNA, 5678 bp, Oryza sativa
  unsure (1)..(5678): unsure at all n locations
ttcaatcttcatttcttcaaaggtaacttaattctaaatcacctcttcagccatgacgtaattaaaggtgacatatttttccttcttaaagaatgcttgatactttgttttttcttcaattttctcatatatgcagggagatgcccgaccggcaaatgtgaatgtgaggataccgtcatggacatccgtggatggagcaatagcaactctaaatggccaaaaactcaacttgacatctgcaggtaacttctgttgttgatttgatgtgctatttcttctgctcccatgggtgtgattcctgcctcaatgtttgtttcatgttcaggcgatttcctctcggtgacgaaactttggggcgatgacaccttatctctcaaattccccatcaccttaagaaccgagccgatcaaaggtatgaaatttacacgatcaacatcttttttggcccaagttaatgaaatttatatgatcatcagaactctttttcacggcaagttaaaagtctctgaaatatagtctgaaatggttgatgaaatttttcagatgatcggccggagtattcgtccatccaagcggtgctgttcgggcctcaccttctcgccggcctgacgcacggcaaccagaccgtgaaaaccagcaacgactccaacagcggcctcacccccggcgtctgggaggtgaacgccacccacgccgccgccgctgtcgccgtttgggtcaccccggtgtcgcagtcgctcaattcgcagctcgtcaccctcacgcagcgcgacggcgacgcgcaggcggcggcggcgttcgtcctgtcggtgtcgatcgccgacggcgcgctaacgatgcaggagtcccccgtcgccgggagcgacgcgtgcgtgcacgccactttccgggcctaccactccccctccggcgccagcgccatcgacgccgccaccggcaggcttcagggccgcgacgtggcgctcgagccgttcgaccggccgggcatggccgtcaccgacgcgctcagcgtcggccggccggggccggccacgcggttcaacgccgtcgccgggctggacggcctccccggcacggtgtccctggagctcgccaccaggccgggatgcttcgtgcagcccccaccacggcctacctcgccggcgccaaggtcaggtcagctgccggaaacccaccgccgccggcggcggcgaagacgacgacgacacggcgttccgccgcgccgcaagcttcacccaggcggcacctttccgtctctaccacccggtgagcttctcggcgacgggcaccgacaggaacttcctcctggagccattgcagagcctccagnacgagttctacaccgtctacttcacgntcctcaccaagtgatccaccgccatgtgacagcgagcccagccttgccatggacagaatgacagatcaccaagcttgtccatggcttacagtacctgtaatggatatgaaattaaacatagttagtacctaagacctgattacctaattaacaatcttcaccatggccgtgatgattcaatcaatgcgtgcatgtgtgctcgtgatccagaaagaaagggaaaggcgatccataaatattgtgccgttcaattaggccccaattgattgctgtcgtggaatcttggagaatttttgttgcttctattctatcaacttagtagtataacagtactactaccgtccaatattattgcagagccgtcacgagatcggtagtaggagtatttttttttcgcttcacgaatctttaggaactactatcactgattgcattgccctgacaccaatctgagttcttggctttctgctgagctgatgctccgacgagaagaaatgagaatcagatgtggcaaaaagataaaaagaggtttttgatgctgggatgctggctgcctctccctttccatctctgttcgatctcacgggcgcaagcaagagcaaacgcaacgtgacaaaggggacgcaacgtgacaaacgggacgcagttgtcgtgtgcgacatgtgagtttgcgaccgaggtgaaaaagggacgtagttatctgttgtgtcttaataaggaactaaggaagggcccctcctaacatgccttctccttcctactgtaccgtaatttttttttaaaaaaagttagaaaaaaaataacataataaaaaaatctaatacccttaagaaaatattcatatgcatagactttacacccataaatatatatagtaaacttcgtatgtataaactatatgtaaggaaatattgtatataaaaaatatttaatctgaattcgaatttgaatcaggtatataaaattttaagctataaatttttaggtgggtaaactttagatatataaacttataaaaagaaaaattatatggtgcaaaaataatggagaaaaagaaaacgatcccccaagcgatcgatcgctaattagcgatcttgtcttaataacaactggattaattactgtttctttttttttttatcagaaccactgccgaaaacgatatcaaaaaccaaatgcggaagatcgatgtaaaagatcctaacttgataatgacattaaggcacaatattagttaacgagatttagccgaaacctagcttctcatgtattgattatggtcaattggtcactcctcccgtatctaacataattatagcgtagagttagtacgaccctcaatcagcacgtcctcaatctatcgtccactctcacagtctcacacgcgctaaattatcatgcggtcacaataaatatgtttatctatgtattaaaagagagcttataataaagtccaacacctaaactataatcaattttgtatccatattcaatacaaaactcttgacacttttctaattgtgtgacgatcggctcggctctgcatgcatgagtgcttgtactttgtgcaacccattacgccacatgatgctgcctataaatttcgtttgatacataaaaacgggtgtccttttcgctgtgggcgcaagcgatagaaagtctttggattcttggtagtttttttctcaccatatccacacctgtgctgctggtttgtgtgtgtgtgcctgtgtagtacacgctattcttcttaccttgtgagcgagagagctcgctctcggcgtcggcgtgcgtcgcggtgcgccttatccagcaaatggcgcggcggcgcgcggcggcggcggtggtgatggtggtggcggtggtggcggtggcggtggcgaaggagtgcacgaacattcccacgcagctgtcgtcgcacacggtgcgggcgcggctgcagtcgtcgtcggcggcggagtggcggtggcgcgaggagtactttcacggcgaccacctcaaccccaccgacgaggcggcgtggatggacctcatgccgctcgcggcggcgtcggcgtcggagttcgactgggcgatgctgtacaggtcgctcaagggcgccgccgtcgccggagacgaagccggcggcggcggcggcggagggtttgggttcttggagaaggtgtcgctgcacgacgtgcggctggacatggacggcggcggcgacggcgtgtacgggcgagcgcagcagacgaacctggagtacctgctgctgctggaggtggacaggctggtgtggagcttcaggacgcaggccgggctgccggcgccggggaagccgtacggcggatgggagggccccgacgtcgagctccgcggccacttcgtcggtgagaaaaaccacaacgcccccacgccttcagcttccaactaacccatggccatgtcccacatgttagattagtgtttccatagagactaaatttcagaaaaaccaggtcagttttatggttaaagttatagaaaatccacatactccctagaaaaaaaaaggttttatggttaaagctacagaaaaattacatactccctccgttttcatatgataaatcgctttgaccttttttgtttaatcaactttctttaagtttgattaaatttatataaagatttaacaacatctacaaaaaccaaattagtttcaattaaaactaacatttaatatattataataatatgtttgtttgtattgaaaatgtttatatatttttctagaaatttagtcatacttataaatgtttgattaggaaaaagtgtcaaaataacttataatatgattttcaaatttcacaaagcttcacgcttatacattttaaacatgaatatattgaaatttttgaaatatacagtgtatataaatttttaactaataaattcttgagtaaggttgatagtttaattctttactattttcaaaattttgtttaagatattctaaatttgttaagatttcaattaagatgggttttatgaagtattgagatcataaaacctgtgataatatgccataccttataacttgtggtttttcacaactttgatcgtaaaaacatacagtacggatggaccgtaatttactctttcccaaactagattagagcccaacttaggcccatttatcagttgggcctagtacggatggaccgtaattccggcccattcaagttcgagggcttggatttgatttaaatttctggcccaattacatagatgtaaaaatagctctgctacaatgtagtactaacttttttgtttaaattttcatcaagtgggtcaaaactcaagcaattttattcggcagtagaaatttaaaatttggttcatgaaaaatgcagccagatttttgtgcatataaattgtttaggaaccatttaaacaaatttaaacgggacaaaagttactagtaaaacacaaaatttggcgcgcagggcactacctgagcgcggcggcgaagatgtgggcgagcacgcacaacggcacgctcgccggcaagatggcggcggtggtggacgcgctgcacgactgccaggcggcggccggcaccggctacctctccgccttccccgccgagttcttcgaccgcttcgaggccatccgccccgtctgggcgccctactacaccatccacaaggcacgcaacgcaacccaaagcatctgcatctccaccatggccatgaatctcatctgttcgtgcaaatgtctgaatgaagtcatgaagatctcctgtgcctttcttcttcctctgcatcgcgtgtgcagatcatgcagggcctgctggatcagcacacggtggccgggaacggcaaggcgctcggcatggtggtcgccatggccgactacttcgccggccgcgtgaggagcgtcatccagaggtacaccatcgagaggcactggacgtcgctcaacgaggagaccggcgggatgaacgacgtcctctaccagctgtacaccattactgtaatcgttcttgtcaatcttgatttgtgctgattggaagcacgttttatttcagcgagttaattgtgttgctattatgaatgatctccaattttgggcagaaagaccagaggcatttggtgctggctcatcttttcgacaagccttgctttctaggattgcttgcagttcaggtctgaagatcttaattcccctatggcactctatgttctcctacatgctattcactttgtaattagtaatttattgtacaactaatccagctagaactcgtaatctgacagaatataactcgtaatctttgatgttcaggctgacagtcttt

SEQ ID NO: 91845 - DNA, 1784 bp, Oryza sativa
ggattcaatgatgttatgtatcagctttatgccataacggtaattgcaattctgttgcatctagtatttggtaatttgtgtggaagatgtgtttcttacaaattaaagtcgttcctgtcttttgtgcagaaaaaccagaagcatttgacgatggcacatcttttcgacaaaccgtgcttccttggaccacttgggctgcatgtgagaacttgagtttcatttatggtattttgttttcttttgcgaatcgagtcttttgcagcaaagacaggtgatatcttttgtttgcttttcaggatgacgacatatcgggattgcatgttaacacacatgttcctgttattgttggtgcacaaaagagatatgaagtagttggggatcaactttacaaggtaaactgatagtagtgagtaaattcactgtgtacccctgaaaactcactcaatccctttcatacccctaaaatttacccgatcccttctgtacccctgaaatttcaatttgatcccttccatgcccctaccgttacatattccatcattttactgttacgtttggttgcaaatgtcttttttgcccttgatgctttaggtttaaatataagcttcaaaaataattgaaaattttgtttgagtgcacatcgtgtgcattttataaaactaatgagactaaataattagtgcagaaaattttgacataaattttgaaaataaaataaatgtaaaaaaaataaaatttttatttgaaattttaataggacaatggatttttttatcaggagcattcataaaaaaaatgttgtgaacattggtatacctatctttatatgaatgctcctcatttttatgaccttttttttaaaaaataaatacgtattttttttatttcattatctaaaaatatttttttgggataaataatgcatcgcacaacaaactcataactataatagtctcatgcgagaagcttttatatttttaataatgtaattcatgaatttctttgttcatccaagggtaaaatggtcatttttatagaaaatacacggtcaactaacgtcaactgacgggaggggtatgcaagggatcaaaatcaaatttgggggtatataaggaagtaagcaaaattcaggggtatagaagggattaggaaaaatttcaggggtatataagggattttctcggtagttaatttgggatttgcaccaaaagtcctcaccttgatgggcttataattgtgccctaccatatcggcttactcgtcaggcaataaaaaaatgatgcagcatttaaaacttttttcaacttgagttagctgactttgaaacaaaatatatggcacaggaaattgcaacattcttctttgatgttgtaaactcctctcatacatttgcaacaggaggcacatctaccatggaacactggtgagtgataatccatagccatatcaccattttactttcttaggctctcttaccattgtccctacttaagttcatcctacacgtcaggcacgatccgaagcggctagtagatgagatcaaaatcagctcaaatgaggagacttcgccacatacaacctgcttaaggtgagccatcccttccatcaacgcgataattctacagaaggaagctctgaatttgcccccgtctacaattgcaggtctcacgaaacctgttcagatggacgaaggaaggtaaatacaccgatcactacgagaggctacttatcaatgggatcatgggcaaccagaggggaaaagagcctggtgtgatgatctattt

SEQ ID NO: 91846 - DNA, 2898 bp, Oryza sativa
tgaggttaaatcattcttgtctcaaaaatttgatatgaaggatttgggagtagctgatgttatcctcaacatcaatctaattagaggtgagaatgagattacactcttgcagtcccattatgtggagaagatcttgaatcgctttggctacattgatagtaagccttctccaacgccttatgttcctagcttgttgcttcgcaagaacaagagaattgctaggaatcaactggaatactcccaaatcattggctcgctgatgtacctggctagtgcaactaggcctgatatctcctttgctgtgagcaagttgagctggtttacctctaatccaggagatgatcactggcgtgcgcttgagcgagtaatgcgctatctgaaaggtactatggaattggggcttcactattctgggtaccctgcggtactggaaggatatagtgattctaactggatctctgatgtggatgagatcaaagccactagtggatatgtcttcacactagttggtggtgctgtttcatggaggtcttgcaaacagacattttgacgaggtcaaccatggaagcagaattgacggcactggatactgctactgttgaggcagaatggctgcgtgatctattaatggatctgcctattgttgaaaaaccagtgccggctatccttatgaactatgacaatcaaacggtaattgtcaaagtgaatagttctaaggataatatgaaatcgtctagacatgtgaaaagacgattgaagtctgtcaggaagttgagaaactccggagttataacgttggattacatccaaacaactagaaacctagcagatcccttcacgaagggactatcatgaaatgtgatagacaatgcatcgaaggagatgggtttgagacccatgtgagtaatactatggtggtaacccagtctatgtgatcggagatcccgtgaattagatcctgggaagaacaaaccattagtaaactagaggagagtacaaatatatataccctatccaagtgaagatgcatatactcttgtgagctgcaaggcaggttggctatgccttaatgagttctgttggctttaattagcaaagatgttgtcctgcagagcattcttgaaggaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctctatcgaaccgctggtatataaacagtacattggaaaaggcaaatctcagtgggattttgagatttggtgggggattgttggaattaatggatgggccttagcccactcgaagattaattctttggaaaatcacaacagcccacctcatgggatggtatgcatgtggagtttagtaccaccttgcttattctaggagagggggacctccttaaaaaggaggatgccctcctagccacttgaagcatgtgtggtggagagaagagggggaacacgtgcgcgctcgctcgcctgtcctagtcgggcacggcaggcggcgcgcgtgcacgacgtacgcgtcgaatggtccgccaaaaattggttcctcaccttgcgcagatgcagcctccttttgcagttttgttttgctgcaaattcggattcgtttttgttttggaaacgttccgaaaaatccggtgcgtgaaaacgacgtggagtccggataagttacgcgcgacttatccggttcggttacacgcagtggagatcgtgcgggcgacctgatcaagcgacccttctctatacaaaccgacctgccgtcttcacgcaacacacgaaaaaatcaatctagggtttgcctcctactctgtgctacgccgtcgctcgtagattactccatctcgctcgccggcgtgcaccggcgatcgggagagcaggtctccggaacctctaccttcgacgtcctgcaccgggagaaggcggcaataatgtttttgggaagcgcttagcgcgactgctccctgttcgtccgcgacggctcgtcttcctcttcgctcgcgtgctgcgcgccttcgtagacgcctgcaatcgcgaaaagttcctgccgagcagccggtctttctaccacctcggtacgtgttcaatatgttgcgcatatttgatctgttcatattttactgcttattttacatgtgtagatctaatgatgcgttaatgctaatatacatctgcaataccatgacttatttatggaatatattaaatcattatatgcctataatatcaatagatccggcgttcctgcctgtgccgaatattagctatatactgtagctgttcttctcccgagaccgcagtcaccgtacgcgtgcgtgatgatatatatgagcaaatctatccaactgtcgtattagggacctagggtgcacttctgatatctaaattaatgacattaataaggatactatttaaattaaatatatacttaaatatagtgtatatatgtatgtctgttattattaaatcaatgcagtatgtccaataaccataaggtggctgccatttggattgggaagattgttcaacgacagatgaagtcgattcagtgaatggatcgcctaattgttatcgatgagctcttcagaaccaaatggtggcatgactttcatagggatcaggtgtatgcttgcgtgtttatagaggtgagggtgtacgtgttatgagcacctatctttgtacgtgtttctcaaataaaatgg

SEQ ID NO: 91847 - DNA, 1564 bp, Oryza sativa
gtcgctcgtagactactccatcccgctcgccggcgtgcaccagcgatcggagagcaggtctccggaacctctgcctttgacgtcttgcaccggagaaacgcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatccttatatgcccataatctcaacaatctttacttctccatatttgtctgttttctctattccatcacctgactataattgcaatcactgatctttgtaggagaagaaaggttttttgcttgcacaggtgtatttatagacttcaatggatccacatcaagagttgtgacttcagcaagtttggttagaatatctgctgatgaaaacaagattgctgataacctgaaggttggcatcacaaacactccttttgcttgtgcatttgagatactctttaattctcacattgtgtttcttagcagattaaagtgtaccttccaaataaacgaatcgccgtaggcgaattgcagcattgcaatttgagctacaatattgctgtggtcagtgtcaagggtttctgttgtcttcggacagcagaactcgacaaacagatgcaaatcgaacctcatagggaggtagtagctataggacgtatctttgaatcaggcaaattaatggctacaagtgggatattgtctgacgaggaaagcaagcttgactgcagagagcttatgatctccacttgtaaaatcactaaggtacattgggttgatttctttcatggtgtaaacaattaattgtatcagaatatgagtaatttaattcatcgcttcatatgcgtgtcattgaaaatttcatctattcatgtgctttttttttttttgccaggccggtattggaggaccactgattgattttgatgggaatttcgttggcataaacttctatggaacaaaagaaacacattatctaccacgattaatgatacagagactattgaaggattttgacgggtacgtttttcatattttttgtagttttttttggtatatgatcatatcagcaagtgttattcatctggattttattttttttaggtaattgcacttgcttctcaatgacttgtgtgattctttccatcttttctaatatatgtttggtttgaggatgatgtgagatgggttaggtccattcatatatttttaggatgagatggatctgatttttgtttggttggagggatggaacggaccatgtttaattggagagatggattggaccaagccaaccggcaactggatatacgcagaatattccttttagacaacccaacctacggttcaaaccccaaggataatgagatact

SEQ ID NO: 91848 - DNA, 1408 bp, Oryza sativa
gcaccgccggtggccccatcctcatctaccccatgaacaggcacaagtaagcagctcgccacactcatgcccccatatactatatccagccaatctacctgtcgtaacagtaatccagtagcactcgcgcccgcagcgtcacatgaagcgcggccgtcctctcacatgcggcgcaacacgggagggcgcgggcaggtggccgatgggatgcggcgtgcgcgcccgcgcgcgcgcgagagagagcgtcccatgattggcgcgggataaacaaatatacctccagatgggcagcagattgcacaggatggatcgtgctgccgccatactttaattccgaaacgcagccgccgcatctccggtgactggaattggccgcggacataccgcgcactagggcgacagggccctattctaatcgctgcgtggtggcgccatgccaatgctaggaacagaacagaacagacggggggcgggcgcatcatcagtcaccttcaccgccttgcgccgaccggttattctaaccagggcgcgcgccgctcccgttcccaatcgcctttccacggcaccagttgttaagcttcgctagtggccagattgcacatatgtgttgtcgctttcacattagtacttaacctgaaaggacgtgtcgatcagaatcagcacagatcttgctgctaactgttgttgcttttcctactctgctccaatctttcctctctctttttttttctcggtggatttaaatactaaagagaacttgatttgcgtacgttgcaggtgggacccgaggagctcggtggtgacgccggaggaggacgtgttctacctggtggcgttcctgcggtcggcggtgccgggctcgaccgacccggcgcagagcctggaggcgctggagcggcagaaccgggagatcctcgagttctgcgacgaggccggcatcggggccaagcagtacctgcccaaccacaaggcgcagcgcgagtgggaggcccatttcggagcgaggtgggctcggttcgcgcggctcaaggccgagttcgacccgcgggccatgctcgccaccggccagggaatcttcgactcgccgccgctcttggcggagtcctgaaacgaagacgatcgacgaacaagatgatggctagctaggcgcatgtaattagtaagaatcataacaggtgattagttagtcttaatctgatgtgtagattcctcgccccataaaaaaaaatctgatgtgtagacaattctgtacagagggatgtatcagtttcatgcaaaatgtgtgcaatgtttttttgccggtaaaagtcggcgtctgcctccagttcctcttcgaagcgtcgtagttacccaaggacgagatatctcaatcactgatccatcaacaggttcaggccctgttccgcat

SEQ ID NO: 91849 - DNA, 578 bp, Oryza sativa
cggaacaccacagtgttttgaagtggcacagggtttgttggaaattcctctcctgtagctgctgaaaacttctgattaagtggaacagcagtagtttcatcaaacacctttactccattagtgagagttgacatccagttaaagaaagagctatcatttttgtggaataatcctgaacaagaactctcattatcttcccttctacatcttttatttccagacgtcatctcagctgcagaaaattgaccatgcttccgcttcggagcttttgtacttgggcagctctctatactctcattgctgtcatcaccttcatttgtgttgctaacacaattactcatatcatagataagcttttctttccccttctcgagctttctaggattacaaccggatgtcgactcatgtcttgctaaaggattaacaccagatgctaactcacatctagcaacaggattcacagcagacacggactcacatctagcaacaataagcccatccttatgcttttcctgcatagcctgatcttggctactgtcatttctattacctagcatacttgtcaatttgccaggcat

SEQ ID NO: 91850 - DNA, 679 bp, Oryza sativa
  unsure (1)..(679): unsure at all n locations
attcctgcagcccatatcatcaagacatacctcaagatgctccgatgagtcatccttatcctcaagtgccatgagacacgggttgatgaagtcctcgttgttggcgagatagcacatcctggagaagtccttgtcccccttttcttgatcatcgtcatcggagtcgatgtcgctaagctgcacctcctcaagagtcgccaagaccttgtggatcgccttcttcatcaaatcctttctcccctttcgcccttgtccctcgggcttcttggtcgtcttgtcactcttcttcttcaacttgggacaattcactcttatgtggttaggctctccacactcaaaacacacaaatggttcattggtttttctcctttctctctctctcacattcttgtaagctcttgagaattttctagcaaaaagagcaagatcatcttcagggatcttctctaattgctcctcagtgactgagtgtaaagcggcaagagagaagccaccacacacaaaagctgagtcattagaagaagtactaccagagggatcagctaccaaagccatcgagtgtttgaggcctttccgatggaaaacatccatctcatgggtttttagctttgagtaaagcttgtccatggtaaggtcactcagaggtgcactatctgtgatggaagtaactntcatttcc

SEQ ID NO: 91851 - DNA, 659 bp, Oryza sativa
tacactttgtacggaaaaggtactaaagaataatatagctatacacaattctattacttcataacatgtgtaacttatgtagtaagtgttcaataaaacttgcatttgcaattatgtgcaacagagatcacatccaacaagttcagtaatgattgacaacaaacaagtaaacaaaaactgcatctatactgaactgaaatgactccatgtcccactagctaaattatgctgcaattccattgatgggttgattttacaaagattatttcagctaatgaacggtgtcgttagcacagcctttttgtccctaaaacaagtgagctgagagcacatcttttattagcatgaaacttgaaagggaagctgctaaggattgtgtagacaaacaaaaacatgagcattcataaaaagatacaaatgaactaacataacaatataaagtgcttatgcagcaattttacaagtgttgaacatccaaagaaagatacaagattcagtgttgatatgtgaataaatacctttacgcttatctacatctacagtgtaatcaacaggcagttccaaaccagtgctggataagaatgtctcagcagtctccttaaaacagttgtgcataagataagacaacactatgttgcggacatcgttatcactcacgg

SEQ ID NO: 91852 - DNA, 656 bp, Oryza sativa
tatcatacattgggcttgccgtattcttccagaggaaacttagtagactctgaagtgacttccataagtagttctggccggttcaacttggccgatcattactatgacgagggctacccgatggcttatgacaggctgaatgctctttataggttaagagaagggcaaaattccacattggatgcttattccaatggaaggatggactcgattacttcaaaaccttggctacataacttctcaaatccagcagtgaaccttggagttaacccaaatggattttcacagcaaatggggaactacaccaatttagggagtgggagggtgaatggagaacatctgtatcgccatgccaacgggcaatggtgatgcctgtacacaattgataataaatcctgctataagttgtcacagaccatggtggcagatgtaagcgtcgccatggccaccaggttgtaacttttaattttaaaggggcaaagaaataatacattgtgtaaagcattccagtgtccgttaaattttctgtcggctgctttcatagttttatggttcttctttatttcttttttggttggagtataaaacggaattttaacaagtcagtccagaagagttctatgactacttcatcgggttggaaagttccagatttt

SEQ ID NO: 91853 - DNA, 3040 bp, Oryza sativa
  unsure (1)..(3040): unsure at all n locations
caataaagttgcggtctccttctagcgtcttcaatcttttgttcaagtttgagatttcttcttgaagcgtgctaagatcagtcttccgactcactgttgaagaatgagcttctttagctaagaaaacgggctcctgggcctctcttgagctttcttggcattgcagtgagccatcatctacaacgtgcattttgttggaaaggtaatcctctatgacatctgaatttgacaagtgaatgttagtactgttgttggagtaggattgaagcttctgctccagcttcgtcaagcaatcaactatatatgccctctcctcttcaaagctcactaatgaatttataccacttggtgtggtaattgcaggagcttcaagaccagtttcatcaagcaaagtttcggcaatgttttcttcattaaaggagacctgattggattgtttctctgttggtccacctgcaaactgcatcctgtagttttcgagctcagcttccaattcctctatttgttgttccctctgagcaagtagctcgttagctttagcaagcgcatcactatcatactctgcttgttcttccatcatccgctggtaatgtaaagcttccatctgcatggcagccttgtcatcctgcaatctggtaatcatagccaaagcttgacttgcagcaatcgctgaagcgttcctttcttcttccagttccttgcagaggaggtgtatagattttcggtcaagatcaatctgtcgtctcaaccgttcagtggcactttcaccttccatctcacttacagtgctaccctccagtgactccaaaccagatgcatttctctcaattgaaattctgttcgtgatgttctgcactatcaaatcatcaccacgcccatacgcacgtgggctagggcctgggtcgacccatggagcctcgagtcctctggaagccgagagctgtgacagcagtaacctcaattcttcatttacactagaagaggaatcctttccaagaatcacatcagtcaaggtgggggatggcaagctactcttggcaccaatggcaagcttgtaggcttcattcatgctaatctgagtgcttagagatggtctcctttcaccaatagtcgcgcttgtttgcggatgttcctcgatgacattgagaccctgaaatacctcactgtttggtctaatagcctgtggtgatataggagcttcttccacaaaacctaaccaaaagggttaaatgtaaggaccagtttttgaaatactgttgcttgagggaaggtagaaatcaactaaccttttgctgtaggatctttggaatttgtattggaaggatctntgagtgccgcttcatgtgttaccatatcacaagtctgttcagcctccttagcataatcttcagcttcatcaacagcttcagaactagaattaacttgtgaaacatggtcatctctaaaattaactgaaagggaaaacaggtcggaataaagaaacctttcagacatatatcttgattcttgagaaatagtcagtcctgaggtacagccttacctggatcatcatcaaccaatgcacttttctggtgaaactctctacttgatgtaacagtaatttctgacctgtgaccttccagatcatctgacatttttttattgtgatggggggttagacgaacaggaagaaaataccattcagtttattgttaaactatgattaagatatacctattgtgctgttgtgctctgaaacagcaatgttttgttctagtgttgtggactgtgatgaacatggatcaatggtgctttcactcgctccatgacatgcctcgttgtacccaagattctgaggtgactcgacacttgatgcaactggaacttgggaaacattgacatctgcatgattatctatgctattaatctttcaaactgaaaaagaagttcagtaggagtcatcccagtttggggaactaacagttacctgtcaaacctgactcttctttgacagctaggggatcatgctggcatgtctgtttttctaatgaagcatcttctgcttccatttggccctcaccaatatactatcaggatgatcatctacaagaacatatggcaaggatatatcatatgagtcaccaacatcggtttccatcggaacattcatttctaatggcctgaccaactcagtggaagaagcagcaaatttctcggcagtggcatcttcattcaaatcttcctccatacaattggttttatgatggtgtgaaattttgccatcatcagcacagggagcctcatcctcggagccagatgtcatctgcagcacactgtatcgttcatggatggagtgatcactctggtgacaaatatctttatccaaagatttatccacttgatgaagtatggaataatctgtgcaaatctttggtgagcaaacagcctcagcaggttctagttctgtgatcattcgagaaaacattgtcggtctctgttgtgtataatgctgtgcacaacatgagcaaattcttgtatcatgggaatataatccttgattactatcaggtagagtggcagccattgttggctcatcggtgcggtcatcattgttttctacaagtgagtcactgcatctctcacacatactttgggcacctgcaagtttctgatgtagacggcagaaggccaaagatgagatctctgacttgtgagttttgcagatcaattccctgtagaagcatggtttctcattacccaggacatggtctagccttgagcagaaagggcacggtgccggtaatctgcagaggcgggcaaatctggtgaccaagaagcaataaaccgcatcgatgaacagcagcagcatcaagatccactcgagcaacaccgatgacagtgtggctgacaatctccgtaaggttggcatccttgtacccatctttgaacagtatgctcaattcttcacaattgctgtactcaagttctttagattggtgaaaggtggctggtgttgaaccagaatttctgaaggaatcaaaaacaaacttaatgagtgaag

SEQ ID NO: 91854 - DNA, 1205 bp, Oryza sativa
ctgcaccccgttgctaatcatgacaaacttctcccaggtttgctgttattatgttggctaaactatcttatgtgttcctcacagtatttaatcacacccttaacacatttcaggatggagccatttcgccagtttactatagctgtgggtaatcttgatccaaagaaagttaaatattcaggtgaggcaatctgtgattcttattgtttgaattaaacactctgtttcagagtttaactaagtaagtttgcagacaccctgcacaaattctggaagaaagaacatgactggggatggaaaaaatttatggagttgtcaaaaatccaagatggtttccttgttgatgatgttcttgaaatcattgctcaagttcaagttatcaggtaggcagtttaccaattttcaggattagcacctaaaagagtaaaatttgtttgcagttctatatgattgaaataaattgcatatctatggccttatatgtaaagcattccacagatatgcttttagatatgtttttcctatgtccctgaaacacgaaagatcacttcatttaattgttcctacgatgcttttgtgctaagatgattttgttgggggcatttatgctctccataattcaagttttactcttcatgtgcagtttcgacttattgaaatcttaactgtaccctgttgtgagctgtataaacctttcttttgtttttattgcatgttgcaacatgttatactgcgatttattcaaagatctctctttgttaatgcctctattttctctaattatttaagtcctagcttctatgtttaatttgtcaatgctcaactatggtgtgctcagaaatttggttatatacttataaattgattgctggacattcagtaactgttctcttctgcttttcaatactggagggagaaagtggatcgcccatttcgttgcctcgatcgcccttatcgacgagaattactccgtgtctatatgaccaatatagagcaaatttaccgacgctttgttgaagagcgcagaagtaaactttgcaagctcattgaggacaaaatgagatggtccaggttatacaattaaagttatcaacatcctgttatcctttcataatgattaagtatctgtgcgcgctcgcgtgtgtgtgtttttaaaaaagttaatactaacacatgcatatctttgtttgtactggggtgcagga

SEQ ID NO: 91855 - DNA, 597 bp, Oryza sativa
tgcacccctgttcctccttcagtcatcttcgtcatcaccccgcatcgccatcaacctcaactcgtggttgcaagaggatggatcgtccatcgtcggcactccggttcctcaacggcggctaccgctcgcgacctgcaagacacacagaatgagagaagagagcagttagggaccggagagaagtagaaaaccaagagaggagagaagagcagagataggtgtgtacggtgtacctgcgcatccggagcaccggagttgccgttgatgatagagatcgacggatctacgagaagaagatagcagagactgggtttggggagtgatgtgacaaagagctcacggagaaacggtgagcgggcgatagtggcaaaaaaaatgaaaaagaaagaggaaatcgagagcacggccaacgatccaaagactggagaggcggagatgagacaaggtcacggatccggcgaggcagcgaccctcggtggtagatccggcaaggcgttcatcagagacggcgacggagagggatggagagatggaggcgtggtcgcgtggaggtggaggcgtggatcgacggaggcggaagcggaggcggagcggtca

SEQ ID NO: 91856 - DNA, 562 bp, Oryza sativa
ggcgacggcgggcatgtccctgagccagtggtcgagcggcttgccgatggagtagacgacgaagccgatgcggcggagcttgtccgggtcgacgacgttgcggccgtcgaagaggaaggccggcttgtgcatggcgtcgtacatccgctggtagtcgagccggcggaactcgtcccactcggtgaggatgcagacggcgtgcgcgccgcgcgccgcctcgtaggcgtcccacgacacggcgacgtgcttcgccgacgacgggctcatcggctgcaggtggcgcgggtggtcccagtcgaacttgttcatcactaggtcgcgctgcacctgctcctccgtcacctgcgggtcgtagatgctgaccaccatcttgtcgccgacgagccccttgcagacgtcgatcgccggcgtctccctcgtgtcgccggtgtccttcttgaacgcgaagcccagcacggacaccttcttgccggccaccgtgttgaacatggaggacaccacccggttcacgaagcggctctttttgtagtcgttgatccggatcacctggtgccagtagttg

SEQ ID NO: 91857 - DNA, 748 bp, Oryza sativa
tgggtttccgtgtccaactttgactgtccgttttatatgaaatttttttataattcgtattttcattgttgttagatgataaaacatgattaatattttatgcgtgacttgtctttttaatttttttcataattttttcaaataagacagacggtcaaacattggacacaaaaaccagggtttgtctttttttggacggagggagtacagagtactcccaggttgtccattactgcccccagacgtagcttcgatggtttcgacccggtcaaatcatgattggacccacccactaacctgctacaactgtcatcctttcttgaaactatgttagctgctacgaagtactccctccgaaaaaaaaatcaatctaggagaggatgtgatccctcctaggacaacgaatctagactaccctttatccagattcattgtcctagtgttgacgcggaaaacatgcactggtctgagagatctgcttaactttaatgcacgtccaaaagaattgccttcggattctgagcgtgccagctggtttgatcctgcaaccaacaagatagaaaaaaggacaaagagttaaatccatcaacgatagctgatcggtaggattgccgatgacgtattgtatgagggcatgccgacgtaacttgcgttagatcggcagaggcaaataaaaacttggagattgttcggtatacttgatcgggtgtagatgttagcgatgcgtaatccatcaaatgggacatat

SEQ ID NO: 91858 - DNA, 541 bp, Oryza sativa
tctcagcagtgtgcttcacatcaatcagcaccaaacccaaaatccttttctctaattgccaatcagaattaacaaaatgagcaacaacacttaaataatcctccttagcattaccagaccatatatcagatgtcaaagcaacagagttaacagacttgaacctctcaataagcatagcacgactcttgtcaaagtacttaaaaacatctctactaatagtttgcctagagacagcttggaatctagggttatgaacattctgaatgtactcctcaaaagtaggagattgaccaaaattcagtggtagatcctctacagcaatcaatttaaccaactcagttctagcataatcaggatcatattcccatggacgaacagtaccatcagcattgagcttaagcatagactgtgacaaattactagcagttctaggtttgccatgacttgagatgcctaagcaaatgaccagtgccaccagatgaatgagcagacaaagttttttttgcagtgattgcatttagcagaaatgcgaaccttcgcg

SEQ ID NO: 91859 - DNA, 1104 bp, Oryza sativa
tcctgcaccccataacagaatggaagatattggcagagattatttcaatgagatggtgtctggatctttctttcaaccagtttctaaaacatatgtgggtacacggtatattatgcacgatctcctccatgatttggcagaggcactatctaaagaagattgcttcaggttagacgatgataaggtgaaagaaatgccatccactgttcggcatctgtctgtctgtgttcagagtatgacactgcataagcaaagtatctgcaagctacatcatttgcgcactgttatctgtattgacccactcacggatgatggaaccgatattttcaatgaggtagtgcggaaactgaagaagttgcgtgtactatatttgtcattttacaacactaccaatttgcctgaatccattgcagagctcaatcaccttcggtatttgaatatcatcaaaacgtttatttctgaactaccaagatcattgtgtactctgtaccacttacagctacttcagttaaacaataaagttaagagcttgccccacagactctgcaatttaagcaagttacggcaccttgaagcatacgacaatagaatagatatattgatcaaagcagatttgcctcaaattcctgacattggcaagctaagttcgctccaacatatgaatgacttttacgtgcaaaagcagaagggatacgagttacgacaaatgagggacatgaatgagcttggtggcaatttgagagtcagaaatcttgagaatgtctatgggaaaaatgaagccttagaggcgaagctgcatcagaaaactcgacttaaaggcctgcatctttcctggaaacatatgggtgacatggatatagaaggtgtttcacatttcgagattctagaaggcctgatgccgccacctcaattggagcgccttacaatcgaaggttacaaatccgccatgtatccaagctggttacttgatggctcctattttgaaaatctagaatcttttaggcttgttaattgcagtgagctcggaagcctaccttccaatacggagctctttgggcgctgcatggcactaaccctttgggatgtcccaaatgtgaagacatt

SEQ ID NO: 91860 - DNA, 645 bp, Oryza sativa
ccgggctggttataactgtcggtaataggtggaaatcattaggggattttttttctagcgtcattagacatagcctttttcatttagaaactaagaaaggacgacagcagtcggaactcggaacttttcccgagattttctcgctaagttcgcgaactagacttccccgcggagatgaaggggacgaggtcgggagagaggaagcgaacggtggactgaccgagaaagtgggcgaggccctcgagcccctccgggtcgctgaacgagcccacgccgacctccatacacgccgccgcctgcaacgccgaggaattaggggttagttaaacacacacgcacgcatacgcaccacaccaccaaatcacgcgagagtcgccgatgaaccgacgagcattctgcaggcgagagcgatcggggagggagatcgagaccttgtcggtgtcggagtcgctgatgaggaggcactcgagcgcattggggagcaccacccggcggtactcccgcttgtcgctgcgcgagcggatgaactccacattgctcgccgccgccgccgccgacatcgccgcttgttctccgcctccgctctcgcttctgctctcctcaccaccaccacgcggtcgtccaatctcagaggaatcgtggagg

SEQ ID NO: 91861 - DNA, 1955 bp, Oryza sativa
ctagccgtgatcaagataggtagtaccagagggcatgacgctattctgggtattgatatttgataaatatgcagcgtctcctcacaattcaagtttgagagcatttccctctatatgaactgaatgatcaagaaccgacatgaaaatgctcattagataaaacagtatcaaactactggttagcatggacaattaagaaacacgataattccataggagatctactcagcaaacagtagtttgaacaagcaatacttcgaaaatgctgctattctctagaggctgcctacagtgcaggggtacattgttcagtttctacatttctgcaaaaatcaatcaagtgtgctcctgaaagagtcttcgcacctgtgtacagcatgaatagggacaaattctcgagtttatcgtcatactgcaagagaaatttaagtaatgtatcttccttgctgctcctgaaggagacgagccgatgatttagcgtccaaatacagagcactgacttcctcaagatcggcctgattaaaaacaaggtcatgggttcagcatacataaaacttgcaagaacaatatcaggctaacaagtgaatgtagcagccagccatagcccatacggcaaaaaagacaacaagaggacgttacaatatcctgctggaatttcaacacataccttgctgatcttctctctcccattagcctttgcaactacactggcgggtgatagcaactgaatagcatgcctacatgagattcaacatgtgttacaatcgttcatcttcgctagctgcctcagtaagatgagcttggtggttataaaactaaaactacaaaatttaaaatgcttatagaacaccgaaagtgggaaataagatcagtccacttaacataactccctactgcataatttccatcttaactctctttctcaaacctgtcggtgtaacaaccaagaatcgtacctcaaagatgtctgttgtccaatctctcctaaaaatgcgagactttcttcatcaatgtcaatctcttccacctgcgctctaatagcaagtatctgtagaggacaatgagcaaagatcaaacacatttctaaacaggaaagcctaagtgatataagatccaaaatcaaacctggatcatctcagtgggaccatatgtttctgttcgaataatcaccaatctgtctagaagatcaactggtataccatgtggacttgtcatatcagttcctctggacacaagcataacaagactttgtaaactttaaggagcatatggtaataaacaaactgacaaacacatgattagtctggtattataatgtagcgcagagtgcttcgactggtaaatcaaactgtttaccttacgttacatattcctctgttcgtagcaagtatcacaattggtgataatgggctctccaaagcacgattaagataagagaagcattcaatgtctaacatgtggacctgcgattaaagttcctcacaagtaactaaatcaaaccacatcaagatttataccatatagtagagaaatagcatggcagtatggcactgccccacaaggacaacccactgtatgtttgacaacagacaaacacaccctcatttgtatttataccttctgactccaaaatgagccactgagaaaatttccaatcataattcgtaaggatgaaataataagatacctcgtcaatgaacagaacaccaggtacaagctcagcaattccttcatcaatatattgttaaccacctagcaacatacagtatagatgttaaagatcatatgccaatcctgacatgtttattaaatgtggtccacttttaaaagcagcagtgctgctacatgggaaatttgaataccttattgatttcttgtcgtagcttctcagtgatttcagttttccgtggcttcatcatctgtcccataagggacaaaatatcttggcctccttg

SEQ ID NO: 91862 - DNA, 2538 bp, Oryza sativa
caatgcaaaaaagacttgcctgtgcaaaaatcttttaggctaaaattcaccaaattacctgcactatttccttcttcttatggacctcccctttggggattggaacatactcctcagcttcaagatcgtattctgtagcaaaagcatcacatctaccaactcttttgaccgcaccactattagcttcaatgtatataacatcacccactgacacctgcatcccatgtatcactgatgtaatgaaacaactagtgcaaaaaatggaagtaacagaagtgaatctcagtatcaaggcatctaatcagcttcacgatgacaagttatgaatttccaatcatgcaattttttttttacaattaacattctccaaagtttactttatagattaaatattcacaacaagacattcttctgaataagaaatgaacaatcatccaactattactaaaatttcaaaaaatgcacttagtgtattctaaaatatccagcacaagataggagggcgaggagcaggataccttttcctttattaaagcatcataaattgtaggatctagcttcagttgcttagtcccttttacagtcttcagacctatgattacatggctaatgctttttccatatccacctgttgtactctcagcctcttctggggaaagttcagtaacctaaaaggcaatgaagcacaaatatatattattttagaaacagacagtgagaatatcatatcagttataaatgtgctaatatcaagagaaaatgaaataatgcacaaattcaagaacaatatcttagtgcaaacttaaaaattagcatatatggtgtgcttacctctccttcgtagacctctttattttcttttatacgcaaacctatagctctacggaaattctccattagcacctcagttttcttgacctctgaggaatacacttctgatcctaccataggacagaaagggacctgtatagtaaaataataagataacacataagatattctccatcaacatgaatgaaacattggaagttttaccaaaaatgaagcagatgtaagacattgaacgaaaaatcttatagttaacacaaagaatttctcatatagattgtgaggtataaagtaaaaaaatgtacaggtatctaataaattgacatcaaattccagtgatccaccattagcagaattattttcaaggaagggaaacaaatatattgaaccagcaagcaacagaatccaagcctaaaagaaatgttgaaagccaaaaacatagaaaaaaacatgctaagtcgaccatttctttagaatagcaatttagttaggtgaatctgaaatttaatccaaccatcctcccaacagttgaactaaaaaataataaggcataggttctcaaataccagaagctcaatatgaatgcctttctggagctagatgagcccttataaatgtagaattacttgtttacactagctaatgaacaaaaaggattcaaacttacaaagaaatggcttattatgaacaattgtccacggtgcccttattgcacttaaacacgattcatcagtttttattggccacatgctttaactccattcaatcttcagtaaagagaactatgaaatagaagtaagacctcttaaactaagtctatggtatgaaaggcaggaaacataacccctctatgtagaagtgaggcttgaacacacacatgtataatatgttgttgaaatgaggcttaaaaccaaggtattcacaaccttgtgcggccaccatttcaccacgctgagggccatcgcatcgacctcttgacgagcggaagagcaaaaatccccaaaaggcaaaacactttgtacaagcttacggtgagcatatgttgctaataacatggcttgttcattatgaagcctaaaatctaacctccaaatttatttacagcagagtgtacaaatcatctagagcagtgctcaaagggtgttcgagaggagaatgagggagtggaggcaccaaccaaccttactaccgagctcctgggagatgccgagagcgagagccgtcttgccggtggcgggcgggccggcgagaagcagcgcgcgcccggccatcttcttctggcgaatcatgtcgaccaccagcccggcagcctccctcgccgccccctgccccacgaaccccgccgccaaccctatcgccgccccattcgcctgctcgagaccaccaaaccaagccaagccatgagaaaattttctctaaaaccctaggagaaaaacctttccccactgcagcagcagcagcagcagcagcaaggtgggggagagagcggaggagcaggagaagcgcggggacgcacgtcgaggccgaggccctttatgtgggtgtgcgtcgcgatcctctgcttcttcgtcgtcgactgcacctcctcgatcctcatcgccgccgccgccgccgccgccgcttcctgtctctccgcctccctccctctcccccaccgcaacgacggtggccggccggtggcgcagcgacgcacgtgcggagctacgagcg

SEQ ID NO: 91863 - DNA, 1187 bp, Oryza sativa
ccgcccgtcgtcgcggaactcaccaagctccgccgcgtggcccccgagctggtcgccgaggtcctcagcgctcgcccgccgccgcccccgccgctcgcgctcccgttcttcctgtgggcgggacggcagaagggcttccgccactgcttcccggcgttccacgcgctcgcctcgctcctctccgccgctgggctccccgccgcggccgaccagcttcccgacctcatgcgagcccatggcaagccggtctcgcattcccagctcaacctcctcgtcaggctccacaccggcgcgcgtcgcccgctccgcgcgctccacgccctccgccgcttccgccacgagttctccgtgcagcctgaggtccacgcctgcaaccgcgtgctgggagcgctggctgcggctgggcatgttgatgataccctcaagctgttcgacgaaatgtcgcactgcagtgtgcggcctatgccggtgacattcgcgatcatggtgcgtgcgctggcgcgggcggggatgacggataaactcctggagatgattgggaggatgcgggctgaggtgtgcagaccggatgtgtttgtgtacaccgcactggtgaagacgatggttcgctgggggcatatggagggttgcatcagggtttgggaggagataagaagggatcatgtggatccagatacaatggcttacaccacaatgatagctgggctatgcaatgcgggaatggtggagaaggcagaagaattgtttggggagatgaggaggaagggtttgctggtggacaggatggtgtatgcgtctctcattgatgggtatgtctccacaggaagggtcagcgatggttgtagagtgttgaaagagatggtggatgctggttaccgtgcagacctggggatctataacacactgattggcgggctatgtgagatagagcgggaggataaagcacacaagatgtttcagattgtcgttcaggaggatctaataccaagctccgagactgtttcaccattgctggctcgttatgccgataagggcgagatggttaagttttttggattggttgataaactagtggagctaagcttgcctatagttgaaattttagtggacttcctgaagctctttgcatgcaagagtggcaatgaattgaaggctgtggaagtttttaatgctttcagaagaagggg

SEQ ID NO: 91864 - DNA, 630 bp, Oryza sativa
gaactgattgtttcagggcaatgcagccttcaggctcttggctagctcttctagcttcttcaatccttcttcgggtgaagcagcttcgcccaattgcctcaccatagcgctcccaatgatcacaccatctgcgccccatcccgcaatctgttacaaggaatgaagcgacaaaggtcatgcaatgaattggggggaattaaacgtatactgttttgaacataagttcttgagtatgatttacctgcttcacatgctctggagtcgatataccgaacccaacagccacagctttgtccgtgacctagaaaagaacaagagattctatgagcatccttgaatgttatataaatgttttggagatgccaacaccaattcactgacgatgaatgatgcaaacctgcttgatatcctggagaagagattgcaccttgccactgacatttgcacgtgcacctgtaactccaacagtgcttacctgaataacataggagttagcaacaagccccatcataaatctagttcgctatcatcaaacagattcttgagatttgataataacaaatttccagcagtgcactgtgattacaagcattcagtttaattttagaacgttgaggtctatgaggtgca

SEQ ID NO: 91865 - DNA, 2655 bp, Oryza sativa
gttatcaagtcgctagcagtcggattcttggaggattcggttaaggaaattaatatattaagggaagcttatccagaagtgactgaattcaaagaggatgcggcatgtcaaattatctattaattaggaagagtttgttagttctcttttatctttaggaaagtgtgtttagtgtcccataaagactttatgtcttccttctatctttagaaaatttctttcttatccaacaacgactagtatctacccatgggtataaatatgtacacccgaggtttttttttgtaaactatctccacgatcaatacaacttcggcgcatcgccacctttttacttttctaatttttcgacgagtttatacttgtcatggctatttgcatcggcggggctagggttcgacactctgatattgtcaatctaagcacctatctatcatacatcttagataatctagtttggtagctcgatttacttgtatcggctgacattcgctttagggtttatattggtatcggctaaatcgcttaccatattagattagctaaggtatctaccaccctgaaaatcagtcaaaggcttgattgtctaaatattatgcttcctttcatacttagtgcagcatcagttaagtttgatctactaagtcgtgcttagaatcataatctctagcccgcttcttgattgccaataagggtttcatcagagtttcagccaatgaggttatctgaacgttgcatcggcttacaaggattgcatacatgttggatttagccgatcacaacaaatgtttcattgtctaatcttgtggatttgatgacatcggatattcagccgatgtatgttttaaccttcggatcggtgattattctatcatatcattgttagccgattgatttctactggatattattatggtttaattacattaccattagtcgattgttcaaaccctatcgacatcggctggaattattccatcggcttgtcagccgatcggctcattgatatgctatttgtatatcttgtcagttgcaggatcaaactgattgacacgcccacatctcatcaacctttggaccttcactggagctaagctaatctcccagtctgttgtgttcgttgacttagttcgcgccaacacagttctggcaccatcgactgagcgcagatttttcgtcaataggtggtcgaggcccgcctcgccggattccttattgcctccttaggtcgatacccggagtccgcatcacctcccgaggtcgatctggggaaagagaggaagaggggtggcagtggatgccgcttgcctcgctggagccagcctcgcctgctgagatactggtaagagagggaagagaggaataggggcagcaacggtagcgccctcctcaccatgtctgcctgctagagttgagctggagaagagagaaatattggacagttgggaccacacaattttttaattattgttttgctgattggactgccatgtgtacgccatgttgtaaaaaaccgcttcagattgaatgagagggtaattcatccggttcaaagaatttggggtgttaaatatctagtattgagtttaaggaggtaattcgagcaactgtaatagtttggggtaattcaaacttcttttttcccttaagaaaagaaaaaaaaaccctcatctttgtaattttttaacacctataatgcttttacaatgatcctctccttccttatcctccaagagccatccctcatactgtgcgccaccgccatgctcctgctctcagccttgagccaacaactaactctattgtacgttaacaaaataaagttgttgaatggtctcaaataacataaaattaagaggatagctagaccgtaggatcccgtgggaacgggatacccttccgttccgcgtcgctagcccccccccccacctgcttcctctcacgtagcattctactgattactcatggctgtgtttctagctacatgcatacatgtgacgtggctgtgttgctagctgcatgcatgcatgtgacgtggcatgtgagttgatacctgatactaaaactagtatctgataccaggcccaataccaacaggtatcgttcaacatcaattcaggtacacctagtacccgatactcaggtggtatcaggtatatgatacctcatgtaccttgataccagcactaggtatggtacctataggtatcagaccgatctaggtaccaggtacttgatacccaaatacccgatacccagtactagatctggtacatatgggaatcatgttgatctaggtaccaagtatctcgatgtacctatgatatcagttggaacaatctgggttggtcgatacccagtatcgaagataatacatgtaggtaccggtgatgatacatgtaggtactggtgatgatacttgtgaggtatcggtgaagatacatataggtgccaattgatgatacatgttaggtatcggtgatgatacatgggtaccaatgacgatacctgtctggtactagtgataatacctatgaggtatcagtgatgatacgtaggtactagtgatgatacctatcaggtattggtgatgatacatgggtactagtgattatacttgtgagatatcagttacgatatatgtaggtattggat

SEQ ID NO: 91866 - DNA, 2010 bp, Oryza sativa
acgcgctcatggcgccgatgctgtgcctggagctcaagatctatgggcagtggatgtcgagcgggcagaggcggctgtccatggtggcgaacccgtcgaaccacctgtccgtcgtgggcaacttcgtcggcgcgctgctgggcgcgtccatggggatcagggagggcgccgtgttcttcttcgccgtcggcgtggcgcactacgtcgtgctgttcgtgacgctgtaccagcggctgccgacgaacgaggcgctgccgcgggagctgcacccggtgttcttcctcttcgtggcgacgccgagcgtggcgtccgtggcgtgggcggccatcgccggcgagttcgcgctcggcgcgaggctcgcctacttcgtcgccatgttcctgtacgcgtcgctcgccgcgcgcgccgtcagcctcttcggcggggtcaggttctcgctggcgtggtgggcgtacacgttcccgatgaccagcgccgccgccgccaccatccgctacgcggcggaggtggaggacacccgcctcgccagggcgctctgcgtcgcgctcgccgccgccgccacgctcaccgtcggctgcctcttcgccaccaccgtcgtgcacgccgtcgtgctccgcagcctcttccccaacgacgtcgccattgccatcaccgaccaccgcaaggtgaagcccaagcccaagcccaagaccaccatggaggtgcactacaagatggatggcaatggcgacatcgagggcggtgctcctgccatgacgccatcgccatgcatgccgatggcgacggcagcttagaggatttcttttcttttctttttgacctgccaagccaacgcgtccacatgcacatgcatggttttagcggtttgaatttgataagatgaatatttgaaatacaaagtgcctatgaaaatttatattgttaatattttttgagtaagttgaactttatgtatctactagaagatggtatgtgctttactgttaaatactccatccgtttcaaaatatttgacgccgttaactttttctcacatgtttgaccgttcgtcttattcagaaaaaattatgaaatatgtaaaactatatgtgtacatgaaagtatatttaacaataaatcaaatgatatgaaaataataaataattacttaatttttttaataagacgaatggtcaaacatatactaaaaagttaacggtgtcaaacattttaaaacggagggagtatatggattagatgactatatattaaatgttatagaaatgataggtaaaatttagtttaatatatcgtgaaaataatgtaagtaatgatgatttagcatgtttttatgttgaactttaaaagataataaatcataaatataatattatagttttaggtgtttaatgggtaggaactttagagtaggtataagtttggttacatactttgagcctgtgacgccctagaataatcggggaaaaaaaaagatggagcaggcagcagcagctagctagctgtagctggcggcccattttgctggtggccttgggcccatttgcaataagcataaataaagcggaaaaagttcacttcagttccttcatctgtcatcaagcttcaaaccgttcctaaaccggaatactaaatataatacatccattatctttcaaaaccgagtcacactaaaggtgtgtttagttctaaagttttttttttccaaactttcaacttttcatcacatcaaaccttacttttcagtcacatcgtctccaacttcaaccaaattccaatctaaacacagcctaggtagtaaggcaatgttgcttccggttttaacagacgtagcactcttaaagcaaaaattaaaaaaaacataaaaaaccacgtgggatccgcatgtcagtgaagctttagacggttgacttaagtgaacgagctcctgctcgcgcatcggcctggcgcgcctctcctgctctgttggaccgccgcgcccagagcgctcgaccagtcggcgggcgatggtcg

SEQ ID NO: 91867 - DNA, 1471 bp, Oryza sativa
tttgactttttttaatgaaacacattacaaacgaaaacgctcataatatgtgcacactcacatctataaatgcacacacacatcctactcctatgagcaccttgagaagattgagtccaacatgatgaagtcaccacggatgtctcgctgttgatggatacgtcacttaccactgacagaataattagccgcaaatgtgagcacccatgtcaattttagaacttgaacccgactaggttggtttcagcaaaataaactaaccagttaaattatactcacttcaccttttgggtttgacttttgaccgcatatagcagaaaggcaaaagccttaatttaaaattacaattttcgttattatagaaaaatatattgaaaagtacaaccacagagtttataacttatttctatatatatagagagtaataataacatagttaaaatgtatacttgcatgtttaggcatggcggataataaaaataaaaaataaagcccaaaaccctatcgaaaagatcaaggcaaaatttactacagaatacttaaaaaacgtgtaattagttgtgggacaccgcaaatatgtgaattggctataggacatcccaaaagagtgataattagctactaaacaccggagacattattttatcatttctggtggaaacggagagaggaacaatggaaaaaggaccagatttccctatgtgagccaaggatgtcagcatctccactattttcatgtcctcttactcctgatgaggcacaccacacgcaatacggcgccgctgacaccgtccttctccatcacgccggcaggctcgtacgcaaacgtgggtagggcatcgatggcgtgataattagctactagacaccggagacattattttatcatttccggtggaaacggagagaggaacaatggaaaaaggaccagatttccctatgtgagccaaggatgtcagcatctccactattttcatgtcctcttactcctgatgaggcacaccacacgcaatgcggcgccgctgacaccgtccttctccatcacgctggcaggctcgtacgcaaacgtgggtagggcatcaatggcgtcgcggacactcacatcgtgcccactatgccacgtcacgctctccgcgcgcaccctcgccgccctcgccgccgcctgcgcacagcgatgcagccgcaaccggcgaggacggcgacgccaatgcaaggcggtaggtgctgcatcgacgagaagtggtgctattccatcggctccttgccgtggccgccagagccagtgcccgaggcagcggctgttgctcggcttgctcctctcgccttgcttgcgcctgggctagcatctgatgcacctgcaccgccacagccccagacggcggcttcttgatggcatgcgactctaacacaagcaaacgacacgggggtatgttggtacttccagcgctctttctctctctgtttccactag

SEQ ID NO: 91868 - DNA, 1276 bp, Oryza sativa
gtcgtctcacccaacgaacttttccggcgaactccccgacgagatcgatggccgccggcgaacggcaatcgaacaaggagtactaggacgcccttctttgttgtttcttctcggcaagatcagttggttggcaccacctgccattcttggtttggaagtgtgggagggaggggttcggttggtcgatgccgttgcggttgccgtgcgcgatggagacgaggccaccgcgggcggcggcgccggcgccggcgagggtgtcgaggttccggaggctgcttgtgcgggtgtccgcggagccggagcgggcgggcggcggcggcggcggggaggtgagggagaaggaggagaaggcagcggagatggaagtggggtcggtggggttggaccggatggtgctcagcttcatggaggattccgccgccgccgccgtggagcggcccccgcgtggccgctgcggcagctgttcaacggcggcggggacggcagcgacgacgaggagttcgacttcctcccctccgactcctccgccaccgccgccgcttcggccgccgccgccgccggcgacgccctggacgcgttaaaggtatagggcctttttccccggctcgattgtcgtttccaattgctcgccggagtgatcaacgctttgtgtcgtcgcagggcttggtgcagagcgcgagcatggcgaagaggaacctcctcgccgacgcgtcgaggatcgccgagaggtgccgcaagggcggcaagaagaaggccgacgtccgctgcgccgtcgccgacggcctcgccgccatcggctacgacgccgccgtgtgcaagtcgcgggtgggacaagaccccctcctaccccgcaggtaaactaaacctcgcccccaattcgatgctgctgaatcgccggcgctgaccggcggcgacggtgggcggcgcaaaccttgtgcaggcgagcacgagtacatcgacgcggtggtggcggcggagacgcggctggtggtggaggtggacttccggtcggagttcgaggtggcgaggtcgaccaaggcgtaccgcgcggcgctgcaagctctcccgccgctgttcgtcgggacgccggaccggctcgggcagatcgtcgccgtcgtggcggaggccgcgcggcagagcctgaggaagaagggcctccacgtcccgccatggcggaagccggagtacatgcgcgccaagtggctctccccgcaagtcctccgctgctcggacaagccgcggccgccgccgccgtcgcccccgcccacgccggtat

SEQ ID NO: 91869 - DNA, 1248 bp, Oryza sativa
actccctaacatgcaataaaggtacaatgagttcctgccttacatacataccatgctccaggaaagaggatacttggaatgatggattgataaattggctctgcaggttttggagttggacatatgcgagataccaaaacaaaaggtttggtggtgccaatgacaactttgtaatgttatcctaaatgattccatatcctaattgaaggattctaacactctgctccacatattgaaggtatatgggtctggggtactcccattgagttagatgtgaatggctccaaagtttctgtcctttacctggacactgagggatttgagagcatcggaaaatcaaatgtatatgatgataggtttgttgcttatagatgaaatgcatattaagtttgaattggaattttaaatggtgaaaaatggactgttagttcttttgtttttgttgcaggatatttgctctggccactgttttaagttctatccttatctacaatcttccagagacggtgtgtttctctggctcatgacatgctcacctccattctctcatttgatagctattaacttgacttatcttgatcatagattcgtgaagctgatatatctagactctcatttgctgttgaaattgctgaagaattctatggaaggtttgctttctgccattcctatttggagcttacaatttactaagtgcctccttaatgttctaacaaaatttccacttttctgtcggcatttgttgactccagagtgaaggtaatacttaaccttaagtgttagaattatttaaactagaaccactatgtcaaagttacagtgcttgtctctgtaggggcaagatgttgcttttgagccagcaaaactactgtggcttatccagagggatttcctccgtaagtttctgtttgcgttacatatgaacaattttattttgataatcaagtattcctttcagcatgttctgaatactagatgagaattagattttcataacaagaatagacaataaatcacaagtcggaccataaaaagttctaattgccttgtattaatgtttgtacattgtgaggtcggacttatgttgcggtacagactacagagggactagttaataacttgatatgtgctgtatattagcaatagtggaaatatacaggtctcgtgctttattttggtcaaatgtctattgttttgcatttcaccgtttgttgttgctgttttgtttttaggatattaaacttcttt

SEQ ID NO: 91870 - DNA, 2721 bp, Oryza sativa
gacaaaaacagcgacaacaactactactacaaaacagcatttgcaggttgcaaatttgcacctccaaatgctctcatcatgttgttaggatatgctcctactactgaagctccatgttgacaagctcatttgcatccatcagagacgatccccatgctgtatattcattcgaacttgcgccgccaccacaagctctattctgaagatgctgcaagctcgccattgttgctgctgcagctgcactggatctgttgggtcaatcttctcgacagaatccacaatctggaacgctggagaaacctggtgcatgaagctgttaacaccggcattgttagcgttggagaagtagttcattgggttgttgttctggatcggcacagaagcatcagagttgacattgaggggagattgcatgtcaggaatggcctggtgaagttgtctagcccctgtaaccatcttcacactctcctctgccatcctcacctgcaatcatgtcaagatgttagctaacccacatcgcatggttcatgaattttcagttgtggtctagaagcatatggctataagatacgacaccgcagtagtgtagtgtagctcaggttctttgttaaaattgattgtgatccattgtgtgaattggttatcaccattcggcaagcgattatttacacctggtacgttgcaggaaaaagaaaagtagttacacccggttgtttcaagacaaaacaagtgagtctaattgttgcaggttataatagatggcaaacaacttaatccttcgaatggagcaagaggacaacatttgcaatatctcctgtaccaaattttaagaacaaatgctagaagttcgtttcattccaagaaaatttggtatatgtttgatatgtagaatattccggttttctacaccatgaaagatgcacaatactgaccagaatcaatgcacatggataattggatacctatttgaaagagaggttcagttcatacagaggactaaaaggcacttaaacagttgcatacctttgctcttagggcttcaatgtctgccattagtaccctattgtcaatagcagcagcactgtacttctgatttgcatcagcaagacgcctcaacagagaagagttttcaacccttaatagtgatacctgcaatgatttagcaacaattacacttgttacttacatattccaaaactttgttgtgcagtcaaatggaatagtgtaaaacacaaaacctgctcctccaggtcttttaggcgagctgcctttctgcttcttgagcgtctagctgactcccggttggattccttcctgaaattggacaagaacacaagctcaaatctcaaatatccggctgtatttattacacaaaaaaaggcgacatgaatgtctgactgctgcgaaaaaaaagaccacagtagataaactcaatttttcatatgtagaaaaagcaactagacacaacaggacatgatattcccagcatgttatgaaaagcaagaagcaaatgcctcctaaattgttctaatcatacacgttgcatttttccttttttgcatgaatagctgcttgcacggaaacaataattatccttaatgcaccagcttgtaacaagcattaccaaaattcagtcaggtatataaagcattgaaacacctagcaagcattagctcaagcatttctaagaaaaaagtgagaatgttgtatataatcaaatacatccagtacaaacatgaaacacctagaaagaaactaaggatccattatcttgataatctaaagcatattacttaaaagctatttctaagaaaaaaggaaatcaatagatgtaaaagtcccctaatttctaatgctaatgctcagtgtttactctttgtatgtgttgaattgaaaaataaaaatacacaagcaaaagaatacatattaccttttcttcactttatcttcttcatcaaggatcatatttcccattgcctctgcatctccttccatatcatcatcctctgatggtgatggctcccttgaggaaccactcgtagcttgcttggcatgagcatctgtattttgatttacatatgggcctgatcctccatttgggccaggacttaacttggtctgcactagtatcccgttacctgaatgtgtcgaaatagggggaaaatccaatcagatatatataatatgaaaactacattacgcaaaaattagatttgcttacaacattagagattactcataagtcataactcataggtactgagaagatttaactaagcacatatgcataatagaataccttcaatgcacttctgtgaactcaggatggaaccaactatactcagtgatgttttattgcctagaggactctcagaatgtattgcaccagaggcctgtggatggatggacatgccaaaaattgaagtcagaatgcaaagggacttaataactatcggagctaaacacacactctcatagttaattagttctaatggcattataatcttatatagggaaccgtttcacattgtaaactgaaatcaactagcaaaagctcagatcaacatgttctgtagtcatttgtaaactgaacccacataatgagttcaaagtatgatatccaattgcaaaaattatataccccacttagaaaactaacataaaaagaagatattttctccggtccaacaaaaagtacctcgaggtaccggtacctcccgg

SEQ ID NO: 91871 - DNA, 781 bp, Oryza sativa
ctttcattaaaatctgaagatttatgtgtcttgagctatcaatcttcagattataatgaagttggttgattaatgtagttaatatttacataggagaaagctggagccacagatgggtcaaacaattggaaatagacgacaagatggatggaattgggaatgactaacttttagaagtcttcattttgccttccccagtaatactagatttatggtcttccttggtctgcttgctctgttgggcaggtttagccaatgaaactttaatattcacctgggacacgccaaaagatgtaaaaatcctatcaattgtaaactaatactctgaattaatccaagtcgagaaaagacctttgagccgttcttactgaactcttccttgtcaaaagattcaagacacgagattgcagcctcacgagtaatgtaattaataaaggcaaagtccctccttttagctgacggcatatcgcgtgacagaaccacactttcaatcttcccatgtttcttgaagatttcttttagctgagcatgatcccaggacgttggtatcccatccacaaaaatcgatttaacctagatggaacaaacagtgcatcagagtacttagacttcccagggaagcgaaatcaaatatgttgttaagtgttcagaacttcagatatgattaaaggacttgaacggggatatgaataaagccaggtatgttaacaagtggaaacaaatggtcgttaacttatttatgtaataaggaggaccccgatgcacttcgaaccaagggcca

SEQ ID NO: 91872 - DNA, 1345 bp, Oryza sativa
catattgatttacagcaatacttgggccgatcaccttcgccacctccgcgtcgtcctcaccatcctgcgccagcatcgcctgttcgtgaagaagaccaagtgctcgttcggagtcaactccgtcgggtacctgggccacaccatctcggcgtcgggtgtggcattggaccccgctaaggtccagccatccacgagtggccacagccccgctccgcgcgtgccgtgcgcggcttcctcggcctggcgggctattaccggaagttcgtccacaacttcggctccatcgccgctcccctcaccgcgctcctgaagaaggacgggttcacatggactgccgacgccgcggcagccttcctcgccctcaaggaggccgtgacgaccgcgcctgtgctggcgctcccggacttcgccaagcccttcatcgtggaatgtgacgcgtccacgtatggcttcggggcggtcctcatccaggacggccacccgatcgcgttcttcagtcggccggtggcgccccgccatcgctccttggcagcctatgagcgcgagctcattggtctcgttctcgccgtccgccactggcggccatacttgtgggggcgccgcttctacgtcaagacggaccactacagcctaaaatacctcctcgaccagcgcctcgccacgattccccagcaccactgggtgggcaagctgctgggatttgatttcaccgtggagtacaagtccggcgcgacgaacacggtggctgacgccctgtcccgccgggacaccgaggaggcttccctgagcacgatcatggcggtctcgggaccccgcttcgacttcatcgaccgcctccgccaagctcaagccagggacccggctctggtggcgatccacgacgaaatcgtcgctggcacacgggcggcgccgtgggcgatcacggacggcctcatcacctacgacggccgcctctacataccgccaacatctccgctgttgccagagatcgtggcagcggtccacgacgatgggcatgaaggggtccagcgcacactacatcgcctccaccgcgatttccattttccaaacatgcgtcgatgtgtgcaggacttcgttcgggagtgcatcacgtgccagagatataagacggagcacctccaccccgccggactactgctgccgctgcccgttcccaccgtcgtctgggctgacatcgggctcgacttcgtggaggcgctgcccagggtaaacgggaagtcggtgatcctctccgtcgtcgaccgcttcagcaaatattgccacttcatcccgctggcgcacccgtacactgccgagaccgtggcgtaggcgttcttcaacgaca

SEQ ID NO: 91873 - DNA, 647 bp, Oryza sativa
ggcaaaatgtgcaaccggagattcaattggtccatcgtcctttttgtggactttgagatcatgcagtgtctcctgaaatattatgtcatgcaatttcttttaataactaatccatatattgtttatgcttccaatcttcgatgaaagcatacaagttaaaaatatgccatactcaaacaaccactccacatgtgacatttcattgcttaatcacccaacagctcctgttaattgcaaaattcgtgcttaaatattcaaacatttgttttccattgtaattctatatatcttcttatggattttcaagtagaaaaagtaatactattttatatatttgcaaaaacatacataagtgtgcatcacatcgaatatttagcaaaataacatagaaaggttgcacataccgggagccacatgcagcttataaagataataaagcagaagaccgatatacataaggaaggtaataagtacgggtacctatgaaaagaatttttaaaaacagtaagttgaagccacttgtctattgtaactgttttttttaataaatgtattataaccgtattcatatgtgatactaaataccttccgaatagtgagttgccaggaaataactttggatatttttccgttggctatcagacaaa

SEQ ID NO: 91874 - DNA, 1364 bp, Oryza sativa
acaagggagaggctggctcatactttgtagctctttcacacacgaatccaccaaaacacaggagtagggtattacgcttctaagcggcccgaacctgtatacatcgccggcgtcttctgtgcttcctgtctcgcgaaccttccacatacagattgggagcttagagtctcacccagggtccccggccgaaccggcaaaggggggcctgcgcggtctcccggtgaggagccccacgctccgtcacatagaaatatatataatttacaaataactaaaatttgatattaaaaataattaataactaacacgtatataaaatacaatatgaatattacacattagtagtttcataaagttattacaaaatttaaaattatgatgtcattttaatatatttgaataatataatgagaaaacatatatgatattatataagagaaaatataatgatgctagctgtgcaatctgcgcgggccaccatgctagttttaacttgtttccgttaacatgttttcaaactactaaacgatatatttcgtatgaaacttatgtgtaaggtaactttcaaacatcagataaatctttcttaaaaatttaaaataattaaaactcaattaatcatgtgctaataacactctcgttttatatgtcgtgcttaatcttatctttagcggatgcaggctaacgggaccatatatagagacaccgacgtgcaatcccaaggcgcaacgggcacagattgtgactggatggatgacaattaagcgcaggaactgcctacaggaaccgtgcgcaaacatttggccatgagtaattttacggtttactattttttctgttataaatttaatagtaactcttagtatctacatactgtaatggtacctttaaaaaaccgtagaattgctctttggccattgcgcagccgtaaattcatttcatcagcgcggacttcaagaaataggccgtgtaccggccagactaattaatgctcagcgtgctgtggtgcagaggtccagagtttggtcttcggtgtgtgataaccgtcatgtaggcctcattttgatgggcctcaatttccaacccatctacgtgttcagactacagaggtagcaagcagcatacggtcgcatcaggttgaggacgccgacgccgtcgccgttgccttgttcaccagaggcgagggacgacggaggtcggatcgaaggaggggagcggtggtgacgactgccgagaaaaaaaaggctgtggcttcgcgcgattgtcgacggcaaggggattgtcgatcccgatctcctcgacgatggctgcagtatcctccactccactttggcaccattgtcccaccgattgctgaccaagtg

SEQ ID NO: 91875 - DNA, 1162 bp, Oryza sativa
cacatccgcccccgccgccccgaggcagcgggtagtcacgtgcgatgaggtcccggtcaaggaggttgccttgggcgacggcccgtccaagaccacacggatcggtggtcttctggacggcaaataggaagacgcgctcgtctctttcctgcgggcaaacgctgacgtcttcgcatggagaccggcggatatgcccggggtccccagggaggtgattgagcaccgtctcgccgtacggccgggcgcgaggccggtccggcagaaagtgctgcgccaggccccggaacgtcaagcctttatccgcgaggaggtggcgcgacttctggaggccggattcatccgcgaggtcatccatccggagtggctggcgaacccggtggtcgtccccaaggcgaacggcaagcttcggatgtgcatcgactacaccgaccttaacaaggcatgtcctaaggatccttaccccctgcctcgcatagatcagattgtcgactccatagcggggtgcgaccttttgtgttttctagatgcatactctggttaccatcagattcgcatggctagggaggatgaggaaaaaactgcgttcattacccccatagaaacttattgttatacaacaatgcccttcgggttaaagaatgcaggtcctacttttcaacgtactactcgaatttctttgggtagccaattaggacgtaatgttgaggcttatgtcgatgacttggttgtaaagacgcgcaaccaggaaacgttactttcagatctagcggaaacttttgagagcctccgctccgcccgcataaaactgaaccccgataaatgcgtgttcggtgtacctgcgggcaagcttctcgggttcttggtctctgcccgaggcatcgaggccaaccccgagaagatacgagctatagagcggatgcgcccccccagcaagcttagggatgtgcaatgcgtcaccagttgcatggccgccctaagtcgcttcatatcaaggctgggagagaaggcgctacccttatttaagctcctcaaacactccgggccgtttacttggacggaggaagctgaacgtgccctcactcagttgaaggcgtatctcagctctcccccagttctggtcgccccggagccaaatgaacccttgctactctacttagcggcg

SEQ ID NO: 91876 - DNA, 5524 bp, Oryza sativa
ctttctgagtttgatttgcactttgaacgcacgccacgctatcaagagccaagccctcgccgattttgtggcagagtagaccccggctcccgagcccgtctcgatccccgaggccagctcggacccctcgcagttgcctcacaccgctcactgggtaatgcagttcgacggctccctgtctcttcaaggcgccggtgcgggggtcacgttgacctctccgagtggagacgtcctcagatacttggtccgcctcgactttcgagcgaccaataatatggcaaagtacgagggactccttgccgggctcagagtggcagctggactggggatccgccgcctcctggtgttaggcgactcccagctggtcgttaaccaagtctgtaaggagtaccggtgctctgacccgcagatggacgcctacgtgcgccaagtacggcgtatggagcgccattttgacgggattgagcttcggcacgttcccagacgggataacatgatggccgacgagctctcacggctcgcgtcctcgcgagcccagaccccaccgggcgcctttgaagaaaggcttgcccagccgtcggcgcgacctaaccccttaggggagacggatgcgcctgaccggcccccgaggcccgtcggagtccaggcctcgggacccgaggggagtgctcccagctcccttagattgatcgcttggatcgctgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagctttccgccagggtttttattggccgacagctctcaatgatgcggtcgacctggtccggcgatgtaaagcgtgtcaattccacgccaagcaaatccatcagccggcccaggccctgcagaccataccactttcgtggccatttgctgtctggggactcaatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataatggcacccaattcactagtgaactcttcggcgactactgcgaagacatgggcatcaagctctgcttcgcctcacctgcccaccccaaaagcaatggccaagtggagcgcgccaatgcggaaatcctcaaaggccttaaaaccaagaccttcaacatactcaagaagcacggcgattcatggatcgaggagttgccagcagtgctctgggcaaaccgaactacaccaagccgagcaaccggggaaacgcctttcttcctcgtctacggcgcggaagcggttctcccatccgagctcaccctgaggtctcctcgggccaccatgtactgcgaggctgatcaagatcagcttcgtagagatgacctcgactacttggaagagcgaaggcggcgcgcggccctccgagccgcgcgctaccagcagagcctgcggcgctaccatcatcgtcgccttcaggcccgatcactctgcgtcgacgacctcgtcctacgccgcgtccaaacgcgtgctggattgagcaagctctcaccaatgtgggagggtccgtatcaagtggtaggcgtcccccggccgggctccatacggctggccacgggcgacggcactgagctgcctaacccgtggaacatcgaacaccttcgtcgcttctacccctgagggggggtcgggtgtcaggtttcgggctcgggccaaccccgcaccccctcgggcgtgcagggttggccgggggctgccacacatgcactttcttatttctcttatttcaatatttcaataaagacagtttcaatttcctaaaggctgtgtctgtgctgttttttccttttgaagaatcttgacttgaaataggtcactcgtgctcaatcctgccctcgggggctcgggtcggctaaaatcgccaaacggggcccagaaccgagccgtgccccggggcgtggtgaactccgggggggaatcggcaaaaacccacaatcgggttacccataaccctcggtcaccacgttcccggcctggccagtctcgacatgtggatctccccaggcactagccccgacccgcgccttttgaggactgggacctgggcacgaacccttaatcaagctaagacacaaaaggaccacggcacagatcatcctcatctcatactcacagcaagatgaaattaacacaaaaatttcttcatttttgattacagattaagttgatctatacaaaaaagaggcccgaaggccttagaaaaaagaaaagaagaaaaaactgaagaatggcgggggtctgggggctcaatccgatgcgcccggaccgccggcctcgacgtcactgtcgtctgcaccaccggcattgccctcctcgtcggagttgggggcaaacgcaagccgaggggccgagccctcgaagctgtcgacgatatggtcggcggcatcccggacctcggtcccaggagggaactcatccagcgccatccatggagagaaattggggtccctggcctggtaactcgccaggacgagctccaccgctccttgggcgaggtccctcgaggatgacttaattgtcttctcgagctcctcggggagccgttggagagccccggccatcttcgagaggcgctgggcgaggcctccctggttgtcggcgtactttacggtccgccctctccagaggcccacttgccgaccggcgcaatctaggcgggagacggcgtcccaaagcatgccgggcccaacctcgcctgccaagcggagggcttcgacctccccggcggacgagtccagcgcgccttgcagatcggcgatggtgtgttcggcagctgcgaggcgggcggctacgtcgctttcgcccgcggccgccccgccgctgcgcgcccttgcgtccagctccttcgcccgcgcctcgagctcagcggcccattggttcagtgcggccctctcggcgcgggcaccttccagatcacggcgcgcctgctcctcctgcgctgcctcgcggagggacaggctgtccgccagctgttgcgccgcggcctcggcccccgcgagagctcgctcccgctcggtgagcgcgtcctcgcggaggcggagcacgagctcttcttcggcgcaggcagcctcgtgcgccgccagcgttgcttcccggatggtgacggcggcctcgcggtccgccagatccctctccacgacgcaggcgcgctcttccagcgccatggcgcgcgcctcaagggcctcttcgcgctgccgggacgccgcttccgtctccgccgcccgctgttctcgggcagcggcagcgtcaagcaccccctgggcggcgtcgggcttcttccctagctccgcctcccaactcccgtattgaaggcggagggtgtcctgcgcctcgttcatcacggtggtggcgataagggcagcctcccgctcctcctccacctccttggcgatctccgccagcaccttcttacgggtttcaagctccgagacatgccggcggtgagccttacggcccacctccaccatggcctccaccgagcgtcgcccctcttcgacacgcgcccacgcggcgtcgagctccgcccgctctgcctgcagggcctccacctgggcacttaacccatccaacatcgtggtgtttgcggcggccaaggcctgcagaaggggctctgtgttcagtggggcgatagaaggcgtggggaagagccgccttggagaggatgccacgtggctcgggccgccgatggaagtgccggactcggggatgtctcccggacccggttggtcctaagcgtcgcccgagggagtgggcccaagcgacgcgcccgcagcctgtcgccagctgccccggaagttgtcgcctgagcgtcgcccgagggagtgggcccaagcgacgcgtcccggcctcgtcgcgagctgcctcggaagtcgccaacatctagtcctggcgggctcgggcggcctcctcccaaacggcttcctcggcctggcgggcccgggcggcctcctcccgagcgatttcctcggcctggcgagcccgggcagcctcctgggcggcctcctcggcttcccgtaggcgatccgcggcctctcgccggtcagattcccgcccgcgggcctctgcggccgccggatcctcagcctcccaccccccggacttggaatggcgggagggacgcgacgggatctcgctgaaacaaaagaaaagaccagaagacgaacgagatgggtgagtaaaaactcgcgttgagagaatgaatacaaccacgatgggcgagagacgaacctgcgagggggtcggttaaacgaccactttggaggggaaatgaggtttccccgagatggttctgtctcccccatcttgcggggccacttcttcttgcgctccccctcgggctgcgatgttggcgcggccccctccgggcgcctgctgctggcacgcgccgccccgccccctcggggaggagatgggggaggtgttcctccctgcttcctcttcccccgggcatcggcagggcggctgctccccgggcccctgtcgcgggacccagaagcacgaccccctctcgggatagattgttccccccggcggctcccgcctgtgccgtcgtggccctttggagctcgctcctctgaggccccgaccgccatcataatggtcaggatggaggcgcggtctggatcgctgcagagggggaggattccttgaggaatgagggccgcctccacggagttgagattcagcacccgttggaccaatatcttgaagtcctcaggagcccagtcccatctcactccctggtgagtcctcatgaagtcttcggacccggtgtactcccaggcgccccgagcgcgccgctggagcggcgcaatccgacgacggaggtagtcgccgtacaccatggctcttgtgagcccctgggatcgcaggcccgccaggcggtcgaggacggcgtcatagccatcccccagatctaccggcgcccgccagctggaggcctgagccgggggctggctcggaagtcggaggcgcacttcgtcggcaaggggggtgtagaaccagtcgctcttccagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcg

SEQ ID NO: 91877 - DNA, 903 bp, Oryza sativa
gacgaagacaagggaaataatggcgaaaggagggaaacaaatcccttcatcagtgcctttatactcttgccaacgctgtcccggctcctcgcttctcgcgcccactgtttcgccccctcgtttctcgcgcccatgcttccactaatcccattcgcccgcttgcggcgcatgaggtggatatgcggttgtggcagtcgagatagatcatatcgtgcgcgcggtaattacgctcgccgaccaaagcgacgttaccatatctccaaacgaaacgaatcgccatgtccagattcgtgtgctactcgagtaatgtggcagtcttgaagagaccgctcattattgacagccgagttaccactgccgatgtgcgtgatttgtgaccgttgggtttctgcccaattgtggagaccggtcccacctgtcaccaggccttaggagtggcgtcacgcccgaccgcttcccttaaagagggcgatcgccctggcataacgccgggggctactgtcggtgacatgggatcaggagtatcatgactagaggtttgaggcagacgcaatcgcccacgtggcctggcaccctcgggggacgtcgggcccgagggtgatgtgttcgccctcctcctagtccccccgagggggtcgggctgcacccccctcggccccgagggccgaggcgccccgacccctcgtgggttttttgctccgcgtgtatgggttaggtgagcacagtggggctcacctaccacatttattgcggtttgactgagcgtgtcacgccgcatgcaacgtagtgcagtgcactcgtttatccggtctgtgaccagtcacagaccggtcagatcgcgggttaggtggccacaggcgatctgacacacgcctcgccccatcccgtcaggacgagggcttc

SEQ ID NO: 91878 - DNA, 979 bp, Oryza sativa
aaatggcagggggtggacatcgcgttccgggtggacgccggctccaaccagtactacctcgccgtgctggtcgaggacgaggacggcgacggcgacctgtcggcggtggacctcatgcagagcggcggcagcgcggcggcggatcttgggcggcgatgcagcagtcgtggggcgcggtgtggaagtacaactccgggccggcgccgctgcaggcgccgatgtccatccgcctcacgtccggctccggccggacgctcgtcgccagcaacgtcatccccgccgggtggcagcccggcggcacgtaccggtccatcgtgaacttcaggagggaggattgatgagatgatatgtaggggatatgtagggtggtggtcgcacgcgcgcgcatgcacggtacaacggccggcggcgtacgtggcgctagcttagtttaattatgcttggagctatgtatatcagggcacaagtggtttgtgtgcgccattgttgcgcgtggagtgatggagctctctgtcagctcgatcgactgtggtagaagaataaacagatccttcagctaagctatttgccacagttgggcacttgggcgttggctccggtccatgtaccgatcagccagcgtggtccggggctccgggccgtcgcgggggataacgcgacttgtgctggcttccgcggttccacctacgcacttcgttcggtggaaaaagtcctttttatttttctcaactaaagttttagtttgattcgcatccatggacagcaaaatcagatagagaggctaccttaacaatcaaaattgactcattttatcttttcgagtgatttaggtaacggttttttcctacatgacacattgaactagagaaatttaaaatgatctatgaaggaaatcatgaccgccatggtggcagcgccacggcaatcgagctcgagataggagaaatgatgccacgggtggattgagtgtccaatggct

SEQ ID NO: 91879 - DNA, 918 bp, Oryza sativa
ctcctcaccctccaccaaacgaatctgatgatacccagctcgaaggtccaacttagaaaagaaacgggctcctgagagttcatcaagcaattcatcaatgacaggcataggaaacttccatttaactgtgatagcatttaattacctgtaatcgatgcacaaacgccatgtaccatcttttttcttaaccaatagtgcaggtgaagagaaaacactggaactaggctgaatcaccccagcaagcaacatctctttgacctgcctctctatttcatctttttgagcaggattatatctgtaaggccgaatgaaaactggtttagaattgggcaggagagggatctgatggtcacaagctcgtttaggacgcagtccctagggctcctcaaagatagactgaaattcctgcaaaagctggccaatatcaggaggaagaggcacttctgtgacagacaaaatttcctgcaattgtaagacatgcataacagaccccatcttcagcatgccttgaagttgttcaccaggaatacccaaacagtggttggtttgaacctgaatacccaacaattgcacttgacaaccagccctctagaaagacatccatttagcagtccaatccacactcattggacccagttgcatcagccaatccatacccaaaatgacatcataagtaccaaggggaagaaatttgaattcagtgtggaaaacataaccttgagtgcaccattcacaatgaggtataaactgagagcaagacaaaagaccaccatctgcaaccttcactgatacagtgttaggtagctgttgtaccccttgtactgctgagaaagagcactgtccacgaaggaatgagaactaccagagtcaattaacataaggacttccacaccctgaacccatcccctgatcctgaaa

SEQ ID NO: 91880 - DNA, 2134 bp, Oryza sativa
tcacggcttgcctgacatccctccttttaatcgtcattaggattctatttcatgttttattaacaatttttatatgtcgtatcaaccgccaccactctactcctttataggcatgttacttaatttatctcgtcatgtgttttagatggttttttctttcaatagtctttatttttatcacaaattttagttatttataaattgtattcctaattgaaatcttatttttctttttctaatttcagaatttatttttttaaaaaaatagttaataccgtattgtgttcttttaatgtttttattttttattttcaatttcagttgtttcaaaattgtatttctacctgaactctcttttattttttttttctaatttttgatattattttatttttattctaaattttaattaatctcgtattgggttcttatatggattcttctttcaatattgtttatttttaattccgaattttagctaattttaaattgtatttctacttgaactcttattttattttctttttataattttggatttatttttatttcaaattttgattaatctcgtattgggttcttatatggaaacttctctaaatattccttattttaaattccgaatttcaactatttttaaattgtacttctacttggactctccttttcctttttttctttttctccgattaatatgggaatttttagcctccacagcgaacgtggtgcctcctttcaaaactgttttaataatataactagctggatggcccgcgcaattgcgcggctagcacctaaacaaaatcatatattttttatatgattttacttaaaatttattagatagctatcttattgtcttaagactttgaaagaccaacccttattatcctcgtgtttctaattatatagtttttaaaagtcacaccagttgctaccccttatgtcatctcgttctttatttgcttgctcaatataccactatttctttttattcttcttggaacctttaaaaattggattttatagtttctagggtttattgtcatgttgggtttcatttttataatttctagatgtcccgtcaaacgttgccattatactcctctacggcccgtctaatgcctcttctctttattgtcattgagattttaaaaatcgaacataattattgtctgggttcaattttactttctagaagttccgccaaaccgtctatggctttgccattgtactcctctatagctcgcctgctgcctgctgccttccttctttattttcattgagattttaaaatcgaacatgattattagtggtttttttttttactttttagaagtttcgaacctttaaaaattggacttgtagttccattttttataatttttagaagtcccatcaaacgatgccactatgcccctctatagcccgtttgccgtctactgtttattgtcattgtgattctaaaaatcgaacatcaatatcgttggaattcattttttattttctagaagtcctgtcagccgtcggcggctctgcaactatactcttatgtaccccgcccgctgcttctcctttttattgtctttgagatttaaaaatcgaatatgattatcaatggggtttgtttttttttactttctagaagtcccggtaaccgccttactcgtttgcttcatggcctgcctgacgtccctccttttaattgtcattaggattctatttggtgttttattaataatttttatatgtcgtatcaaccgccaccactctactcttttatatgcatgttacttaatttatctcgtcatgtgttttagatggtcttttatttcaataatatttatttttatcaaaaattttagttatttataaattgtattcctaattgaaatcttatttttctttttctaatttcagaatttttttttaaaaaaattagttattaccgtattgtgttcttttaatgtttttattttttattttcaatttcagttgtttcaaaattgtattcctacttgaactctcttttaaattttctaattttggatattattttattttttatcctaaattttaattaatctcgtattgggttcttatatggattcttctttaaatattgcttattttt

SEQ ID NO: 91881 - DNA, 722 bp, Oryza sativa
atatccgcgccccggtgagggagcggacttgcacgcagtacagcgaagggatgatgagtcacttcgctagtacattcagcggttctgtcaagtccgtaataccataccatgcatccctgcacacgcggtgatttacgcgttcagggggggtgtgcggcacaaccgcatgctcgaaaagatcgcctccaaagagccccagactaccgcggagctttttcagctcgcggaccgagtggctcgtaaggaggaggcatggacctggaacccctccggttccggtgtggcagcttcggccgcccccggatccgccgctcagacagggcggcgtgataggaggaggaagaagaggtcagcccataccgacgacgagggtcatgtcctcgccgtcgagggcgctccgcgggccacccgaaaggggaggcctgcgggtgacaaaaagaaagaggccggcgctcccagcagggagcgcccaaccggcaagtggtgcaccgtccacaacacttcccttcatgacctcgcggactgccgtgtagtcaaaagtttggctgagcggacgaggaagtgggaggaggagaggaggcaggagcgccgagagggaaagtccccggcggttccttccggcaatcggcgaagtgaggccaagcagaaggcccccgccgaggacatcgatgatggcgatgatgacctaggtttccaagagcctggggctgatgagctactgt

SEQ ID NO: 91882 - DNA, 628 bp, Oryza sativa
ctctcttgctcaaaaaggatgttccctttgtttggtcatctgaagcagatcaggcctttcaatccttaaaaatggcattagtatcagcaccagtattggcccttcctgacttttctcaaccttttatagtggagacaaatgcttgtgatgttggcattggactgttctttcccagcaaggccaccctattgcttacattagcatagcattgagtttgaaaaatagaggcctctctacctatgaaaaggaatacctcgccattttattggcagttgaccattggcgctcttatctccagcaggctaaattcattattttgacagaccatcacagccttatgcacttgaatgagcagaggatacacacaccttggtagcacaaagcgtttaccaagttgttggggcttcaatttaaaatttgttaccgcaagggcagtactaatgcgactgctgatgctctttctaggaagtattctgaggactcctctaaactgaatgctgtctacagtttgtacccctgtttggctccaagaagtaagtgatggctacctttcagacccttactctgctcagttattgtctgatctggccctctgccttactgccagaccattgttttctctgtgtag

SEQ ID NO: 91883 - DNA, 933 bp, Oryza sativa
aggcaaaagcttgtgctcaaccagtgttttcactacacctacatgaaaagatcccagtgaagcacccccacttaagagtaatgctgtcctcccaaaggcatgcctggtctcttgaacaaaggcaagtttctcttccaaaagcaaatcatcggtatcagattcacataccattttcagctgggcagaaacctcatcaatgtaatcttttataagcttaggaacctgcattacaacaaatcattttttttagacagaatggaaaggagtattttaacatttcatgatagggagtgcgaaaatcccagttgacagcaagcaatccttttatgtgtgcaataccgaaacaaatagtgagagctgtggaaacattttaggaacacatactacaagggaaaaaaaatgagctacatcaattatataatatttgatcaaataagatgcacaagcatattcaagataattatccctggtatgactgaatatgtacatgccatttgcgcgcaatttcagaacctgaccaaataagaagcacaaatgtctccagggcaatcatcatagaatgactaaatatgcatatctatgataaagagggatcagacatataaacctcgatgtaaaatattacactaatataatagcatgaactagtacaagagaaggtttgctaattacctcaagcctgcccttatgaagctcgggattgcacatgttccccaaattcctcacaagatcaccacgcatgcagaacaccacatcccggagcgacccttcctccctccgccttcggagctcctccagcctgttcctgatgagctcctcgtcgtacaaatcgctctcactgacctgctcagacattttgtcgagcaccttggcggcgcgcgcccactcctcgtagctcgccgcgtacctaatcgccttcttgcactgcaaccg

SEQ ID NO: 91884 - DNA, 835 bp, Oryza sativa
ccttgagatataaaaggaggaccttgcccacttaagaagggaggagctggggaaagaggggggagaagacctgagctcgtagaggagagaaagaggaagagggtttctagagtttgaactctcttgctctccagctctttgtaactccttcatacacagatccaccagaacacaggagtagggtattacacttctcagtggcccgaacctgtctacatcgcccgtgtcttgcgcatttgctctctcgcgaaacattccacagatcgagtgcttagaacctcacctagcgcccccggccgaaccggcaaaggggggcccgcgcggtctcccggtgaggagccccacgctccgtcaacacccatcgccgccgccctccggccgccgctagccgccgcaccgagcctcaccgtcgacgccgccgcgttcgccatccggcgagccgccgcgtccgctatccgcccggccaaacccgtcgccggagcccgcatctcctcgcactccggtgagcaccaccactactgccgccttcggccatggtttccgcccgccgtggaccacccctctccctctaatccctcccatcttgttccctaggaggtctcggagctcgtccgcccatcgtcgccgttctccggtcgctcgccgtcgtcttcccccacaccggccaactcgcggtgaggcactcctcccctcttttccccttcctctccctcctagcgctgagccgagccgagccgccgcttcggccgtgcgccgtcgccttcggctgccgccgcctcccgcgccgccgattgccctcgccggcgaccgcatgccgccgccgccagccatggcc

SEQ ID NO: 91885 - DNA, 4130 bp, Oryza sativa
cttgtcttgtcacgatctttctctctcctcagtttctggtatggtgcagctgctcgaagtgtggcatcaacagctaacctccttattggaccctacaacacaattaactgttcaaattggagcctacttgtgataaaggtgccaagcaataggatgggaacggcagaatacaaggcaacacagcagtatatgactattgtttgatagtatatcagtaaatgacagaacacagcagaaagcatcagaggaaaataggcaaaatgattatgcacacatttctagataggagaaactctaaaacactacaggcattgaattgagaggaaacaaggatctggattcaggaatcttggtacaataaagtgattaagaagtttaccttgggaagcatagaacctatgtatcgtcccctatcagatgagaatatgagattctttgctcgtccagctttccctcgccgtctttgagcttgctgagcaaagaaaaggagcttctcatctactataccacttcagcatcaaaaatgaactcctcaggtatctgctggtcctgctgttcattttcttcatcatcgtcctgtccaagagtacagctaatgagctacgagaaaacaaaatgaataagttagtcaaatcgtatatgtattaacctcttggtcctcttcctcgtcttcatcttgatcttcttgagaatcttgatcttgtggagggggtggcggtgggggtggaggaggttgttggtcttgctgctcctgtgggttatcagataggattgatcgaggtagaataactagctctacctgcaagaaggtgcacacatgtcaaatgtcttaactttattcagaatatactgacatcattacattaatgcaaacagccagcatggcagaagaaaattgtgagccatgcgagggcaaaatttattttgctgtgacttttattacgtgcaagtttgcagctttctattttgttcttaacaacaaatcatgatgcatgtttccttcggtacatttcagtaaagagatgaaaaggaatagttgtaaacaggaaattacagggggtgtcttactgtattaaataatgaagaattcaaaggcataagtatacttaacagctttcttaaggtcatccacatatactttttcacgcccttccatagcagcaagacattttgccactcgagcagcatacagctcagcccggtgcccctgcaaatgagtgtcagttttatttacatgagaacacagccactttttgaattacattaaccacaaaaaagtagcatcagtgtctcaaaaaccatgattgcttcaggtattacattaaccacatggtgcacagcggacaggtataatatctagacaagcagaaaataatgcaaagccacatcgatttcagggcatgataaacacaactaaaatgaaatcaatggttacagcagacagtttttagccacctcgccacatgttatgaccagaatgcatgatcatggggtacagactacagaccattacaaggacagtgcaatattccaatcaagctccttactcagcttaagccaaacagagctaaaaaattctttcactgcaaaataaactaacctgacagccaccgcgtatagcttccatgacaagatatttgagctgctctgtgctgattgcaacatctttcagatattctcttgccaaaattatctgttagaccatgtattaccacctgtgagatgaacagtgcataatattgttttcaactaaacctccatcgttgctagttaaagtcgctcatgattttccatagtcttcaatgtgggactttggccacgttattttttcaatactacatactagtaaaataatagaagtcataaactgtgaaagtattgtccaacaaaaatagaatggcattattttgtgtgccatcatataccttttatacgtattaaagattgatgttttgaatgttggaccagataaaatatgttaagtggcagaacaacacagggaatataatgtaaatgtgggtacatgcagttaattcagcatgagtggatgacgttgggatctcaaaatacagaaccatgaatagcgtatatactttcgactatgaaggcaagggaaaaatcatatgtaaatggcacaagttgtaattaggtgagaaagatccaaaaatcaatgtatcaacttgtctgatgtgaccatttgtttatgaagcatattaatgaatccacatattttgtgatactgattgattagatatcgctgttctgaagaaagctatttgtgtgcaatacaaaaaaaaaagcaaaagctaaatagtttctacaccctattctagttcaataaaggaggtactctatcttacaggtttacatccctagtttaacagtatcggtggtacctgggtttttgcaacctcagtttcttcttccaccattttaaaaacctctttgctggactcttgaaattgtgttgcaatatccacagctgccacacgatcatcaaaactcattggcagatcagcgctgcaacaaaacaacaatatggaatgagcaatctgtggtatttcataaatgcattgagagttttcttatgttctccacaccaacagagggtgtataagataatacaacctgaacttggttaaaagaagtgagtaaatgagtgatccatagtctaaagtaccttaaattaattgcaatacgatcaagtaagtgttcacgtacagatccttcctctgggttgtaagtagcaattagaagtggtttgcatggatgacgaaagctaatgccctctctttccacaatattgactccctcagtcaagacattcagaagtagattgcttacgccctcatccaatagatttatctcatcaacataaagaacgcctctgtgagcttcagcaagaaggccaggttgaaacacagtagttcctgattgcacagatgcttcaacatcgactgatccgattaacctatcctcagtgataccaagcgggatctgtcaaggggaaacctgaaattgaactaacaatggtatgtcgaaattattttttaaacaaaaagtccatgcagcatacctgcacaaaaggtgttttgataatctcggtcttcaagttaccatcagcatcatattgaacttggttagccaaaccctcctcccatctgccataagaggagaacaatcaagtgagttacctgacaatcatttcagaaatgaaagtaaacatattcaaattgtagttggtatgtaaaactttgtgggggtgaaaagaagaatttggatgcttaaacagaagttctagaagcattattagacatgcatttggggacattactcttctgggtagttagggtcagcatttgcaatcgagcctacaaccacttcataggtggaagcatagcgtgcaagccacgagccatcactgtctttgctgtcccacgcttccctgagatggcgatgcctccaatttcacggtcaattgccccaagcagcagagcagttttaattgcatcctggacgcacaataaggtaagttaaaattgtaacatatacaaagttgagaccataaatcaatggtttgataacaagatggtgtcttctcctttgcaggttattacattagtcacccggtggctacgtacctaggctgtcctccacaaaccgggacttcgggatactattgcggtagtatcacgatagttggaccaggtgacacggagtttttttatccaggagcatgggtggcgatctagtctacggattgatagccactaatccctatgttttggttattcttttgtgcttgggaaggatgtttttggttcttttggctgtgtgcatcatatgcagaggccggggtgggcccgatgcggttgtattgtctttgtgtaattgactgagtatattaataaagcttccattatctaaaaataactcgatgcagggaacaatgggaggaaaactaaagcttgaaagtcattccagctcgtttgtttcatcttcagagagagtatgacagcaaaataactcatagcaaaggcattttttcagagatgtacattggcacattgtgtactgatcggtgatcactatttgtccactgattgattcgcttacaatagcattagcat

SEQ ID NO: 91886 - DNA, 695 bp, Oryza sativa
gccctttgaatctccattctacaacgatcaaagggagtatattattttctatagtctacttatatacaaggacctaatttattaaaggagacgtatagtaagaaatctaaccgaacgatatacttacaaaatccagcaactcataatagagacgtcgagggcgtccagctggtatagttcgtagattcccttgaaattgatccagagaatgtcatctccttgcaagaagtccgtgtccctgatcctcgctccgatcatctctctaccggcggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtaaccaacggctcgatctcctgttttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgt

SEQ ID NO: 91887 - DNA, 799 bp, Oryza sativa
ctgttgggcgtttacgacttcaccgccggcctgcctccgtcgccgcgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctgttatgccgccgctgttgggcgtctacgacttcaccgccggcctgcctccgtcgccgccgagtggtgcctccgcctacacggctggcctgttatgccgccgctgttgggcgtctacgacttcaccgccggcctgcctccgtcgccgccgagtggtgcctccgcctacacggctggcctgttatgccgccgctgttgggcgtctacgacttcaccgccggcccgcctccgtcgccgccgagtggtgcctccgcctacacggctggcctgttatgccgccgctgttgggcgtctacgacttcaccgccggcccgcctccgtcgccgccgagtggtccctccgcctacacggctggcctattatgccgccgctgttgggcgtctacgacttcaccgccggcccgcctccgtcgccgccgagtggtacctccgcctacacggctggcctattatgccgccgctgttgggcgtctacgacttcaccgccggcgtgcctccgtcgccgccgagtggaactccgcctacacggctggccattatgccgccgc

SEQ ID NO: 91888 - DNA, 2019 bp, Oryza sativa
cctcgcctcattcatcacctcggcatcctcttcaaaatgccccaataagcgccaaggttggtagagcaagctaggagatcaattccattttccccaactctagccgccgagcaccaccgagatcaattccattttccccaactctagccgccgagcaccaccgccaaatcctccttctccggtgagtcaccatttgattccgtgcaggtgtcatccctagaacctcagtagcttcacgtgcccatccttttcatagttgggaagccggatgaagccattatcatcgtctggcctattcggctgccgccgggccattacacacattgtcaccaccatcagagccccgccagacctcgtgcacctaaaccgagccctagcaccacatgcaccgtgaccccgatcatggggaggaggcagcgatggtgatggggaagtggtttcgcggcggcgatggaagcgagaaggtcggcaggcggcgctggatgcgttctggtttctgggatgtggtggatgtatttttttctcttttttttattcacgtgctcactgattcttgtactccctccgtatcacaattagaagatgttttgcgtggccgtcgtactttcacgtttagatgatgttcctagccacacgtacaaaagccgacgaaattgcccctgcctcctcgatctcaaccccacgccggcgctgtattaacttcgcactcttcggttccaccacgcgcttttccctcgctcatccttcttattcaccacaaacgccaccgcccagaaacaccgctgccccagaaacaccgtcgcagaggaggagctcgcgccggactccatggacgcgccagagtcggagctcgtgccagactccttcacgctggagttgcaggagctcgcgccggactccatggacgcgccggagtcggagctcgtgctggactccttcacgccagatttgcaggagctcgcgccagattccgtggaagcgccggagtcagagctcgtgccggactcctttgcaccggagttgcaggagctcgcaccggaatcggagagtagccttggcttcatctagcaaagatggttcgcaagggagagaagttggcagccgatcttctctttctaatgtttctttttgcatgtgtggaatcttaaaattgttgcttcctttcaccttcatagcttccatcaaaacactttgtagtgttacaaacattcggtttgctttgtgtgccgaatactccatgaatgcctacaaaataagtgtgcaagaaatgagtcaatgagcaaatttgttgttgaagaatcaatgtaacatgtgtgaacaatttgatcaaattacctcttccactgttggaactagagcttctattgtttttgcattcttattgtattgaattgcttgaatagctcgaaaaaaatccaagtcaagaatgttgaaatccggagaatttggtgtttggcaaattaggcgaatatcaaatccttcttgcttagcatgctcacagaaatccgaatcatccaagtttagatgggaaggtgcattatcctgttgaatgaagattggtttgcccacatcttcttttggccatttggctcgaatagcgggcaagactttgttgatcatgaaatctctaatcacttctcttgtgatcgaagttatgggcttcaaaaccaagtctccacggacacggccggttctcacattgcctctcatagccggttgataagtaacaagtggaaaacaactaatcctaccatcaaaaatgcaattcccatccctaaaccttggccgagcacaaacacacaagaacatgagcctagggatgtaattcttgttcttacaagtccgatggggatcatcttgttcaggtagcaaataatatttttcagatttttgagagaggtagaaccatttttcatcaatgagcacaaagtcaaaaaaatccttaaaccttggaccaccatgcaaatccctcttaatcatgtcaacacacccttcaacctagacttatattagcttcag

SEQ ID NO: 91889 - DNA, 943 bp, Oryza sativa
ggtttttaatataagcacacatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtaccggaatcacgccatgaagggagactacggggaaagggaactctcggaaggaaagcaattatgacggtagacaacaatttattccgtaaagcccatttcactgttctgcaacactcttcattggtagctccttacatcgaggagcacttggctctagttcgcgccaggaacatcggtaagtccgatgtatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaa

SEQ ID NO: 91890 - DNA, 705 bp, Oryza sativa
gtcctcgccgccgcctccgcctctccgctgccgccgcatctctggggtgagagccgccgccgccagatctccctttatctctcgatctctccgatctcagctcgatctctctccgtctctctccgtcgccgccgccgccacgccacgccgccgccgccacggccccgcaacgccacgccgccgccgccgccgtcgccacgccaccgtcgccacgccgtcaccacgccgccgccgtcgccacgccgtcgccacgccgccgccgtcgccacgccgccgccgtcgccacggcgccaaccgccgccccgatgccgccacggccccgcaacgccacgccgccgccgccgccgtcgccacgccaccgtcgccacgccgtcaccacgccgccgccgtcgccacgccgccgtcgccacgccgtcgccacgccgccgccgtcgccacggcggcaaccgccgccccgatgccgccacaccgccattaacgaacgagaacgagaacgatcgaacgaacgagaagcgagaacgaacacgtcaacgtacgttgccgtgagaacgtgaacgagaacgagaacgatcgaacgaacgagagcgagaacgaacacgtcaatgtatgttgccgcgagaacgtgaacgagaacgagaacgatcgaacgaacgagagcgataacgagaacgatcgaacgaagacaagtgagaacgagggaacgaa

SEQ ID NO: 91891 - DNA, 554 bp, Oryza sativa
cgtgcaggcggaaacaccagtcggcggcggacgaggcggcccgtcggtgaagacgtagacgcccaacaacggtggcataataggccagccgtgcaggcggaaacaccagtcggcggctgacgaggcggccggtcggtgaagacgtagacgcccaacaacggtggcataataggccagccgtgcaggcggaaacaccagtcggcggctgacgaggcggccggtcggtgaagacgtagacgcccaacaacggcggcataataggccagccgtgcaggcggaaacaccagtcggcggcggacgaggcggccggtcggtgaagacgtagacgcccaacaacggtggcataataggccagtcgtgcaggcggagacaccagtcggcggcgacgaaggcaagccggtcagtgaagacgtagacgcccaacaacggcggcataataggccagccgtgcaggcggaaacaccagtcggcgacggacgaggcggccggtcggtgaagacgtagacgcccaacaacggcggcataaaggccagccgtgcaggcggaaacaccag

SEQ ID NO: 91892 - DNA, 752 bp, Oryza sativa
tatgcatgtttgggaaggcttaggccgactcccagtgcttggtggctatgattagtcgggcagagtgtttaaacgtaaggagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacattaccaccggctcgcttcgaccgtcgccgactggtgtttccgcctacacggctggcctttatgccgccgttgttgggcgtctacgtcttcaccgaccggccgcctcgtccgccgccgactggtgcttccgcctgcacggctggcctttatgccgccgttgttgggcgtctacgtcttcaccgaccggcttgccttcgccgccgccgactggtgtttccgcctgtacggctggcctttatgccgccattgttgggcgtttacgtcttcaccgaccggcttgccttcgccgccgccgactggtgtttccgcctgcacggctggcctattatgccgccgttgttgggcgtctacgtcttcaccgaccggccgcctcgtccgccgccgactggtgcttccgcctgcacggctgacttattttgctgccggtgatgggcgtctacgtcttcaccgaccggccgc

SEQ ID NO: 91893 - DNA, 604 bp, Oryza sativa
gtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgaggagatcatgagagctttgtcccagattcggagaaagagatgctgtggaccacaatgctcgagacattcaccattcctgcgggtacagaggacaaagtgaaaaggtggactctgaagaaaatggcagaacagtttcagagctt

SEQ ID NO: 91894 - DNA, 718 bp, Oryza sativa
ctacgtcttcaccgaccggccgcctcgtccgccgccgactggtgtgtccgcctgcacggctggcctattatgccgtcgttgttgggcgtctacatcttcaccgaccggccgcctcgtcggccgccgactggtgtctccgcctgcacggctggcctattatgccaccattgttgggcgtctacgtcttcaccgaccggccgcctcgtcagccgccgactggtgtttccgcctgcacggctggcctattatgtcaccgttgttgggcgtctacgtcttcaccgaccggccgcctcgtcagccgccgactggtgtttccgcctgcacggctggcctattatgccaccgttgttgggcgtctacgtcttcaccgaccggccgcctcgtccgccgccgactggtgtttccgcctgcacggctggcctattatgccgccgttgttgggcgtctacgtcttcaccgaccggcctgcctccgtcgccgccgactggtgtcctcgcctaaacggttggttggtcacaccaccgttcatgggcatccacgtcttcaccgaccggccacctcgtccgccgccgactggtgtttccgcctgcacggctggcctattgagccgtcgttgttgggcgtctacgactccaccaccggcctgcctccgccgccgccgactggtgtcctcgcctaaaacgtgggtggtcacaccaccgtcatgggcaccacgtct

SEQ ID NO: 91895 - DNA, 945 bp, Oryza sativa
tattatgccgccgttgttgggcgtctacgtcttcaccgaccggcctgccttcgccgctgccgactggtgtttccgcctgcacggctggcctttatgctgccgttgttgggcgtctacgtcttcaccgaccggccgcctcgtcggccgccgactggtgtttccgcctgcacggctggcctattatgccaccgttgttgggcgtctacgtcttcaccgaccggccgcctcgtccgccgccgattggtgtcttcgcctatacggttggttggtcacaccaccgttgttgggcgtctacgtcttcaccgaccggcctgcctccgtcgccgccgactggtgtcctcgcctatacggtcggttggtcacaccaccgttgatgggcatcgtcatctacaccgccggcctgcctccgtcgccgccgactggtgtcatcgcctatacggttggtcggtcacaccaccgttcatgggcgtccacgtcttcaccgaccggctggccttcgtcgactggtgttttcgcctgcacggctggcctattatgccgccgttgttggatgtctacatcttcaccgttggatcaccttcgttgccgtcgactggtgtttccgcttacacggctggcctattatgccgccgttagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctagagatgttatatcatatttttcataatatttatcttgattgcttgcgacatatctgagtacaaaagtacctatcgagttatggagt

SEQ ID NO: 91896 - DNA, 991 bp, Oryza sativa
gcacagctggcctattacgccaccgttgttgggcgtctagtcttcaccgacaggccgcctggtccgccgccgattggtgtcttcgcctatacggttggttggtcacaccaccgttgttgggcgtactacgtcttcaccgaccggcttgccttcgtcgccgccgactggtgtctccgcctgcacggctggcctttatgctgccgttgttgggcgtctacgtcttcaccgaccggccgcctcgtcggccgccgactggtgtttccgcctgcacggctggcctattatgccaccgttgttgggcgtctacgtcttcaccgaccggccgcctcgtccgccgccgactggtgtttccgcctgcacggctggcctattatgccgccgttgttgggcgtctacgtcttcaccgaccggcttgccttcgccgccgctgactggtgtttccggctgcacggctggcctttatgccgccgttgttgggcgtctacgtcttcaccgaccggcctgccttcgccgctgccgactggtgttttccgcctgcacggctggcctttatgctgccgttgttgggcgtctacgtcttcaccgaccggccgcctcgtcggccgccgactggtgtttccgcctgcacggctggcctattatgccaccgttgttgggcgtctacgtcttcaccgaccggccgcctcgtccgccgccgattggtgtcttcgcctatacggttggttggtcacaccaccgttgttgggcgtctacgtcttcaccgatcggcttgccttcgtcgccgccgactggtgtctccgcctgcacggctggcctattatgccaccgttgttgggcgtctacgtcttcaccgaccggccgcctcgtccgccgccgactggtgtttccgcctgcacggctggcctttatgctgccgttgttgggcgtctacgtcttcaccgaccggccgcctcgtcggccgccgactggtgtttccgtctgcacggctggc

SEQ ID NO: 91897 - DNA, 593 bp, Oryza sativa
gactggtgtttccgcctgcacggctggcctttatgccgccgttgttgggcgtctacgtcttcaccgaccggcctgccttcgccgctgccgactggtgtttccgcctgcacggctggcctttatgctgccgttgttgggcgtctacgtcttcaccgaccggccgcctcgtcggccgccgactggtgtttccgcctgcacggctggcctattacgccaccgttgttgggcgtctacgtcttcaccgaccggcctgccttcgccgctgccgactggtgtttccgcctgcacggctggcctttatgccgccgttgttgggcgtctacgtcttcaccgaccggccgcctcgtccgtcgccgactggtgtttccgcctgcacggctggcctattatgccgccgttgttgggcgtctacgtcttcactgaccggcttgccttcgtcgccgccgactggtgtctccgcctgcacgactggcctattatgccaccgttgttgggcgtctacgtcttcaccgaccggccgcctcgtccgccgccgactggtgtttccgcctgcacggctggcctattatgccgccgttgttgggcgtctacgt

SEQ ID NO: 91898 - DNA, 649 bp, Oryza sativa
cataataggccagccgtgcaggcggaaacaccagtcggcggcggacgaggcggccggtcggtgaagacgtagacgcccaacaacggtggcataataggccagccgtgcaggcggaaacaccagtcggcggctgacgaggcggccggtcggtgaagacgtagacgcccaacaacggtgacataataggccagccgtgcaggcggaaacaccagtcggcggctgacgaggcggccggtcggtgaagacgtagacgcccaacaatggtggcataataggccagccgtgcaggcggagacaccagtcggcggccgacgaggcggccggtcggtgaagatgtagacgcccaacaacgacggcataataggccagccgtgcaggcggacacaccagtcggcggcggacgaggcggccggtcggtgaagacgtagacgcccaacaacggtggcataataggccagccgtgcaggcggaaacaccagtcggcggctgacgaggcggccggtcggtgaagacgtagacgcccaacaacggtggcataataggccagccgtgcaggcggaaacaccagtcggcggctgacgaggcggccggtcggtgaagacgtagacgcccaacaatggtggcataataggccagccgtgcaggcgga

SEQ ID NO: 91899 - DNA, 2118 bp, Oryza sativa
aagtggctctattgggaaaaagtggctctattccagcgactgccccttcacgccagctatccctatccatttcctcgcctcatctcttcctcgcgtcgtctctctctcgctcctcacaaccccgcgccctcgccgccgtcctgcgttagcccccaccgcagctacgcgctagctagtcctctgcccgccgcttggttcgccggtgtcgtgcaagccgacgccgctcgcgtaagcctcacgaatcgcgcatcagcaatggcgggtggaaatcctcacgatttcttctcccagtcgttcaatgaagctccaacgggccacatggacggcttctcgcaggggtcttcaggatatggtggatctggcaccggcttccattttgggggagggggatcggggggcctcgatctgaactcccaggctgacgcctcctaccaacagatccttgaaccgtgtagccttgtgttacctccgattcgggcagggagcagatccacagtccccccgtcacgtcctcctccagcggcgggagggggacgtggcagaagtcgtggagggagaggaggaggacgaggccgtggcaggtcgttgaccaatggcgctggatctagcaggggaatgcgaggatttgttcctcctggctcatcgtctggccaaggaggcgtccgaggtcatggggcatccatgtcgcacagcgggccacccgccttcaactttggagtcttcggaggaggacggcgagccggtgcctcgtcgtcccaagggacaaatgtgttcgaggacgacggcaatgaagaagacgaagaggactttggtcctgatggtcagcacatggtaaaccccccatggttactttctgttatgtttgatttgtgctattgcgaaatatgccaattgttgctcatgatattgatactgctatgcatgccgtgatctaagcatttgtattacagtatatgttgttcattgcttaatttagggttaaatcatgtttttctttcctagaatacttatgacaaggcaaattggacagaagaaaaaacttacacattgtgtgaaatagcatgtgaggaaataagggatgggcattgtcctaatggagcatggacaactagagggtaccagaatttgaaggccaaatatttccaaagggctaacctaaggcattcaaccaaacagataaagaatagattcacccatctaaagaattattacatggcttgggtgtggctgaaccaacaaactggagctggtagaagtgctagtggagaaataattgcatcaaatgcttggtgggaaaaaaaattaaggtatgcagttgtcaaaaatttagctagtttacatgattttagagttttctgtgatattgatttagtgtcaatacaggagaagggggacgccaagaaatttcgccatggcaaccctgagtacttagattttcttatagagatatttcaaggagttgcagttgatggttccacagcatacatccctggttttgaagatgaagatgaagaggaaggagaagaagaagcaggggatgcaggggaggcagctagaggggaaagagctgtaggggatggttatgagaacagccccatgagcactaacagcaggaagagagggagtagcagctgtgatgtgtccacagcttctagtcctgggaaaaaaagcaagagcccagtggtgaagctcatgaaggggctgctcaattctttcaactctgattgtgataagtcaaataccctaattactgaacttgttaacagcaagaagttaaaggagcagaagaaagaagaaattgctgagtcattgacaaactgtcagaggttggcagtagagtgtggtgcagcagaagacagtgtggaatacttttgtgccacacagttgtttgcttccaaacataacagagttatgtttaagaacattagcactaaagaagcaagatttatgtggctgaggagatggtgccagcagaagaatttgtattagatgatccctttctttagctgcatatcatgggtctggtctgcattagttgtgtcctagctgcattagttatgatctacttttgtgttgaactatcaacttccttgatgtgatgtgacgtaatgaacatgt

SEQ ID NO: 91900 - DNA, 1038 bp, Oryza sativa
tttttttatggatagtcggtgctccccaatcagttaggcaagcccaagacagatttgttaggtctcttcaaacagtacatagtaagttcaatgcagttttgaccgctctactgaaacttgcacaagatatcattaggccaaaagatcccttattcacaacagtccataagaaattgctttctcctcagtacacaccatatttggataattgcattggagcaatagatggtactcacatccaagttgtggtgccaaattcagctgctgttcaacataggaatagacatcaggagaagagtcagaatgttatgtgtgtctgtgacttcgatatgagatttactttcgtgcttgctgggtggcctggttcggttcatgacatgagggtattcaatgatgcacaaactagatttagtgccaagtttccaaagccacctctaggaaagttttatctcgtagactcgggatacccaaataggccgggttatctagcaccatacaagggtataacatatcatttccacgagtacaacgaaagcacattgccaaggggaagaagggagcactttaattactgccattcttcgtgtcggaatgtcattgagaggtcatttggggtcttgaagaacaagtggaggattttgtttagtttaccaagctactcgcaggaaaagcaaagcagaattatccatgcatgcatagcacttcataatttcattagagacagtcaaatggctgatacagagttcgacaattgtgaccatgatgaaaattatgatccattgggtggaacctcttctccatctagcgaaccaacaaacgaattggactcgcgtgtcatgaaccaatttcgggactggattgccgatggattgtggtatttgaaaggaatgtaatgaatggttcaatttttcttgtgaattgtatttggtttaacttgtcaattgaaccatgagtgcttgtaatttctaacattgaaacttctgtgatgtatttgaacaacttgagatgtatatgagcttctttgaatttctgtgattg

SEQ ID NO: 91901 - DNA, 2423 bp, Oryza sativa
gggtagcacccccgtcactgagcaaaggttactgatgtgagaaaatatctcaatcgggcatccggccgtcacggatgacacacatctcaatcgggccaacaataaagcccgtcacggattactctcatctctaacgggcctaaactatagcccgtcacagatgactcttatctcaattgggcctaaactatagcccgtcacggatgactctcatctcaatcgggtctaaattatagcccgttacggatgagtataatcaaaaaaaattgttttttggttagcctcaggcctttgctaggcacgcccgtgggccggtcttttctacacctggaacgcccgtgggccggtcttttctacacctggaaattctttccgggttggtcacccatcccgaaattgctccaccctaagcacgcttaacctcatagttctttggaatcgactttcggagaagtagttgtacattcattcacatacacaaccatcaatatatttaacacaaccacattcacataacatctattttgatcacatatttcacatccattcacatatttcaccagcaaaaccgagttaattggatcaaatatatatttagcaagtattaacatgatgaggaggcaaatcagacttctaggtaaaaataaattttgaattgaattttatgatactaaattaactcatatgaaaaaactgtcaaaaacaaagttgtagaactcattgagatctaccaattttattttggtcatttctccatccgggtttgattgaactatataaaatttggattttaaaatataagaaattcaaatattttttcgggtactaaatgatttcaaatagaaaaattgtcaacaacaaagttgtataactcatcaagatctataacttttattttgatcatttttctatatgacattttttgaacagtttgaatttgaatttgaaaatatgacaacttcaaacaatattttcaaataccaaatgatttcaaatggaaaagtcatcaacaacacagttgtataacttatcaagatttacaacttttattttggtcatttctctatgtaacatttattgaacagtttgaatttgaatttgaaaatatgacaacttcaaacaacaatttcaaatactaaatgatttcaattgaaaatgtcatcaacaacaaagttgtataactcatcaagatctataacttttattttggttatttcttcatccgataaagtgataataacattgttcacaaaattcacatatctctcatctggttttataaactataacgtagatatgaccatcatctgtgacgggcgccaacttgaggccagattgagatgtggaatgttatctcaatcgggtctaaactacagcccgtcactgatatgtgtcatccgtgacgggcctaagttatctcaatagggccgaaaaaaggcccgattaagatgactttcatgtgacggccgctaatttcaagtatgttagaggccgtcacagatggaaggttctgtactgatgctaattgtccacctcattgcctcatgtgtcaaccatttattccatgaagttttgtttcttatgacactattgggtcgccccttattacagtttaaacttattacagctttgttcctgaaatatctataaatatccaaataccactaacatcagcatgcaactatatatgtaagtaagaacgagcagtattcaatattgtcacatcaacccaaaatcgaccatctgcacaattcaactttgcattcaccttcccgctttgattataggtggtgattgctgcagaggttcgatctcgttctgcctgccgaactcatgggtggtagaccctgagtagctgctggtgacatagcttctattaccgtccatcatttgccactcagtgatgtagcttggctttgtgaccaccttaggtacctcaacttctccggtgagcattgccacgaccttcgacattggtggtcgctgatgtggtgagccctgcgtgcagtgcagcgcaacacggatgactctaaaagcttcatccttgttgaatcccttgagatttgggtcaaggattctgagagcttgctccttttcatactggtcccaggcctatagatgaccataggtttagtacacaagagataatacaaagaaattaactttttttatcgcttagggggttcatggagggcaaacacaaaaaaggatagatgggcaagtgttggcttgatctaggatgaaatgagactagattagttcatattgattgcttgcttgctaattgatgcatgctatacccttttgtaggtatgtctagctagttgattcaattgatctatccctaatacatggaatatatccataaggggtaactcgacaataaggaaattaactattcttatctctaattttaaactatt

SEQ ID NO: 91902 - DNA, 3449 bp, Oryza sativa
tacgaactataccagctggacgccctcgacgtctctatgatgagttgctggattttgtaagtatatcgttcagttagatttcttactacgtcacctttaattaattaggtccttgtatataagtagactatagaaaataatatactcccttttatcgttgtagaatggagattcaaagggcccgacggcggggggtttttgatactggattcatcgaccctcggaaagtaaacgtcgcaatgctcgaccaatatccgcaagccacagaggacaatctcgtctatttcctgaaggcgcagcattacaagacgttcatactattgccgtacaacacagagttagtttaattttactgtcttcctataccaaatttcattcccgtacgaacttgctaagtgtttcatatgtaatgcatcccacgcacattgcagattccactaggtgcttttactcttcgacctgtcggcctgcaccgtcaacgtatatgactcaatggataaaaaagagtctacgtttgacaaggttttcgaacttatagataggtactgtcataagttcctctgttaattaagaaaatcttgttatgttaattgctactacgaatcatagctttaaactccatatagggcttggtatcggttccgtcatttggtccgcggcaaatggagagaaagacttaggcggaagttcaaatttcctgtgagtatacatgctctacatttatatttctccgattcaaatacatacaagtgtatattaattagatctctcgtcgtttgtcatttatttgtagtgcgcaaagcaaaagcagggaactaacttgtgcagctattacgtgtgccagtattgccactgccttgcagaccaaatcatcaccacaagagagctcgatgtacgtataaataaattcaaaatttcattacatattgatttcttgtttaattactaatcaatttcatacattcatatagtttattcgcatgagggataacctgaccatacacaaggaatttatcgtggcggttcaagaacaactcatgggattcatcaacgaacaaatccttgatcccaagggtgaattctactacgacggaaacacaattcataggtccttagcttctgagctagctactacgtcgaaatcgtagctagctaggacatataatggattgtaattaatacatgactatatatgtttctatatgcatgtgtacacattttctataatgtaaatatattttggtcatatatatatatatatatatatatatatgcatttgtataacatatatatatatatatatacatatatattatgcatgtacatatgtattgaaacatatataaatataatataatatatatatgcatatatatgtttaaatacatatatatgcatggtttatatatatatatatatatatatatatatatataaaccatgcagcaacagggccatgcaagaaaaaaggtcagctcgatctttagtcccggttatttcacccggaactaaagatagcgatctttagtcccggattggtagttccggattagaaaccgggactaaagggggttacgaaatgggactacaaagggtttctccaccagtgaggcttgagcatccacaagaatacaagatcatactaaataggaataagttcaccggaggtccctcaacttaacgaaagatttttgaggtcccttaaccacaaaatcagaaatgcgtacccctaaactcactcaaaccgttcacataaggtcccatggcagtatttttctcggttttgctgacgtggcatcctaatcagtaaaaaaatataaaaaattacatggggcctacatgtcagctgcacatttttttctcctcttttcttctccttctcttctcttttctctcttctctcttcgccggcggagggtggtgatggccgagcgcgggatgcgggcgaaggtgtagagccagtgggccttagaggctggcagcaagtgagcccggcagcggtcggtgagtggcgggcggagcggcggcgggctgcgagcagagcggccgactcccgctgccaccaccgtcgctctcacccgctgtcagctgccgacccccacgcgtgcggcttcacggcgacggctgtattcctcatcaccgttgcgctgcaagttgcccctgtccacgccacccgcgggtgaccacccttctccccgcgcccggccggagagggggagaggaggccgggcggagtcggggaaaatgaggccggttgagagggggaaagaggcggcgcctcaccgccgcttgctgctccgccctcgcccatgggtacgtgctatgatccggggctttctttctttctctctttctttctttctttctttctttctttttttcattttttggatctggttttctctatattttggctgcttcgcgcttcgatacgtcatgggcttcggaaattgcctaattttgttgttgcttgccatgccatggatgcaggtcccgcggcggcggagcagatgaggcgtgtcatcgcgtcgtcggaccgcgacactggccgcgcgctaacgccaaccctgcacctgctccggccacgcgccgccgcccgccctctgtggccgcgctcgcccgccgttttccaccgcctcctgccaccgacgctctgcagacacgcgccactgccactccccctctaaaacagaaagagaagaggggaaaaaaaggaaaagagaagaagattgctgactatatggttgatcccacatttttttcacttacatgtgggtctcacgtatttttttttctgattaggatgccatgtcagcaaaactaggcaataatactgccatgggaccttttgtgaacggtttaagtgagtttaggggtacacatttctggttttgtggttaagggagctcaaaaaatttcgctattaagttgagggacctccggtgaacttaggctttgttgggaggtgggtgttgggaatccatctcccctgcacgaaaaacggaatggttcattagcgcgtgattaattaagtattagctctttttttttcaaaaatagatcaatatgcttttttaaacaactttcgtatataaacttttttttaaaaaataccgtttagcagtttaaaaaacatgcgtgcggaaaacgagaggggagagttggaaaagcatactaccaaacacagccttattcctactaaataaacagggctgtgagcatataatacttgcaggattgtaggaaccttgactgcacaagacaattagcaaaacagttcagaattgaaatcacatcagggttcacctgaaatcagcttaaactcttggatttggacaaacttactcatcaggtctccggccaatcatcgccgtcacccgaggctgctgccagccattagtcgtggcagtggtctgcaggcttactgccgcttgccgaggttctaatt

SEQ ID NO: 91903 - DNA, 2537 bp, Oryza sativa
gtgccacgatatatctgtagctcatggccagatacctggaaaatttttgtttgttagtcttaactatggttttgagagatttcacattgttcatttcctaattcctgattatcagagataccgacagggaaggagtggctagcacttctggacaattcacattcaacacatctctagcctcgttgcacacctatcttggtggtaaatgtcctcgctatccttgctatatgatgtttgatgctgatagaaaagaaagtgtaataagactctttatgtgtcactcagaggttgatgatacacggggtcgagtttctctcttagatggtggcacaatcctcagcttgccaatgctatatcttcaaggtaggtcttgtatgtttgtattttatttcgttaatccgcaatcttgattatcatgccagcgttgaagacacactaattagtgatcacaatttttttttcatgccatcatttctccatattattttgtctgcatgccagcccttctaagttacattcttttcttttgaactcacttgacataacctggtctattaacgtatccactgttattgttaatgttaaaaagagcttgagcaatactactatctatttatatagacttattatttcagaggaattgcacataccatttttagtcactatttcctttatattgcagttatacagccatgtgaatatacggagtactttgtagtgagtttaggacctgaggtttcttttgataattgataatttcttaatgcatatgactagagaagtggcatccaataatctaaaaggctacaagcatccctaaacagtgttgttatgtcgacatttttctgttccagtcctgcgggttcatgatacaattggatattaactccatgggcagtgaaatatattcttaattttaaatctggaacataagaacaggcacaaatccttacctgtctctctcctgactaatgcataacagtgatagtgtaaatgcgacaggatttttctggtaggttatcaagcatcaaatttattataatatgaatttgtttcaggtgttgtcctatttcctggagctaccctgcctctcagactaattcagggtagatttgtagcagctgttgagaaagctttgaggcaggtcgatgctccatgcacaattggtgtggtaggtgccagtctgttgaaattaactaattttatttgttgaattcctttccaatgacgcagtttaattttcaggttctcatgtacaagcgacacagtactcgacattatgctaatgcttcagttggaacaacagccgaggtgttgtacattttctctgctgtgcttcaagttagaatttgtttatcagttagtcattttcaccgattcttcatgtggtttggttgttttctgtgctgccaattgagcttttccgtagccagttccatcatccttgggtgatttgttattatttctacaggacacataagttaccctctcgtcacattttgtaattaagatgatctgcttaataaataaaaacatgagggagttaatttatatcattcaagaatcaggacccagtcttagcagttagcatttaatatttcttgtaaatgggacaattgaatcattcatttagaatagactgatatccaatatttcagaatttccttcacttggtcacaatatctctatcaaacttttggagaatcatgtactcatctagttttctgatacttcacaagatctagaagaccaacagaacatataaagccccatcgtttggcttatctgcggaataagccaaacggcgtatttgcaaacgaaaagtaatttgtgaataaaacttttatatacgtgtccttagtgatctaaaagcaaaggctgaaaaataaacttcgatgagaaaacctcaaaatcggcttcaaatttaaggttgaaaattcaaattttggctgataagcataagcataagtgaaaagatgaggccgatatgcactgtgatgtcttgtttacatgtcaagctcggtcattagccccttagtatgatttatgtataaagtgatgtataattcctttcgaacagcctcacaaggtaagctggtattttgttatttctttaacagataagacaacttgggaggatggatgatggttcattaaatgttgtagcccgtgggcacaaagatttcgtctgaagcgtcattggatggatgttgatggggtggtaagtataaatttaattgaagatatattattctgaattaggagctggagagaagttaggttcattttttctcactcaacaggtgtggggtgatgtccaaatcattgaagaagatactcctttaagaaccccaagggatgcatttgcacagctagcatcatgtaacagtttacggcagcatacctcctcaccagttatcagtttggatgtctctccaatcaaacaacgggatcatgtggattcagaattggattgtggtacaccatcacctaaaagcactgcaagcaatcattcagcgattgattcaaggatgtgc

SEQ ID NO: 91904 - DNA, 845 bp, Oryza sativa
gatctgacttatgtggagaagccgattcgtatcctcgagaccagtgagagaaggaccagaaacaaggtgatcaggttttgcaaagttcagtggagccaccactcggaagaagaagccacctgggaaagagaagatgaattgaaggccgcccatccgcacctcttcgccagctcttctgaatctcggggtcgagattctgtttaaggggggtaggtttgtcacgccctgaagttcccctcccttgctctaaattcataaaataaatcgtccgaagaaattgtttaatttaacctagagagaaaccctaaagtaataaatgcaaataataatcggaatcggcatgtggaatttttcttggattctacatgtcaaaatatgctaacaggatttttagtggaattttcagagccttggaaataattttaaccaattaaaaatcactaaagtgcaaattttaattccagggaaaatccttttcctttttctttttcttttccctccctttttccctccttttttcttttcggatgggccgccggcccattcccctccttcctccccctcctccttgctgggccggccgcaggccgaggcccagtccggcagccaggccgccccgctgcctcctctctcggggtcgccgacaggtggggcccacctgtcgggcccgtctccctcctcccgccgatcccggcgcgccgccgcgccgaaaccgccgccgcgcccacgcctccgtctctcccgggccacgtcagccacgcccgcgcgtgcgccgcgtctcccgcgctctttcccctctacctcccgttcgcgcccgcgcccgagatggccgggattcgaaaacc

SEQ ID NO: 91905 - DNA, 667 bp, Oryza sativa
ttcctgcagccctccggtgcttcggatgcgtaggtaggtagagtaaaaaaagtccatgtttttctttagttttttttcgatgcgacccctaaaccctaattattctctgtgtattgtaggtcgctgagcggtgagcgccagtggtagccaccgttgaggaacagtagtgtctcgatggatgatccatccttctgcaacttcgagttgaggctattgggaatgcggggtgatgacgaagatgacttggaggaggaacgcgtggaggtgttcggcaacactgcctcgcctcggatcgatgggtcgcagccggagacgaagacggagccggacgatgacggtaccggtgctggtggcaacggcgcgccgtccggctcaagtgctagcaacaaacggtccagatctcaggtatggaacgactttgaagagctctatgaatcctgaaatggcagtcaggtttgtgtccatgctaaatgcaattactgccataaaatcttgtctgctttttcatctggtggtactggacatttgattaggcatattaagtcatgcaaacctataaatgctggtgctctgtctcagtctatgctccggtttaatgctgatggttctgttagtcaatgggaatataagacagatgttgctagaactgagttggttaagttgattg

SEQ ID NO: 91906 - DNA, 604 bp, Oryza sativa
gagctaagctgaaggatatcctgtgggtatgataatacatatcttgaaaataagatactatcaaatctaattttcaagaaccattgattacttacgatatgcctgaacttatgtttaggtcgctgaacttccctggaagcacgatacatcacccttcatgtctgcgacctcgttgcagagagaggtgcacgcttagctgctgctggtatatatggcattctaaagaagctgggcagggacagagtgccaagtgacggtagtcaaaagcagaggactgtcattgctctggatggtggtctctatgagcattacaagaagttcagaacctgcctagaagcaacgcttgcagacctgcttggagaggaggctgcctcatcagttgttgtcaagttggcaaacgatggctctggcatcggagctgcacttcttgcagcatctcactcccagtatgctagcgtcgagtagtaacaggagctcatgggactgagctcccagtgtagcttgatttcctcccattttccccgtttcattacaatgggagttcgtgaccctcctgcgatgagcatctccttttgctattctgcagtcacataaacgaatgcct

SEQ ID NO: 91907 - DNA, 1933 bp, Oryza sativa
taattcaaattcaaatttgaatcgggtatgtaatcttttgacttataaacattaggtctataaactttagatgtatagaaatactatatatagaaaatatttgaattcaaattcaaatttgaaacgggtatataaacttttgacttataaactttaggtctataaactttaggtgtataaactttagatatatagaaatactatatataaaaaatatttgaactcaaattcaaatttgaatcggatatataaacttttgacttataaacttttggtctctaaactttagatgtgtaaacttgaggtgtataaactttaggtgcataaatttactaaaataggaaagtaatgcggtgccaaaaaagaaaaccaggtggagggggggggggtgaattgatcgctacccgatcgcccttgcgatcgaccttgaagaggatgcagcagctggagggggtgcaggcgatgcccaggatcacctagaggtgtgaggccctccgccctttccttagatttttgaagtttttcttcttcttttttgcgtttgccgggaaaggcgaacaatgtacattcggcctcttccctccttattgtagccgaaaacgtccctttgggtatttggaatgtatgactctatcttagccactttttatggtcgatgcctttggcgtatatgattatgtcattttcgtattatgtaatatttcctcttctttcgccaattcttactatacaaatcgtcttttgccctttctgcacagtttaacagggtgttcgccaaaaattgtgtattcggcgaagcaaaaacaagaaatttgtggcgttgaagggtttgccaacggtgcgatgcccatttcggcctgtttattgcgaaatagtgataaacggccgcagctataaggtttttaaggttgccgactggctacaggcgctgacagctttcgcacttcttgacttgctcaacacagactttcagcatggtgggccagtatactccttgttgaaacactttggaggcaactgttcttgcggcctggtgtgcgccacagagcccctggtgtatgcactgaagcaaaggttagagtatgccggagcgatatagttggcccgagaccattttgtatttcgcggctctgagctgtaagcgctttgcttctgcttcatcttccgggagccagccgttcttgaagtatcttacgaatggggttcgccagtctgttggatcctcgcccagttctgtctggtcgattgccatgacatctaggccctctgcgggcacacttggtgcgtataggacttcgaaaaagatgctcggcgaatgtgggcccccataagcagtagatttcgccaaggcgtcttcttcctcgttctggcctctagataaatgttcaaccattatgccagcgaagcacttttccatagaccgaacagcctccaaatacttcttcattccttcttcctttgcctcaaaggagttatgaacgtgacctgccaccaacttggagtcggttcggatgagcaagcgccgaacccccaatgttttcgctttttttaggcccagaagaataactttgtattctgctgcgttgttggttgtgtcgaactgcagccttgcgacataccgaatcggcacaccccctggcgaagtgagtaccgccgcaacgcccgcccacttgtgcgaccacgagccgtcggagtacatcacccagggttgttcgacgggctcgggctcaggggcgaatgccagtgtccattcagccacgaagttagctagcacttgagacttgacagcagtgcgggcaacaaaatgcaagtcgaaaggggatagctccgccgcccacttgctgagtcgaccagtaacttccttgcctcggagtacttcgcccaaagggtactgcgatgacaccgtgactttgtgggcttgaaagtagtgttt

SEQ ID NO: 91908 - DNA, 671 bp, Oryza sativa
cgatgttccacaataaaatcggctatagcttgtcccttgattgccttgggcgattcatacctgaggtcaaattttgtcaaagcatatatccactttccaactcttcctttgagaactggagctaatagcatatatttgatcacatcggctttgcatacaacaatgcattcattggataacaaataatgccttaacttggtgcaaaagaagtataaacacaaacataatttttccactagagactaacttgtttctgtatccaatagcctatggcttaaatagaaaatagctctctccttgccctctagttcttgaatcaaaactgagccgattgacttctcatcggctgatagatataacctgaaaggcactctcttttgtggaggaattaaaactggacgagaactcaaatatgccttaatgttgtccaaagctttttgctgctccgccccccaagtgaattcctgatcgggtttcaacgtttacaaaggtgtaaaaggttctaaccgtccagacaagttagatataaaccttcgaacaaaattaatcttgccgatcaacgattgtagttgcatcttatcctccggaggttgaattttcttgatggcattaatactcctttgagggacctcaattcctctctcatgaacaagaaaacatagcccccaagt

SEQ ID NO: 91909 - DNA, 5388 bp, Oryza sativa
  unsure (1)..(5388): unsure at all n locations
cctccccccccccccccccgccggcgtgcggaaagaggcgaagaagaaggccgccacggtggcggcaacgaggatgcggatagcggcgttgcctccgccagcgcgacgccggccgccggacctcctcctctcccctcccccacggcagttctccccacccatcggccgccctgctgaagagcaccgtgagagaaaaaggatgaagaaaaggaggggaaatacgagagaggtgaacatatgggattcacgtgggttccatgctaactcagccgccacgtgaaacaaatccggagtcgaaaccaccgaagggcgtaaaatgaacggttttgttaagttgagagatgtcatatatctagttttgtggttagggacgattttgtaactcgatgacaagttgagggaccttcggtgtactttttccttcctatattaagatggcctagtaggcagtgatcttggaccaataaattttcttcataggtaaagacatcttgataagaggcctaatatacagtggtctatgggccaaacaatgcctagcaacctgcaactagacctccaccttgtctgttttaatggatcattctaatacttcacacttcacagtttacatcnnncgtnnttnnnnnnnncnnngncccccccccccacccccccccctacatatggagtaacttgagaaatgtttatattgttttgttacaccagactgtaaaatctatttgttgaagtccaaaatatacaaccagtgtgaattcaggttggactgggccaaaggtatgggcttcatttgtgttatacattggcaaatatcacttcgaaataacagctataacaattttgattatgtgagttaacatgagggctcctttatagcattaactctcccaactagctaagggaaggatttaaacttttaccactctaatttataaggtttaagaatatatactatactatagtaacaaagtatgttgcatgttaaattgcaaccgtacatcttatcaaagtctgataatttaacagttactataagtgagtaaagttaaaacagtattagttattcccaacatgaacaagtatctgagaacaaattaaaagagatggtgcctacaagataatagtatctgatgtatgatggcagtaagcattccgaccatggtatatgacggcaaactaaacacgagacgagaccgagagaattaattttgtagttcaaccaaatgatcaagtcaaatccatttcctgatgttttgtgataccgtccacatcttaccttcaaatattgatatatgtcttgttacacatctcagtgaaatgacacgattgtacttggtcagcactgttaggctgccaagcatgtgccttgttcaaggaagtatctgtcaggccagcaacctccagccatgtcctctaatgcgcatctatctgaaattcttgtgcaatcgtgtcaacaattctcatgcaacctggttggcgccacatcgattttcttccctgcatgtgtagttctgtaaacatgaataagcctaaggccctattcttttctgattttggatttttcattttctttttcatgttttaaagctttaaaacggtacattttcatgtaaaaattttctatatattatttaaaataattcctaaatcaagtctcagctttatagtatttaatttattcgtttatattctcaaataactaaaagaaataagattatccatcaactttagctatatcaaacgaagcattagtagaagaaaagttcagttttatactagttcggagaaagcgtgcactttgacaccataacctttttgcattaataagaacaacaaatccaaccaaataggagtaattcacacaagcttgaaaaattaacagtttaatttcaaatgattaccaccaaacctcgcaaaactaaacatcaatgtgacttgcaagttgcaaataatcatactccatgtgcttgtcccactattgagacaattgtgagttggtgacctagcagggacaagagcataaatatagctaattagccacacaaacaagatggatgacatcgatagcaatacacgagattaaacaaccatttccacaacttggaagtaattaagaaccaattgtactcatcagcttcttcccttgacaggccaagaattcttccagaaagccttagttgaagcagtagtagggaactggtatctcaactggtcagcttcaaagtcaactgccggtgagtggcctatgaaatggccaaacctttagaaaaccgaaaagagtgctccatttcattgaacagtctgcatggaagaagaagattaagaatattctgcactttcagttgttcagtctttcagacaccgtgtgtaaaacgtcatgacacaaatgggagaagcttcagaaaccattgaggtccatgtcaactacccagtggagcagaatagacgctctccataggcacaaacataagtgacaattgacataacattggttccaatcactaaaacacatggtttccagggaaaatatctggcagaaaactggtacttaaaacaaatagtcagtggtgtctaaatagaccagacattatctgtaagctatagttccagccttcaagggaactgcctgagaactgtgatacaagttgcccattttctggtttggacaaacattgtataccacacaaagagagaaacaagcattccgttattagctttaggtaagtaatgaatgatcagtggcattggtgaggaacaactaaactcatctcccaactagaaaccaaaacacaggtcccaaaggaaacaaacttgtcacaagtatgcacacaaaaaaacaagcagaagaatcaaacctaatatttggggtgaaaagaatacatttatttgatatgtaccagtaagacataggtgacaccagggatgcaagtattccacatatcaccacccagggatattcagcagatgagaatgtaaaaaagaattggcacccccaggtgttattccttgaataaaagctcatgtaatgtagtccacttatgcacttcaaacagacaataataacttcattgtttgtattatgcttatgtacaagaaatacatattctccatgcaatccagcaccctatcaaatcagcaagaacataagaaagtatccgcatttagaagagacgaaatgaagaattaatttccatcccagtatggtgacatcttgaatgagtggaggaggaatatcccctgtacatgaaaatcacaaatcacacacataatataaacagagcatcacgttcttctgctacatggcttggttttatcatacttaataatcaatttaaaaacagatgcaagtgactttgacttaagaaattgatgcatcagtgcccctcttcaaactaattttttctctcaaatacacagcagatctgtgtatcattatattaagaagaagaattaatgggtaggaaaaccctcgcgtacataaccatccacacagtcgctaagctcttgggttacatgtgcgcctatgataaaaagaaaaacaactatgaccacaaacatagccacaacttcaaactaaagttttcatcccagatgtcatactttgattgattgctaacaataattgtttcttcttccttgaattgaagtaatgatttttgttcagaccttgaaacaaacatgggaagctaagataaacatgaatcaaattgcaggttttccatatcttgtttccaaagaaaaaggctacctaaaataagattgcgctgtgctattgcatccatccctgctattaaaagcaagaataaataattaagtatcctgccaacataaactggaatttctataaacaagccgatcaggaagaacagcatgttaccatcccaaaagacaaaaacatcggtcgcaacgaacaacataaattaatgtaacatacaaacatgaaagaatgaagaagctaatggagcaaccaaagcatccaattctcatgactcataacaactcacacgcggccgcctccggaacatggaaacagacaagctccttgacataaaagcacccatccgtgctttccaccccgatggcctgccgctgctgccacaggaaaggtcagggccccctatccgatcatccaaatcgtccggcagggtgtcgctaccagcattctccaggacaccactctcatccacgctcctagcatcctgcaattcaccagcaccacctggcgtgtcaacattcacagcaagggctccgttgcggctagcccgaagccgctcagcacactctggcgtcactccctgacacttcttcaccttcaccttgacaagacgtgggcagccttgagcgagcttatccattcctgcatcagaaacagggcatgccttgatgcagagcttccgcaacgcagcacatttcgtcgcgacgcaagatatctcggcatccccgaacgtatcagacccgcacagtgcgaggcgctcaagggcagggcagttggcagcaatcagttcgagactggcggacgtcaaattcaccccgatgagaaccagttcttgcaaagcagcgcatttctgtgcaacagccgctaggccgcggtcaccaatcctgtttgctttccatccatcgacgtgcagcttgcgtaggcgtggcgatctggtggcgagcttacccaacccaacatctgtaacctctggcgccttggcgaggtagaggacctcgaggcccgacaaggcagagacaccgcggtcgctgacctgcagcttctcgagatggagctcggccagcatggcgtcctgagggaggtcctgaagcacgggatcccagtcgccggagcagcggatgatcttgagcgttttgaggttgggcgagttggtgatgagagaggagaagcactggccattgtagagctccttgaggcagagggaatggaggcagaggctggagacggcgacgggctcggattgggcgaggccgcggaggcgcttgatggagagctcctcgagatggaggcaggagcggaggacggcctcgatccccttggcgccaaaggtgcacgagccgacggagagcttgcgtaggttggtggcggcggcggcgagcgcggcgacgccgtcgtcggtgacgagacggatggagcggagcttgaggcggcggagggcggggccgaggcggtcggcgaggagggcgagcgtggggtcggcgacgctctcagcgcggcggtcgcacttgagggcgagcttggagacggcggggaagcgggcgaggatccccgggagggcggcgtggagcggcgcccgcgcgtcgagggcgaggcggaggcgcgaggcggcgtcgacggagagccagcggcggcagacgagggagcagcgcttgcggtcggcggagccgaggagg

SEQ ID NO: 91910 - DNA, 7060 bp, Oryza sativa
ggttgggtgaggggggaatgggggggcgccgcggacgtgaggacgagggcaacccaaacattaaatcggcttaactcctccctctctctctagactctctcagtttctctctcctttcggggggcgcacgcgttttttcttttatttttctcttctccatccctcctttcgatgctattcaacgcatgcccgctagttatcccaaccagtggactgaccaagacctgcatcttgttttaagggtacttcctccgttcaattcacaacatatgtcccgtaaagcttatcattttcgtttgggagggccatttcttatttggttaattggatcctgttgaagaaaaatctgcgtccgatcaatggtaccaagcctgcgttgatgcgaaccatatcgacgaacacacaaagttctaggagatctgcttaatttcagtgcaagtcctaaacttgataagatgcgagcgtgccaatcgatttgatcctactactgacaaagatatgtaaacaaccgatcggctgacaagccgatagagagacaacaaccaatgccgatggggttttgagcaaatgattgtatgtccaatgtagagtctgaaacatgaatgataatgtaaaataacaataatataatttagtagaaaccaattggccaataatgatatgatagaataagcgccgatccgcggttaaagtatacatcggctgaaggtccgatgtcgttaaatccaaacgattagataaacagtaaaatctttgttgcgatcggcttgcatataatccttataagtcgatgcaacatccagataactcatcagctgaaactctgatgaaacccttattggcaatcaaaaacaggctagagattatggatctaagcacgacttagtaggtcaaacccaattcatgcagtagtaagtatgaaaagaaacataatatctagaccctaagcctttgactgattttcagggtggtcgatgaaatgatttaactactatcaacaaaaccctagagaagatccggccgatacaggcaaactgaaacatcgactcaaattaattaagatatataataaataagtgtttaaatcgacaagattagagtgtcgataccttagccctaccgatggaaatagccataacaagtgttacccctcatcggatattgaagccgatgcagcccaactcgaaacaataactcatcgagaaagacgaaaataaaaagggtggtgatgtgtcgaagctgtattgatcgacagatagattatagtgaccctggatgtacatatttatactcatgggtatatagtagtccttatcggacacgacacatatttcctaaagatgaaaggaaagatacaagtcctgatcggacactaaataaacaattcctaaagataaaaggaaactaactgactatgcctaattaatagataaatttaagctgccattttgtggtcttcatgactccctctcgaactcggtctcttctgaataagttttccttaactgaatccactaaaaattaccaaattttggtgttaacacatacctcccaggtattttggagtatgggaactcatgcttcaaaaatctcttctgccttgccttgattacttcaaaattgatcctttgttgcttcttgtcttggctctcataaaccaatactgtctgcattagatgaaccagactgtcaaactcatggcgaaagaatttgtcattgataagtgctgacaatccttgaaatgcaagatctgctaactgctcatcacttagacttaaactacaacatcggctgcgaacattacaaaatctttgaatatattacatagtcgattctccctcttgctgctcaaccgatattaagtctaaggggatgtttggttcatggccacactttaccacaccacacttttggctgccattgtttgttaggcatgtgtttgattcactgccacagttatggctggccacacttttttcaatagcatgtctcacatgtcatatactcatttttttgccacatttgccacactttatggctaccaatttgtccaccacacttttgtgattgccacaacttgcctaacgttagttgtggcaaagtgtggccggcaaccaaacacaccctaaaagcttcatctcattgattctagcaaaaaaaaattcatggaattgcttttcaagatcggcccatcctctaaccgaatttgatggtaatgatgaaaaccatataaaagccgatccagtcagagacaatggaaaaaaaatctaactttcagaacctcttcagccgatgtttctccacattgtgctaagaatcggctgatatgttccaatttaggcatatcatcttgccatgaaaacttggagaaatctggaaccttgtcaaaccactcaggatatgacagccgatacacaaaaatttgctactttgacttaagtccaaactgctactatactaactttgcaattctattggccaaatcattgttatattaatactctttattaatgaaattcttctggccgatattgaaatgactcatcatgctgatattgattttcttgtccctcgtgctgattctgttgttgccgatgattatgaagatgctcatcgatttgcaccccaagttaaattctttgagaaattaattcatcaaatttttccttgatcaaattctacaatgtattcatcaaaactcttgattgatcagaaaatgcacgatgaactgcttcatcaattgtatcttgacgtgtttcaaccaacggcttgggaaactgaaccttcttggcattgacttcctcttcagacatgttggtacaaaatgtgtgtcccgttagacgtgccaaaagggtgttaacgaaaaatccatgtccggcagattgtaccaactctgcgttgacgcgaaccgtgtcaatgaacatacgaaggcctgggagatctgcttaactctagtgaaggttctaaaattaatgagatgtggcgtgccagtcagtttgatcctgcacctgacaagatatgtaagcaacagatcaaacaatcgatcagttgagaagccaatatagcgatactagtagatgtagcccaactcgaaacaagaactcatcgagaaagacgaaaataaaaagggtggcaatgcgccgaagttctattgattgagagatagattatagggaccccggatatacatatttatacccatgggtagatagtagtccatatcggacaccacatatttcccaaagataaaaggaaagatacaagtcctgatcggacactaaataaacacttcctaaagataaaaggaaactaactgactctgcctaatttatagataaattcaagctgccatgttgtggtcttcatgatttcctctcgaactcggtctcttctggataagctttctgttggctaattgtgctctttccttaaccgaacccactaaagaatcttaccaaattttggtgttaacacatatccccttattttggagtatgagaattcatgcttcaaaattctcttctgtcttgccttcattacttcaaaattgatcatccgttgcttcttgccatcagctctcacaagacgatactatctacattagatgaactagactatcaaactcaggaaggaagaatttgtccttggtaggtgctgacaatccttgaaatgaaagatccgctagaatggctttcgttctttcataacttgacattttttacattacatcaagatatgataatgaaattataatgttgtgaattcgtttttaaatatctagctagagaacaaataaggatataattctcatgtaaaagtctagatagtttcttttctggcgagaaaagtatcctcccttcctttcataacatctggcaattttgactaacacttgctctagtttgaccactaacatcatttaaaatcatttgattatgaagaatgagatttatatgttcatatttacagtgtatcaaacttcaattacatgatatatcttttaaaatacctatgagtttatttctaaaataggagcggtaaactaaaattaggcaaattttttgaaaggaaaaaataaggcaaattcaaaattgccaagtactatgtgtcgacgggggatacccacagactggataaatggggtactggggtacgttggtacacggatctacacgatacgacatctaaacagacaagagataaggattatactggttcaggcccctcgtaaggtaatacccttaatctagtttatatggaatagatatggaagaccatggaatacaaagggaaccaatgaatccgacaataccggcgagatccttgtcgagattggtcgacgagatctcccggcggcttcggcttgaatccttcggcttcgtaaactatggcgagtgtgttggtgctatgattcgatgatcctaaacccctccaggggtacgtcttttataccgtgagttgccttagtctcccagtgaaactcggagacaacgaaccctatacgatatagaatagtcccattcctctccgagtgggactctaataatctccagcccgtgaggatattttccatgttatctcgtatatttccttattgcatacgaaaacatatcgcaagatatgaggtatgccaatctggtatatttggaaaatcgtaggataggaggtatgccttatccgtaaccctgacactatgaaaatggccttgtcgccatggctgcaaagttttgaacatattatcggttgaattcgttgtatgacattgaacaataaacaatttgggcaacaccagctttgctttgtggctcacatgtaatggttgtggaatcctttcctgtatggatgctggccccccaaactataagggtcaattggatccttatcactgcaactttacccaattaaaaaaataccactactattcacgatatcggctgggtgccatcagtattttgtaaaaatttaaccatgccattatatacgtctcgaatgaagttggaaatggtttttgcattttcgtacagaccaaaatgcctccagctcttaaagtctcgtattttcgtacaaaccaaaatgcctccagctcttagagtctgacaagtgggacccaccttgtcatacacatcttttgaattcttaatttggttgttgcagcaagaagcggtgacagcaagcagcggcgatgggatggagcaagcggagcaatggcagtggagcaggcagcaatgtcagccatggagcgagcagtaagttgcgtcaatggcataggaagcgacaacagtggtggtggccagtggggaggcggcggatccggtgatgattcaagctagcgaatttggtggcgacaataggtctggccgtggactgaaggaagcacatccagtggcggcggcgaggcagtggagagctcgtgctgcagtggcaggtctagcaacaacacgagcagatccattgacggcggcgggtccggcagcagctcggcatggtgtggccactactggagaactggtctttatccagatggcaaaaatcacattagtcctagttcgaatagtaaccgggactaaaaaaatatttttaatcccggttcaaaagcccaacggtactttttgatctttagtcctggttggtaacaccattcgggactaaagatcatatatttagtcccggttggtatcatatattcgggactaaatatctctctcccgcgtcattggcatctctagctctctctctcttccttatctcggcatcggcagctgcgtcttatcccctcctcctcctcctcccctattcacgccttcttttccacctccactcctcctccccctcccctctcctccgatcccatcctccccttcccctctccttctccctctccctctcccatgtccatggcgcgcggcggcgataccctctcctctgctggatccggcgggaggggaggcgacaggcgcacggcaggtggaggcggcgcatgaggcggtgggcggctacctcccctccactagatctggtgggaggggaggcggcgggatgggaggccgggcggcggcccaacggaagcagcggcggtggcacccgggcggcatgctcctcctctccccgatctgtcggttatggctgatttgtttttagattttgttatagatttttttagatttgggaatgatttgtggattgtggttgattttgtggatggtggatgattttgtagatgggcatgtgatttgtggatgattttctgggtaggccagtgaattgtggatgatttttttgtggataatttgtggggatttgaggatctggcgttggtgatttcagctcggaatcaatagatgcaagtagcaaaaaaaaaacaatggaaaaaaagaaaaaacctttagtcccggttggtgttgggactaaagatggtagcgccagcacgtggtaccaaccgggactaaagatccatcttcagtcctagattcggggtcccggtttgcaacctgtgactaaagggggttgcaaatcaggactaaagattacttctctagcagtgggcaagagcaggcctgacggcggtgagccccatccccatccttatcgacaacgatgatagcagcgtatggccgcggcgagcttgttgatgcagtggcgggtttggcagcagtgcaagcagtcctagtggtggcggtcgcggtgagcaaatccaagggtgcggtgggtttggcaccgcttcgctgtgacgcggtgccaataggcccaatggcaacgttggcggtgaactccatcaccatcattctcaaagatgatgacaacaacacgaccaagactaataacaagtttaatagtatagccaaatattagctccaaatcatctattagctaatataatagctcattcatacaatagttaactataaaaatatactacaacattaatacccgatcccacatctcatacacacataacgtcttaaagtccgtgttgcagttggctacaaatatgtagcccactttcttctctctcttctcttttcttctcgatatgggattatagctgggggctgcaggaatt

SEQ ID NO: 91911 - DNA, 2506 bp, Oryza sativa
ttaatgactaccctgcactcggtaatctttccggacaaactataaaaggaaagaaagcatgctccgattgcaaggaacatacacgaagccggtggctgaagaaatcacgaaagatggtatacatgggtcaccggaggtggctcccgctacgtcacgcatttagaagaaagaagaaaatttttaacggtaagagagaacttcagcctgctcccaaagatttgtccggagatgaggtgcacaatatggtaaaggacataagtaatgagtttgggaagaaaagaaaatgtagaaagacaaaggagaagggtatgtggaagaaaaaatccatattttggcggttaccttactggaaagatctagatgtctgtcattgcattgatctcatgcatgtagaaaagaatgtgtgtgagagtttggttagcctgatgctgaatattcccgggaagacaaaggacgggttgaacgcgcgccttgatctataggacatgaatattcgcagtgaactccagcccatacgagatgcagagacatgtaaagtgtacctccctccagcctaccacacactgtcgaaggatgagaagatcgcaatgttatcatgcttgaaggatattaaagatccattgggctattcagcgaggataagtaagtatgttaaattggacgatctaaaacttgttggaatgaagtctcacgattgccatgtgctaatcacacaaatcttgccagttgctatcagaggcattctaccaccgaaattgcgtcacacgatccaacgtctgtgcgccttcttcaatgcaattggacagaaggttatagatccagaagatctagatgggctgcagaccgatattgtgaataccctctatcacctggagatgtttttcccactgtctttctttgatataatggttcatctccctgttcatctgatgaagcaaacaaaactatgtggcccggcttttctaagggaaatgtggctgtttgaaaggtacatgggagttctgaagtcgtacgttcgtaacagagctaaacccgaggggagcatcattgaaggttacacgaccgaggaggctattgagttctgtgtcaattacatgtccgatgccgatcctatcggagttcccgcgtctcgtcacgagggaaggttgtcaggtgttggcacaatcggaaggaaaagaattaggcccgatcaagcgtcgtacgcgcaggctcattacgctgtgctccaacatatggcagaagttggcccatactttgaggagcacttagcgaaaatccgagatgagaacttggggcgatctgatgcatggattaacatagaacataattctcggttcaacaaatggttcaagaatcgtgtgacaatgtcctcggatgtcccaaatgagacagtacagttgttggggatgggaccgtcttggaccgtagacacatggcaaggatacgatataaatggatacacattttacaccgtcaaacaagatgacaaaagcacagtgcgaaacagcggcgtccgtatagatgcattccaggatcaagttgggtcaaacacatactacggccgcattgaggagatatgggagctaaactacgtcaagttcaaggttcctttgttccgctgccgttgggtgaatctacgcactggtgtcaaagccaacaaggaaggtttcactttagtagatctatctaaggtgggatacgccgatgaaccatttgtacttgcaaaataggtcgagcagatattctacataaaagacccttcaaacaagaagatgcacatcgtgagggatggaaagcgccgaattgtaggagttgacaacgtcgtcgatgaagaagaatacaaccataatcttcatgtaagacctcacattgaccttgacgatgatccccaagagcctgtggcatatgctcgttcagatcatacggaaggcataaccttgtgactgatgcatttgtacttatctattgaaatgaatgaagtattttgttttattgcaaagacttgatatgtgtagtcattaatatggctaattttgttttattacaaatgaccaaaataaaagttgtagatcctgatgagaggatcaactctattgttgaccatatttccatttgaaatcatttagtattgacaaaattaatttcaagctgttgggaaaaaaattatatagaaaatcatttagtataaaatgaattattacacaacagctatatattttgcactctcaacaaatgaaagatggaaaatgagtcatcgttgacgggccaacgtttacggccgatagagattaatctatcttaatcgggctttgccgtagagcccgtcacagatgactcatcggtgacgggctccatactaatgcccgattgagatgacattccagcccgtcacggatgactcatctgtgcgggcccaaagataatgcccgatagagatagattaatctctatcgggcttgaactaaggcccgtcaccgatgactatttttccatttttccagataag

SEQ ID NO: 91912 - DNA, 971 bp, Oryza sativa
aggaacaagcaagttcagatcacatcgaaattcaggaagatctgacgtatgtggagaagccgactcgtatccttgaaaccagcgagagaaggaccagaaacaaagcaatcagattctgcaaagttcaatggagccaccactcagaagaagaggccacttaggaaagagaagatgagttgaaggccacccatccgcacctcttcgccagctcttccgaatctcggggtcgagattccggtaggtttgtcacgccctgaagtttcccctttcttctttctttaaaagttggttgaataaatcgtccgaagaaattatcttaattaacctagagctaaatccctaattaataaatgcaattgataattggaattggcattgtgagatttttcttgggttccacatgtcgcaattgattaacaggatttttagtggaattttaagagccctataagtaattttaaccaattaaaattcgcaaagtgcaatattttaaatcccaggaaaatctttttcctttttctccattcctctccctcctttttctttgttgggctggcccatctctctcccgcgcccctccctcttgctgggccggcccaagccgcctcctctcctctttgggacgctgacaggtggggcccacctgtcaggtcatccccaacctccagccacccgcgccccgcggcaaccgctgctcccacgtcgccgtccgcgtctcccacgcccactccgcgtccacgcgctgcgcccacgttgtcgtccgccgctcctccgcctttcccgctcgcgcgcgcgcccgcaaatgggcgggattcgatttgaatcccgtcccctctctctctctctctccactcccccacgtcgcctgccaaatagggggccaccccggccgtttccgtccttccctcgcccataaaaactcttccccgagcccctcttgcgtttcccccattcgccgcgccctcccgtgc

SEQ ID NO: 91913 - DNA, 742 bp, Oryza sativa
agccagggatcagtttaaaccaggctgctggtgaggaacaagaggtagcagtggagaaaaccactaagaagttggaagatattcccatagtcagagagtatccagaggtttttccggacaatctgacaacaatgccaccaaaaagggatatcgagttccggattgacttggcacctggaactgcaccgatccacaagaggccttacagaatgggagccaatgagctggcggaagtcaagaagcaagttgatgaatagctacagaagggatacatccgcccgagcacgtcgccttggggtgctccggtcatctttgtggaaaagaaagacaaaaccaagaggatgtgtgttgactaccgcgcactcaatgtggttactgttaagaacaagtaccctttgccaaggattgatgatctgttcgatcagctgaaaggagctactgtgttctctaagatagacctgcgatcaggctatcaccagttgaggatccgcgaagaggatattccaaagacagcattcatcactcggtacgggttgttcgaatgcacagttatgtctttcggactcactaatgcacctgctttcttcatgaatttgatgaacaaggtgtttatggaatttctagacaagtttgtcgtggttttcatcgatgacatacttatctactccaagtccgaggaagaacataagcagcatctccggctagtacttgaaaagttaaaagagcaccagctatatgccaa

SEQ ID NO: 91914 - DNA, 2512 bp, Oryza sativa
tcagctgtctgaaggcccgatcaagtcaaatatcgatcggcttgaagctcgtaagattgatcttggcacaacttcaagaatgcaacgctgagttggatatggagcacaaaaagctagccgatctcccgcaagctattgaagaacagaaggcaaagctaaaatcggccatcaagaatgtcgctgatatgaccaagtccttgaaagttatctctggaactgacgctcaagatgcccaagccatagaagatgtagaacagattaggcagaaggctatatcggctatccagcaatacttgtctcaataactttgtgtaatagaacttaaaaatttttttgtaatcggctaagacattctagtactttattatcttgacaatcttttcaccgattagcacaaaaaatttgcctccaaaaatttgcattgcatttggtatatatgtgcccccctaattttataatatcaaaagcattgataaaattataaaacaactaagggcgatataaccatatcggccattgtacatcggcaaatcacaaccgattacattatgaaaaacaactaagggtaatataaccatatcggccatctcaaggcgatgtaaacacatcggctgtcatgcatcggcaatacgagccgatcatgcgttaacccaaacacttgggtaatatttcttcaaatatttgccattgagcgctcgcccatagacttcgccatcaagcccttgcaacatatatgctcccttagacacaaccttataaatttggaacggtccttcccaattcggcgaccacttgccgaatttactatcacgagtaccaatcggcaaaatcaatttccatacaagttctccttctgaaaaatctttaggcaccactttcttattataatgccgagcaatacgttccttatacttagtaacctttgcaagggctcgcaatcgtgattgaaccagatcctccctctcattggccataaggttgtaatactcatcagctgttaaatcgttttgtaattccgttcgtcgagagccgattctaacctcccacggcaaaacagcctcatgcccataaacaagtttgtaaggagggacttgaatcgatccatgacaagccatcctataagaccacaacgcttcggccaactgagtatgccattgccaaggataatcaaaaattttccgcttaatcaatttgatcaaacttttattagacgcctcggcttgcccattaacttgtgcataataaggtgaagaattcaacaatttgatacccatgctatcggtaaactgaacaaactcatcggacacgaagattgaaccctgatcggtagtaatagtttgaggaagaccaaatcggtagattatatgctcttgaacgaattgaatggcatccctagaatcaactttcttcaaaggaatttcctctacccacttggtgaaataatcagttgccaccaatataaatttatgccctttactcgatggtgggtttatcatactgattatatcaattccccaacctctgaacggccatggcttaataataggattcatagctgacgccggcgctcgctgaattgctccaaacttctgacaatcctgacaccccttataatatctgaaacaatcctctagcattgtcggccaaaagtaccctgcatgccgaagcaaccacttcatcttatgagccgattgatgagtaccacagactccttcatgaacttcaccgattgcaaccttagcctgatcggcactcaagcacttaagtaataccacatcaatcgtccgataataaagctcatcatccagcagtgtatactttaatgccttatatcttaatttcctaggagccgattgagatggattattcaaatattgatgcacatcgtgcctccaatcatcggctgtcattgctgcaatttcaactttaacatctttgatcatcggcttataccccgatgccccttgggctaaatcattagctttaatattttgttcttaagagacatgctttaatgtaaccagccgaaactctttcattagttcctggcacttctcattataaaccatcaatgtatcgttcttgcattcatactcttctgccaattgactgattactagcaaagaatcccccatgatttcaatggtatcggcttcaacttccttgagtaattgcacccccttgagcactgcctcatactcagcttgattattagtcgcatatggtgtaatagtataagcaaactcgaaacatgccccactaggggaaattataactaggccgataccacaaccatgagtacataccgattcatcgaagaataaagtccatggcactatttcaaccaagccgattgaatcatcacgatgttctacaataaaatcggctatagcttgtcccttaatcgccttcggcgattcataccgaagatcaaactcggttaaggagaatatccactttcaaattcttctttttaatattggagccgatagcatgtacttgactacgtcgg

SEQ ID NO: 91915 - DNA, 688 bp, Oryza sativa
ccgaccccagcattccgccggcgcctgacgcgccttccgggaacttcttccctccggcgccaccgaccacgacgacgccgacgagccccggaacgactccctccccgaccaccgtcgccgccgacgtctcgaaaactccgtcggggtccggctcgggacaccacggaggcggccctacgaaggcgaccatagtcgctgccggggcgggcgcggctgccgccgtcgcgctgctcggcttcgcctgcgcgttcctgatcaccggccgcgcccgccgccgcggcgactcgcagaagctgctcggccccgaccgtgccggcgcgcatcgcagcgccgccacctccgccgccgacttcctctacgtcggcacggtggagcccaccacccccgcgcgccaccacgggcccaccaccgccgatctcgtggggtccccgtaccgcaagctgcgcagcgagcgggcgcggcgcggggtgagccgcgacgaggacgccgaccacccgagcccggagctccgcccgctcccgccgctgcggcgcgccgcaacgctgggctcctccgacgaggacgggtactacacgccgcggcagctctccgggggctccggtgggggcggcgccgccgaggcctggagctcggcgagcgcgtccagcccgcccaccaccaccacggcctcacgccgcagcctccccag

SEQ ID NO: 91916 - DNA, 627 bp, Oryza sativa
ttaccgatgggcctggcgcgaactatagccaagtgctgctacatgtagggagctcccagtgaacagtgttgcctatcagggaaatgggctctaccgcttacagtgctgatctaccgcaattattgctctgcttacaaagtgcccttctcccgtatatctcccttcatggcgagactcatgtaccccgatggggcgatggccttcaagcaattctacacagaatttgatgacctcatctgttccataacccttggcgatactcgcctttggacgagccctgatacgaacatactgcttcggaacccccctgtacctctcgtacggaaacatgtggcgtaggtatacatgcccgagaataccgatctctttacaaggcgacaaagccgatgcttccttatatgcgaaaaatgaaggtgcaaatttcaactcaccactgacgagacattgcgccacttcattctgaagggcttgtaatctatgcggatcgatgaccttctgcaaaatcgcgttcatgagtgcacatacctttgacatgggaccggacgaacgtcaccacgttgctccatatgcttcatatcattacgcgcttccagtgtatctgtcaactttccggatacacctaggaag

SEQ ID NO: 91917 - DNA, 1483 bp, Oryza sativa
aaaaatgattcagcaagcattcagcacaggaatcctaaagcacccacttgacattgaaggagcaccgcccaatttgcaaatacgcagatgataccctgatcctactaaaaggagaagctgaccaagcaacagcaattaaagaaattttggattcctttgcaaatttctcaggtctgcaaataaattaccataagagcactctagtacccatacacctgaatgaggcaacaaaaactatggtgacgcaaattctacattgccctgctagttcactcccttgcagctaccttgggttacctctttcaaccacaaaaatctcgcataacatgctgctgccagtcatctcaaaagttgacagatatctagccggatggttgcctctatcaaagggaggaaggctaactatgatcaacgcagtcatgtcagctatcccgacatactacatgtcatgttgtatctggccggaaaaatctatcgaagcaccggacaagataaggcgtgctttcttttggaaaggggaaaaatccataaaaggaggtcactgcttggtggcatggcaaacagttctactacaaaaacagcaaggtggtcaaagatctcagggcacataacacagctttaattttaaagctaggacataaggtactcttttgcccaaacaatccaatgactaacttggtttagaaggcgatatctgaagcatactgtacagttactccccagatccagtgatacccccacttggaagctcattatatctcagtttaacaccttaagtgctgcaactcaggtaacccttggtaacggcaaaactactctgttttggaaggataattggctgcaccaacggttacaattcacacacccaattctattctcctttgctctggatcaggactgcacggtagattcacagtttacacaaaactcctggcatgtcaaattgcatcctaacctctcctaccaagcagaattagagctgcactcgcttatgcaaattctgcacaggcttagccccatccctgagattcctgacacaagagttcttttgcattctgtacccaagttctcaacctcaatgcctaccaacttctgacttaccatggagccctttggaaaccggcagaatatgtctggatacacaccatcccacaaaactgtaagatcttcctttggttggctttcaaagacaggcttaacaccaaggcgaatatggtcagcaaatgctggagcgaagatccgcactgcccgctttgcccggcattagaatcagctgaccacatcatcctgagatgcaagaatgctaatagcctatgggaaaaaatgaacctactgcacctggcaaaccattctgaatcatcctcagctttccttcaagcagtcgttgacagaaatcattcaaatagaggaattgaacctatctggtttgcagcttgcgcctaccaccctgtggaaagcacgcaacaacatgatttttgagaga

SEQ ID NO: 91918 - DNA, 1017 bp, Oryza sativa
tgagcttcaagtttggcgttggcttgcgagatggtgattgttgtcgaagttgtagcttgttgcgaagaggcggcagcttgagacgcccccaatatttgagacgaaaggattacgtccctgatctggagcgtttccaccgcggccgctgccttcgccccctcttggtctgtcgaagtagtcggtgccgaaggtgggagagatggcgccgccgtcggaggtggcgcggctcctgctgctgcagaaaggcttgaaactgggctttcaaggcctaagctgcctccatcattgcttgtggcgtgcgagtgggcttcggatactgtacttgaggtgtaaccgggcgaaccggcaccgaagtcatgtgacgggtcgggtgcggggccgcagctggagcaagcttcgcgaagtagttttaattggttaaaattatttccaaggctctgaaaaattcactaaaattcatgttaatgtattagaacatggggaactcaagaaaaattccaccacgccatttttgattattatttacgtttattaattaggattcaactctaggttaatttaaacaatttcttcgggcgatttacttaatgaatttttaaagcaagaaaggggaaacttcagggcgtgacatctacgtaatatgacatcaagcagacaaaagaaaaggattatactggttcaggtcccttatcaggtaatagccctatccagtttatatgagattgatgacggagaaccacagattacaatgaaagtaagcgaatcagacgataacgacaagatcgtaatcgatgtactcaacgagatcttctggcgacttggctccgcgtactccggcttcgtaaactatggtgggtgtgttggcgatgagattcgatgccctgcacccctccctggaggtccctctttataccgtggatcatcttgacccccaagtcaacggaatctctatcccttcgagtaggattcaggaaatcgcttatctcgtagagatatttccgtaatttgcaacagatt

SEQ ID NO: 91919 - DNA, 10874 bp, Oryza sativa
ccactcaccaccactactactctcttttaaagcagtatagaaactcaatgtcaatttctcacccacatcaagcactcaaatcttttacatatataaagaattgtaaaccttcctaaaagttgtcacttgtaaatggttccaatgtatctccaatctatgtgtatttcactgtttgtgggttatccttgcatactctaagttctgcgattatgggtccaaggcggaagaacatggttaaggatacttccagtccagaaccaaatgaagagaatttttctcgattgtatgaatggaaattgaacctaaaaacaaggactgttgcaggcaaatacttaactagcttagatgttgccttggaatttccagttatcaatgataaattttctggcccacggcataggtatgtgttgtcgaatggacaactgagtcacgtcgaaagacgtggctctctcaacagtagttggaagtaaagacaattgtattgcttagtaaaaatttttttggatccccctgttacattgtcctagggggctacttatagccctattacagactccctcttttagggtctagggtttacaggggaatttacatagttacccttgtgatagggatatcttcatgggtatacagtgtcttttgcttatatgggcccttagcgggccaagtgtttcagcccagcaactggcgaaaacttcggaaggtgtgtcggcctgctgagcctccttctagtgagacccgatgcctggcaaaagctgtgcccttcgtggcaaggctttcgccttagaccttcgaccgagtctcccatggtgaggtctgtctttggcgaggcttgtaggctccacgctacgtctttcgccatgtggccttcgcccacgccgtctctccgatcttcgccgcttgcttccagctcgtgctttcgatcatctttggtttcggtaggcccggtcgaaggtcctcgtggtatgcttccaacaagcccatcacgggcaagggtgagtaaggagctttggccaagactgtgcaagtcgtgtggtgtaccatcagacaccccctttcggccgatgttcctgccgaaacctatgttatgtacctatgaaaggaaaaaacttgtcctcttgtgttaacaaaaaaattttgagggaagtttccttcttgtttcgccaatgagtggcgaagtggttaggttacagtttgtactactatgaatagtgacgggccctgtgggccgcgctatcgttgctttcggccctttactgtttgaccccggcccgatgggaatttaccgtttcgtctacccctagacacgtgtcaagctctgattgggtgggagccgaaccgtcgcgcgatggggttacataaccctaccccaggtctccgctcccccccccccacgcgcttttcacttttaccaccgtcacgctcccgtgctctcagccctagctcctgctctagcctttttccaccgctgtgcgctcacgctggctgcttcgaccttctcatactctttcaccctcgacctcctttttgccacggactcgatggctccacgcaagcctaccaaggccgggtcgaccggcgaagaccccggtactcagcgaagggtggtcgtgctaccttggcaagtcccttgtcaaggagtctgacctaaccgagttcgtccttactggcgtccttgcagagcgtctggcaacttacgggggtgaagctgttgtcccttcgcccggcgacagacgaacggttgtctttactactttcttcgccgttgggcttcgccttccatgtgacgactttctgccgtccgtgctggagatatacgaagttaagctcccccagcttagcccattggcgttcccgaagttagccgtcttcgcgtggatgtgccaaacttgcgggttcgctcctaccgcgaagctgttcgccgttctattcacggcgtgcgcaacgaccaaagacgtgaacatgccggccgggccgaaaaagaccgttttcggctgcgtgaacttcatgctacggctggagcattcggatgcctggccggttccttcgtcgatggtgatgcagaagtggttctacgtcgataacccataccccgccgacgatgataaggcgaactggctccggtttcagtgccttcctgtgaagatatgcttcgactcacttcatttttttctcgccccattttatctagtccacacttggaagatgctgaggcggaggaggtgaggatagtcggaggtttgaccaccgccgaattcagtcgcctgctttaacgtcaagccgacggaagggtgaaccgtgttcatgccggcgagctagctagtcgatcgatcccctcaaaggccgccgccaacgacactgggacgtcgaagaagcgcaagcgagccgtcactaagggtgactaggcgcgaacccgtcatgccaccaaggacgcgccgacacggatgcggatgaggaggatgacgatgaaagagaggccgggtctgacgaagacggcggatcgcgcggctacacccccaatgtggtttgggtgaaggctggagcgggttctaatgctttgcccgtgcgtccgcaggatgttgccggtgcgaacgcgctcctggcgatctccagctccacggcgaaaataggggcgatagccagaaagaagaagaaaggggtggtgcaaattgccggcggcttttccgctagcgaggaatcttccgacgggacgcctacttcgccggcgctgcgacgcgttgtcccccgaaggagatgcctgtcgccaccgcctaccagcgatgccgaagcgccaacggggggtagcgcttcggccccggccgctgctccggtcagagcaatcgagtcggcggaggcgaacatctctggtgccgacagagtcgacaaggctccttcgtcaagccaccagcgggacgggaaggcgccggcgattgagatgatagtgtccgacatgacactcaacgccccgcacttcgtgtccgtggatttcgcctcccgactggagtcgcccccttcgtggatggggtttgttagatggtttcgccgtccgacggccttagtctcttcaccgtgctcaacgagttcggcgagagttgcgcagctgcggagagcttattcgtgcaggtaaaaatttttcctttcgcccacatagtttttctgtccttttcgctcttgttgtactcaaacagcttcggtttctcttacccagggtctcgcggcgcacctgagtgcgaagcggtccggcctatagaggctggatgggtaccggcttcaccttcggaaggccgaagaggacctccaccacaaagaagacgaacgtcaggtcgtggcggatgccctgaagaaggcgagcgcggagaacaaatcccttgtgggggaaaacaaatctctccgcgccgacttggagggggcgaacaagagggctgccgagcgggaacgtcagcttgctgcggccgaggaaaaaataaagtctcttgagacccggctcggctcgaccgaagcagctgttgaggctttggcgccagtgacagagtccgccaaataggcctgctatacccttcggctggccctcaacgaccttggggcgtgtgcggaaggcgctccgggcgaagacgggtcagtgttcgacttctctgagtggacgcaggatgcggttggttcagttgtcgaagtgtctggcgcgtacagtgactgctgtgcgcgagttgccgcggattcgtgctcagcctgcttcacgaacatggttgtgaccatgttgaggatttccctcagaccatgaagaaggattggcctgaaaatgcccaatccgccgcgtcggctttgaaggcctttcggaagggcttctgggaaaacggcagcagggatggcgcgaagacccggcttcgcgagcagctggagaggatagcgagggccgaagacgccgctgccgccaatactggcgaagaccccgggccgtcggagacagctactgatcgtgagggcgaaggcaacgaaagccgagaccaccctgaggtgtgagtcccttcgccctcatgttctttgctttttaggcttttgtagctgtagtttgtctatatacaagtattttgcatgttcggctagtggccgttaccatcttgtagctgttatggccttatgtttattaatgaaaagttagtgtttcgccaattgtgcgcctttatcgcaatgtgtgattgatttcgttagcatttttcccttttcgctgtactttatgccttgttggcagggttttagccgaaagtcgagcgttcggcccccctttgggaattggcgaaataaaaacgagaagttcgtggcggtgaaggtgaaagtgtcaattaggcctagagggggggtgaataggctaattcaaaaaacaattaaaagcggaagcagtaattttcggatatttccgaaattttcggatatatccaaaaattttcggaatcagcacaaacacaaagtaaatcctagatctagctacctataacaagaatatgctagcacaaacagcaactagacctatagcagctcaaacaagcaaagctagtggagagggaggaagtaaagtcaccaaagatgaagctcacgaagttgttcccgaagttcgaatccttgaagggattctactctccgttgaggatctcactaagagccgggtcttagctatccctttcctcaagaggttgcactaagcactcctccttccactaagggtatctcttccctttcagaggtgagatccgaccttcacaaacttctcccggccaaccacaagtagatcggtggctcaggagcaacacctagccgcctaggagtcctcaacctccaagagtaacaaatgatgcaacgaactcccggagatgatgcaagtgctcacaaatcttcacgaagtcaacaacaagcactcacacaaactcgaattcacaactctcacacacacaccaaatccgaatcgaatacgggtgagaggggaaacaagaaagcaaggctcaaaagtgaatctcaacaagagcaagccaagggcatagaatgtccaatgtgaccagcagccctcacaggtgaggggagggggctatttatagcaacagcccaaaatctgcccgttatgcacaataattgtgattttcggatattccgaaagattttcggatatatccgaaaattccaactaaagatttttcgaacattccgaaaacttttcggacaagtccgaaaatttccagacccaaaaacacccttctggactgatctactatccaactgccattttcggaaagtccgaaaattcctttcggaaaactccaaaaatttacagaagtgagaaagactctattgatgatttttggaaaatcgaaccatttttgccttttcagtcattttcggaaagtccgaaaatacctttcggatatatccgaaaattttcagaacacatcaaactgaggagaaacacttttaaaaattgattttgagcactttgatcactcctcatatgtcaatgcatcatccctcttaatagtgcggctttcctattgactctaagaaaagaaaaggtacaatataccaattgctcatttgccgcatctcatcatgtcaacgcatttggcgggatatgcattactttaactcattgaggacataacaaccttcacatttgcttaaataaaaatgttagtcctctctaatcgcattgtaattaatcaccaaaatcattaggggcctagatgcacttttaatctccccatttttggtgattgatgacaatacgattagatcacaagagagaatgaatataattaatggatttggtgcaaaggtttagtgaaaactccccctaaaagtgtgcattaaagcaagtggagagctccccctaaatctttgcatccacattgaagctcacaagacaataaatatatcacaatttactcatcacatacaacacatcacatgcataataactattacatctcatcacaagcaccttataaagaagataagacattgcatcacattaaacataataagatccattacatctcaagcatccataattaaacaataatgtcttacaaagcattaaactcacttaggaaccacacatagtctcatacaaataaaagccaaatgtgctcgacccaaaagacatgatagataatctccccctttggcatcaagacaccaaaaagagaggacgatgagacgaagactcaaacaaagggcgcctgagggggatcctctggaggaggaggaggatagccatagccatggccgaacccaaagaagtcgaagtccggaggcagcccaacaaatggatcctcgagctgttcctcctcaggctcatcgggctcagcctcaaagcccggaggggaaggcgggacatcgatgtggtggtcctcatgataccgcgccttgagatacttgacgtcgcgagccgttttcttcgccgcattccgcaatcggcggttctttttggcctccgcggagcaaagaccaaaaagactccgcaaaatgcggaacaagggagatggctcacgacgagccacaggagatggacgatcacaagcaggaggcggctgagtggaagaggaggggatgtccccagctgcagaggtgcctgcctgagaagagcgggaggccttaacaaggcgcaaatgaagctgggaatgagacacatcatgacgaaactgaagctgagtgacggtctcgatcatccgcataatgtgaggggcatagaccaaccccttccagtactgaatggaggccatgcggatttccgcccaaacgaagtgataaacatgaaagcgatgaggagggggatcgaacctgagaagcacagtcctggagaggtggttaatgctgctagcatcaccatctttaggcacaaaggaccggcgaaacatccggttcaaatagaaaaagtatggcttgagaccgtcgaccttgcccaacaccacatttggatcattaggaatgtagagagggagcaaatcagtgttggcaggaatttaaagattatgcaggtcatcaaggttgaacaaggaatctaagtcaaagccccaaatctcagccaatcgccgataggagacagaataccaggacccatgagtcatccagtgaatggcgcgaaaaccatcaaagaaggcggttgcataaaattgagcaatgacttcgttgcaccaatcctgctgtaaagtcatgaaggagcgaagtcccatgagctcacaattggaaatcacatagttgagcaccggatcatcatgagcctgcagctgctccagttgatccattgcatagggaccgtggggtgagctttggacttaatcacagactcgtaaaagtcttgttgaaagagagtccaaaaccgtgaatccgtggcggtgcggcgaagggggcgcggatcctcatcccggcgaggagcaacaacctcagtcttccgcctccaatcatacacttggcgaatcaccgccgggtccctctcgggggtatgaaagcggagaggaccaatggggacattgggttggtgtggcggcgtttgcggttgatgagaggagccctcaccaccgccaccaagagcttgagtggaccaccgaggagggagagtgccgccccgagccacccacgcaacctgaggaaccgcatcctcttccccggaccaatcactgtccgtatcatcacgagaggatggggtgggagaatggttcctttggcgcttggacgagtgggacgagcggggaggcatcttcaagaacgcgaagaactttggagaacgcggtgaagattaacaatgtaggtcccaagtagtgccccaaacgtgctcccacaaggttggagagaagggaagccgcggggggtcaccagagtaggggtggtcgccggtggggaggggaggagggagtcaagctcgtgggggaaaaagagtggaaaggagacagagaagaccacgggtgaagggttatatatgagccccgaaattttcggatatttccaaaaattttcggatatgtccgaaaagatacaggaggtttcgaacggatctggagtttttcggatatatccgaaaatttttcggaaagtccaaaaaatcctgggattgcttggaagaaaggcgacaggacaggagattttcgcaatgtccgaaaaattttcgaaatatccaaaaattcctggaaaactcagatttgcaaagggatttcactgggaattttgatgaaactattttgcaaacatttttaaaggaattttgcaagggactagcaccgggaaattttgacaaaacacatttcacaaggatttttgataggattaaaggaatggagggatggtcgagcactatagactccatttgaacttgaggctagcacacacaagcatacgaaacaatagccacaagtcaaatggacgatccgagggatcaaaagagagggaattaccatgagacaagataattcaccctcgagagagggaatgtgtgaatctatctcaaattgtgttaggaccaaaattcattgaaaaatgagatccccaaacacatagattcaagttatccacaaaagtgactagtgtccattttgtcacaaagtggtatgcaaacctatgctagcaaacaaacatgcatgcaaaagatcaagccacattccaagaatccaagatatttagttcacttctcaactcacaaaacctagcttcatctagaggcttggtaaagatatccgccaattgtttgtcggttctcacatgttggatgtctatgtcgcctcttgtggaatggtctctcaagaaatgatggcgaatatctatatgtttggttcgggaatgttggacggggttgtatgctatcttaatggcgctctcattgtcacataggagtgggattttggacacatttaggccatagtctctcaaggtttgcttcatccaaagaagttgagcacaacaactccccgccgaaacgtattccacttcggcggtggatagggcgacggagttttgtttcttggaagaccaagaaacaagggacctacccaagaattggcaaatgcccgatgtgcttttcctatctactttgcacccggcataatccgcataggcatagccaatgagatcaaacctcgctcccttaggataccaaagaccaaggttaggtgtgtgcactaaatatctaataattctcttcacggccacaaggtgacactccttcggagcggcttgaaatcttgcacacatgcacacactaagcataatatcgggcctagatgcacaaaggtaaaggagtgagccaatgatggaacgatataccttttggtcgacatctttaccttgctcgttgaagtcgaggtggttatttgatggcatgggagtgtggattggcttggcattctccatcccaaacttcttaagcatgtccttcaaatactttgtttggcaaatgaaagttccttccttgagttgcttgatttgaaggccgaggaagaacttcaattcacccatcatggacatctcaaaacgtttggtcatcatcctactaaactcttcactaaaagacttgttagtagaaccaaatataatgtcatcgacatatatttggcacacaaaaatatcattatcatgtcttttagtaaaaagagttgaatcggctttcccgatttcaaagccgtttttcacaagaaaattgcgaagacactcataccaagctctaggggcttgcttaagcccgtagagtgccttgtggagcttgtacatgtggttgggacacttcggatccttgaagcccggtggttgctccacgtataccactcgttgataggcccgttgaggaagacgcttttgacatccatttgatatagcttaaaattgaggttagtagcaaaagcaagcaatatgcgaatcgactcaagtctagctaccggcgcaaaagtttcaccaaaatctaatccttcgatttgggtgaacccttacgccactaacctcgccttgttccttactacgactccggcttcgtcttgcttgttccggaagatccacttcgtgccaatcacattttgctgaggtcgctccaccaaagtccacacttcattccgggtgaagttgttcaactcctcttgcatcgccatcacccaatccggatcattaagagcttcttccacccttagaggctcaagagaagacacaaacgagtaatgctcacaaaaatttgcaatacgagaatgagtggatactcccttgttgatgtctcctaagatgttgtcggtggggtgatctctttgaatactttggtggattcttgggcgagctagattgatcggtgagggtggcacatgctcaccttcttcaccttgatccaagcttgaagtagagagatcgtcggcttgggtcgatgtaggtggctctactttgtgtgaggaagaggccccttcttgtggctccctaggacgtacgtccccaagagccaacctcttgattgcttcgctcgggtcctcctcatcacctaacacatgtgagtcaacttgctctacttgagagccgttagtttcgtcaaatgtcacatcaagcgcgatctcaacaataccggaggttttgttgaaaacgcggtatgcgcattcatttgacccatacccaagcaagaacccctcatccactttaggagcgaacttagaggatctagccttcttattaagaatgtaacacttactaccgaaaacacgaaagtaagagacatttggtttgttaccggtaagaagctcatagggagtcttcttaagaaggcggtgaagatagaggcggttgatggcgtggcatgcggtgttgacggcttcggcccaaaagcggtccgatgtcttgtattcatccaacattgtcctcgcatctcgatgagagtc

SEQ ID NO: 91920 - DNA, 2807 bp, Oryza sativa
aggcccagcgccgccggcggccgctcccctccttccctccctcccctccagatctggctagagggggaggggggaggggggaggccggtggcggctcccctccctcccttcctcctagatctggccggaggggagaggctggcggcggggcacggcatcgcgcgtgggcagggtgtggatcagccggaggcagcggggtgcgtccgtgcgatggcgacgatgacgtccgtgcgaaaatttgtgatttgatttgatttgatttgatttgattgtgaaccactatgatgtctgttaatctgtgatgtttttgtgtatttgatttggtttgatgttgaatctagatgggggaaatgggaggagaatgagaagctactgctaccggccgaaacggcggtgggcggtggctgcctattttttttaatgccaggtgctattttcgcaggcggaccagttgtccgtctacgaaaatcaactattttaacagtcgttcagttgcagacggacaattggcccgcctgtgaaatcctgtttaggccgcctgcgaatttctagtagtggcgtcgacgtcggcgagcacggcgatgagcgggcagcacggctccctgctgggcggcggcgccgcccccaccaccgcgtggatcagcgcgttcagcacgctcccgcacacccctagcttccccacctccaccggtcacttgccattgccatccgccttctccaccgccggcggcgcggcccgcggaacgatcggtggcaggcagttggatttcccgagtttgcacgccgccgacggcttagcgccggtgaggcacagcacggccaccgccaccacggcgacgagggcagcgtgcgccgtgatgctgctccctgtttgcgccattaattcgctacagctaagctagcttttgcttgttagttgtattgtgcttattcttcagctaacttgctttgatagagtatttgtaggggattataggaggatatgtatggctaaattaggcatcggtgattagcctgcttaaataaggagtttcatccaggtattatgcaggggactttgtggcagtttttgccatcttaaatggaaaagattcagttgtcatatcgtgtatctgtggtaaatacacggtatgagaaccgaagcttttgcccagaagataggggtaattattcacgtaggattattttttgatgagttggagaagagacgatagaagagatagcatgggtaactataaacaggtacaatagcatacgataagccagttataaatatattttaaagagataaaagaggagagagtagagcagcgggctacagatctgtagccagctgcagcacggattccaagataaaacgtgtgtatgacatgtgggaccagattaatagtgtagtaagtaactattatacgaattggctattaatttggctatagatgatttggagctagtagttggctatactattaaacttgctctaattggtcgtgtggctgcacactcagcccaaggacggagtcctcaccggagtcgtcgatgttgcatcccacgggctactgccctcgtccatggacaccgacgccaacgcctacgtcctcgtctgatgtcaccaccgccatcctcgcccacgaacgccgacgctgccctcgtcctcttccgccaccaccttcatcctcgtccgcgtccgttactgacaccatagtgtgccactgtcgatgcccttgtcctcgtccgtcgtgtcctccaccgcgctgccgctgccctcatctattgttggtgccaccgtccttgtcctcatttgttgcagctgccgactccctcgtcctcttccaccgcgctcgtcgcctccatcagtcactgctgttgcgctcgtcctccgtgtcctctgccaccgccgccatcatccaccatgaccgctgcagccagcgctatcaccgtcttctcgagctggcgaccaccgagcataaagaagacaaggaaaacggtaaaaaagaaaaataggcactgaagaagtggtgggaggaagaaagagaagggacaggagaagatagcaggccccacaaaaatagtagactaatatttgtgtggtagtataatatttttattgtatctttacaatccgcttctcctctcttctctcctccaccttagtatttagctggcttatagcctactattatacttgctcttaattacaacagcctgcaggctagctgcttcatgcatgtcacagtgatagtcgtcagtccgattgagtatgcatagctatggtcggcctgttagtgtggtgacatggtgagtgtgtggctatcctgctcagtcccaactacaatctgcctccttccaatcaggccttcttctccgccaatcaactcgttgattatccccgtcgcttcgtggttgaagttctggtttttataaatacatgactatgaatctgtacagtctatcatcatgatctccaggtcccttctagccaaacataaatatttgagctctgttttgccaagatgctttaactctagttctcgatgcatccagttcctagcagattctcaccggtcactaccatctccttcctgctagcaccctcacttagcaaggataaatgcatgtaatgacaggaacaggctggtcaggctctatagttttgacgtgtttatatatggggccttccccagcattccacatcaactacatcactactacagaggtgatttttctggacaccggccccttttggttccaggcgggccaaaagtggctccgcctggaaccaggcgaatgccggcgccgggctgtgggcc

SEQ ID NO: 91921 - DNA, 4621 bp, Oryza sativa
gcccacgtaaggcgaccgcttgcgatggtcggggggcatataagccccagcccgaccgttggtatgaaattccgacggtttctctctcataaacatccacaaaattaggggggaaggttttcgacctcaaatctttgattgggttccatataaaaggtgtagagcttgttctcctccttcatttgcttccatttttgtcagttttcatcggtggaatacgaagaaacttgcacttttataaatggaatagtgtaggcacctttttgttttttttatttttttagcaaatacataatgattccattacatgtttataaaagtatttagtacctacattgaaaagttgggtttgcctctattaaatttattttcatttggatgaaaggatgattttttttcattttttagaaatggacagtattttattaatgcttaaaatcactgtgcggctatttaaatagttcgtaaaactttaaattaccatgtgattcgttccctccaatttaaatacattcgtgtttgaatcgggcatggatgtattaatgacaagctttattgtaagtcatggatcagacatggatgtacaacacgaaaagagctcatccaacgttcttgaaggaagcagccaaatttgttgagctcgcaaaggcacatgctgtgagggagaatttgaggaacattttttgcccatgcaaagtttgtaagaatgaaattttgctgcaagatccgaataaagtattgtcgcacatcgtagaatgaggatttaagaagggctacgagatatggacctttcatggggaagtcaatggtcgtaatgaagagttagatgatttctgttttgatgatgcagaaaattttattgtcgaagacatgtcacagggaaacatcccggaatacggtggctctggtatagagaatgaaggtattgattttgatctggaagatatgttgcggcacgttgaaccagagatcctaactggtacaagacgagggttggacaattgggaagcgttggaaaaagcagcgaaggagcttctgaacgacgaagccaaaggatgcgacaaggactattcggtcctgcgctcggtgctcgaacttctcagattgaaggccagacatggatggtcggacatgagcttcaatgatttgatggatcttttgagagttatgcttcctaagctgaacctgctaccgacgaacacatatcaagcgaagaaattgatatgtccattgtctctaggtgttcagaagatccatgcatgtgaaaatcattgcatactgtaccgcaaggaattcgcggatttagactcttgcccaacatgtgggacgagtcggtacaagacgggcaacggagcctccgatagagaggtggtcgacaaagatgatgcaccggtggatgagaaaaaaaagattcttaggatggtgatgttggtacctgccagttaaagatcgcctgaagcggctattttccaaccatgacgacgccgagttgatgagatggcaccaggagggtaggaaaaatgacggtaagatccgacaccccgccgatgttcgacagtggaaaaactttgatgcactacactcggaatttgcaaaggacccgagaaatgtaaggtttgcattgagcacggacggaatgaacccgttcggtgccctaagcagcacacacagcacctggctagttctgctaacgatgtacaacttgcctacatggatttgccagaagcgaaagtatattcttttgtctatccttatacaaggatcaagacagcctgggattaacatagatgtgtttctggaaccattgatggaggacatgcaagaactgtgggaggaagggttacgaatgtgggacgagtaccgtagggaacattttactctgcatgccatcatattcgttacgatcaacgacttaccggcaaacttttcgctctcgggctagtttaaggggaagttcggatgcctcctatgtatcgacaagacgtcgtacaagtacctcacctcatcaaccaagggtgtttacatgcgtcatcgtcggttcttacctcagaggcataggtggcgtgcgaaggccagattattcgacaatacagtagagaacgatctagctcctgaaacacgaacatgtggctctgtcttcgagctgacaaagaacattaaggttgtcttcggcaagccaaaaaagaagcccgtcaagaggaagaaacggacggatcaggaaacaactgatgcacctttagaggaaagtaacctgccctttaagaagcactcaatttttttcaggtatcttgattactggaaagacctggaggttcggcatgccatcgacgtaatgcaccttgagaagaatgtgtttgatagcaccattggcactttactggacatcccgagtaagacgaaagatgggttgaagtcccggaccgacctcgtcaatttggacataaggcatgagctttacccaaaagagctgccaaatggaaagatcgatattcctccggcttgctactcactaacacttgacgagaaaaaatctttatgtagatgcttgcatagtgtgaaagtcccgactggtttctcagcgaacgtcagaaaacttgtatctttgaaagatttgaccatttctgggtacaatgctcatgattgtcacaagatgttaacagtcttcctaccgattgctataagagcggtcaagccagttcacactcgattagtgataacaaagttgtgctactttttcaatcgagtatcacagaaggtttttgatcctgaagagttaggcccccttcaaaaatttgcaatcgagacagcgtgccagcttgagatgtttttccctccagcttacttcaacatgatggagcatctgattgtccacatcgtacctcagattatcgagattggtcccctgtacctacaccagatgtgggcgtacgagaggtacatgtccgtcctgaaagggtatgtccataaccgagctcatccggagggatcaatgatagaggggtacacaactgaggaggtggtagaatgctgcatagattacatgaaggacgccgaacccatcggtgtgaccccccctttacacgaggggcggttagctgggatggggatcgtaggcaagaaaatgttctatgatgaggactacaaagatgtagcggaagcacgtagcagcgttttgcaatagctcgccatcgtcgagccatacattcaggaacacatgaacgagatccgagcccccaaccctagaagaacggccatttggatttgtaaagaacagaaacggaaatttcttgaatggttgaaggagaaagatctgccgttgggtgattcgctgaaggaaaaaactttgcgcaggctagcaaatagcccaactagccttgtgacctcatggcaagggtacgacatcagcggatataggttttacacgatgttcaaggacaggaaaagcgcagctcagaacagcggagttcgggtggaggcgtttgacgcatcaggtgagaagaagtcttactacaggatcatacaagacatttgggagctggactatggccttaacatacagatcccagtgctacgatggcaatgggtcagagacacaataggcgtattcgtcgatgactacgacctgacggttgtgaatcgtagcaagctaggacacaaggatgatccgtgggttcttgctgagcgtgttgctcaggttttctatgtcaatgaccctccgacgataagatggccattgctgtaccgggaaagcaaaacatcattggcattgatagcattgaatatgcgtcagattacaatcaatacgacgacgtccctttgttcacagattttcctaaccggatcaaggaagttgagacaagccttgacgaagatctgttttcgtgtgtgcgtaccgatggtgtttccaaaattgtgaaacattagtacatattttggagtgtacaacttagcttgtaaacaattaatggatgagacttattttgcgaatgaatgtatttctcactttatctggtcaaatacttgacttatattaatcaatcgatatgaattatatgcgaattaaattcatgtgcttaattctttgtgggttgaaaaatattatttgattaaataattacttgattactttattacatatttatttaatgtaggttgaataatttgtgggttaattaacccgaactatttttaattcgtggtttagtaatgtacattaaatatatttaatttgtggttcaataattatatggataataactacaatttatataagatttattaattaaatgtatttaattgtgctatattatacattataattaataaatgccaactaaattaaaattttgcaaaaaaaaaatggtaggagccttcccgtgtgggccacttaagcctattatcccgtgcgggcgtattaggtcacccgcacaggatgcccatgtatatatagaggaggcgggtagaagggctgaaattttctaagtccactccaccgacgctgccaggctgctgaaaaatccaaccgccaccgccctcccaaatccccctcgccctcgccgctgccgcctcctctcctcctcggccttgccgccgccgcctctcctcgagctcctccccctcg

SEQ ID NO: 91922 - DNA, 6465 bp, Oryza sativa
ctgtgatggaacattcaggtgtttatcgttcctaagctttatcgtttcttccgaattaatcacacgtacgcattttcttctgtatatacgagaaagatattatgtatatatctaatctaatgatctaatgatttaaaataacgggtccaccaatttaagtgaaaatcgacggtgagattagatagtgccatgtggcgaattgggagcgtttataggaacgctacatggcggcttaggagtgtttgtagaaagtttaatggacttttagtatataatagaatagatgttaagaatatgtttgataaagttccaacttctaattttagcttcagagttgggtctgaggagagttgtggagctgcctaaactcagctctacctatctagttcattttgtgagagagctccacccaactccgctcccattttaggtggagctgaaacagtttggctgaaagctggagctgtgccaaacagacccagtacgtcggctcttacttatcaatgaaatctcacaaaccatttttttttcatacaacaagttgtatgtaaatgaataaaaaaaggttgagaatggtctaaagtagtgcaaaggtaagatacccggttcaattaaaaatattggttaaatggtaatctaaaacagaacatccataataaaaaggtggtccaaagtaaaatttactttttcttttctttgagaggatttaattctcagataacggaaataaaacaaagaaaagataatgactctttaaagatttttagatccaaaccagacaattcatgtcacatgtggacacgtggatgaccaacatcgaaacaacactatctctatctaccgcttgcatcatcgatcacagtatcctctagaaagttcaattgatctctttcctctgcgtggatcgttttcttttacctacggcacattgcaatctgtgctcaaggccacgatgcatgattcttcgcccaaatgaggcctaatcgcacccacattagactcccaaaaattcttatcgattgcgtaacactaatcgtcgtccaaacacttctctgactcttaatcgtgctcggatgcactgcggtcggcgggcacataatctcctacgcccctcccccaacaaacgcacgcacctccgcaaatcatgtcatgtgccccccacgaggtcgcatgcagttccaatgccaatcgctcgcgatcctttcttcttctcaaacgcagcttgggcgatttaggctaatgcaaggatctacatccccttatataagcattgtcgcactcatcacgtttgatcttgtaccaggcgtgaaggtgtgtcatctacctttaacctaactagatgaatacccgcctcgttgctgcaggaaattaagttgtataatatgcacaaatcagatgcaatatgattattaaaactaaaacaaattgatacttatgaattttaagcctaaaaataattgagatcgcatggtattacgagatatgaaagaagaaacaatttaaaccatagatttattatttaaaggctagaaataattgagaaaaaacataaataatattaactacacttagtggggatcgatgaaatatatgtataatataggataagcctagcttttggttcgtgccacaactatgatcaggctatccatagaaatttgggacctatgccttatatttaacgctaacaacaaagagctatactaaataagcatatccacctattaaaataggggtgatctaactaagaagaatggttacaccaatttagagcccatttagattggtgccattttaaactatatctttttcttaagtcgataaacatgtggatgtgtttagtttgttaccaaacattgataatgtataaataattttggttacaacatatttagtttatcctaccaaaatttgataatattaccaatttagtttttctgaagaggcccttaatttttgttactaagttaaacaatggaatccttattgtttggaacacacacttatattgttatcacaagatacaactattcgaggtagctatggttgtcatcgaacacttaccagagccaagaaaaaaaatctcgttccacccaaatctaatggattagaagaaatgactttgaaaaaaaaaggtaaaataaagagataccaagcatattgaaatgcattggtgtagattgaaaatatacgattttagggcctaaattttatggccatgagcggtcgatcatcttaagcacagggataggtgtagctatggtataacaccacttttaagaaatcaagaccattcatgattagtacatttttcttgccacaacttgtcattcactgcacctaaagcctttcagaaaacttttcaccctgtcaaatcgaatgtttggacacatgcatggagtattaaatataaaaaaaactaattacacagattgcgtgtaaattataagacgaatcttttaagcctaattgcgtcatgatttgacaatatggtgatacagtaaacatttactaatgacggattaattatacttaataaattcatctcacaatttacatgagaaaatataatttgttttattattaggctaagtttaatactcttcaaatatcaaatttgtgtccatatagacacggtctctctcccaccgaaacgtaaagaaactcgcgagttggccccacgtttcatcctcacgaccgtgtccaacccagggacccaaaccgacctccctcccaccacatccccagttccgccgcctccgcttccgcatcgcgccgccccggccacgaccttctccgtcgtcgtcgtcccgtcccctgctccgccgcgtcgccgccctcctcggcggccgcgtgcgcgccagccaccgcctcctctcctcctcgccgtcctccgccgccgccgccgcagccgagagggcgtcgccgccgtcgcccgcagacccggataccgtgcacatgacgatggctgcatccgagtatgtccccttaccttcctccccttcgttcattccctcaagatcgtgtctcccgtattctgtgtggaatataggcctaataggaggtttctgctgaaaacttttggtaacctgatgttttctgttttgatttggtaagatttgatttaggtaatctgtcgtgatgttctgggaaattatgcggcctcccttttgaggtttttttggggctttgcactgacaaaataccgacatagcgaattgaatttggagtcagctagtcaccgtgtgctatgttaatctgctttggaaatgctacaactggaagcacattttctgaacattttcactagttcagtaaggggggaaaatgcaaaggcctgcatgagttgtatgatatcacagaattctatatgtttgggtatgacagccacaaaaattgggtgttggattgcttttttttttccttctaaatggaagattatgttggaatctgtgaagtgtaggataactacaagcaatgaatcataaataagttgttccgatgctcagagtgaaaaactataaacaatagtattagacagccgaaacataatgttgtcagcactttgatatttaagttattgctcacaccttcatttcgcgttcccggaaataatagaggggcaatagaaggctttgacgcccttcattccattgcgccagagctaaatgctgtgttgattatacaagtttgtttggtcacctacccttgcctatatttctcactgttgaaatggagtattctttttgggctataccagggtttctgtgacaggatttcaattcttgttacatgtattcagggtctctagatgaatgcattttctgttgttaatactatacagtagaagtggtttcatatgcttacacttatatcccatatgtttgcaaaacctttaaaatattatgaaaattttgaaatatggacattgctaaagggatttcctgaaatttcatcagagaggtgatattctttttttggaaacaacaaatatttcctgctctttttttgtcttgatttattttcaactgttacatttgaatatgctacttctatcacattttgttcaacgcagtaggaacatttgagaatttaatttgtgccaagttgacttcaaatatgcttttggtgttcaggatgtatccccctcgttttacatactttcttataattttagttttcctaacagttccgcatttttgtgttctttggaaacttaatgcttcacagagattaaaagaattacatgctaaagaaccaccttctgaaggtaagatgctgcgattaagtgttgaagctggtggatgttctggattgcaatattctttctctcttgacgtcaagaaaaactcagatgatcggtatgccaattttcctgactggtttgtccattttagacaagtttaaattctgtatttcttctaagcatttttgtggaaacttatgaacagagtgtataccttataggtgatttatgcagtgagtgttgcacatacttcatcaatagttttacttatctcaacaattgttgttacacatgtaggatctttgagaaagatggtgttaaattggttgtggacgatgtctcatatgactttgtgaaaggtgccactgtggattatgaggaagaacttatacactccacgttcgtggttagtttaaatttgacctgtttgattctcgatttgaatactctcaccatggaaacatgtttggtcaaatcttccgctggatactaaagttgagaaagatgtcagaacttctcctagtgccaattttatgttgtgaattgtatttttactacgacttctcagctcagtaggcatatgcataaaattaaaaggcagaaatacttttctactgagttagctagtagctaccaccctatcattgtaagacgaattaaagaaatgatattggtttgatcattttgggtaaaaagagcaatttcaaaccactagacaactgcatgtttatttctttttaatatcaagatacaatgcactaaaaacaaaagttccttctcgtagattttcacaagtcacatgctggtgctgcaagcttgctgatctgttagtggtgtaacaaagatgaattattaaatgaataatcttttccattatttggtctggatatttaaatctttttcctcttccaccatatatgtttctctggctcttcttcatcatgacaagtgcacacatggtttctctggtctgaaggggttattggtggactggggacatttaggtgttagggatacattattttagaattagttgtcctccttgccctttgggtgttagggagaggttactttacaaatacttgtcaaccttgccacttccatgaattttgtgctctacagcaatcagcatacattcaacatgatattgttctaaagtttggattcagaatgtattgtatttatattggttacagcttatattacttgtaatctgcaggtgtcaaccaatccaagtgcagttgggggctgcagttgcaagagttcttttatggtcaattagtttcagctttagtagcttgatgagataggtaatatgtgatagcattctgtattgaaatatacttcattgatacatgtgtacaatttggtatatttggtggttccaaagatattatttctactgcttctaccttgtgattcttgtgattacaagttatgtatactgaatcatttggccttcagtatttatttgtttgttgcttctttcaaagtgctaaataagatgcaatcttttgtaacagtgatatgagtgtatatatgtcagaattttcttactatcttgaggttgatcctagtgctagtatatataatatagggtgtggtcgtttttctattttgtctgtggtgcattggtaaagtatcaagagttccttgtacttaaaagattgatcgcatatgatttctgtgcgacaagtttatctcaatgaactaagtccctttgggtatgatctttttgctgatatgttttttttcgtcctgagtcctgagtacacgatctagcaccatgctttacttcaaactcagtgattcccaggcagttgcttgatatctttggtgatcaccaggtatggtgtttgtgagatatcactttctgagtagcagacagttccaaaaggtaaatgtactactctgttcactgaagatcgatctgaactagttgttttacatggcaagaagttgagaagagatcttatggtggatatttaaaagcttactgcccgttagagtgatatattctctggattttcataggcatatagagccaacaacttgataaactcctcatattaatctcttggttaatcctcaaaaccacaatgttttgttctacagcattgcagatctaagagcagaatgcaactacgaaggcaaatcttcaaatctagtgctttatctaacttggaacatattgtgattcctaatcattctcctggatt

SEQ ID NO: 91923 - DNA, 4576 bp, Oryza sativa
gaattcattaatgtgtctcactgtctgatagtaggtgtgtaaacgggacgtgtattacccgctatcctgaccgacccgaggcttatgagactggtactggagagtgaaatgaatacttgccattatccatcagaatttgaacctaggagaaaaataggataggttatgttatgagttgtagccgtactattaaacatacaccaaaatctattatgactccacttatgaacatgataaaagatataaatagtccttatatatttatgaactcgcaaatgaatccctagatccatccccatttaacagttgacatgcccaactaatcgggttctctaattgtccctaggcttaatatcttagtactagagataaaaatccgttcttggatccaattccgagggaaaaaaccgggataagtaaatcaatgcttggttttggctctgaagaaaatacaagataggtcaaaaaagagtgctatccgatcatatctgacctgattatacccctatttgatagtataatttattggctaaaccatgaaattcttttgcaggaggataattttccagaactgctaagcggcggtttcctcaacccaaatgatatttcactcgagttcatccaagtttctatttctttttcctcttgtttgggcaaaagaagtctaacttccggccttcgcaccaattctcttccataccaatttgaatggagcttatgtatcgagcacaacgataatccgctacaacttcgttgcataggtttgagggtccgttatgaagtttatctgtatcaagacagtgaaggtcgaccaaataagttgagcatagtggttgacatccctgagaatctcagacaagttctagaattttgtgatgaaatagctgagataacattccggaagtttgggagcaattctgaatggcggcaagtgattaaggaatacgggaatcgtcctagtgtacgcctaaagtgagttacattgctctctgattcttttaaaatgtaaaaataagtgccaagtgttcatgcttctgtgatttttaacaacaacaacgatacttcctctgtttcgtattatatttataagtcgtttgaatattttcctagttaaacttctttaggtttgactaaatttatagaaaaatatactaatatttttaacacaaaacaaatattttatcaaactatagtcaatgttagatttaataaaactaatttcatatattagatattgttaaaattttactataaatttagtcaaacttaactaagtttgtcttaaaaaaaagatcaaacgaattataatataaaaccgagggagtaacaacaaccacattcccttttcgcagcatccccatcgtaggcagcggcgacgatgcgacctatgcgacagagatatacctgaaagaggctagcggcaacatccggaagaaggatttcagcaaggcagatgtcgcagagctggaatttatgttttttcgaggggacatggtcgacgcgttcttctctgtggaactatacgactacaaaaataatgctggtattcggctggtcgccaagaagttggttgtacactgcaggtagcatgcatcactaggctaaacagcagatagactgattattcctcttccttccctctctcctctatttcatcatctctctttatcttccggtggttaaagtggcgactggtgggattaggggtggcatgagttggagacggcggtgacctcgttggtgggagagacagtggccaagagaggtaagaactagccaggcagaggtttgagttcatgcttatcaccgtgttgaggaagtagctgggaggaggtgatccggcctcgagctccactacagcaacacacgtggtggagatgggtcaatgtctagaggccgagcttcatggcggtggtgtacttcgtcccccacaacatggaggccactgagagcgctagccctgtccttgctagagaaccagtctggcgaagggctagctgcctctgcccctctcccttctccctaacaacagcttggtgatagctacacatgcaatagcaccacccttggtttcctagtggaggagaggtttgtggtagcggaggcgaggtaagcggtggcagagttggatcccgttgtcattctcgtggcagcagatgacatgaacaacgacgtgtatgtgccggtggtcttcaagtcagggtgtccaacctagtaggccacatcgcgatctcaggatgccgactctagattccattgctctcgaaggcaacataagcgaaggtggcaactagagttgtcaacaagccaaacttgagcgagcctgcctgtataggctcgacctcgacacaagctcgagccgagcctaatccaccttcgagtcgttaagcaggctcgactcaaattcggttaggtttgcgagctcgaccgagtatatgataatgtatattttgatgataatttttatgtaaaacaataatttcaagataacaatattaaagaaaaggttaggagaacatacgattaatatatgataccaaaacagactaattattttacatgaatctgtactcatttatccttaacctagtcacttgttacacaagacataaaaatcaaacatacatctaggctcatgagaagctcaagctcaacttgacgaaagctcacaagcttggggttgggctcgggcttggctccttaagagctctagctgagctcgtatcaaatctaagacgaaccaagctcgagcagcccacaagccttaagctttttttataggcctagctggcaaccactagatctcgcgctctctttagccttgtcaagctctgcaccatcacccctaccagttgagcaagtcatgggaattgggaaagacaccaccaccaccgctgtcttaggctccagagtctgcggtcctctctttctctccctagtctcctctctctacctcaaagcttggctcgatgcttgccgagaggaagatggcagctagagaggaagaaagcaaagatacttactgatacgtgggttccattgcatttatactttttttttcatatttttcttctggtgctacataagcaccacatgccctagacttagttggtttgaccaaggtcaacatgtcacatcagcgagaaccacaaatcaacgtgccataccatcaagaaagtaattttacactagttttaataattgaatgggttgatatacctgattttacgatatgcatgggcatataaatcagattcaacctacagctgagggagtcgaattggactctttccgcgtgaaacgcaaggcagcaactggttccctgcacgtgaatcctccttaccagaactgagtaagtaaaattttttggcacggtattttctataaagaattttttaatataagtcaggtataaagatgcacttttaaaaaaattaattacttctagtactccctccgtcctagattagagggtgtttattttttgggtttagctcgtgccattgagatacgttgtttctaaggttctatggatagtttcattctggtaccattttcgtttcaaatgttctactatttcgattctattcccaataaacaatatatatgcttgtggaaatagtttgagcatttttccgaccattttcatccataatttgaagccagctgtagagttgtgtggatgccaaccgtagaatttctgtctgttcgatcgatggttgagtcttgcaagttctcttctagctatatatgctgctatggtacaacaatcggatggttaattgatgaatggatgacagggatggatcaagatatggccggaaagcttgattttggcaaaaaaataaggtaggcgatatggatccctagctggctagatccagcatgcatgccaccccttttcatcatctagtcccattgttctaaaaagaactcaatcctgactttgaatccggttacagtgtatgttcaaattaaacctaggattgggtatactcagggttggaaatttcggtcattttggatcccttcgatatgatattttttgggccaaaatttttcaatttttcatgaattttgataatatttgttcaaattcaactaaattttgttcaaattttggaaatttccgaaatttcggtgacgccagatcaaatcggctaaaccgaaagtataaccctgggtatactcacattcaaatctaggattgagtttgttttgggacatagaaaatatttatcaagaaagccaaatacggtactctgcttttatagtactcaaggacgaagaaagccacctccaacgactttagctttacaatgtgcgaaaccacgcaagcagcgtactacgttattaccaaacttttcgatcgaaaagtgaactctgatgagtgagtgggaagaagcagacaatgcaaaacaacctaggcacagcatcactgcatgcagcttctatcacaagccacaacacaccctggactcagaacccaacagctaattcctccgattaattactcccttcgtagtttttttttaccaatttttgaccattcgtcttactcaaaatttttgtgtag

SEQ ID NO: 91924 - DNA, 784 bp, Oryza sativa
atttatagataaaatgagttttggttttcaaacaaagggatacgaagaatttaaaggaacaaatttgctagtaagcatagaatttataggaagattaactaatagaagtgcctccaaatacaaaataaatgtaaatgacgtgattgaaaatatgcactctaagggaataactttcatgagccctttaaaaataagttctgaagaaagggcaggagaagaatggaaaattagtgatttaatcgaaagcaaaactttgagtcagcctgaaaattatataagttatcaaaacagtaaagggaataccagcattagatttataaattacaaacccagaaccacagatgacttagaaacagaagcatctgatagaaatataatagataatagaagacatagtgtttcagagtttatggaaaaattagatcaagaaagtgagataaaatattacgaaaataaattaaaggaaataaatgaagaatataataaatctatgaagtgtgagtggcctaaaataagagataaagaactttatttctatagagaattagctagagtaaagaaagtaaagaagaaagaagatatggcagtagaaatttttaaaaaccacgaaaccatgatagaacagataaagaggatagagcaagataagcatggcaaagaagagcaaaatcttggtaaaattttaagtgaagaagagcaatgggcagagaatgaaagattatttcttgaaagttatgaagaacaaattaatctaataaatgagatggagaatatagaaaatgaa

SEQ ID NO: 91925 - DNA, 594 bp, Oryza sativa
gcataataaccctcgaatcaatcgctaaatattttgcgcctaatccaccgatgttcagtgactctcctcgcgcaaccgcatcagacagtctcaccggcactgacgttatggcggcgcttggccttgctggccacaagtgcgggtttggtttcgatctttacctctcgaaaatcggcattagcagcccagatatagcactggagagactctatgagcaggcacgtaagttatcaggtaaattcagagcactgtctgaactcgatgaatcagctcggtcaggcgtgcttaaggttctctgcgcttttgcataccaggattattcaagaagtgctgccagcactcgaaaatgtgattgctgtgatggtggggatttacagaggcgcaagtgtttaccaacaaggtctcatacccatgggggaaaccgccttactggtcgaaaatgtcgcgtgccgttcgcccaagcgactgggagagctggacacaggcgcgtgaggtggtgcgagttaagtgcaagccgtgtaacggaaaaggcgttatcagcaattcgtgtcgctgccatggcaaaggtaaggtgctggacaaggctgatgaact

SEQ ID NO: 91926 - DNA, 2615 bp, Oryza sativa
gccggattccattctagtagcaaatttctgcaatattccatcaattagagcgaatattaaaatcgctcgtcaggttggaaaaaaatggttgttgatttagttctcgttaattcccaagcatgctgtccgacattggcatgttcctggattcagatttgataatggactgatcaatctttgttgatttggtaagtggcggtgacacgcatagggaaggaacctgcgggacggaggtgaagaggcccaagagctgtgcggatggcaaggtcctcaacaagaagaggaactacgcgcagttccacctggagcttgggcagcccgattttctcctccacatgtgctcggtttgtggcatgatgtatgcccgcgggaacgacgacgatgagaaggctcacaaggcataccacaagagttacttcgagggtgtcccgttcaaggtgttgcacctgatgtatatttgtgaatctcactcttctgttcatctcgtgttataaatttctgtgaagagtttatgacaaatgtttgagttgcagggttggcgcaatgaaaccgtggtcgcgaggtctgaaggtggggatcggataattcttgtgactgatgaaaattcatgtgctcggaacagcaaggtattttgcctgaatgactaactgtattgcctagatagttgaaagaaatcactagttggggtcttggggaaatgaatattgaaaagagtgggttcctcatagttctaaactgtagaatgtgtgtctttactaactgcgaagtttctgatccaattttgcaaccactttacatttacgagaagttcagaagcagattgcagacattttatgattatgtaatgtcatgtgaatatttcaggtccaggaggtgatcaaagtggtacagaaggagctggggtttggtgaaggtcagctccttcacaagctttgtaaggtaacatcagctcttagttcaaatatgacaacatctatgcacatatattcatcctaatgggtaaaacctcatttgcgttgcataggtatatttgttcatatctagtcagaggatagtgggatgccttgttgtggaaccaatcaaaacagcacataaagtgattccaggctccacagaggaaaacggcagtgatctgcctgttgataaaattgaaccagtcaaaacaaaccatacattagcgttcgggaaaatcagttttaagagggaagtcctgaaacggcatgatcattcagacaagaacaaagaagagtaccgagatcctggtgctataatatgtgaaaaggaagatgttcctgcacattgtggatttcgagcaatttgggttgtaccgtcacgcagaagaaagcgaatagggtcacaactgatggatgctgctaggtaagttctaagtttgatgcgcattctcacctactttgcttcacttagcatctttctttttcgcagcattcctgcaatgcccgtcttgaactcttgatagcatacattgttctttttggggggaatacgcaaaaggcttgcgcatcattgcactaagagaaggatagcatgcattgttctctgtaacaacaatgtatagatccatcatagcatgcattgtcaatttggacaaattccaagcttttgaccagattataggactaataaaactatttgttaactgacatcacactgcaaatatcactgaattatttatctgtctgtccagttgttctcttctatgctctgcaagcatttccaagagtttgatattatcttatcttgctaaggcactctccattcgtcttctgcagaaaaagcttccttgaaggcgagactttgtgcatctcacagtgcgctttctcaccgcctacttcctccgggaaggcgctggcacgcagctattgcaagaccagcgcattcttagtctacaaggagcaagatgcataggagatgctgcagaagatgttacatatctgaaacttctcttcccattgtaaaaattgttttgctggggatatatgtgaaacataaacaggcatgttctgtttttagtgtaagtctaagcaccagaagcagtgcgtttttgcaggatctctatgtattgacactttggatttcctgatcagcagcattttctgaatatcatttcatattagtagcttgcaatcttccttggggaagatgagatctttatcttccttggggaagatgagatctttattagtccttgggagttattaacaagcagagttatcttctagtgttaacctctgtctctcaatactctcaaaacccaagaaaaacacaggggaaacagtacaagccgctgcaatcatatgggaacatgtcacaactttggtcaatatatacagcagaccgatgatacaatgttctgataactagtcagaatcaacaatgggcgacactgatgcttgtgcgccagaataatacatcttttaatgttttctcctcgtcaatggaccatggatggctgcatttgagtactcatcaaccactgattgtgtaagtgatggacgcaaggatcttagcgcggcctggaagtgaatatcgtcacatacaaaacgttctgacctcagactttccctcaaggccttcaagatctgcgcccgtgaaaa

SEQ ID NO: 91927 - DNA, 1743 bp, Oryza sativa
agccaatacaataattccctacatcaaaaattgcaagatacttttttagtacaaagaaagggcatatatgagatatgacaaggagagtcacatttgaatgccatcgtcaatctaaatatgtaagaggtaccgtagccagttctaaaccatccatttccgtcaatagagttgataagagtctttctccaaccgtggcattgccactagagttcccgctgggaccagttctgaacgattacaaactccaatattaacattcactggtcagatgtggaacatgcgcagaagcaaagttttcataaattgattctactatatgaaaataacatttggggaaccatatccaacaaaatatgcttaacacttctgacacctcttcaacttcctaatcatgtacaccatggaaaagatgcaaatattattattacgtaattatttttttattagagaagggtattttttacccggcctctacatccaacagatatatacggccattaaaatagggaacttagccccgcaaacaacccaatctgaaattcgctccataggacggccattgaaatagggaacttagccccgcaaacaacccaatctgaaattcgctccatagaagatttgaactcaggaccttggggtactactcaggtcattataaccactaggctataattattacgtaattatagaagatagcctataacaattcatgcacattcttatgatgactgtacagaatcatttttaccaatatcatgcatcatgtatcatagatctcactagtatgtgccacaggacaacaagagacaagatataaatgtgcaccttttaggggcaattgcatcagcctcatcaaaaaatataatgcttggagaagcaagacgtgccatctggaatgtacgtcgcaacaaagcttcaccttcaccgacatacttggagtataactcagcaccactgtttgaaaatgtgtaagaaatttagaacaacatagaagactgtatactgaactcaaaatgatccggttagcatgttctagctatattatttggactagcgtacaggacaacgattcaagcagcagaatttgaacaaattatgccagcttggtcttaacagtacatgaaataaacatgttaagttcttttgcttcctctaataactccttttcagtacatctgagattaagtgatgtttattgaatttattacaatataagcatcacatcagaaaatattatgcaattcacaggcttctttttgcatgttggaaggatgaaatgagaaaaagagagaacaatttttacgcagcaaaccttaatgaaaagaaagaagcttgggcagcatgagcagcagcctttgcaagggtagtctttgagcaccctggtggaccatgcaatagcaccccacggataggtgatattccaagtctatcaaatgaagcagcatgcttgatgggccattcaacagcttgctgaagttttttctgaagcatagcaacaataaccattaaaggaggtttgattaaagaaatcctaaaatgaggcatattttaccttaacagctttcaaacctcctatatcatcccatgaaacagctggaatttctttaattacccctcttgtcacactatttttggccacagatttagcagactcccaatcctccatgattagcgttagcacattctcactctctgatgagcttgataatctaccataagcacgtcttgcagcttctcgacata

SEQ ID NO: 91928 - DNA, 6846 bp, Oryza sativa
aaaggccttaattacggctccctccattttttcaataaataacgcttttgattttagtataacgtataactattcgtcttatttaaaaagttatataaatgttgtttgttttgttgtgaattattttgtcattaacatgcattgtactctaacatatttacactaaatttttgaataagatgaatgattaaatgttatttcaaaatgaatgattaaatgttattccatgtctataaaatgccagaattttatatgtatccttcttccagctccagcctcctgtccgattgatcactgtgaataagtgaccccagcagatgagttctcgtgacttgtaatatgcatatccgttgccttaaaaagaatacatataggttattgttgatctcagtaaaacagatggttcaagtatgaaaataaagagaaatatatcctgtaatttctcactgacaaatgctcgatcctacggtttacaatcgacaagttctacaaattctgtaagttccacaaaatcccagcacaagtattttctttctatttgtccgtcatacataaatgcttatatttcggaatagggagcaggtgttttggaacagcaagccttgatgctcctatttttctttcgaatcatatacacgttgctgatgtgaaaaggtaaaaaagaaaaagtagtaaaactgcaaccattgtactgcaatcattttagcaacaaactgcatctcagcattggagcgccatgggcggcagactgctcttaatcgaacacggtcagcgtgcgaagggaggcgcctgaggacaagaccaagtagttctggctggaaatctgcccaacttgaggactgttgtttagataccataatctaagaagaaaatgcatcgaagtcagagtttaccaaagtaaatcatcatagtaaattgcacatgtttcttccatgtttagaaaaaaaaaatggtgcttattgttgtctacacagtaccaacattaatcagcatctcttgagaacagaagtgcgcttagcagaagggttggtcctttccgcgctaataataactatgtgatggaagaattagcatagtaagtgactatatgatctgttaaacctatcagcctatttatttttttcgacaaaattataaacaagggcatctttctcatcaatactaggtgccacagtggaaaatgttacgatctccgtcctaaaatataataatctagaatctaatggttctggtattacgaatctagacaggaaccatccgatcctagggagtagtagattcagggaaattgaactccagcactaagatcaaatcagctacaaagggcaacagaatctggcatttggagtatcgatttgtcgaaataaaattagggcttagtgtaagggagctcacctgcttagtggttaggacctgatgaacggtcggtgagaggggacgaagagcagggaaccaaccaagaaccaactccgtcgccggagatcgactagtagcagcagacgctcagtacgtacggccgtggaactcgtcgccggagatcgactagccggcaacagccgctcgtgtccaggcagtgcgccgtgcgcggtggctttctccaaagtaggtagcccggggaggagagggttgagggacggcgtccgcgcgccttggtgcgctccggcagggctccctcgccgtcgccggcgagcgcgcgatcgtgtcgcggcctcttggtgggaacagcgaagagcaggggaaaaagatggcgtacgaccctagcatagattggttttgatttgtgtttaaaaaaaataaatttcgtaaaacccacctattatatgctaaagtagtagtacaagtagagggcacttgatatagatttaaaaaaaatggataaatgcgtaaaaccacgctattgattattatccacattttctgcagcatattagagcaagtttaatagtatagccaactactagctctaattcatctatagccaatctaatatctcattcatacaatagttacatactacactattaatacatggccccacctttcatacacacaccgcgtcttggagtccgtgctatagctggctataaatctgtagcccgctgcccttctctctccttatttatcttcttaaaatatatttgtagctggcttatagcctgctattgtacctactcttatagccttagatattatagctattagtttttacaaaaccatgctattgattattttgattttaatctatcatacttctaagttctataataacattaaatttatgagtttttttatccatcatttaactgatacgtttgtcagagttatggataacacatatctaatagtagttaactaaatctcggcaggacccaccacatatcatgtcttatacggaaacaaccttcggatatagaaggagttccgcataaggaatgataatagagttctacatggaaacgacaagtactactcagattgtatccatattagttttcctagttctacttggataaggggacacctatgggtataaacataagacccctaggaggagaggggggacggaacaatagatcaagacacaaaatcaacatacaagccaacatacgccaagacaagacgccggatatcgaattcagagataagcatagctagtcccctacggtgtctacagattctgtcaggagagacatagcgccgtctgtgatctcgccgggcacggattcgaagaggaagactaccctattgtcgactacgtgatgatacttcagaccaccaagtcgataacagatagatatgctaccccaaatattgtattggtgtaattatggtgaataagagcaacgaccggcttcggccaacgggagtaggattattacctgacaatttagggacccgaacctgtataaaaatcctcgtccccatctgttttacctcagtctcgcatataccctgataccaacaatccccatactatgcaaataccggaatcgcgacatcaaacgtcgacaacgtttatgtaagcatttttttaaaaaagttctgaacttctgatatacgaatatatcaaattggttaatggtgtggtttatgaaactttaggatcgtaatacctgggttatataccacgtgtcaaaattcatatagttttgtgcaacttgaaaaaaaaatatgtgtggctttatgtaatatacttaaaaaggttacattgtatctcgttaaaaaaagggttgttaggaataatatttgaaaaaatttagtaagagatcctttgttctcaaaatgtacatattatttacaaatttgagtctaaaaatattttgagttcaggcttctagcagtagtaaggagcactcattactgaactatttgaagcatacaaaggataccattaataaaaatgaaaactaaggttaatagtcgttgtgtgagtgtcggggtttacccctgtcacgccccgaactagtaccgaccggaactagcccgtgacgctccaaattaacctgttaattgataccagtcccaggaaacagtgctggtatcacaggaagacagattatcacaacaacagaggtctctttattatagagtagaggtacagtcatgttgggctgcggacagaccccgagctcacaactacattataaaagaaaaacggaagccaagactaggaccaaacatcacaggcgcgacttgggaactaggtcgaaaccctaaaactcatcgtagccggcttgctcctggaagaactcctcatcaacaggatccgcttcatcttcttcagcaatgggggggattatttatatagaacaagggtgagtacgggagtactcagcaagccatgggaaataagtgtttaatgcaggcttcaaggaaaggttgttgtttttgcaattgattttatttgaactcttttctaaaaacaactaagtgagtgcttctcaaacgacgcggataagacagtgcgtctcgtccggtcggagtatgtgtaatgtatcagtctttagaattgattcaaggttggcacccggccaacagcttttcaaacggccactagggccaacaactttcaaacggccacccgggcctagctgatcccatcagctgcagatttttcaatcatcgaacccctttacacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccatccatgtggtcgtacttgtcttatgtttgaatgaaattccaaggaaacggtccttaagtgcgagagcgggaaaccgtacacccggtacgttccccggtccgcggttttggaaattcatttagttcgcaagcaccgacccaggtgtcgggttttccaagtcttttgtaaaacccaagttttacccaagaagtttttcagattttaagtttgaaggcgtccgtcgatactcgcacagggtgcacgaatatcgagacgcaactagatggttacaaggggacacgatataacaattatcaaaggaaggatcaaatgcaacaaattaggtaggtccgctaatctgcattgcagacgggacaacagattaagtgcgatcctatcaatgcataatatttttcaagcaacataattaaatttcaaatataggctcaagatgttcaaaggtggcttgccttgctcgagatctggagcttgatcctcgaaatcctcgcgatctgccttgctcgagatctgggtcttcgggctccgaaactacacgcgaaacgggacaactcaacaaacggccaaaataaagccctattaatgacctctaagcgtgccattagatagatctcgagatttgaggaattttggaagttgaacggagtcaaacggatttacggttgggaagatattgaatttctaagattattggatttttagtctaaaggaaaaggatttaattaaatcctttttggaaaagaaaagaaaagagggagggaatatagacttttcctcggcggctagggcgcggctcgagagaattggggcggtccggccgagctaaatgggccggccggcccaaggcggcctagggcgcacgcgcgcgggagggaggagagagagagccggtggaccgggctcaccacgcgtggtcccgggtgggacccgcttgtcggtgactcggttcaccgtgcggagcgagcacgcggcgcacgcgcgcggccggggctgggacgcggtgcacgcgcgcggttcgcggtggaatggatgcggcgggcccacgcgcagcctcacggctcgcggtggaacgcgcgcacgggaggggctgaccggggtcggcccgacccgatctcggccgagctggtgccgacgtggcgcctacgtggcgcctacgcgggctggcgggaggaagacgaaggcgccggccgcgaatggacggcgggcggcggcggtttctccgggacgccttgcgacgatgaggggcgacggggcgtacaccgggatgacgagggagaatgagagggagcgagcgaacgtcttggattcgccggagggtgtccgtcggcggcggattgcggcggcggcacccggcggagagaaaagggagaaacggcgacgaggtcacgaggggccaattcccggcggtgagagcatctacgcggctacgggaatctgttgctagcgtcggattgggcggagctacgtcgagcgaggctggcgacgagcgggtgctacggagcacgggcggcgacggcggcgagcacatggcgagcggcggcaacggttggggcggcgccggctagctacggggaggctacacaagctactaccgaaaactaaggggggagatggagcgaggaggaagaacggagggaggcactaccgtgcgggcggggcgcagtgacgagaggccgacggcgcgggagtaatctctccggcctcgggccggggaagaggaggaagacgagcgcccggagtcctcttccgcgtccacgaacgcaccggttctcccggcgcttggcgatgaacggcggaggcaagacagagctcggaaggcggcgacaacaatggagtggaggcgatgggaggagaagagagggagggcgcctgggctttaaagggcggcaatgtcggtttggaaaccgactttgggcggtcaaggcgcgagctggcgctccggctagcggccaaatcggcgacagggcggagggaggatgacgccggcgggaggaaaaggggaaaaggagggagagaaagggggctcgccccttgcctctttgggaaaaggaggaggggaacaggggcgacgcggcagagggaggaggggctctgcctccgtcccttggcggcttgcgctcggagtggcggggccgaggcaatgacgacggcgatgactgcggggcggtgtggagcggaacggcgacacgggcgacaggcgcgggcaggcgctgacgacggcggcgaccaggcggtcggccaccacggcacgcgcgcgcggcttgcaacgggaggcgcggcggattgagcggcgcggctcgggcacgcgcgctgg

SEQ ID NO: 91929 - DNA, 767 bp, Oryza sativa
cacaaagctcagcaaacaatcctttcaaccaaactgattctttacatgcttcagcaatagccatgtattctgcttcagtggtagactaggcaacaacaggctgcaatgttgccttccaactcacagcacaactactaatggtaaacacataacctgtgagtgaccttctcttatccaaatctgcagcaaaatcagaatccacatatccaacaagccccttatcagtcctgccaaacttcaagcaagcatcagctgtacctctgagcctgaaaatccactgaacagctttccagtgttctttactaggattcgccatgtatctactaaccaaactcatagcatgagataaatctggacgggaacaaaccatggcataaatcaaagaaccaacagcactagaatatggaactctagacatgtattatacatcctcatcagtactagcacattgtaaagctgataatttaaaatgaggtgcaataggagtactaacaggctttgcatcatgcatgttaaaacgctgaagaaccttcttaatgtagctttgctgactaataaataacaaaccagaatttctgtctctagtgatttccatacctagaattttcttagcagcaccaagatccttcatatcaaactcactactcaactgtttcttcaatgtagtgatttgttccttgctcttggcagcaatcggcatatcatcaacatataacagcaagtatataggtgatccattaacaaatttaatatacacacagctatca

SEQ ID NO: 91930 - DNA, 1212 bp, Oryza sativa
gatgacagctaccagtccatcttcaagccgatcatcagcaaagtcatggagatgtatcgtcctggtgcagtcgtgcttcagtgcggcgctgattcgttgtccggtgataggttgggctgtttcaatctctcaggcaaaggtcatgctgaatgtgttaagttcatgaggtctttcaatgttccgttgcttcttcttggtggtggtggatataccatagaaatgttgcacgctgctggtgttacgaggtatctatactttcccccgtttttttttccttatgcctttaacaaacaattaattaattctattaattatggatgacaaaacaaagccatgagctcggtaatgtgttagaacctaatttgcttttgtgtttccactttgttccttgctcagcatcaagaacttgtcttctagtagttggtacctactgcctggctttgttgattgatccatgttgctgtaattttacaatcaccaaactaagattttggtttgtactgagctgatgactgaaatgcacagaacacctatctcccatttacatgtaatgcttaatgtatttattttctactctgtttcattcaaatgcattaatttgtgagaacttgtgcagtaacaaatcatccggtgtttctcaaagcattaaagtgtggttatttttaaacagataagtatcaggcaaggcactgctagctaactgttaacccttgcaaaatcatatgcttcaggccaccacctgttcctcagttgttagctttcatcagagatgtctttaataaattagcaacccaaaatctggtctctttggaccttgcaagcctggtttcgttgccttttgtgaatttataaatctgaacacacaacaggctaaacatggcgaacaagtggaatggctgcacttatgcttgcttgagtaaattatctcttatatcaggaacacctgttgctacagctatggttttatcctctgactgtttatttggttttttatttggccagacaggagttgcacttggtgaagagctacgggagaagttgccttataacgagtattatgaatattttggtccagaatacagtctttacgttgcagcaagtaacatggagaacagaaatacaaacaagcaattggaggaaataaaatgcaatattctggacaatctttcaaaacttcaacatgcacctagcgtccaatttcaagagcgaatt

SEQ ID NO: 91931 - DNA, 628 bp, Oryza sativa
acaccaaaatatcatggaagatggtgaacacaaggcattagatctcatcacgcgactagaaatcgcaattgatgtggcatcctcacttgaatatcttcaccaatataaggcatcgccaatcattcactgtgatcttaagccaagcaatgttctcctcgacgatgagatggttgcacatgttggtgattttggccttgcaagatttcttcaccaggacccagagcaatcaagtggttgggcatcaatgagaggcacaactggttatgctgctccaggtaagctcctaattgttgtagcttttttttatcatatttcatattatatgtatcctactatgctggattcagccaaaatggagtaagacttattggtacttcattttactacatagacaagttttgatgaaactcttatttccctaggaatttgaaaggggaaaaatgaacaagtatatggtagcaaaatgttgtatcctgtaaatggatttcgcacaaacataaataggcttgtggagttattttctcataagccatttcttatttttagagtatggactgggcaacgaagtctcaatccatggcgatgtatatagctatggtatattgttgctggagatgtttagcgggaa

SEQ ID NO: 91932 - DNA, 1349 bp, Oryza sativa
tcactgtgatctcaagccaagcaatattttcctagatagtgaaatggttgctcacgttggtgattttgggcttgcaagagtcctgcatcaagaccatagtgacatgttagagaaatcaagtggctgggctacaatgagaggaatggatatgctgctccaggtatgcttctaacagctacaatccacggttttctttctaatttattcagaaacctttccattgatccatacttaagtagatcgttttgctattcagatgtgtgcaatttgttatgaaaaaactcaaattcttgcaaatgataattatgcagcagtgtaaattatatattattagactgaagcctacatataaatttaaatataaatgcttaaacttgcaacaatttcctttatgtaacattttcttatgattacagagtacggtttgggcaatgaggtttcaattctgggtgatatctacagctatggtatactgttgctggagatgtttaccggaaaaagaccaactggcactgaatttaaagaagctctcagccttcataattatgtaaagatggcacttccagacaatgtgatcgatattgcagaccaacacttactatcagagaacaatgatggagaagaaagaaactcagatggcaaaagaaagagacacgagaatagcctgcatcatatcaattctgcagattggagtttcctgctcaaaggaatctccagcagatcgcatgcatatcggagatgctttgaaagagttgcagagaacaaaagacaagtttagcgtgtccctgcgttgaagcatcaaatctctgaataatttggcataataatccccaggctataatagatatttacagccgagcaaccgaagccttatcagcataggttcaggttgtatgagtagcttcatgatgttcacacatgcagggtgctgtttttttttagataaaggattatcaaacccggcctctacacctttgtggggtgtacacagccaaatgcagggtgctgttactgaacaaaatataagaaccatgaaccatttagcatttgcaggaagaatatgtaaatcgactaactgcacatacagttttttttgtttttgttttttcgcttgtaacctacaaactgttttgatggaagcattcgatagcacgcaagttcagagactcacagcaaacagctcctctcctgaaaaatcccaattccaatggttcagtactgcaactgcactaaactaacctaaaggaatggacatttaccaagatccattaccacaaagtataatgttttatgtttccccatttggttgagaagttgcaaactcaaatgcatcgacatcatcccaagca

SEQ ID NO: 91933 - DNA, 1194 bp, Oryza sativa
cgatcacgaaacgccctcagcaagtcgtcccgctcctgtaacgcctgttgaactgcgggcagacgacatgaacccggctagtaggcacgcagcgtcggcggctcgtgaccatagacgacgcggaacgacgatgttcgaagtgacgactgatacgacgtgttgtagcaatacatcgcgcatggtagccatcgaagccattgacacgaacgattcctagtgaaacatcgaagatacatcatgatgatcttgttagtcacctcggactggccattggatttaggtgaaaggctgatgaaagattcagctgcacacccgccaaccataaaatttcacgccaaaaagtgctggtgaagactggatctcggtcgctgacgatggagaccggaaaccatgcaagcggacgatctcagcgaagaaggcagctactaccgacgtcgccgtgtacggatgagaacgggatgaagtgggcaccggtacgatgaccgtcttgccatgtactcgcgggagcccctcgacgaagtccatagcgatgtcagcccacaccgccaaaggcaccggcaaggattgtagcaggttggccggttggaggtgctccgtcttgttccgttggcacgtgaggcacgcgcgcacgaaatcttgcaccgtcgctctgtcccgcgagatatggaaatccgcgcgaaggcgagatagggtcttttgcgttccctcaagtcccaagccatgcaccgactcgaggatggccggcaatgattcggatgatggcggcatgaagacgcagcccttgaacatgatgaggtcgtctgtgaacgcctatgctggcggtttggcacccttggtgatgtcttcacaaatggcggacagggcgggtgtggaggctacctcgcgggacaactcatcgaacagggagaattggtgggggggatgataaggcgaacgcctccgccaggtgttcgtcccatctagagagcgcgtccgccaccaagttcgccattcccaacttgtactacacgccaaagtcaaagccgaggagcttgcttgcccactgatgctgtggaacagtggagagacgctgatccaagaggaagcgcaagctgcagtggtcggtgcggatgaggaagcgacgcccccacaagtatggccgccaatggcggaccgcctggacgaggccaatcaactcgcgttcgtaggcagcga

SEQ ID NO: 91934 - DNA, 3660 bp, Oryza sativa
ccaaccgggagtaaagaaaagatctttagtcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattgatgacaattacttcgaaaaattatttttgtctgtaataaattaagtggataaatcgtaataagcaaatatatgacttataattaataaaaattccaatatatatatatatattcttagcatatatatgaatgatattattatattggtaaaaactctaattaagatattaatgtacatactgcatgatttaaaattaataaaaattgtaatcatcatatgtacttagcgtaggaattatattaaattaaatgctaacaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgaaacctctaataatcgtgagtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatatgtggcagttgttccatcgtttcccatggcatcgacacgaacagcgctgttttggttcgtgctcttcatgtcctgggctctcgtgtagaatgtgtacccattgatctcatatccctggaatgtcgcgatagacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttatgaacttcttctccttcgtgcttattattcgcttgatattcgtggagtatccagacggtacctttatgctctccaagcattcaaacatactttccttctctgccttgctaagagtgtagctggcaggactcaagtaatggcttcttttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcaccgcgtgaccatcttcgctctctatatgctggcttccaggcccctttccgaacactactttaagatctttaaccatagcaaacactgttttcccgctgcgatgtttaggattcgtacggtggtcggccttatgttcgaagtgcttgcctttctgccgtaccgggtggtttgctgcaaggaatcgacgatgacccatgtatacaaccttcctacagtgcttaagatacgtactttctgtttcatccatacagtgagtgcaagccttgcaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccagtgcgaaccatcggcggggtgtctcagcatcccgtcctgttgacgctcttcagcgtgccatcgcaacattctagcattccccttgttcctgaacaaacgccttagccgtggtattataggaaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacat

SEQ ID NO: 91935 - DNA, 938 bp, Oryza sativa
ttttttgctacggtaaatgccacattttttgtagtaatcttgccaagggtcaggatcctcctcctcccattcaccttgatctgtgggctgcttctgcgatccggccgcttcttcccgctcgagctcccgcaagatgtagtagaggacctccttgggtcgaagcggtaaaaaatcaaggtgcaccgccgggacgttgaccatgatactgcgacggtagtagtagtctggagcaaccaaagtttcatgtgcaatagcaaggacttccttattatctgcatctggtgctacaatggcgatggacaacgtcacgatggcgtttccaggaactccctcaatccactccaataacttggccttcacgtagtcgtccagagaagggggctcaaagacgggccatcgagcagaatgatgggccaacgttggtgttgccacagcaaattgtccttcgcggtcatcttcatcttcttcttcatcgtccccagcagcatagccacctgttgcatcaggtgcggccgccttcgtcgtggctgggatctcaacgccatacctcagtcgtcgctcgccgacgtcccgcgcccggtccttgagctggcggagctggatggccgctcggtgctgcgcgaccatcttgcgcagggaccagtagacccaccagaggtgtcgccggagtctacctttggcacggtggatctccgggttcccgctgtagaggtagaggtcgatgcagttgttgcagtcctgcgcgagcaggcgcacctggttcatccaggtgcgcacctgctcgtcgtgctctccaccctgcggcgcgctcctggctaggtgccctacgaagctgttcatgctctccatctcctccttgatgaactgcacatcgtcccggacgccgccaagcagcacagcctctttgcggatgaccaccagcagtgagctcacggcgc

SEQ ID NO: 91936 - DNA, 2015 bp, Oryza sativa
tatgtcaagatgaagcaatcaattaatcagccaacaagtcaactctgggagtcatcaattttgtcttcgcttcagagcagtaggtcaagattaaatttacatgtctgggagtttggagtcatcaaccaatcaactcatatcagattcaatgagttgaacaacagcatatactttcctccaagtgaagcatctacaacagtttgatggattattgtcactgacatcatcaccagcacatctgcttcatcagctctgacattccgccgttgctaatggatgactaagaccttgccaacttgctattccgccttcacggttgacctactatgcaaacgctgatgagcgtcttcgtcattatcatcggctattacaccgctattgactggatcaccgacatcgtcatcttcatcaacatcttgtcaagcctcatcaacatagcctactctgcagccgttgatgggaaacttcatcatcatagtcggctatctctgttgccgctaattatcattaccttcggatgcgtttgtcgccgccgattattttcttcatcttcatgattggtggatttcgccatcaccgttgatgcgcgtctacgtcttcatcgtcggtttgcttttgtcaccaccgactgttctttcgttgttgttgggcgcctacatcttcactgctagctgacctgactgttgccgactggtttcttcgcctccatggttatgcaactttattacatttgattggtggcatctttactaccactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggactatttattattccccgtaaaggttatcaaccgaatacttgcgccagtcgggattcaatttttatatctattttggagtatcccataagggataatcactcagatcacatagtctatatcacccgggagcatgttacatgcgtcatcctttaaagggtatcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattggatataatatcattgcttttcgccacgtaagtgtgcatttttattgaccaatattatggcttaggctgattatatattgtggtcattttctaggcggttggtaaatcctttatgagtttatttactcggattttacaccacatatgccatatatttccaggtgtggtgaaaccatgtgtcttctagggacttaagcacatatgttaaagcagtgtgcgcatggcgtatgcccaatactttggaaatttctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctggtcggtgcacctgactttattttccagccctccacagtcttcagatttggtaaaagtactcgggagaccatga

SEQ ID NO: 91937 - DNA, 2313 bp, Oryza sativa
acccggaggtgagccgggcgctgtacgagcgcgccgcagcgccgacaaggccatcaagctctacgccgggatgtggcacggcctcaccgccggcgagcccgaccacaacgtttacgccatcttctccgacatcgtcgcctggctcaacgggcgcagccgcacctggacggtggaggaccgcctgatgaagatgatggcgtcgccggacaggttcatccgcggcgagaggggcggcgccgctgacgtcgacggtgacgccaagcgcggccctccacggcggcgcggcggctgcttctccgggctcgccggccgaacgcatcaccactcggaaatgtagctttgtaacaatgtaaagattagaggctccagcctgcctagaatggtcaataagtggcacagtgtgcatgacttcgtgtattatagaggtgttaagagtcaagacatatgccaacttgccaagtaatgtaatgtatcacaaaccattccttttcctccaatccagtgcaaatttggtcaaaaaaaagtttaaaaagatgcttcatgtaagcaagtggaatgttctgttcatactgaaacatatatcgagtttccaataaagattacatgtataacaccatatggcttctatgagcaagaccaaaaaagacagtagcttacagtagtgcctatgatagattgatagtattagtagcatccccatgtgtccaaagaactagctatgtattcagccatggccattttgtccgtgaggtatgaagcaaccaaagaaccaaggcaccaatttcctttccaagtatttctacccgatttaacttctccacatgtagttactataaagtacaagttataggattttaatgagttgtgtgccgttgtcatgttgaaatttaatacatgccaccagctgctgcagattaggcttcctggtcgccaaagatgcgtttgcggaagtcggtaaccatgaggggaaggccctcacgcaggggaaccttgggctcccagcccaggagctctttcgcacgggtgatgtcaggcttgcgcttgtgtggatcatccgcagtgttcggacggaactcaatgcgagcattcggatcaatggtgtcctggacaaccttagccagctccagcatggtgaactcacccggattacccaggttaaatggtcctatgtgctccccttccatcaagctcatcaacccttccacctgaaagaatcatcacattagcagcttgatacacgcattatcaataaaattagatggcagatctaaatattggtttataattaaagaggggattgctccttgtatataaacaaaaaaagatgtgagatgatctaatcaccataaaccctcaccgtcaatcaaagttactggatacctaaatatatactgcaagaagtcaacattctgctcttcagcagatcataaatgtgtactcagagtattatgcagaggacatcaagtatattagtcatttcggtgatgctactttcatgtatgagacaacaaaacacaattatatgctcagggaatgtatgcaaataaggtaacaggcagatatcaggtcattgatattgttcaggtgtctcatcatgttatagatatacccaccaaatcagagacatattgaaagctcctagtctgcttgccatcaccatagacagtcaaaggttccttcctcagtgcctgaaaaccataattgcagaaacaagatgtcagtatcaaaggaacaatcaaaccatctgtaaattcgggagccaaaagaggaagatgcaagtgacggctacctgagcaacaaagttgctgacaacacggccatcatcaatgcacatgcgaggaccatatgtgttaaaaatccgagcaatcctcacctaaatacaacacaatatcataaattaacataatttccaaaagaagaaagtagcctgaatgctatccatcacaaataacctaaacagcataaacctcaaggttggcaccacggtggtaatccatggtcaacgtttcagctgtgcgcttgccctcatcatagcagcttctaacacctattatcgaataaataattttcattaaaaatctcttgtggaacaagcaaaacattgcttaaatgaaaccacacagtatatgccaaaatataaggactgctttttggaaagggttagctgttgcagtgttgctgtcaaatgtcaagttgaagaaaatactcctttctctactgttgtttgattcttctctaatgctctattgctgtcactattttggaaaaaactatgctgacttggtgtagtttttatcctactcttcccttgtt

SEQ ID NO: 91938 - DNA, 1659 bp, Oryza sativa
tctgtattccatgtcagtacaagttcaacattttccctggacctaatttctcacatccagaggaataatcgaagtgtcattgcaattaaatatgtaaaaacagatttttaagttatttctttccctgcgaatttgaagcatatttcaatgtattaatttagaaagaataaatactaaacttacatttttgttaagtaatgctgtatgttcttttaatcatgtgccaattctgttgggtttcgtgcaccatttttttatatggtaaaccatcttgatttagttcctattagaatttattctgtgcataggattttgggaaggcatacaatgaatataagcaaggagaaccagcattggatcgcatatttgatctaacaaggttcatccctgaggtacttattcttttgggtaggtcaatcacaaaatttctagttatctgagaaaaatattgcatttttcaaacactgctatcaaggaaatgattaaggcactgctattggttctgtatgccctaattcaaagtcactaattgcttcttgtgtgctgtaggtgagggataaagcaaccgctgttcatttaaaatatgtcaagggggacattaacttccatgatgttacgtttcaatatattgatggcatgccgccaatactagatggcgtgaatcttcatatcagatcaggagaaactattgcttttgttggaccttcaggtggagggaaaactactcttgccaaattactccttcgactttatcaaccacaaagcggtatcacactgaacaccggaatagaattttctaaattgtcctgctacatgttgctgccttttaccacaaattcaagtgttcaacagacagcactcctgttctcttggctatttaaattgtgtcattatcttctaagctgctgttggtttgcttgcatcttaggatatatacttctggacaactgtgatatccgggacattcaattacaatgcttgagaacacatattgcatttgtttcacaggatgcattaagtacttatgtgctattttccctctttgttgttgtatcctcaaatgatgttattctccaaacaggaaccatattttttacattttaatttgtcttacatttgctaaacagtagcatcctggtcagctacaactgagggtgaaaacgtaatatgttctatttcctttggttggtttctcttgatgcagtgcctaatcataagtttgaatttcaaccatggagctcttgaacttttctcctcttttgttacttccgtttacatatctcatccatggtgtttaaaagaacatctttgttaccattcacatatgcaactattgcacatatttcagatatatttatgttatgcatgctggagcaacaacagtttgcaatattaatgtattactgacttcattgtgtttttatagatgctgctctctggaacaattgctgaaaatattgcttatggagaccccatgggagctattgatatgagcaaggttgaaagcgctgctaagattgccaatgctgaggagttcattaagatgttgccaggaggatataattcatatgtagggcaaaaaggttctagccttagtggtgggcagaaacaaaggtatattgtatcacggattgtaacaaatgaaacattttactcagt

SEQ ID NO: 91939 - DNA, 537 bp, Oryza sativa
ggactggcgctgaggtgggacttggccgcaaccccaaggcccagaccagcaagccttctggatggcttgcgggctgggacctcagcgccagccataatggcgctgactgtgggaaactcagcgccagccaatctggcgctgaggtgggacttggccgtttcggccttggcccagcccagcaagccttctggatggcctgcgggctaggacctcagcgccatccataatggcgctgaccgtgggacactcagcgccagcccacctggcgctgaggtgggacttggccgtttcggccgtggcccagcccagcaagccttctggatggcttgcgggctaggacctcagcgccagccataatggcgctgacattgggaaactcagcgccagcccacctggcgctgaggtgggagttggccgtttcgggcgtggcccagcccagcaagccttctggatggcttgcgggctaggacctcagcgccagccataatggcgctgacattgggaaactcagcgccagcccacctggcgctgaggtgg

SEQ ID NO: 91940 - DNA, 3305 bp, Oryza sativa
aggagaaggaaatagagaagattgggaatatacgcaaaacgaggtgaaccattagcgcatgattttatgattttgaaacttcaaaaatggattaatatgattttttaaagcaactttcctatagaaaatttatacgaaaaacgcaccgtatagtagtttgaaaagcgtgcgcgcggaaaacgagggacaatcccccctatcttccctgaaagaacgcagctaattacacacagatgatgctatgctttgtgatgagctatgctctggccttcgttctcacctcctgcggcagttggccttccggtcggcggcgggggctttcctcttcccgccggcgctggccccgcccccgcaggtgacctcgctctgcacctccgacccttctcctccggcggcggagaccgccgccttgtcgagcgcccgcatcgcccgggagaaggtgtggagaatctggtcgacgaagcggccggcctccggcgagtcgcggaggagcccctgcagctgcgccgccagctccttccccttctccatgtcctccatcacctgcgcgtacgccggcgccggcgccggcgacatcgatgacgtcatcctcaatccaagcaagcaagcgcacacccagtgactgacactacactgccgctgccgcgcactctcgcactctctcttcctcgcagctcagctggtgatggagctcaaagcagcaggaggcttggggtggaggcaggtcggtatttatggctactctgctcacctggagcggattgatccgtctccatttctgtagccgaaggagatgatgcgtaggcgcggtctaccgtcgatgacgcgtaccgtgtcaatgccaggtgggaccgtgcggctacgcccagtgagcggctcacgaggggtttccatggactggggcgctcgctgcgtgggcgatgggaaaaagggacgcggctcggcaccacgcgagaaccatagacccggttcaccgaattgtggcggcccacgcggtgactcgcggtgaacggcgcagttgaacctcatgaaccgagcgtacccaatcccccatgccggtgtgaatgcacgaggtgagtgggccagcggggggggggggggggcgggggcttcacacccggcccacgccacagtggacgtagcccaccgcggaaaccacgggagagatcacacggacatgtgggccagtcctggagggggtggcccggcgctcagtggaccgcggtacgaggaattcgggggagttttggtggtgggggccacgagagattattttaaaaaaataaaaaaacttgagttgcaagttccttcgttgggtgggcatgtgggagtacgggcaaggggggaagcatcgccgaaggagaggggggacgaggggacgacaaccggatgacgtcacgggggcgacgtcagcgaggtgatcgatgccgggttggggggcaaatgaggatgaggaggtggtggtgtggtggtgtgcgtccgcgtcatttgtggaaatttttatgcagccggatgggttggacggcggagggaggggagggaatcgtttgatcggattccctggtggaacgtgcgtgtgtgacaaccaacagttgagaaatcattggagtagaaaactggtactataaaatttaaacttcggaatcagatggcctttgcctccttgatgtcctcctaagggcttttacagtgggcagagatgtaagttcagccttaacaaagccgggtcggacattccatgccatgtctgctgttcttgttgtccccatgaagatcgtggagccaagttaaaccacaagttctttgtcaaattttaaaggactggcccacgctcgtgccctgtgccgctagagaagggagagggagaagaactcgtcggccatgggagggtgaccaggcgccgtgcttgtggagctcttgggttgtgccggcgacggcgatagctacggacaaagaggggcgcgagcttgacggggtggcggtgtccactacccatccgccgcaacagctcggcggcggccgccttgagccctcggcctatctatagctcgtggtcaccgtcttgtggatctagttgtcactgttgagtggtgaagaagaggaggggagagggatgctggtgggaaggggaggtggtgtacggggagcttgctttcggttaaattgtcctgctagattatattatctaaggcatctaccatcctgaaaaatgtataattgcttgattatttagactgcattgtttctcttcatactttgagatgtatcatccctagttgtgcttagaaccatgcaaactagcctgcaattaggcataataaggatagtatcgaggtttgagctgatcttacataatatgcatgtttcgttcttgtttcatgtatattcgccacttatatagacatatcattttatataagcatatgaagctttagtcagtatcggcaagatttgtacaccttcatgcttgatttctgttttatatgtttatatggatcaatctgtttatataagtttttactagagtgtttatataagtttgtactagagtattagctagtacgttatctttcttgctctaaatactgtcacatcggctactttcataatattgtcttaaatcaatatgttaaactccatagatagtattacagccgattgggcatgtttagggtttattattctttgatatatccagtccatagctgatttggtctaactccatcggccgagaccatcaacgatgcactatcggcctatcggccgatcggctatcggtcgactgatatgcttttattctttcttgctgattgcaggattaaatcagctagcacgcccttgacacactcgacactagctttggacctgcactagagttaagcatatctcccaggccgtcgtgttttcacaccaacaagtagcccagtcgtcgttgtcgcggtagccatcatcgtcgtcatggcagccgccgctggatccacctccttcaccaccgtggaggaccgcccgagcaccgctcgctgctggatctgccccaaccctctcaccaccttcgctgccctccccgctagccttccccgtcgtcgcggcagcagatccagccaccccgtcgtcgcggcggcggatccagccaccccgtcgtcgtggctgttgatatttcttaactttacagataaaatccgcaagcgcacggaaaataccgatgtagcacttcacccgggagtattcttaggtatcgattttccacaggaaacgtgtgtgttaactccagatcaggttcatccaaggacacgaacctaaggata

SEQ ID NO: 91941 - DNA, 641 bp, Oryza sativa
aatccatcttttgaacccatctcgtcgaaatcctgaagcaccaaaatccccttacctggcgcgccgctgtcgacgtttgatgtcgcaattctggtatttgcatggtatggggatcgtcggtgctaggatatacgcaagactgaggtaaaagggatggagacagggatttttatacaggttcgggcccctgaacggtcaggtaataaccctacatcctgttggccgaagtcgggattgctcttattcatgataatcacaccagtacaatatttggggtagcctatctaactgttgtcgacatgggggtctgacgatctgactcgtagtcgacaacagggtagccttcctcctcgaatccgtgcccaacgaggtcagagatagcgctttcatctcttctgacagtattcggagacaccgtagggtactagacgtgcttatccctgaagtcgatatccggcggcgtgtcttggcgtatgtaggcttctttgttgattgtgttgggtgttgatcgtgtcgggtgttgatcccgttgggtgttgattgtcttgtcccccttctcctcctagggggcctgtatttatacccataggtgtccacttgtccaagtagaactagagaaaccaatatggatacaatccaag

SEQ ID NO: 91942 - DNA, 1229 bp, Oryza sativa
cccaccgcccggccaaccgtggccacccggcaagctcctccccggtgcccagccggccgaggcatcccagcgagctccatccgcgcgtccaggcggccgcggcctcccggcgagctccatccgcgcgtccgagcggccgcgacctccctgcgagctcctcccccgcgctcggctggccgcgactacccagcaagctcttcccccgcgtccagccggccgcaacctcccggcgagcttctcccctacggccagccggccgcggcctcccggcgagctcctcccccaccgccgccgctcgagccaatggaaggcggctgtgagagatgagaagatgaaagagagaggggaggggtgataggtgggtcccacctaatttttttacagtgaatgccacctagatgccacgtggatgccacataagctaaaactggactcaatactgccttgggagtcgatttgcactggtttttggagatgagggagtcattatacctggttttgtggtggagggatgttattcgacaaagggcaagagatgagggagctaaaatggacttattccttttgcataaaataatggaaagagtacaccgaaggtccctcaacttgtcatcgaattacaaaatcatccttaaaccataaaaccggatacaacacgtcccccaacttacaaaaccactaaagactaggtccctcgacggttttgactctggttttgtccgacaatacaatattatgaaatttttcatctcacgaaatgacaacaaaattaacataatgataatatattagttaacaagaaaaccattgcaacgcacgggcattatgctcttttacaaaatgtaccaaacttatgatattatgacattatttcttgaggcaaattcaagcatgcaattttttttgttgtttttaaatttggctgtttgaaatggcatttggctcgagatagggacgaaaacggcttggaaacggacggagactatagtttccataacttttttcggaatcggaatcggagcaggaaacctcaaatatgaaaatggtattgaatatgaaaacatagcgaaaacggtaacggatatttatcataatagaaaacccctcactgaatttttcaaactaacgaagagtgtagctcattacttttctaaaataataaatcgacatttctatattttttttatcaattttaaatataatacgactagttgtacggttcacttacc

SEQ ID NO: 91943 - DNA, 694 bp, Oryza sativa
aaaaacatatacagtacaaacttgtcagggttatggataagccatacctcatatcctacgacttatggaatatactgataaaagtataccttcatgtatacggattgttcttgtaaatatcgcgtggagtccatttctaattatggaaaatatctctacgagtcaagtgatttacaaaatcctactcgaaagggatcgatagaatttatgttataccgttacaggtcctatatcctcaaacctttcttgggggtcaagatgatccacggtataaaagggaccccctgggaggggtttagggtatcgaattccatcaccaacgcacccaccaaagtttacgaagccgaagtacacggagccaagccgccgggagatcttgtcaaaaccttagactacgatctcgtcggtgtcatctgtttcgactactctctttgtaatctgttctcatcatcatcaatctcatataaactggactagaactgttacctgataaggggcctgaaccagtataatccttgtcttttgtctgcttgatgtcgtactatgtagggcctcgtttcaacgtacctcaatactctactcatccggtccgcgagtatcactcgtcgacaaatctaccaaccaagtatatatcatgtcatcacaacacggttaatgcacaaattaggcaaccatgcaaattaggttcgaattt

SEQ ID NO: 91944 - DNA, 583 bp, Oryza sativa
tttgattttcctttcaagttggttttctacctcagctttatagattttaaagaaatgcaatgcctcatcctttgttttcaatagatacacatagcaaaatctagtgcaatcatctatcagtgtcatgaaatatttctttccccctttagtcaacacgccgttcatttcgcacaaatcggaatgaacaagttctagaggtgccaaatttctcgcctcagatgccttgtgaggcttgcgaggttgtttcgattgaacacaagtatggcacttggaaccttttaccaaagtgaattttggaattaaactcatgttagctaagcgcgtcatacaaccgaaattcacatgacagagtcgcgaatgccacacattagactcatcattctcgctaatatgggtcacagcattatgattattacacatgtcattcaaagaaaagcggaacaagccttcgctgtcataaccttttccaacaaaaggtccatatttagatacgacacatttattggactcaaacacaagtctaaaaccttctctacacaataaaagagccgcttactagattcttctttattgaagggacatg

SEQ ID NO: 91945 - DNA, 512 bp, Oryza sativa
ctcgcacgacaacctcagatggtcgaggtacgactacagcaataacgcagcggtcctcgcaccacgacttcaaatgatcgagagacacctactcactggttctcaaccagtcaatcatagcgatctctcgtacatttacttctagtggttgagttacgactactacctggttctcgaccagcggggtagcgattctcccactatttccacttcaagtggtcgagtttagactactgcctggttctcgaccagcggtgtagcgattctcccactacttccactttaagtggtcgagttacaactattgcatggtcctcgaccagcgatgtagcgattctcccattcccctgctttaacaaagttgatatcaggtgcacaagatcgccaagtgttttacccagagatcccttacccagatgacacctagcgttgaaacctatactactgtccctttacgccggcttgacaaggcctccgaggaacctgagggaacttcagctggggacggccag

SEQ ID NO: 91946 - DNA, 788 bp, Oryza sativa
tagcctatctaactgttgtcgatatggcggtctgacgatctgactcgtagtcgacaacagggtagccttcctcctcgaatccgtgcccggcgagatcagagatagcgctttcgtctctcctgacagtatccggagacaccgtagggtactagccgtgcttatccctgaagtgatatccgacggcgtgtcttgacgtatgtaggcttctatgttgattgtgttgggtgttgatcctgtcgggtgttgatcccgttgggtgttgattgtcttgtccccccctctcctcctagggggccctatatttatacccataggtgtccccttctccaagtagaactagggaaaccaatatggatacaatccgagtagtccttatcgtttccatgtagaactctagttatctttccttatccggaactccctcgaggtcagtttccgtataagacatggtatgtagtggatcctgccgagatttagtcaactactattaggtatgtggtatccataaccctgacagtagcccccgacttcgatgcaaatgaacgagttcatattctcaaccgcagactttggaggaactgttatcgagctcacgtgaccgttctcggtgagtttagagataacgttagacttcctttatcagcctcgtgcgggcaccgaaagggtttgtctaagtcaatctctgatgtcgaccgagaaagtacagagcgtacgactaagtctcccgtcttgctgcaatcgagaatttggattgaagtcatgaaattttatctcagcgggtacaccat

SEQ ID NO: 91947 - DNA, 532 bp, Oryza sativa
tttcacaaagtgtctggttagcatacctctgaggggccaaataagcacactttcaagttgccatcagccaatagtcgtaatctattgcaaccagcacaaaaatgctctgtcatcgatgtaataaacgaaattgttccagcatgaccatcaatcttgaaattctttgcggtctctgacggatgatcttgaagtctctctacacctttaaaacgttggcgctgatccccaaagttgcaagtaagaaaaattacttgtagcttccataataataataataaaaccacatgtacataaaatggctaggatgctagatgcaggcggaagaaagaaaggtaaaatgtataagggaagtgaacttttcagaggtgtaccttaccactttatccatcatctctgcataaggaaccaactttttgacattccaaacattaccatcaaacggcataaactctataaatctgacattgacaggcttttctctcgtcatttcaacaaaatcacagatctcgtcatcattcatttcacgcatgac

SEQ ID NO: 91948 - DNA, 1058 bp, Oryza sativa
agttcgtgatttcacataaatatcttatcaagaactttccgataagttttgtgtagcctgcatatataagcttcgttccttttctaactaaaattactcctctgatgcaaagcttccaatcccatagaacccatacgttggcttatgtggctggcatttttagtattgttttcccagaaattctcacttctggataatgctgatgtgcagataatattaaccaaggtattactggtatcaactagagacaaggcttacattggcatgccagtggtgaccaatgctgctgttcatgcagtggttgaggaacaggtatgtcctctgtatgttgtcgggttaatcatggatattcaaaattacttgaccctgatgtctccccaatatttttatatcagggacgggatgataaagtgatagtcttcaaatataagaagaagaagaagtaccagaggaaacttggtcacagacaggtaagtttttccaattaccttcttcaagaaaggtagaattttattgataaatactgattcagtttttacagcgaagcaattagagttcttttagattaaaaatctctgttgttttgcagccaaacacaaggttaagaattaccggcataagtggatacgaggacttccctgctgacccgatacttgagtatgttccagcttaagagcaattgtaagttctgtagttacaaacaactggtagtacattagaatacgagtgctaccttttcttgtctgaaagaacagtttttgaacaaaatttgctttgttcatgtgttcgagtgctgccagtcatccagttgttccatcctttgtttattccaccatctgttttgttcattctgatattgtgtatcctagccaactgtattattttcactgtgcttaaaaaaagagagagcattttaccacgatacggatgttttagctttggtttgtgtaactttatacagtttttgtgactactgatgctaatttcactgtttttggcatctgtaccaatggtgcttagtttattgaacgggctatgtcctaatattttgggatcag

SEQ ID NO: 91949 - DNA, 7857 bp, Oryza sativa
  unsure (1)..(7857): unsure at all n locations
gtcactccccttccggtgattgggaaagaagaaggggtaaggggaggaaagaaggcgttaggggaaagaagaaggcgtgaggtgtgaaaagggaaaaggccgcccgtgggtggagacttagaaaaaatcaacctctaccaagtttatttatatttaagtctattttcgtaggcggaccgaccatttcaccctaatttatatttttgtaggcggtcatttggctttaagagtcnnnnnnnnnnnnnnnnnnnnnnnnnnnnnnttgagaaaaatactttttctagtagtgtcagatacaccacagagcctttttctctctcttggcaacgaacgtatgacaccaaaatagcacaagattaagctgtgtgagcatgggtttttccccctaacttgggtagagatggagatggagataaactgaccaatataactatagatctttgcgatagatgcagccagtgatgcaccgtgagtagattccacgtagagcaggaaaacgacgctcagtttgggatctcgaggtgtatattctatcctgcctccgacatgaatctttgctttcttgtcccttgttttctgcatcttgcttatgctaattactcaattggccctgtttggatccaagggctattttttagccctccctcaaatagcctaaatagccccaaaagatccaaaagggtgagctatttgagggctatttggaaatagcccacccaaaaaaactatcccatctaagcggtactaattggagctatttcgggtgggactcactaaaaaggtgtcttttctctctcccacaggcgcacgggatcctcctcccctccccatccggtcgcgcgcgctcgcccccaatattcgccgccgccgtccccacgattcataggtcaccggcggcgccgcccccacaaatcgccggcactgcggccgtcacccgtgtcgccgcctcctcctcctcttcttccctcgttggcccggtcgaaacggcggtgagccggcgccggtgaaggcggggtagcatccggcgcgagtctgcgctgacctgggtgaccgactatgagacgagtgattttctcccccaccaagaaccgaatcgacgaactcgaagcagagaaagagagacagaagacagtagatggctcgtcgactcaatctaatcttgccgctctctaggctcacagtttcttgatttccccaaaccttccattcttttttcgtttctaaagtttgttgttgttcttcttgttgatttcttcctctgcgaattgaattccacactgttgaagcacaagtcgatttgttgtcataaaattttctctttttttgtttgttcgtttgctgcgttatcacctctccttggctcttttttttgcttaaatctgatgcccgcggaggaggagctcctgcaccggcaggtgctggccatggccatccaccagcacctcgacaccggcggctccatgtcctgccgcatcagccacaccaaggacacaagtgcacaagatccagtggaaagagagagttgagtggtagtttgattggaaaagtgccaaataacccttggatccaaacagctcaagggctattttattggagagctattccttatgctaaaaaatagctcttaaaataaccctcggttacttctccaaataaggccaatgttgatttgataattattccatttgttccctggtcgatcgggcaagtgcgacaattaattgatcggttttttccttggtactgactggaacttttaattgaacactacagttttattttattacaaaactggaccaggcaaatcatctatagccaggtcccaggttgtttgacaaattcagggatctgatttggcatacctggcagccccggacttcaattagcccagctggccagctccatgatgcatgagtcactagggtaatgtggagtaatccctccatgcacccacgaccactattgatttcctttgtttttgctttggtagcttctttgaaacgcatgattaaaaaaaaagaaaaacacattattttgatacaaatgtcagcgcaaaagagagaattacaaaacacaaaaacataggagtgatcatttgattaggccgtccgcaggaattggatgagaaagacatactcgaaggaaaattttaaagaggttggagctcttgctttcattcaaaatatctacaggattatctattccataggattttcaatggaaaaggatataattcaatcatttatgtaaaagtccttcatatgaatctttaatatataattggaatatttgtttttcctggaccttatcgttcaagttaagattttgtcgaacttttaaaattttaaaaacaagtgtattgttccatacattttgctatcttctttatgctaattggatgatctcctataaattgcagcgttaattttaggaggccaagaaatttagaaatgactccattactcagacaaaaggttagaagttccaatgttaagaaaaaaaaatgtcactcaaccatctatcacattgtacgtcgttgatagtaattatgaataatttaatatatctcatttgtatatccattatcaaaatgggaaaaaaaatataaccttgaactttaattcgtgggtaattttattatcctttagaaaatcctaagtggtatcatagggcctgttcggcgtgcctagatggcagccagcagctacagtaacaacgtacaatttctacgtagttgctgctgctgcagcagcagcgctgcacagccgctgcagttgggcagccgaacacacccatatttactagtgtaatatttaatacctgaaggtatcagataccttatgataccgtaaaggttctcttgactctaagtctaaaaacaatcttggacttgtcaactatataatgttgaatcataactatcaaagccgatcaagcttaaaaagatatcagtttaaaagttctggaacacaagattctaatcgcacgaatagaaaaaagaagcaggattggaatatcgtgccatgttgaaccctgtggaaaataaaatcataggattgctcaaaacatgtgtttggatggctcaccggaaaaatataagaattttgagattatgtagtggtacttagattgagtaagagaagagagatgttgctttgaaattctcatagaaaatgtttaaaatcatttggaattgggccatatgaatgaatttcaaaggaattttgtgagcccaaatcaaacaacctttttaggaaaaaaaaactaaggattcaaatccttcacatttcctttgaaaatcgaagccctcaacgttgttttctagacttggttgaatccaaccttgtggttgtaggatgaggctttctttggtagaactcgatccaactcctaaatttaattttaggagtttggtttggagtggagttgttgagcggtctaaacatagctctacctctctagtttattttgtgaggacacttcaaccagctctacttttattttaggtggagctgaaactgtttggctaagctcctactccagaagcggtgaagttagagttgaagtcgtgccaaatagatcctaagtaaactttgtccaacagtacatgaatacaaaaaaagcataaactatcaagaatcaaccaaggccctgtttggttccatgggctaacgtttagccctcaccttttagcctcaaattagccctcaaggacccaaacaggtgggctaattttgggctaatatgaattagcccccctcaaaacattagcccctctaaggggtgctaatggggctaattttgtgtggggaccatcaaaagtcagctctctctctcctctcccctctctttctactatctctccaccttttagccttgaattagcccatggatccaaacatgccaccctaggctaatgtttagcctaccaattcataactaaacattagctctcaaaattagccccgggctaatcttctaaacagggcccctgcccgtagcaacggtcagtggcaacgtctaggtgcaatgaaccggccaccactcgatccccacaggtgcaggcatttgtcactacgcactaattcttccaagcattttccatgctgtgtccatacgattaaaagcaacctagcttagcttctggaaaacacgtagccactgagatcagaaaggatcaaaagagcactttgttttttccttcttttttttttctttttagatgaaccaagagtactttcttacctctccttgatcgatcggcgaattagtagagaaagtgtccaaaaaaaatatttagtaactcatgcacataagtgcgatcttatgtggactagtcgagacctcacaattggaaactattattttccagaacacgcaaaagattttgttacattattccattacaaaagcacgttacaagccgttcatgcatgcttaattggtgtcaaccttataaggccagagtttgttgtcaacgtcacctcccaattatactttattaattctcatcatgttaatgtcatgtcctcggttatctttgaaaagtgtgaggaaagttacgtacttcctcagtttcatattataagattttctaacattattcatatttatatatatgttaataaatctagacgtatatgtatgcctagattcattaacatctatatgaatgtggacaatgctggaaagtcttataacctggaacggagggagtaaaagaacacacaaaaaaaacccaacgaggacattaaaatacgctccggtgttgttgaacaagcaatcgattccaacaatgacaaagaaaaggatttagcggtgttttattgtgtctgaaagaaacgatacttttctatagcatgcaagcacagtaaaacatatcaataacttataattatattataattaaccaaagagtattgaacattgtattgtttttgtttacgtaatatttagtggcacttctgttagtaacaaattaaggccttatgtgcatttgaaaaaagtaaaaaagaaaaatctcgaatgaaaggatgaaggaaataattgtttgccgctggcaggtgagcaggagctttgacctcctccatggttttaaatttttgtgctgaattcactatagcttcagcaaaatttaagtgtatctgacttatgactgatcgttgtgattgatgttaattcctcatgctccaaataaaactatctagggcatgtgcgtgcctttcgccctccgaagctccaacactactgcacattattttcctgccctcaaaattcatataacaatttaacaatcagatcttatttgtcatgcctccatatcccagatccttgctgaattttataagttaaattatagtattctgaaattttgtattttctattaaatattaataaaatgattcacctctgtaaggtttaacagttagaaatatccaattaaaaaatttggtccggacctgtgccaaactgaggtttagttttttctctacaagtgaacaaccaaacataggcaaataaatttcataaaatcctatagtttaaccagtagtatacctctcgcaaaatttactcatcatgaaacaattcaaatatgtttggtgataacccacatcctcctcccgtgtcacctctctcggcgacccacgaggcgaaacccgcccaccccctccaacctcccaagcacgaccactggccttgctgccgccgcctacggtggtggtcggcagtagcggcagcgcacccctcctccctcctttttcttccctctctcttcctttctccttcttcctttctctctttttcccttccacccttttcttcttcctttctctctttttcccttccacccttttcctctagatttgaggtgactgtcgtggcccttcctgcagtcagcctaagcctcttttcctttcctcttcttccttctctccattttccccttccgttttctccaaatctggggattcaccggtcatctcctccggtgctggcggcctgcctccccgcatctggcgttggctcttccatcccgggttggtggcggcgttgtggcatcggccagtggtggtggtgcaagggggacggctagatctggctcctcttggtctagatacggggcatcctcagttgatgaaccctaagttcctctcgacactcaaggctgttgttggcccgatctttcggtgagttgtaggtaactacgatttgagagaaacgttggtgatccgactacaaccgtacaagacgttgtgttgcgccttagcgatcgatacacctctccgtgggttgttgatcttgccggtgcagatcaaccttattcctgcaagcaaatcgaagaaacaagcaagaacaagatagaagcaatctgaattgcaaataggaatgaatacacaagataagttggggttccgaagaacaagcagatggacggtctagccgacacgcgcgctgcaaggaagtagcaatggctaaactttcatctaaacaaaacccaagaaactctaaaggggtacctaactatttaaggaggtgggaggacgacctaaggggaccctagggtcgtgctccacctggttggggcgcaccccacatgggccccacttgggccggggttccagacgaagttacaagcccataggcccattataggtgacgcagcaccttctttttgtgatttcggccgactgggatggaatttggcgatgaagctggatccattggaaagatgactctgagagctttccatcaagtactcatggacctaaaatggagctcgcatgcatatttggtggccgtttgaagtcgacactgtagcaggtggccgaactagattgcagaacttggacggcttgatcttgatgtggacgacggttgtatctatagtagccatggtcacatcatcagtcggtgttgagtgtggctgggcccgacgtcgaggttactcaatgaagcttgggcagcctgtgtggtcgtcggatggcgccgtcagtcttgctccgccgctcggtggagtccggtcattgtgcagatggtgtgaatagtgcaagtaccttcggtgtgcaggtggcatttggtggcttccgctgtggttgctatggttgaaggggactccgaggtgaaagccttgctcggcttgccggtgctagcaacggcaacaccctcgggtgtcgttcacattcttgaaggcattgctattggagttctcattcaactccacatcaagggaattcagcaggtgaaaactttagattcttttggattggacgatgtcgccctgttcttagtttcagtatgccaatgtcaaggttttcatcggttttttgtaaattaaccgtgtcgttctagatttctgggtccggtttttcttataaagtgaatcaacttttacactgaaattgtaggaactccatacatgttccctcgaaaaagaaacaattcaaatatgtttgtagctaatctgaggtgaggttagacctaacaaccggatcgaatatcccgtgacccttttggaatcgttcgtgcatgagaattaaggtcaatcaagtaaatataaaaggtaggtatcttcatgttaattaagcgtcaacttaagacgaaagctagtcatccacggcactaattcattacgattatgtaaacatcgctgtgtcatcttcttcttcgatcgaaaagtgtaagctatatttatatttgtaaaatcatgtacaccaagcaaggactgaaaagaaaaagatgcgatttctcatagatgaatatagccgcgagcacaagacactatacttttgtgctttcttttattaaaaaatggatcgcaatgtcaaattgtcaatgatcttttacaagtgatactcg

SEQ ID NO: 91950 - DNA, 1327 bp, Oryza sativa
tcagtcagaacatcaccaccggctcgcccccgtcaccgccgagtggtgtcctcgcctatacggttgggtggtcacaccaccgttgttgggcgtcattgtcttcaccgaccggccgccttcgtccgccgccgactggtgtcctcgcctatacggttgggtggtcacaccaccgttgttgggcgttgttgtcttcaccgaccggccgcctcgtccgccgccgactggtgtcttcgcctgtacggttggttggttacaccgccgttgttgggcgaatacgtcttcaccgaccggccacctcgcgcgccgcacactggtgtttccgcctgcacggctggcctattatgccgccgttgttgggcgtctacgtcttcaccgaccggccgcctcgtccgccgccgactggtgtttctgcctgcacggctggcctgttatgccgccgttgttgggcgtccatgtcttcaccgaccggccgcctcgtccgccgccgacaggtgtttccgcctgcacggctggcctattatgccgccgttgttgggcgtctacgtcttcaccgaccggccgcctcgtccgccgccgactggtcttgccgcctgcacggctagcctattatgccgccgttgttgggcatctatgtcttcaccgaccagccgccacgtccgccgctgactggtgttttcgcttgcacggctagcctattatgccgccgttgttgggcatctacgtcttcaccaccggcttgccttcaccgccgccgactggtgtctccgcttgcacggctggcctattatgccgccgttgttgggcgtctacgtcttcaccgaccagccgcctcgtctgccgccgactgatgtctccgcctgcacggctggcctattatgccgccgttgttgggcgtctacatcttcaccgaccagccgcctcgtctgccgccgactgatgtctccgcctgcacggctggcctattatgtcgccgttgttgggcgtctacgtcttcacctgtcacgccctgaagttcccctttctagctttaaaatttgtaaaataaatcgtccgaagaaattgttcaatttaacctagagctaattcctcaaattaataaatgcaaataataatcggaatcggcatgtggaatttttcttggattctacatgtcaaaatatgctaacaggatttttagtggaattttcagagcattggaaataattttaaccaattaaaataagcaaagtgcaatatttaaatccctagaaatccttttccttttctttttccctttttccatcctttttccccctcttttcctcctttgggccgccggcccatctct

SEQ ID NO: 91951 - DNA, 745 bp, Oryza sativa
cccggcgtgatgaatgaagtcttcaagcagtcggattccttcagtcggatctgatgataccccgagtagcattccaaaaaactgagaagctcgcagccggcggtcgagtcgactacctggtcaatgcgaggcaacccaaaaggatctttagggcaagatttgttgaggtcagtataatcaacacacatgcgccattgccctgttttcttccgaactagaaccgggttagccagccagtcgggatgaaggacttctttgatgaagcctgctgctaacagcttggttaattcctccttgatcgcgtccttcctgtcttgtgcgaatcggcggagtcgttgtttgataggcttggcatcttctttgacgtgtaaggagtgctcaatcacctctctaggaataccgggcatatcagacggtttccacgcaaagatatctttattgttctgaagaaaggtgatgagcgcgctttcctatttacaatctaactcggcgcctattacagcagttttagtaggatcagagggatctaggggaatcttcttagtcttggcttcgctttctccactctttgaaatcttggtagcgggcacttctccttcgctcgccgtggctgcagccagtcggatatcctctcgggcagacgccatctcgcgggtttgggccatgtcgcaactctccttgtcgcatgtgacggcttgcttgatgtcgctccgtaaggataggactcctcggggaccaggcatct

SEQ ID NO: 91952 - DNA, 749 bp, Oryza sativa
caacctatccggacagtccaacaaggggtacaaggcttgcactcactgtatggatgaaacagaaagtacatatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagaataaaggtaccgtctggatactccacgaatatcaagcgaataataagcacgaaggagaagaagttcacaaacctaaagtctcatgactgtcacgtgttgatgacacaactgctaccagttgtaataaggggtaaccttccagacaatgtccgggcaa

SEQ ID NO: 91953 - DNA, 566 bp, Oryza sativa
tctacatgattcactaagattaataactgtgcctttgggtgattacttgaatttaaaagatttgtttgaattagtatccaaaataaataaaaacggaaactgacaaaacctacctctggacctcgtagtctagacttaaatctagataccaaatcttgtgtagtgacaggagcaacagcaagaaaaacagtcttgatttatccctctgtgacaggaaatacatttgcactagtttttgatgcaacaatggccttcaatgcaggttttgaggaaaatggtgtctcatctttggccactgatggttttgtatcctaaaaataatgaaaggatttatcatttaaagactaaagtaaaaaaagtattcttgataatagtgtgtaagaacttacagattccacctttgcttttttggaagctgcaccgccagatgcttttgaatcatcaccaccacctgatttcctcttttgcttcgatttggatgcaggaggtgtgccacgagcatgtcctgatggtgttggtttagcggggctgttatctacaggttcatctttgggttgatccttctg

SEQ ID NO: 91954 - DNA, 1497 bp, Oryza sativa
tcaccttccagatctccaaggatccttgggtgatccgctcacaacaatagatcggctcatggaagtaccctacttgctggagtaggtacttcaactgttgggcatacccattagggttttccatgggctaaggtttttttgactggcttagttcaagaggggggtgtgccctttttgaagttgccttaggttccttttataggcactattttgtcggtggttcctgtatcccatcagctgggttcccattaacattgcttgggaaggggcgagtctggattttctgggattctggatctgcagggttcatttcgaatcgtcctgtggttggtgcgtgtcttcaatgtcataccatccctcttgtggtgtttccaaggtggctttggatagaacgggtggactggtcatgctagtttgagtaggtcaggtggggaggggtaattcgagatggttcccggttgtttttctcactggccatatcatgggctgctcaaccggttagacataaattgtgaaccacttcacaaatgaaaccatcgcatgacacaaacatttccatagtgctatgaattcaactgatatttctagaataatacaaattatgtgattatgttacaggaaatcataagtgcgtagaaagctaagtgctaatacatatcttacatctgaaattaggtaaaaacaaacatcagcacataaatatagtgctggtatgacaaaagctagctacttgcatgctagctcagaggattgctgttcaaaccaacatactacagtggtgctagctcagaaatcagtacctctatgacgtgagaacctctctatatacaatgttcctcgtgtacgtcccacgagacatggaacgatggctcttgtccttgctttgtaccgcgaggatcttaatgttcattcttgctgttgctctagacaatgcaacatacaactgaccatgagagaacaccgggtcagggaggtacacgccaacatttggaatggtctggccttgcgccttgttaatggtcatggcaaagctaagtctgaccggaaattgctttctcttaaaacgaaatgggaacatctcatcgtcggaggggcataggggtatcctaggaaggaacaccctcttcccagcatgttgaccaagcactatctcagcgtcgatagtgtttctctggaatcctcgaaccaccaacctcgtcccattacagagtccgttggcaggatcaatattccttagaagtataacggggcaattgatcttaagctttagtatgtgcggaggcaatccattaggggtcaacgaatttaagaattcaggaggatagtagttgtgaggatcatcctcggcacgatcgaagctgtggtataacatttcctcccctcgaaaacgatcgatcatcttcatgtttatttgatcaacatactcatttcgtgttgacaagatggcccgagatgtgatatagtttgggtcggctagattagcatcaagcatcggaa

SEQ ID NO: 91955 - DNA, 1298 bp, Oryza sativa
tccaccgaacacaactgtcttccccccaaatggcacgtcaggacggtccatgatgtcgcgcatgcttctatctagggcctcgactgcttgccgttttgtcatagaagcttcgtcccatataattagggaagctctctggagaagtttagctgtcccactctgctttgtgaaactgcatacccctccatcatcaatgttcagtgggatcttgaatcttgagtgggcagtcctaccgccaggcatgatgcaagcagctacaccagacgtcgcagttgcaacggctatctttccctgaccacgaatagtagcaagtagagccttgtataaaaaagtctttccagtacctccagggccatctacgaagaagagacctccttgtccgccctcaatagcggataatatctcatcataagcacatctttgctcagggttgagtgaacttgacaaatccatgtgcccatgatccacctcgattgtagactcctcaaagatctctctaggctcgctgcctgaagtgtcgtatgactcatcaatttcgggtagaggaaacgacgttatttcttttcccatcgactggagcatatttctaatgtccaaaagcaccatctgctcaattgtacgtgggcacgtgtgagaacgacgatagtcatccaacattccctccaagtgcttgttccatagaccaagtacgtcacttggctcacaaaagaccaatatcgtggcaaagagcctccgtagcgatgatggcatttggaacacctcagcctcagtaaggcactcatctaatgtgttgtctgcctcgataagaccccttttttctgcagcttcacgaaaggacgagcagacttcaccatccactgtcctaaggtgttcaaaggaggtggcgccagtcacatgggttagcagcaccctaaggtagtaccgctccccctctgcaggatgagctgtcacgattctcccaatttgagtgattcgccgtttcctccgttgccatacttttgggccagcttgccaagtaaatgcctctggaaaatccttgtagaggattcctcgagcatcttcgttaactttatttgcctcaaaatactcagttagcatactcttctcgacgccatttctctctacgacatcatggagatcttgccccgcacgaaatgagaccatgtgcatgtttggaagatgcagttgtagctgtttcacaggcggatgtaccttactaaggtcaaagctatatatacgccatagtgcttctggtggggtgacccaccttgcatctctatattgttgaatctcatcaa

SEQ ID NO: 91956 - DNA, 1132 bp, Oryza sativa
ctggcagccgagtcccccacttccgatctcatgactaccgtcatccaagtctcagcatcaccggcgcagcatccaatcgcaggagcaggggtcacgacgagcggtccgttcactcacctcccgatcaccatagggagcgccgagtggaacagccccgctcaccacctcgtcgccgccccgtcgatcttcgcgacacaatcatacagcgccgagcagctcgaggctatcaccactcgccgaaccgccacgacgacgaccttgacggagtagcagccttcaccgatgatctgcgtcgagtggattggccagccggcttcaagccgactggaatagagaagtacgacggtaccactaatccagaatcgtggcttaccgtctacggtctcgcaatccgcgcagcaggaggtgacaacaaggccatggcgaactatttaccagtggctttagcagattccgcccgatcttggctccatggattgccccgtggtacaattggatcttgggccgaactacgcgaccacttcatcgccaacttccaaggcaccttcgagcgtcccggcacacaatatgatctctacaacgtcattcagaagtccggagaatcccttcgagattacatccggcgattttctgaacaacgtaacaagatctctgacatcaccgacgacgtcatcatcgccgcgttcaccaaagggattcgccacgaagaactagtcggcaagtttgggcgtaaacctcccagaacagtcaagctcatgtttgaaaaagccaacgagtacgccaaagccgaagacgccgtcaccgcatcgaagcagtcgggtcccagttggaaaccgaaaaatacgccggccacgggaggaggtggaagtaacaatcataaggaccgcaagcgtaagcctgaggaacttgttgcaaccgccgctcactcttctcgacagcgttcgcgcgtcaacaccttcgacaagatcatgaactcccaatgcccgcatcatccaaactccaaccacgtggccaaagagtgcttcatctacaagcagttcgcggagcagtacaccaagtctactcggaagaactccgacgaggaacaaagcacgtcaaggaagaaggatgacggcgacaccccggctggttt

SEQ ID NO: 91957 - DNA, 2423 bp, Oryza sativa
taatgtgaattatttttagggacttttttcaggttgaaaatgattaccatagacaggcaacctaagatgcctgcccgtggaaatcatttttcacaagtgggtgatctaatttgcctgactgtgaagtttgattttcagtgccggctgtttcctgcctacaaaattgatgatttctgcgctcgtctagatataggcggaccgtcgatctagatacttcgatgaatggaataacactttgtttcataaagaatctaataaagtatctatgattgcaatagcacatgactatatcaccaaatcctagtaaacattttcttcgaaaggaacatactctattgtcaaaatgacatgttcaacaattccggaagtcacatttttctagctataatatttggccgggtaggcgggccatggatctagatacttctatgaaataacactttgtttcataaagtatctatgattgcaatagcacatgactatatcaccaaatcctagtaaacattttcttcgaaaggaacatactctattctcaaaatgacatgttcaacaattccagaagtcacatttttctagctataatatttggccgggtagccattgacaccgctaatccaaacttctcagccatgtctaaaccattcctgttcaccatttgaggcattgtccatttaaattggtgcataagcgagccaagtatcatgtgcagcattcggttggcaagaggcaatccaatgcaaatgtgcctccctgaaccaaatggaatgaattcgaagtgtctacctgcaaaatcgatatcttttgtaatgaatctcttggggaggaacttttctggttgtatccaaactttaacactttgatgaatagcccatgcattcactattactttgctccctttggggattgtatgtccttctatttctactgtcctctctgcctcgtatagtcgcaaaggcacaattgggtgtagccgtagtgtttctttaacaattgcttggagatagggaagttggccaatgtcagattcttcaacttgagatctagtgcccagaaccatttttatttcttgttgtaacgttttcatgatttcaggattttgaagtaactctgccattgcccactctacagtagttgcggtggagtcactccccccaacgaataaatcctgaaattcattcaaattgatgattactgcacagtttatttcaacatatatacaatatgtacagttattgaagttccgatctaagggcggatctacagtgtcaatgccggtatcaggtgatatcgacgacttcagcatatatggttaaactgcttgtctatatattataacactatgatataagtatgatgagtatactacaatattgataggcaccttatgacactaacgaaccaattttttttgatccgtcactgttctgatcggactgacaatatgtacatatcagtgaaaatcaattaaaacaacaaacgtaatatatatgtccatttagaatttacaaataaccattttgaacgactgtgtttgactccttttaggtgtaacaaaaaccttgtgtttttattttcattccaaaatgtagttatgtagaacatgtattttttcagtggtcagagttcgggagttcttttacttaccgtgagcaacgccctcatcaaatcacggtttatcacctcgtcgtcgccatcttcccgctcttgctcggacatgtcaaggagcacgtcgagcaagtccatggcctcgccgccgcggccgccgcgcaactccctgcagcgcatccgatggtcgatctgcgcgtccaccagccggtacgtgttcttcatcagctcggcgagcctgcgacgcaggccctggaggtcgagcgcggcgaccgccgggaagaagtccgagacgttgggcgtcccgaggagaacggcggcctcgcgcgcgacgtcgcagagcacgtcgagcgtcgccgcgtcgaggcgggtggagaacacggagcgccacagcagctccacgttcgccgcgagcgccaggcgccccacgttgaccggcgcgccgccgcggtggtccgcgcgctcggcgacgcgccggaggaggccgccgacgatctcgtcgcggagcggcgccagctcggcgagcttccgccgcgagaacaggtgcgccgcgccgagcttgcgcagcaggcgccacttgcggcccggcgggaggacgaacacggagttctccgcgtggccgccggcgtgccacgcgtcctgccggccgcggccggcgaggctggcgttgtgcgtctggagcaccgcgcgggccgtcgccggcgaggaggcgacgacgcaagtcgcggcgccgagccggacggtcatgagcgggccgtagcgctcggccaggcgcgcgaatgagcggtgggggaggtcgccgatgtcaaggaggttgc

SEQ ID NO: 91958 - DNA, 515 bp, Oryza sativa
tggctctagttcacgccaggaacatcggtaagtccgatgcatggattacacggcatcacattgatactttccccgcgtggctacgacaacatctcatggataacgagtcaatcaaccaacaacttgccttcctggcgaggggaccgtctgggtcgatcacgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgcgaaggacatgtctagcaaaggaaagaagggc

SEQ ID NO: 91959 - DNA, 803 bp, Oryza sativa
ttggaacccgggagatacctatagaacgttccattcaagcagatcgcacatcctgttttacctttaatttgacctaaaactgaaaacattgctggataatcattaatggtcacgaagatgatggccttcactgtgaagtattcccttaagtactcctctcacactttcaatccctctttccataaatcagccatatcttccaacaatggttcaagaaatacgtcaatatcaataccaggctgacggggtccctgtatgaggatacagagtagtacgtatttttgcttttgacaaagccagataggaagattatacatggtgagaagcactggccaagtactatgtgagctgctcatgtctccaaaaggattaactccatcagtactcagggcaaatgtaatgttccgtgggtctttagcaaactctctgtactgagcatcaaagtttatccactgacgagcatctgccgggtgtcgaatcatcccatccttcttgcgcccttcttcatgccagtgcattagttccgcatctcgtgggtttgagtatatcagtttaatgcggtctttgacaggaaggtaccacatcacaagctgcgggatttttctctgtcgtccctcagttgtgtcagacggttctaggccagtattgctattcgatttgtaccggctagtaccgcatgttggacattcatctaaaaaaacgtactctttcctatacagtatgcagtgatttacgcacgcatgaatttattccacaccaagtgaaagagggcatatgggtttctttgcttgatatgtgctgga

SEQ ID NO: 91960 - DNA, 616 bp, Oryza sativa
tatgggcacgggaagggtggacgaggccgggaggcggccggatttctcgccgacgtgggggagtggggagagagagttgggggggattcaaaccgaatcccgcccttacggggcgcgcgcggggcgggaaggcgtggggaagggggcggcgacgtgggcgcggcgacgcgggcgcggggcgcggagtggaggaggtggggcgccggcggttgccgaccggctggaggttagggaaggtgctgacaggtgggccccacctgtcagcgcccgagggagtgagggggaggcgacctagacttcgggagggggcggaagagatgggccggcggcccaaaggtggaaaagagggggaaaaggatggaaaaagggaaaaaaaaaggaaaaggatttctagggatttaaatattgcactttgcttattttaattggttaaaattatttccaatgctctgaaaattccactaaaaatcatgttagcatattttgacatgtagaatccaagaaaaattccacatgccgattccgattattatttgcatttattaatttgaggaattagctctaggttaaattgaacaatttcttcggtatgatttattttacaaattttaaagct

SEQ ID NO: 91961 - DNA, 663 bp, Oryza sativa
atatatataggacactcatatggggcaccatggtgcccgggcaccatggtgtgtaatgcacaaaattactcaaatttttcaaaattttcaaattgtgagtatatacctagttataataatttgattcatacctatacttatcaacaaaacaactcaaatttaactttatttcacaatccatgattacatacctaactaattatatgtatggatgctatatacctagaattaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggcaccatggagcaccaaacaaatttactatatatatatatatatatatatatatatatatatagatgcacacaacaaaaaaaaagtgattggtggacagaaaaataggtgattgacgaagaaaaaatagttgacgatcgataagttataatttttaagtagctataatataagatttgcatgcagaagttgcattacagagacataagagaaaatcagagagttctagcccatcacttccattgctgcagaattaatcgtcacaactatggatagggcagtcaaaata

SEQ ID NO: 91962 - DNA, 544 bp, Oryza sativa
atccttatttgtaccgaattagcaccaagtaagataatgttcttcagatacagaagctggtgatcattccttccattgattttcatattttgcgagtgcagtgaagcttgggatcggcggtttcagcatgggtgcagctgctgccctccactccgcagcgtgctacgctcacggcaaattcgcgaatagcatgccatatccaatcacactcagtgcggtcatcagcttgagtggctggctcccttgctccaggtgccactttgatatccaataatgcagaaatattaatccaaacacgttgtctctactttttcatgactccaatgtttgttctaagaccctgaggagcaagacggagagctcacacatggctgcaagaagagcttcctccttgcctatcttactaagtcatggaagaggtaacacattaagctgttgatccatgaaaagccttccctccagaaacagtataatttactagttaattattactcctagtcaatgcatcagtctgttctaaattctgtatgttcttgcaggggat

SEQ ID NO: 91963 - DNA, 980 bp, Oryza sativa
gatcgatgaatggtgaaatttacctagctaagtgttatccggaacttccggaggacaggaagtttcggacctgtttccagttcaaaaatgtgagtaatggctagatgacgtcacctagccgttatatatatcccaatcgtccccagctcaccctttggccatttcacttttgcttttccattccataactgttgctagcctctcccaggtgtttctttgcctcctccgcccaattttgagccattcttgtgagagagtgagattttgagggtgaaggagaagatttggagaaggtgtgaaggctaggattggtgtgagcacttggggtatcttgtgggctgacatctcggtgcttattactcttggagatcatctcctagatggttaggtgtcacccgcgagcttcctttgcaattgtggatttcccgggaaagcttgtgaatattttcctcacctccgtaagggaacgaggtaagtgagtaaagaatcttatgctaaagtcctagtggttttcctaatagagcaactcacacttatggtgttttctagaagtaggttaagttggatctaggtggtcactcaattctagaaaattacctaaaggtgttggggttgaaggctgtggatttcctctaagatttttgcacaagtgaggcaaggggttaattgatacccccaactctttggagctcctcaacggagagtagatcgcgagatccgaacttcgggaaaaaaatatcctccttgtccatttctgtgatgtttctatgcttgtatctgggaacctattgcttttctggtcacctgtgtgtttctacttttgagaattggcttaatttttggaagtgaaatttgaatttcgtctgttttccggccaaggacaccggaagttccggactgtctgaacataccggaaagtttcggtgttctacaccaagagatttcaggcctggtgaatttaccgctggaattgtttttga

SEQ ID NO: 91964 - DNA, 691 bp, Oryza sativa
aaaaccaaccgattgcgggttagatagaatcactaataaagattataaagtgtatatgataactcgacaaattacataaacatgattagagtgtcatgaagatgtaagcactaataccgaaaacgcaatccgccatgacaagtttacctctagttgaatatcgaaaccgatgcagctcaacccgaaagcaagaacatgtctatacaaacgaacgtgaaaaagggtggcgatgcgccgagattgttattgaactattgttgttaaattacatgggttcgggttatatttatacccgagatacatgatatgtccttgccggacacgactcttatctctaacaaactctaagatacacataagtctttacggcagacttttgtccaaacatatctctaaggaaactatttaaaatatcctaattaatagatacaattgcctatctgggagcttatctccatcatgaaaatcctttcgtagcactgatcgatcccagaaacgatttcataaccatctcaatgaaatcggctatatcggctgtatcggttgtcccctgtccgatgtcatctcagcagatgcagactccagccgatgcctccgcagccgatgcgcactctgttcttcgatcacaacccctttgccgaatccacttcaattccaatgccgaacctagttcatcacttaccaaatttgg

SEQ ID NO: 91965 - DNA, 722 bp, Oryza sativa
ctaaatgccatattacacaagggtggggtttgtagtatctaactctaaggtgcttagccagcttctatcactatgaactggcgttgatacatgttgcggcttaaaaaccagtgctaattataaatattagtgccaatacgttcttagttataactggcactaatggacaagactacatcatgccagataaaaaactacaaaatggtcttagctacttattttattgtatctacctcatatagaaggagtaataatcgtggttttgctttcatacaaaacggtcttagctacctaatttaatacatccgcctcatatagatgaagtagtaatcgtggttttgcttgcataaataatggtttagacaattgcaggcttgtagctgactcttgaagctcaatcctgtcaccacctggtggtatgctccaactgaacccctgcagaagccttgcaaatagcatcattgtaattgatgttccgagtgacacggcaggacagccacgcctaccagcactgaacgatacaaaacgtaactctggctcagctagcaccacagtaccagtatttttcagatgtcgctctggttggaattcgagtggtttatcccatgctctatggtttcgaccgagcccaattcggcttaacatgacatggctaccctttgggatcatgtatccgcgacggcggtgtctgggatcgcgacatggggtgggttgaatgggtg

SEQ ID NO: 91966 - DNA, 554 bp, Oryza sativa
aatgcgttgcaccagaatcaaaaagtattgttgcagggattgagttaacaggaaacgtacccagtacagcctctggtgctgcttgtgcctcctccgcagatgcgtggttgacacgagcctggataaaccttggcccggcacgcctaggcttcgggcatttgttagcgaagtggccaagctcgccacagttgaagcaggaccctggttttgctccagtctccttcttggattgcgcgggcgggcctgtctgtgccggtgccattggtgggcgtggagctgcaccgtgattggactgacctccatggtggttctgactgccactggcgccctggggaaagttgctagggttgaacgggcggtgctgatgaacgatcatggtggtaggtccaccctgctgcccgggagcgaagcgcggcctctggtgacttccctgaggtgctctgaactgtgcggccttcctcttcctgtccatcttgttgcgttgatcctcctgacggattgccttgtcaaccagcctctcgaagtcagcgtagtccccagatatcaggtggttg

SEQ ID NO: 91967 - DNA, 1497 bp, Oryza sativa
tgggctcgacttgctggtcactcatgcacaccgatgtggatcttgtaaatgagaccaagctcgatagcgagattaagtcatggcttgcttttgctgcccaaaaagtggttgaagtgaatgcccttgctaaggcattggctggacagaaggatgaggtatggtactcttttttgccctttatctattctcacctcttaattagagcctgagcatagtactcattactcaatagcatttgaagaaacttctgctcatttatacatttgtgaacaatattgtacaggcttactttgcagcaaacactgctgctcatgcctccaggaggtcatcacctcgtgtgacaaacgaggaagtccaaaaggctgtaagtaccttctgtttttaggctgcatgcttgattctattcaacataacttggcctgtttttcttaatatcatgttatattgcttgtgcaggctgctgctctgagggggtctgaccaccgccgtgctaccaatgttagcgctaggttggacgcacagcagaagaagctcaaccttccagtccttcctacaaccacaattggttcattcccacagactgtggagctcaggagagtccgccgtgagtacaaggctaaaaagtgcgtaacagtccacatcaacgcttcaccgttttcccccttttttttgtctatattgctaattacaattcctgctacaggatctctgaggatgagtacgtcagtgccatcaaggaggaaatcagcaaggttgttaagatccaggaagagcttgacattgatgtgcttgttcacggcgagcctgaggtcagtatcctcgtgtactacttgtgtttagtgtttattactagactttacacttggctgtttgagaaaacaatattattagatttattgactcattaacaaagtttggtttgttctgcattgaagtaagctaactggcatgtattttacagagaaacgatatggttgagtactttggtgagcagctttctggttttgcatttactgccaatggatgggtgcaatcctatggatcccggtgtgtcaagccaccaattatctatggtgatgtgagccgccccaacgccatgactgtgttctggtccaagatggcgcagagcatgacctctcgccccatgaagggaatgttgactggtcccgtcacaatccttaactggtcttttgtcaggaatgaccagccgaggtccgtgcctgttgttgatgatgcaatgctaattattcaggttgcgattgagctttctgttgaggctgacattttcacacttgctcaggtttgagacatgctaccagattgctcttgccatcaagaaggaggtcgaggaccttgaggctggtggtatacaggttggacctgttctataattttgttctcaagtgaatacgcaaaacatgatcattttgcttacggctttttaattgtcctttacaggccattcaaaacgatgaaagctgctttgagagaaggtct

SEQ ID NO: 91968 - DNA, 535 bp, Oryza sativa
gaatcggcaaaagggcaagcccctttgtccccctcctttttttcccctttttcccccgccggcgtcatcctccctgtcgccgctttggccgcgaccgccgagcgccagctcgcgccttgaccgccctaagtcggttcccaaaccgacattgccgccccctttaaaccccagctccttcccctccaatctccctcgttttcgcctcctcgccatagctgccgcccccgtgctctgttcgccgaagccgtttgttgttgcacgtgtcgaaggagtcggcacgagcaaggacgcggaaggggactccggccgcgccctctccttcctcttccccggcccgaggccggagatattactcccgcgccgtcggcctctcgtcacagcgccccgacccgcacggtagtgcctccctccgttcttcctcctcgccccatctcctccccctagctttcggtagtagctcgagtagactacccgtagctagccggcgccgccccgaccgttgccgtcgctcaccgcgtgctcgccgccatcgccg

SEQ ID NO: 91969 - DNA, 873 bp, Oryza sativa
aatgctatggctgatgcagcacaatgggcattaccataccaacttcgccagctatttgtcacattacttcttttttgtgaagtcactgtagcgcccgttccgtcgtggcgcctagcgggaaaattatctcttaaaaaccctaattgcgaaatttgtttctttgcttgttgtctagtgtccgtgccatctcaagatctcaatccccgatctatcgtcgagttcaattccgaatccaaatccttccaatcaaattcctccgcaaaagtctattttgcctcccccgaggtcgatgggccgaatctcgctcggcccatcttcccctcttccccggcccatcttcccctctctccccgggcgctctctctctctctctctctctctctctctctcgcactctcccatctctccccccctcccgctcggcctcgcccgtacgctgctcgcgcgtgcgagagccgccctgagcgcctctctccccgctcccccgctcagcctcgcccgcacgccacgcgcgcgtgcgcgtaagccgccgcgccgagcgccccctccctttcccctcgctctgccgcgcctgcagccgcgcagccgctcgtcctcgcgagccagcgtgtgcgcgcccgcgcacgtggtggccgaccgcccggtcggcgccgccgccagcctctgcacgcgcctgtcgccagtgtcgccgctccgctccaaaccgccccgccgtcatcgtcgtcgtcatcgcccggcccccgcccctccgcgcgcaagccgccaagggacggaggcagcgcccctcctccctctgccgcgttgcccccgctcccctcctcctttttcccgaatcggcaaaagggcaagcccctttctccccctccttttttt

SEQ ID NO: 91970 - DNA, 1652 bp, Oryza sativa
caggatcccgtccacggaggagattgcggaccgcatcaacaagatgcttgcggtgctcgacactaacattctctgggtgaaccctgactgcggtctcaagacccgcaagtacaccgaggtgaagcctgccctcaccaacatggttttggccgccaagctcatccgcacccagctcgctagcgcgaagtgaggatcgcctttgcagcaagttcccttcgattttgaggaggaatgccatcatagccatcttgtttttgaataatctgggtccagtggatccactgtctgtggttaggtttagtcagtctcttggggccaagatcactcatacccattttactttgaatgaatttggtggtttttgaggcagtctgtcggtgtatttgtattgtaaactgagtggaaatcagcagtgtttcatctacatctgagttgttgcggatcaaattacaaaattttcaaggagagttgatgttatgttctgccaagtacccaaggcttttgtctggttttcacccgagttgatagttttctgatgatttcttgctgtgttatcactttgcattcttttactcgtgcttatgtgctgttcatgatgatatataaatccaatcacttgaaagacttccatgttgggatttgaacacaaattggcttacttctgtaggcatattcaacaatagcaaactcttcatgttcattaggaaatgaaatggattgaaaatgtaacaaaagtatacttgcaattagtagtacattttggttattaatgtggtgtttcagtatacacatttgcaggtgttaatttacatgtaatcacattagcttaattacatatcattcacatttggcatctgtttggtcagagacacaagagtcaagagctcaaggtgcgccacacggatacgatgatcccgacgagcaccgccgccgccgccgccatgttcaccatcagcctcctttcctccgcctccctcctcccacctccgctcgccgtcgccgtcgccggcggccgctcctcctccgctgctgccgctccagctcgacccatttcttgcgcctccttctctctcttctcctctttcctcttctgcttcgaaagcggcgtagtcgccggtagccttggatcgccgccgtttgctgctggacttggcgcaagaagcggcggccgtggcgagtcttttgtgctcggcggcgacgaggatgtcggcttgccggcggcgggctttgctggttcaggggtgatagccggaggcggggtccaataccgctgtgacggttgctgcggcggcggcggcggcgatggcggcggtggctttggctttgttggttccggaggagtcactgccgttggagaccaataatcctctggcggcggtggcagcggcgatggcggcggcggcgagggctttggctcgagaacacgtggcatcttcaccggagctcgtggtggtggtggtggtggctgcggctttggctcgacaacggcaggggtgtcccccggagttcgtggtggtactgtacgcggcggcggcggcggagatggtggtggcaatgttggtggcggctgtggcttctgctgcacaacggggggcttcaccgacggtggacgtgtcagcggcggcggcggcggagatggtggttgcaatgat

SEQ ID NO: 91971 - DNA, 524 bp, Oryza sativa
ttaaactagaccaaaagtgagaatccccattcttatgtttgatttgagtcagagttttctttttcaaatacttgtttcttagcatgtcttgccacaaaccttctgtattctccaaattccacagccatttccccaacagagctttattcattacatctaaatctaaaatccccagccctccctgatctttagggaggcagatcactagccatttcactagatgatatttcctaataccttgatcttcttgccacagaaatctccttctataaaaatcaattttttctctaactccacaaggaagagagtataaagacatcatataaagtgggacactgctaatgctagagttaatcaaagcaaccctccctcctattgccaggagtttcccctgccagcaccccaacgtcttttcaattttttcctctacaggtttccaatctttgtgatggattcttacttgatttatgggaacacccaaatatttcattggcagtcgcccaatttggcaagtgaacatttgg

SEQ ID NO: 91972 - DNA, 2216 bp, Oryza sativa
ggatattgttgcatctttgatgaccatgctcaatgcacacaacccagttgttcagctctttcgaactgctcgtgataggctgcatgatcagttagaggatcattactcagtgaagttatttgccacccccaatgaacatggtaatatctactcagccccagttgcatcagaggtggttggtttgatggttaatgatataagcactaccgagaaaggtcgtgacttaatagtagaggatcactcattgcagcttcaaagggtaaatgaaactcattgcaaatttatggcaatgcaatacccgctattgtttccttatggagaggatggttttcatgaaaatctcaagtatagacaatgtcaccgctcaggaatgatcaaacggaagaaagttagtttggtagaatactttgcatatagattgcatgatagagatgatgacttcaacaccccattgcgttgcaagaggctcacacagtcatatgaggttgatggtttttgttgtgtcaaggatagccgcttgaaccattataggaaaaaaaaaacttttcagctgaagtataggagtagcccctataaagctttacttgatacagtcagtagcggcattattgatgcttcatcggtaggccagaggattattttgccaggttcattcactggaagtccacgctattactaccaaaattaccaagattgtgtggctctctgtcgtagatttggatgcccggatcttttcatcacttacacgtgtaatgctgcttggccagagataacagaagctttagcatttataccaggacaacaaccttctgatcggcccgatattgttgatcgagtttttgaaatgaagctcaagctgtttgttgatgatataaaaaaaatatgagttctttggtcccatactcggaagttagctcgtttaattactatgttttaattcttatgttttaatatgagttcttatgttttaattactatgttttgtttcagttttgtttacctcaatattttttttcagttgtctacacgattgaatttcagaaacatggtcttccgcatgtccacttgatagtgtggcttaaaaaggatagaccccttgatgccgatcagatagacactttcatatcagcgcagttaccagacccatctattgaccctattggttatgaggctgtctcacaattcatgattcatggtccttgcaatattccaggttcctcttctccttgcatggctgatggtaaatgcactaaattctatcccaaggaattttctgacaaaacagttgtgctacctaatggccatgttaggtatgctcgaccaaataatggaatcatacaaagaaacgtggcattgagattgataatcaatttgtggttccacataatgtagacttattagttaagtatcaggcacacataaatgtggaaagtgttaatcgtgatggtatggagaaatacatgtttaagtatacaaacaagggccctgattttgctaaagttggaatcaaaagaaaaagatacccccggttcttctacagaggaaataaatgaaataaaggaataccttgaatgtagatgtgttacaccacatgatgcagcttggcggcttttgcaatttgatatccatcacaccgatccagccgtggaacgtcttccagtgcatctcccactagaaaatggtgttgtatttactgaggatgaccatcttcaccaggtgattgataatccatgcaatctcataacaaaattgactgcatggtttgaggcaaacaagacatatccagaggctcgacaacacacatttgtagagttccctgaacattggacatggcatggtgatggaaaattttggaaaccgcgtcgtaatgcccgtggaaaggttggccgtatagccaatgttagtcctaaccaaggagaaagattttatctgcgtatgctattgcatattataaaaggggcacaagacttttctgatcttcacaccatggctggccaactatacccaacatttcgtgctgcatgtcaagcattaggtttacttggtgatgattgtgagtggtccaatgctatggctgatgcagcacaatgggcattaccataccaacttcgccagctatttgtcacattacttcttttttgtgaagtcactgtagcgcccgttccgtcgtggcgcctagcgggaaaattatctcttaaaaaccctaattgcgaaat

SEQ ID NO: 91973 - DNA, 923 bp, Oryza sativa
aacgggcggcacggcccggcccggcacgggcacggttccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcccgcggcccacgggccgttcgggccacgggccgtgcacagtgtttttttttttttaaaaaaaaggaaaggaaatgtataaggaaaaaaaaattaaaaatggaaataaaatgtttaaaaaaaagtaatgatttactaatgttaaaaaatgaaaaaatggtatttaaaaaatggaaataaaagttttttaaaaaagtaatgatttggtaatgttaaaaaaaaagaaaaaatggtatttttttgttgtgttgaaaaatttaaaaatatagattgtgattcattattttgaaataatttaaaggtaaatccacacttgcgaaaatattgcaaaagaatttgttaaaaatagtaatgacctttattaatgtttatatcattacaggatacaatgatacatgctgcctcgttaaaaactttgtcatgtaaaaactcataggggaaaatgagaaaaccatgacaaagaaaagagtacagctcaaaggtcagaacttacttctaacaaaattctactggggttggtctggatccaggtagagttgctcaaagtggccggccaattcttggttgtccgcagtgtattgggcatgttgtcgagcaagctcccagtctttaacgtttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaa

SEQ ID NO: 91974 - DNA, 597 bp, Oryza sativa
ggcatgaatcaattgagcaaactttcaaaacgtgatctacttgtgggcttgaaagatgtgaagtttgagaaagataagctttgtagtgcttgtcaagccggcaagcaagttgcatgttctcatcctactaagagtatcatgtccacatctagaccattggagctcttgcatatatggatttgtttggcccaacaacctataagagcattggtggtaatagtcattgtcttgtgattattgatgattattctcgccatacttgggtgttctttttgcatgataagtctattgttggcgagcttttcaaaaaatttgcaaaaagggcctaaaatgaatttagttgcactcttgtgaaaattagaagtgacaatggttccgagtttaagaataccaatatcgacgactattgtgatgatcttggcattaagcacgagcttttcgctacctacttacctcaacaaaatggtgtagtggagaggaaaaatcgtacattgattgagatggcaatgactatgcttgatgaatatggtgtttccgattccttttgggcgggagccaataacaccgcttgctatgcaactaataggcgttattttg

SEQ ID NO: 91975 - DNA, 684 bp, Oryza sativa
gtgagtgtcgtcggaccggctaggatcacacagggcccgagagctaactgtgcggcgtgctatgaaggtcaaggaaatagtgaagctccgaccactgtacgcatcaaggcgtggggtgccaggagcagcacttcgaccttgggtttggttttgccgggctttacaaccaatggttcgacgtcggggccaatagaccgcaaacgtccccatggaaggtgtaaagttccaaccgacggctttttagtggctaaagggtattttgggataaaagaaaatatttaaaaaggcaaatataaattcaaataaaatagcaaattgggaaatgaagcatttgaatttatatgaatttaggtccaggtttcactgagatcggatctacggtttaggagatatgagcttctaaagaataggatttgaattaaatctagaaaatatgaaaggttactattcatgggcctacctgtcagtgtctattcccttttctcttctttctcttcttcttctcgtcttgttcttcctcctgcttcacagagagccgagagaagggagaagagagggagaaaggggcgctggtgctccggtggtcgagaggctgcgacgtcggcggcaaaacatgttcctgagcgacgcgcatccagggagggtggtagctagctaaggtggagagtgagatggccggaacgg

SEQ ID NO: 91976 - DNA, 2876 bp, Oryza sativa
agtcggcatctgcaggaggcgtagtcggggtcggggtcagccgcgagcgtcgacgttggcggcagcatcggcaacgagctaggcggcggcagtttggagagagagagagagaaagagagatcgagagagagagagagaggcagtggcggctctcacccaagagatgtggcggcggcttcagcggcggaggcggcgaggaccgcaagacgacggcgagagacgacggcggcgtcggcgtggggttgccctaggcagtggcgccgaaggagaagctgagatcgattagaggaaaaacttctaagtgttggtggagaagacgagggcgcaccgggaatatatatacccctagatctttagtcccggttggtgagaacatccgggactaaagatattttcccgctatttccaaattctttttaaacccgattagggttaagaaccgggactaaagataatagcactgaattttgaatttcattacatatgtgtttctaaaatagtaaataatgcattacaattatttaaagtcaaaaaattaatgacaaaaccttcgaaaaattattgttatctgtagtaaactaagtggataatatataataagcacatgaatgatttaaaattgttaaaaattttaataatcatatataattagcatatgcatgatattaaattgttaaaaattctaattaacatatgtaaataccacatgcatgatttaaaactaataaaaattctaataatcatatataattagcatatgcatgatattaaattgttaaaacttctaattaacatatgtaaataccacatgcatgatttaaaattaataaaaattctaataatcatatataattagcatgtcatgatattaaattgttgaaaattctaattaacatatgtaaataccacgtgcatgatttaaaaattctaataatcatatataactagtatatggatgatttcaatttgataaaaattctaataatcatacataattaacatatgccatacaacaattgatttgtatggatattcaatacatccaaaatagtttacatcgtgtacacaacaattacggcaatacatcggcggtgacggttgaccgcacgtactttctcctcactattgttccttccttgtgatcgctacgtgagtaaggggtgtcttcatttgataggaggatgctagggtcaatcgtcaccgtgaaagggggttgcccatcaaactgatcgtaatcctcgtcagtcttgtcctctactccgacaatttttctttttcctgggagaaccacgtggcgcttcggctcgtcaggctctttgcccttttttcctttgctagacatgtccttgatgtaaaaaacttgcgttacatcattggcaaggacaaaaggttcgtccgagtatccaaccttgttaaggtcaaccgttgtcatcccactgtcatcaatcgttacgcctccaccagtcaacctaacccattggcaccggaacagagggaccttgagaggtccatagtcaagttcccatatgtcctcgatggcaccgtaatacgtgctagttgtaccatcgtgtcccatggcatcgatacgaacaacactgttctggctcgtgctcttcatgtcttgggctctcgtgtagaatgtgtacccattgatttcatatccctggaatgtcgcgatcgagccagatggtcccctcgccaggaaggccagttgttggttaatcgtctcattacccatgagatgttgtcacaaccacgcggagaaagtatcaatgtgataccgtgtaatccatgcatcggacttaccgatgtttctagcacgaactagagccaagtgctcctcgatgtaaggagccaccaatgaagattgttgcagaatcatgaaatgggctttacggaataaattgttgtctaccgtcattattgctttccttctgagagtcccctttccccgtagtctcccttcatggcgtgattcaggtaccccgattgggcgaaggacttcaataaattctacccagaattcaatgacctcctttgtttcataccccttggcgatgcttgcctctggacgagcacggttacaaacatatttcttcagaacgcccatgtacctctcgaaaggaaacatgttgtgtaggtacacagggccgagaataccgatctctttgacaaggtgacaaagcagatacgtcattatattaaaaaatgaaggtggaaatatcaactcaaaggtgacaagacattgcaccacatcattctgaagggcttctaatctatccggatcgatgaccttctgcgaaattgcgttcatgaaagcacatagttttgttattgttgcccggacattgtctgggaggataccccttattataattggtaacagctatgtcatcaacatatgacaatcatgagactttaggtttgcgaacttcttctccttcgtgcttattattcgctttatatttgtggagtatcctgacattaccttgatgctctccaagcattcaaacatactttccttctttgccttgctaagagtgtagctggctggactcaagtaatggcttcttttctcctttggttccgggtgaaggtcgccgcgttgttccatatgcttcagatcattacgtgcttccagtgtatctttcgactttccatatacacctaggaagccaagaaggtttacacaaaggttcttagtgacgtgcatcatgtcgattgcgtggcggacgtccaagaattctcaatagggtaactcccaaaatatggagttttttttccacatcgccgtgtgaccatcttcgctctctataggctggctgccaggcccctttccaaacactactttaagatctttcaccatagcaaacact

SEQ ID NO: 91977 - DNA, 616 bp, Oryza sativa
tgatcgtgatcacccaccagatggaaaaagtgcttgagattgctgatgaggtaatcttattagataaaggtaagatcttaacatcaggcacgccatatcagatctttactaaccctgagatcatgcaaacaacatcaattgcactgcctcatgtggttcaagtcattaatgacttgtcattaagaaatccgatctttaaaaaactgtatgactacgaaccaagaacagttaaagatctagcaaaagtaatcaatgaagtaatcaagaactatgaaaaacgcaattaatgggtacatattaagtaattcagttgtccataaaactaatccatcaattaaattgatcatttttattgcttttgttgtgatcattttcttaccaactggtttagtttttcagttgattgtactagcaataatctcattgatcttcatgatctctaaacttccgtttagaatctattgatcgactttaaaaacgatcattatcatgttcttgttcttgtttttaattaactggtttacctatcggaatcctggttttttaaatatctcagtctgagctaacaataaccatagttacatcttaattggtgattataatgatcattcagtgg

SEQ ID NO: 91978 - DNA, 789 bp, Oryza sativa
cacaaccccaaagcctgcaccgtcgccgccgccgccggagccaccaactgggccagtctctgctcgccggctgctcagaccgctcccagcagagggccccagcattgtgatacccagggcgccagcaatggcggtgacaaaggacaacgacgccaccgccgccaccatgtcagtgcgaacgcggggtgaagccgccggcgacgagccccggccaaagctgaagccactgcactgggacaaggtccggacgagctccgaccgcgacatggtctgggaccggctcaagtcaaattcattccagttaagataaaaatttcagaaaaaaagatctggaattcttatgctgttcattacatttttcaatttgttgattgctgatatgaacatgttgcaggttggatgaggatatgatcgaggtgctattcatgaacaattcgacagccgtggcgcctaggatggacaacccgaagaaagtcggcatgccgcaatttaagcaagaggagagagttcttgaccccaagaaggcacagaacattgccatcctgcttcgcgcgctgaatgtcactctcgaggaggttacggatgcgcttttagatggtaagcaataattgtttggcctctgtttactactctctccgtccgaattttaactttttgcttttaatgtttgaccacttgttttatttaaaaaatttgtacaaatataaaaaacgaaatgttatgcttaaaatattttgaataataaagtaagtcacaaataaaataaataataattctaaaattttttga

SEQ ID NO: 91979 - DNA, 697 bp, Oryza sativa
tagtcgtaactcgaccactttaagtaaaaatagtggaagaaacgctacatcactagtcgaggacaatgcagtagtcgtaactcgaccacttgaagtgaaagtagcgaagaaacgctacatcgctggtcgaggactaggcagtagtcataactcgaccacttaaagtggaagttgtgggagaaacactacatcgctggtcgaggaccaggcagtagtcgtaactcgaccacttaaagtgaggcgagagagatcactacgtcttcctggttcgagaaccaggagtaggagtctcttaatcacttatgggggcgctaaagttggtttattacatgtgcatatcatgtggccagcatgactcacatacccaacttatagcatatccggatgtcctcttgcaatcatgttgggtgatcaagccgacggtgttcgtgaggagttatccgttaacaaccttttctcgagtagtccagcgatggctggtgctatgagataggtcgtcggtcttctttggtaggttgggcgtgacgactctgcatttgtcgagatcgttctcgataatgcggtgtactcgaccatgacctactcgagtgctcaattgttcctgaaaaatattttctagaaggcaagatatatagcaaataatgtcgagtatgtactcaaaaaactgcatggatgttctagtattattaggatataa

SEQ ID NO: 91980 - DNA, 599 bp, Oryza sativa
atgctcaccttgcaataatcaatcaacctcagttgaagaaaaaggatccagaaggagaagacgtttggcttataccccagttgagctgcctgtgggagtggagccggagcttcgctagattttattttccgctgcaattttcttcttggtgaggactaagtgcctcttaagtaagtatttatcgttttagttaatttgatgaatctgtatattaaattgtcagtttgtgtacctcgactgattcctggacgaggattttatgcacaaataagttcggaaattactagtgaatttccgggcgtgacattgttctagccaagagtcaagtgcattgcttccatttgtagagctagtgtggcacttgatcatctccacgccgggtcatcgcttgttactcttggaggttgccgcctcctagacggcttgtgaaggagttgcccggtgacctcttgtcgcacccggaaaaatacattttccagaacgctagtgtattaatccccgtcccaggaaaagccggggtacaccacacaaacaggatacaaaaggcacatctttattatatcgataaatttacattattacaaagtcacttcagccct

SEQ ID NO: 91981 - DNA, 817 bp, Oryza sativa
tgcaccaagcgggcaagcggccaacatgcatgatgcatgcactagtgagcagcctagcatgcatatgctagggtttgattgcatatcggtacgtgcacccgagacatactaccaggagatgaatacgtgcttccatcaagcacgctaatcacggtaattagtaagattggtttctaaactaatttactaattcatagatacatccgggcatgcgtctattaaggtatgcggtgtttttataaattgattatattttctcgtttttcatcatattatggatgctttgcttgcagtagatttgattatgctcttgatctagcggtagattaatttcctgcttttgatctatatgcatctattttatctgatgaaaactgaagaaacccgtgtgagagaaatcattaaaattgatgggataccctggactggagacgtgccaaattcggctgggccgaaccaaccgtctcgcccaccctccctcgcatctatctgtttctctctttctctgatgacgccacgccggaaacacggcgacatattctcagtctgtgcagtcggacttggagacatgttggccattgttcgctgtcgctgttgggtacgccatcggccttgcgtcgatgccgtcgcgggaaacagccgtctcagaaaaagccctaaacccatgtcgttggtgccgctggagttaatgctgaagtgaggcgccgccgacgttgacctcccatcgacgcttgcgtcgagccgtggtgggaagatgatgggtcattggttgcctactatccgattaatctccggcgagacgatatgccggatgcaa

SEQ ID NO: 91982 - DNA, 828 bp, Oryza sativa
cattgttaactcagtctggcccaaacttgtgtttacccgaccatgtgttgttacaacattttcgatacgggttagacaaggagtctgctacaaatctcgatattttcgctggaggatcgttcgcacacaagacaactgccgaaggaaaagaactcttagatctgatcttagagaacgattctttcggccaaagcgaagcatgcccggagatcgagattatccatgagtatcctctgcacgtggagtcggaacccgactcaactgtcgaatcctcattccagtcgctggagccggaggaagaagaaattcatcctccgaaaattccattccaattcaggggtgatctttatgaaaattatgagaacaccctgaattattccagcgaaaagaaggctcatcccaagcatgagccgttcgagaaggtgatgtttgtatcttcgttcgtttcttctgaatctatttcccatcttcatgaaactgaacgtccctcatcaccctcgatcaagcctaagccttgtccctctggccctcataatgatgttctcgtttatcatcatgaaacaacccaattcttgcacgatgtatctcttgagaaggaaaacccttaggccacggacaagcttgagacattgactctggaggacgagagaaaacattccacatatgagcatgaaagtttctctttcaaaaccccccaggattcatgctcacataaggaatccccagagtcctgttctgtggtcgtaagaaataccaacaaagtcttcatactcggctaactcctggagatactcctcggcggttgggacgatgtcttcatcttcatac

SEQ ID NO: 91983 - DNA, 3449 bp, Oryza sativa
tcctagggggaggatgacaacagtacccttatgatttttcatgtttttgtgatgtatggctgattttttctctagaatttcaacaacgcaatttgcaaaatcatagtaacctgggaaattacatatctctacaaaaaatcacccaatatacatgtaaaatcaccctatttctctctctctctccagatctgaaatctaaaaaaaaggaaaaattgccgagccgtcgcccgcacactgtcggccgaccacacgcctcccgcctgcgccgtcggccgaccgcgccccgcccgcccaccaaatcaccaccggaagcgcccgcacgccaccggccgaccacgcgccgcccgcccacgtgcctgcgctactcctggccgccgccgtgcgtcgccggcccagatgcgccgccgccaaccctagcaacgggatgcgctctgaagcaatgggagaggatgagtacgggatgagaggggtgagcttggttgggtagggtaggtcagtggtattttgctgtaaatacgttaaaaatttaaagggtagtgggtcttttggggtggagtggagctgtggagcagaaaaacccagccccacacccttagttcattttttaggagtaactctactaactccactcctaaaaatggaggatctgaaccgtttggcatagctctagctccagataagttggagttgggagttggagctgtgccaaccaaaggaataagtttactttagaaccctcaatttgtcaccaagtctgaaattcattcctgaaaccaagctaccaggtacctgacttacaataccatgtcaactttggtccatcggcagtatagtgtccggttttggctgaggtggcaagtgagccccacatgccagcggtcaactcttctccctcctctccctatccctcttccatgtggtattgagctccggaggcttagccggatggcatcgcggtggcggaggatgaggccacgaagagggtgtggctggcttcgtacagctcctccaactcgttagagtcggctaaggtagcgcccgagcccaccacagagggaatgcaattgaaggagagacttggctctaacttcattagtggcatgaatcaagggccagacccatgggatgctgatgttggacagctgcacccgagttagggaaaacgactccaacaacgattggaccttgacgagggatggaatggggtcgccggatttcggggagcctgttggtggtgtaggccaaaacaattggggatagtggcggtggaaatgcactgttctgagagggcaaggcgacgaaacaaggagatggccgacgtgcgtgttccatgggacggtgtcggtggtcgggcaccagagggagatggaagacgccatcttctttgtggcgccattcttggccgccgcgaaggaggcggcgatggaagggagcggcgacgtggaagaggatagcaaggaggaggatgacgaggttcttcacggtgtacgacgggcatggcgggtcccacgtgcagaggtgtgccggaagcggatgcacgtggtgctcacggaggaggtgcgacttcggaagctgctgccaggcgacagcgatggcgttgatgtcaagaacaaggaccaggcccggtggaaggaggctatggcgacgtggttcaccagggtggatggcgaggtcgatggcaccgaggaggccgacacaggcgagtagatgatgggcttcacaaccgtggtgaccatcgtgggaccccgccatatcattgtcgccaactgcggagatccccgcgttgtcggcctgcttcgctcgtgcggaaagcgaggtctgtggcgtcgaggaggccaacaccaacacatgcgagcagacagtgggctccactgccatggtggccgttgtggggcccagccgcattgttgtcaccaactatggtgactcccgtgttgtcctctctcgcggcagcctgcttcgccaatgcggcaccaaggaggctgacacaggtgatcagcagccaccatcctctcccgcgatggtgtggtcatgccactctccttcgaccacaagagggagagagatgaggaaggttaagaagaggggatagagagtgatgacgtgagtgccgttgtatttctttttacttttaaccgaacacttagtgacgtgtgggtctcatggttttttctgactttatcaatgccatgtagacactgcctcaccaaaaccatcatccaaattgccttgggacattatttgcattggttttagaagttaagggacatatcatatttaaagacgaattttagactcggcgataaattgggagagaagtgaacttattcctaaaacaacaagtggactagtgcttggtcggccttttcatattttatttctaacttcacaaatttatgaatttagatctgtgattacatcggtaacatttagatatcttaataagattttaaaattttaaatcactataatgtaacatacgagcttcaaatttacgagtatcgtaaatatggagctgtggcatagtacgggacaggtaagggtgtgttcgatccggctgcggctcatgagctcatcatggcatgcaatacgagacaggtcattatatataatcaattaaatattaactattaaagatttgaaaaacatatttgtttgactttaaaaaaagatactttcagctatttcttagctatgtcctaatttattactgtgcatgtttcttaaaatgctaaattgtgtgttttttaaaatattttctatatcaaaatatctttaaaaaaatcaaataattatattttctaagtttataatatttgtttgactttcaaaaatgatactttcagctatgtattagctatgtcctaatttagtactgtgcacgctttcttaaattactaaatggtatgttttttaaaagattttctatatcaaaatttcttttaaaaaatcaaataaatatattttctaagtttattataagattttttttagaaaaacattacaatcatagacgctcataagctaggagtactatactttttttactaggtctctaatttcgccatgtgttcatgcctggcttagtaaaattaattgctagaaaacacataaaagcttagtaaaattaattgctagaaaacacataaaaaaaccagtaaattttaatttgcaagataaagtcatgaaggacgtttcttttaaaaaaagacatataaaaaaaaagctcacaatggatggtacagtttacaatcactatcaggaaatatagacatgaatatgataactatgataaatggctgtttctgtatagttggatcagcttttgaatttgcaattttaagacggatttccccccaaaaaaaaacaatttgtgcggccattaggcgttgagacctcggcgaatggcagccggcgacgtcgtcccacctccaccgcgcccacgaatc

SEQ ID NO: 91984 - DNA, 1162 bp, Oryza sativa
cgatatgtatagtacaaaagcattgaagcgatagtaaaatccacaattaggagacacaataatcaagggcaagggaacgagaaccagttcatctttcccggcctcttgttgaaatgatttgaagtagtatagtagtagtaaccaacaatcaatatataataactgtttcgtttgtacatacacatggagagttgaacccaaatctccacatctcctttgtgctgctaaaatcataaaattaaaacctactagtttttaaagatggaaacaaagcagaagcacatccatgtgtttgctttgatgcccccaagctcatctcctttttggcttgggaggaaaaaaaataaaaagaaatgaaaagttgatggaatgcatcgatcgatctcttgtcgctcttagattagatcttcatttgccttggtgatcctagccctgtggcttcagatctcttcatgatcctcaacttcttgcatgtgctggtgaacatgctgcaaaatcaaacagcaaatttaatcagtttgactgcaaatatatatataagcaaattactaattaattaagagatttgttgagatgaaaagtttgtgaagaacttactcgaaagggacgtcgccgacgagcatgaggtcgccgtccttgtcctggtaggtgatggcgaactccgacgggttggcaccgtcggcggcgccggagaagcagacgaacatggcctccagggcctcgcggagctccctgtagcccttgtacatcctcaggtcgatcttcctcaggtacggcgccccgtccatgctcaccttcaccagcgacccgccgttggccgccgccgccgaggaggctgccggcgccggcgccgcgttcttggtgatgggctcgtctttgttgttgcagctgctcacggcggccttgctcttgctcgccgccgctgactgttgctggaagcagctcttcctgtacgacctcaccggcggccacccgaccacttgagccctgcagggaggaggaggaggcagtcgccatgtcagaactcagaaccctagctagcttcatcgtaaaagtcaaagatgatctctggaaaagctagctactcacttggctaccggcggcgcggcctcgacggcgtcgtgctcgtcgtcgtcggcggcggcggcgttggcgttgttgt

SEQ ID NO: 91985 - DNA, 556 bp, Oryza sativa
atggctatacaaaatgattgctggctgcagaaggtcatccagcaataaatatggccaacttttagaagagcattccagcactagcaggtcagtaaataatgcatgtacacaaagtacacaaggcatccctgccaaaaagttctaagatgacctcattttcttttgctttcgatttgggcttgatgattccttgaaagctgaagggcagatgttgtttatgccgcacatgtcacatttgggcctaagtggagtacagattgtttgcccaaatccaacctgcatgattttaaaaacaataatttcaatttacataagacttacatttctgcagtttaggtaggattcagatatgtagtgttaaaagcaaatgacactatcttatgtagttatttacatggtagaaattgaacatcagcggtggaaaaaagaaccgattcataccagtaatgggttgataggttcccactcatcctttggtagccacttctcaagagacattcttgtttgctcgggtgttgtagttttctgagcaaagtaaacaaggggcaatttgtca

SEQ ID NO: 91986 - DNA, 638 bp, Oryza sativa
tttgagggtgatttttttgtgtgtgtgtgtgtgttcttgatttttgtttttaatttggtttgttccagattcctgacggaataatgggtgagaccatcgccaaggatgtcaccgaggtgagcgagcgccaaaatggtttcttgttcttcatcgtggtggcatttttttggattggtattgggatgtgatttgagagagaaaaagaagaagattgaatcttttttgtgatgtgctgtagttgattgggaacacgctgttggtgtacctcaaccgggtgacggatgggtgcgtcgggcgcgtcgcggccaagctcgagtccatggagccatgctccagcgtcaaggataggtgaagctctactgaaatttatcatcttgtcatgttagggtggtggattatgtctgaaaaatcggttatttgtggttgtttccggaatggagatgtgatttttctctgtttagttctcagctgtttatgattagagctcttacttgcatcttggattttgagatgaaattttgatgtgtggttgtgttgggtttgtacaggattggatacagtatgatctctgatgcagagcagaaggggctgatcactccaggcaagataaggattttttttaatgatttcggtgttct

SEQ ID NO: 91987 - DNA, 736 bp, Oryza sativa
atccccgcaacagtgcttttcgattttggtgctacacattcatttttatctatgagttttgcgggaaatcatgggatggaagtagaagatcttagatgtcctttgatggttagtaccccaagtaatcaagcactctctttgcaacgtagcccctcggtcagaatagaaattcaaggagtaccatttctggccaatcttattctgttagaatccaaagaccttgatgtcatcctagggatggactggttagccagatataaaggtgtgatagactgtgccaacagaaaagtaactctcaccagcaatgatggtcgagttgtaactgttcatgcattgtcttctgagtttttaaggtcaagtctgaaccaaatagctttggaagagattcccatagtacaggaatacccggacgtgttcccggacgatttacctggtatgccgcctaaaagagatattgaattcagaatagatctggtaccaggaacaactccgatccattagagaccttatagaatggcagccaatgaattagcagaagtcaagaggcaagtagatgatttggttcagaaaggatacattagaccaagttcgtctccatgggggagctcagttatttttgtggaaaaagaaagatcatacccagaggatgtgtgtggactatcgtgcactaaatgatgtgactatcaagaataagtacccgctgcccaggggtaccgagctcgaattcgcctatagt

SEQ ID NO: 91988 - DNA, 746 bp, Oryza sativa
atagctatttcacagtatccccatgtcacaatgtcacttgcttataaataaaaactacaatccagttgaatctacggaaaaaaaaatttaaagatcgaaagaagaaacaagagtataaaaatacgaaactacaaaatggcatggttaacactaatccaataggtcatttaaaaaagaaggaaaattaagtattgataaggtgaaattacatagaccagacagatctaatatgtctcagacatgtccaaagattaaggcacaaatgaagattttaaggactcttctaccatgtaagggatgtatacacatatgtgtattgtgtatagttcacatttaatatctctctctgtttgtcttgacttggacttttttacagaatgttaacacctgatacttttaaaaattgcagttttttttcaataattttattattatcttgcaattatgaaacaataaagttcagttttaatacctcttatcttttaggaactcccgaagcttgtcaatgagtcgctgttcatcaaagcacatggggctaccattccccagtatttgagatagtagatccattaagatcttcctcatgtctggtttctgggacatagacacaaaagccttacaatcaaattggccattgatttccttatagacttgattgcaagtgttgtcttgcccagacctccacatcccacaatggacactactttgagttgctgtcttgatgggccactatcagcttcataagt

SEQ ID NO: 91989 - DNA, 740 bp, Oryza sativa
ggcgaattcgagctcggtacccttatctggctgcctactgatggtgacgccgaaaactttatgaagtcgcatgttgagccgacgattcgcgatattccgtcacttctggcgctggccccctggtatggaaaaaagcaccgggacaatacgctcagtatgaaacgcttctccaacggtcgcgggttctggtgtctgggtggtaaagcggcgaaaaactatcgtgagaaatcggtcgatgtcgccggttacgatgaactggcggcattcgatgaagatattgagaaagagggatccccgacgttcctgggtgataaacgtattgaggggtctgtctggcccaaatctattcgcggctcaacgccaaaaacaaaggggacctgccagattgagcgtgctgccagcgagtccgggcatttcatgcgttttcatgttgcctgtccgcactgtggtgaaaagcagtaccttaaattcggcgacaaagagaccccgttcgggctgaaatggacaccgggcgaacccttcaacgtcttttacctgtgtgaacataatgcctgcgtcattaaccagcaggagcttgatttcactgaaactcgttacatctgcgacaccaccgggatctggacgcgcgacggtttatcctggttttcataacaggcacccaaatcgacccgccagacagcgtgacgttttacatctggaccgcatacaaccccgttaccaactgggttcacatcggtaaa

SEQ ID NO: 91990 - DNA, 1259 bp, Oryza sativa
tacagtacagaagaggttgtcgagtgctgtatcgattacttcaaaaatggaaatacaattggagtacctatgccttgacacgagggcagattgagtggcaagggtactataggaaagaagagattcgtcacccatgatcacaaagcatttcaagaaactcacttcagcacgcttcatcagtttgctatcgttgagccttacaccgatcaacatatcaaactactacgagctaccaataaaggtcacacaaccgagtggataatgaaagaaaacaagagtctcttcatagattggttgcgagacctagacttacctgatggacaaacaaccgatgaaataactatgaagcggttggcttgtggtccatcaactacagtaaattcttgggagggatatgacattaatggatactcgtttagtacgagagcccgagatagtaagaccttaactgaaaacagcggtgtccgtgtggaggcaattgattcaccgggtgaaaaacaatcatacttcggatttattgaagaaatatgggaaatcgactaaggacacacaatgcaatttcccatatttaagtgccagtgggtaaaatacctgaacggggtcaatgttgataagtttggtcttactgttgttgaccttgcgaatgtgggtcacaaggatgacacttgggtactcgccaatcgcgtggcacaggtgttttatgtgaaagaccctcaaatttgaagaaagagataatgctaccaggaaacaaatagatattgggagtggatggggtcgaagatgttgaagattacaaccaatacgatagtatgccactttatactcaatttgtacaaaagattaggcatgtcgaggcatctacttagaagaccatgaagctttacatgcgcacgaacggtgtgggcaaaaattttaaagggtaatgattgttgagtggcatgtaagcctctaagaagttcttagttatgtaatgatggtatgtaaggggatatgtgtgctcatattgcaaatttgcatgttataattgacgaacaattgtacttaacattttgcaaattagtttgtactaaattttatgtgtaattaccatttgtagggcaaaattacagacatttacatttcaaagtttgtttaaatgaggtttcaaaattttgtagcattttttttatatacacttaccattgtctgaacaatattttaaaagtagtaatattaaggtttcaaacaaacatttaagtaagatttacattttaaaagta

SEQ ID NO: 91991 - DNA, 5573 bp, Oryza sativa
cattaatgtataaatcaccttcaattagttttgaatagcgatacgtttttttaatgaaccctacaaatttggtattaatagtgcaaatattttttgttcatttttttgagatatggaaaggcggcaatggatgtaacattcgccgaggtttttgggtccatatagggataaagtgtctaaatttgttggtattgtgaaggcacacgctgaaaagaacaatatgaggaagataatttatccatgtgctagctataagaatgaaatagcctgggaagatgcttctaaagtgatggagcaatttgtaactcgtggatttatggataagtatgtaatatggacacgtcatggcgaagaacaagtggacgggactgaaaatatagttccgacaaaagttgaagacatggtgtacaatgatggttctggtgaggacaaaatcaatctagaggaaatgctacgtcatgcagaacccgaggtgccgatggggtcggttagaggtttaaataactttgaagctttacaaaatgcagctaaggaagttatgtacgatgagtcaaagggttgtaacagtgagttcacaacactacggtcagttcttgatcttatgaggttaaaggcaagacatggatgatctgatagtagtttcaacagtctgctagaacttctgcagaaaatgctcccgaggcctaactcactaccatccagcacatatcaagtaaagaaactcatatgtcccctttcacttggtgtggaaaagattcatgtgtgcattaatcactacatactatataggaaagagtacgcttctttagatgaatgtctaacatgagatgctagtcagtacaaatcgaatagcaatactggcctagaaccgtctgacacaactgagggaactaagagaaaaatcctgtagttgtgatgtggtaccttcctgtcaaagaccgcattaaacagatatactcaaatccgcgagatgtggaactaatgcgttggcatcaagaagggcacaagaaggaagggatgattcgacacccgatagatgctcgtcagtggataaactttgatgctcagtatagagagtttgttaagacccacggaatattaggtttgccctaaatactgatggagttaatccttttggagacatgagcagctcacatagtacttggccagtgcttctcaccatgtataatcttcctacctacctttgtcaaaagtgaaaatgcttattactctgtatcctcatacagggaccccgtcagcttggtattgatattgacgtatttctggaaccattgttggaagatatggctgatttatggaaagagggattgaaagtgtgggacgagtacttaagagaatacttcacagtggaggccatcatcttggtgaccatcaatgattatccagcaatgtttttagtttcaggtcaaattaaaggtaaaacaggatgtgtgatctacttgaatggaacgtactataggtatctcccgggttccaacaagcttgtgttcatgcggcaccggtggttcctatgcacaaatcacaagtaccgcaagatgaaggcggagttcgatggcactaaagagagtgatcctgcaccaaaacctacatctggggaaaaagtgtgtgcaatgacagagaaaattgtttgcgaatttggaaaagttactaagaaaccatcaaaggggacaaagcgcaagaaactcgagaagactaagaaaccaaaagatagtaagaagccagatgatagtatgaagccagatgataaactccctcccccattcaagaagcattccatattctttaagggtctgtttggcacagctccagctccagctccagctccacccctcctagagctggagctcagccaaacagtttcagctccactaaaactgggagtggagttgggtggagctctctcacaagatgtactaaagttgtggaactgggtttaggtagctccacaactccactctagactcaactcctggagttaaatttaggagttggagctgtaccaaacaggccctaagtacctcccgtactggaaagatctggaggttcggcatgccatagacgtcatgcatctagagaagaatgtgtttgacaacatagttggaacattgttggacatgccaaagaagactaaagatggtctgcaatcacgaattgacctagttgagataggaattagggaagagttacacccttaagaaggagagaagaatggcaaagtatatcttacaccagcctatttcacgctgacacctgaggagaagaagtcattttgcaaatcactccgcgatgtcaaagtgcccataggtttctcatcaaacatcagtcgattagtttccatgaaagatttgtcggtatctggttataattcacacaactgtcatgtcttgctcaccgtgtttcttgcaattgcaataagagccataaaaccggaacattgaaaggatgctatcacaaggttgtgctactttttcaacgcagtgtcacagaaggtcattccttacgaagagttagcaaatctccgtccattcacacatgagacacagtgccaacttgagatgtgtttccctccgtcatttttttatatgatggagcacctcattgttcacatagtgccgcagatggttgtgcttggcccattgtacctccatcaaatgtggtcatacgagcgttacatggcagttttgaagggctacgtccgaaatcgtgcacatctagagggatcaatggttgagggttacagtacagaagaggttgtcgagtgctgtatcgattacttcaaaaatggaaatacaattggagtacctatgccttgacacgagggcagattgagtggcaagggtactataggaaagaagagattcgtcacccatgatcacaaagcatttcaagaaactcacttcagcacgcttcatcagtttgctatcgttgagccttacaccgatcaacatatcaaactactacgagctaccaataaaggtcacacaaccgagtggataatgaaagaaaacaagagtctcttcatagattggttgcgagacctagacttacctgatggacaaacaaccgatgaaataactatgaagcggttggcttgtggtccatcaactacagtaaattcttgggagggatatgacattaatggatactcgtttagtacgagagcccgagatagtaagaccttaactgaaaacagcggtgtccgtgtggaggcaattgattcaccgggtgaaaaacaatcatacttcggatttattgaagaaatatgggaaatcgactaaggacacacaatgcaattccccatatttaagtgccagtgggtaaaatacctgaacggggtcaatgttgataagtttggtcttactgttgttgaccttgcgaatgtgggtcacaaggatgacacttgggtactcgccaatcgcgtggcacaggtgttttatgtgaaagacccttcaaatttgaagaaagagataatgctaccaggaaaacaatagatattgggagtggatggggtcgaagatgttgaagattacaaccaatacgatagtatgccactttatactcaatttgtacaaaagattaggcatgtcgaggcatctacttagaagaccatgaagccttacatgcgcacgaacggtgtgggcaaaaattttaaagggtaatgattgttgagtggcatgtaagcctctaagaagttcttagttatgtaatgatggtatgtaaggggatatgtgtgctcatattgcaaatttgcatgttataattgacgaacaattgtacttaacattttgcaaattagtttgtactaaattttatgtgtaattaccatttgtagggcaaaattacagacatttacatttcaaagtttgtttaaatgaggtttcaaaattttgtagcattttttttatatacacttaccattgtctgaacaatattttaaaagtagtaatattaaggtttcaaacaaacatttaagtaagatttacattttaaaagtactaatattaaggtttgtatatttgtatgtacaattaccatttttattacaacttttgtaaacattttctattttaaaaaataaattaaaaaacattttcaactaaactattgtcaggtctctaacaatcttcgtaggcggacggtgcgccaccgcgcgcttcgccaccactgctccactgcgcacttcaccaccgcggtggctccactgctgcccgcgcttcgccgccggccgctcgtcggcgccaccactctctctctctctctctctctctatctctctctctctctctctccctccctcccagtctcagtctcggccgctccaccgaatgtcgtcccggtcgtcgtccacgagtgaactcgtcctcgaccgaacgacatcttcggccggtcgtcgtccacggccgaacctcgtcgtcggccgttcgtcgtccatgaccgaacgtgtgtgcatgtgggtgtttctatttatatgtgtgtgcatgtggatgtgaggggatatatatgtgtgcatgtgggtgtggatgggaatgagggatgggtggtatgtgaatgaggggtcatatgttgattgtgaatgtgaatgtgggaatgtgggtgatatgtgaatgaaaatgggtgattgttggtttttgttcatttttttttgtgtaacatgtgggagggtatgttcaaattttttttatataacatgtggaggatatgtccaattttttttataacatatgataagtagtacactatttatcattttttttaactacgataagtagtgttctattttcgttgattgttaatatatggcaatgtggatgaatttaaatgtgttcatatgacagattgttaaaatacagtttattttttatgttagaagttcgaaacgatggccgatagtactaaagggaatgaagagaagggtttatgggaggaagagccattccttcctattctggttgctccagaaccaacagtcccgccggaagatatttccgacaacgacgtagctgacgatgatgatgagaactcgtcgttaagtgatccttgtccaagcccgaagagatgaaaaacgggcgagggtgaaaaaggcgacaaagactacattccctctaaagaaggggtaagtacacttaatatctaaactgtttgagtgataactgttagcccgagctaattataaactttgatacatactcataggaaacggcgccatggcgatcaaaacagcagccgaagaaaaaagataagtcaaaagacgacgaggtcccagctaagaccaccggctcaaagaaaagcgaaccgtcatcaaaggcgaagaaaagaaggggcgagagaagcgtgaataaaaaggacgaagggttttatgttgttaccaatgttgggcctaaaggagagtcgctcgcccctcaaactgcacgtgccaaatttagttcacagtgtggcataatcgtaagggaaaagatccccatcacggtcaaggactgggatcatgtgtcgaatggggataaggaagtcctatggaaagagctgaagaaaagattccagttcccggattgagg

SEQ ID NO: 91992 - DNA, 670 bp, Oryza sativa
  unsure (1)..(670): unsure at all n locations
caacacggtgaatatacaaaccacccattgctaattgcatactaactattcccctgtccatagaaaatcaagccaatctggacatcagcattatcttcgaaatgcaattttgactgcaataatttctattgcaacaatgtctgtgtaaaatcaaatgaactagtacaatactacacaaaacaagactgcactttgtagaaatcaaatctacacatctatgtaactcgcatgtgtccaatttttaaatgttttagaaatagctatgcataaattttaaatgtgcccacatttgatttgacaatatatacctagctggtgcgcttcttcttgggaggcctggaggacgttcttggcggcgggggtgaacttgatctccatggggaccatgccggggcccctcccggccatcttctccacctcggcgcgcgccgccttgaggctgagcccggcgcccctgagcaccttggcgccgatgccggtgccctccccgatgacgccgaggaggagctgctcgctgccggcggcgtggtgccccagccgccgcgccttcttctgcgccatcatgatcgccttgatcgccttgtccgtgaacatggcgaaccccattcttgccaccacccgcgccccccttcttcttccgccgncgncgttcgcacgcncgtacgacgcc

SEQ ID NO: 91993 - DNA, 848 bp, Oryza sativa
ccccaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccattctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggc

SEQ ID NO: 91994 - DNA, 2275 bp, Oryza sativa
gacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcgcagaaagagatgctgtggaccacaatgctcgagacattcacccttcctgcgggtacagaggacaaagtgaaaaggtggactctgaagaaaatggcagtacagtttcagagcttcaagggagatctgtaccagaagtatatactgaaggggcagacaccgaacttcgacacattcccaaagctaagggatcactgggacgagttcgttgcatataagataggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggctatcagatacaagaggctgcgcgacgactaacagatgcagtggaagcctcctctcagggcacgttccgaccagacagagatagggacgagctgacactcgccctgcagactccagagcatccaggacgaacttgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttgaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactccaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcaggatcctgcaccgactcctcctcgtgctcctacacctactcccccgcaagctcctcttccggcaccttcaaagtcaagggcccccccagctccaccgcttgcccacataagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgacccgataagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtgtcggtgatatgggaccgggagtattgcgcccggaggcttgaggcagattgaatcgcccacgtggcctggcaccctcggggacgtcgggcccgagggtgaggtgtccgccctcctcctgatttccccgagggggggtcgg

SEQ ID NO: 91995 - DNA, 3166 bp, Oryza sativa
agagtttaacttgcttggaggtttctcagtttattgatgtatcattagtcttacactcttactattgtccatcacctggtgttgcagatccatatttaaacacagatgctggtacaatgtctccttttgagcatggtgaggtctttgtgcttgacgatggtggagaggtatggcttctttgatgcttccatgtgatgttactctttatgacctgtgcacatgagcttgtaatgtttgaaatttgtaggttgacttggatttagggaattatgagcgtttcttggatgttactctgacaagggataacaacattacaactggaaagatatatcaggtgatcatcccttcctagaaaatgcttgctggttgtcacatgagtttgtaatcaatggcttttgttgttttcagtctgtcattgagaaggagaggaagggtgactatcttggaaagacggtccaggtaattcccttgtggcatttttttttggcaatggtcacatgcttatggaatacccatatgacaaactaaaatcttatggctgtaacatgttcaggttgttcctcatgtaactgatgaaattaaacagtggatacagtcagtatcttctgttcctgtggatgggcagactcgtccagctgatgtttgtgtcattgaattgggaggcactgtaggtagggtttcgaggcatcttatggtatagttattactattataatggatgaactaaattttttcttgtttcaggtgatattgaatcaatgccattcattgaagctctgcgccagttgtcattttctcttggtacagttggattttcttcttgtgatttcaaatttaataggtcatggttgctgagaaatatgttgagttcaatgggctacgctgactctctatcatttcacaccatttttctctgtttatttctttggaaatgattgggctgtagattaggtatccactttattcggtccgcaccgccttcctcttttgtgctaaagtggcaagctgatagtcacatgctattgttgatatgttgagaagacatgcagcgttgttttaaaaacaattctgatttgttagtgctcattgttggatattgtacccatcattcttatatattttgcaggtaaggacaatttctgcctcatacatgtgagccttgttccggtattgggtgtagttggtgagcaggtaaataattctcttcaatcatgatttctgctgatgacatcttgacctctgacatgagacaaaattgcattgcaatattcaagtcttatgtcaggacatataattgctaagattgaaccctgaatctgtcatttccatttttgtagaaaactaagccaacacaacacagtgtacgagaactaagggccttgggtctgactcctgatcttctagcatgccgatccgcacaggtaatgcaaacaacatagaataacagaacactcttaagatatgatatctccattgattctagcatttgatgttgatgttccctattttattatcatatggaatacttctctggcagtcactctaatatgtcttttcctgtcttactctggacatgactgtccatatctttttggtgcttagtctatattttttcttgtctgtaatggattgacataattttttgcgatctgaacattcagccactaataggatctgtcaaggagaaactttcacaattttgtcatgtaccggtatgtttttgcttctaagtttgaaaagagccattttattctcatgttttcctacttacattctatcttatctcttacaggttgagaatatacttaacatccatgatgttccaaacttgtggcatgttccacttattcttagagtgagttatctttggctcaaagcttaagtgttgactctgtagagaaagataatgagtatgatttatataatcattgcactaatactttattttgacatgtgttattttccagaaccaaaaggttcacgaggctataatcaaacaacttaaccttggaaggtgagccagacaattactgaatatcagtttcttgtcaatgtttggaaataatgtgcccaagtgtgtgcctataggaagttttatatttgggatttactacctttgaaaatcatgaatagttcattattatgttacacttgctatttctggtctatatttgaccccttttcagttaacgtgaatggacttgcttgatcgttgtgagatttatgagttcgggcagtaataacaaatctgttgtactttcctggcattacttattttatataaggtgttttggttagtatgttgaatcaattccataccttattctgtaggtctgctggaccccctgagttacgagattggacacagatggctgagtcatatgatgacctcaaaaactctgttagtattgttaagttgctctaatatcttgactttgcattgattattttcaagtgcataattaattttgatggacttcaatgccatgcaggttaaaatcgctttggttgggaaatatactaatctgaccgattcctacttatcagtggtgaaggtgagttaaatcaactttttaatatagaattgttatttattcaattatgcatccaattggtgaaaatgggtcctttttatttatgttttgcctgttgtgccattatttccctccattagtgcctactgcaaatgcaatcaattcctaagagttgtgtttatgcaaggagatttttgaactacccactactcttgcagtgctactgatttaattcttattgaaatattatagtattatacatgcaaatgttgtttcaaattcatgtgtatacaaatatgtttcaggctcttctacatgcgagtgttgcatgttcattgaaaccttctatccagtggattgcagcttcagatcttgaagatgcaactgcaacaagtgtaagcccgaaactctttgttcataatatgatagggagtagttctactggattacgctacatctcttaacacagttgtaatgtttaaaccaatgctctgttttatgtttgttgccaataattatctcagggctaaagatcatttttattcatactagtctactaacttaatatattctctattgaaagcaatgtaacactcctattatagttgtccttcctgctttgtgttatctta

SEQ ID NO: 91996 - DNA, 849 bp, Oryza sativa
ttttcttgggcagactttctcaatccaggacatgatcagtatgtgtaccgccatccaaacgggtgagctcccaagaaatcaaaattagtcttccttagaaaaaaaaatgttagaatgggtttgttgatgaacttttcatattcacaaggtggatccaaagcaggtcataattcactgtggtgtgttttccccaatgagattatatgtaggcaataggcaactatgtctagtgcattcttaaggaatatcatcataccattggtttatctttttgaggcatgcttcaattttgtggtagttaattattttcatatgtagcttgagctgaaacgtgccactccatccttcgttttaattaccgcgtctatgatgaagctgaactttttttttctcgctggtttcttctgtttctcaaaagatcagattgtgtgtggttggtttagcttcagcccatattgcattgaaagaggaaggggggataactgccgttgatttcaatgttgggaagtcagaccgcagtgagatgaaagtcacaggaaaacgcaaaagggtaattggatgacttgaactcttgaagcatgtttttatcattggttgacttattggaactatggaagcatgactcggttcttattttactttacagaatgcacaacatttgcaagaaaattcagcgctgtgtaaagtctgcacaagtagtaattcttttgtagtgaggttggtccactagatctcccaatcaataattgataatgccattctatttttgcactgagttgttgtttatgctaaactcatgtaggtgttgtgtgaaaagatcacctttggagatcaatgatagattgatca

SEQ ID NO: 91997 - DNA, 2536 bp, Oryza sativa
tgaagctgtaccaggacgcgcacgtggccggcggcgagctggacggcgtgcggcggcgcggggtgttcgagccggggcggtgctgggaggacatgtgcctggcggtgctcggggcgcagcacctggtgtacgtggcggggtggtcggtgaacaccaaggtgcggctcgtgcgggaggcgatgtcgccggagatggcggcgaaggtggaggaggtgcggacgacggcaaccgacgacgacgacaatccggtggcggcggagggcatgtcgctgggcgcgctgctcaagtacaagtcgcaggagggcgtccgtgtctgcctcctcgtctgggacgacaagacctcgcacgacaccttcttcctcaagacagttgcgttgcgtaccaactcaattcaactctgttcttgaatttttgtcaaagaaaattgaatttggatttgatttctcagggcggcttgatgcaaacacatgacgaggagacgaagaagttcttcaaggactcgtcggtgatctgcttgctgtcgccgcgatacccaagcagcaagctcagcatggccaagcagaaggcaagatataattaattactcaatcatttccaaaatatattactccttttatttttcacatcgtcttatttaaaatatatataaatattatttatttttgttatgacttgttttactatattcttattaataacttactccctccgtcccaaaatataatctttttttttaccttgatatggtctccgagatgctattttgaccaacaatattaagatgctttaaataaaaatagttgcatattataatagtttgtttaatgataaatctagtaacatcaattttacatgtttgatttttttttattttttgttattaatggtcaaagttgaaaaaatatttgacttattactatgctaaaaatacttatattttagaatggggtatatacttttacatatttatgctaaacttttagataaaataataattaaacgatacgtgaaaagttaacggcgtttgaaacgaaagtagtatcacaagtaaatctcgattaaaaatggtgcaatgcaagcaaagcatgcaagacccaatgctgagaggggcgtgtcagccagcgtgcagattgtggggacgatgtacacgcagcaccagaagtgcctgctggtggacacgccggcgtcggggagcacgcggcggatcacggcgttcctcggcggcctcgacctcgccgcggggcgctacgacacgccgtcgcacaggctcttcgccgacctcggcaccgtcttctccggcgacgtctacaaccccgcgatcccgccggcggggaacaagggcggcgccggcgaggaggggccgcggcagccgtggcacgacatgcactgccgcgtcgacgggccggcggcgtacgacgtgctggagaacttcgagcagcggtggaggaaggcgacgaagctgttcagaagggccaaggcgcactggaaggacgacgccttgctcaagctcgagcgcatctcctggatcctcagcccctccgactccggcgccggcgacggcgacggcggcgacagccacctctacgccttgcccgatggtcaccccgattgctggaacgctcaggtacatgataaaccgatcgattgatacttgaaatcgatggagataattttaatttcttggtgataaaactggcaggtgttccggtcagtggactctggatcagtgaaaggattgcctcgttgctgggagacaaaaaagatggttaataatctcttcttctctcttcatcaatggctcatcgtcattaacttatcaatcaatcaatcaataatcgacgtactccctccgtattttaatgtataacgttgttaaatctattatcaacatttggccatttgtgttatttaaatttttttacagatataaagatatttatgtcatgtttaaataacgtttgatgataaatcaagtcgcaataaaatatatggtacttagataaattttttaaataagataaatgataaaaaatgtatcttaaaaaataaatagtgtcataaatttaaaaaataaatagtgtcataaattaaaatacggatggagtaataaaatggtactccatcaaatagctgaagcatcgatatgcgatgcaggaggcgaagcacctggtgtgcgacaagaacgtgacggtggagcagagcattcacacggcgtacgtccgggcgatccggtcggcgaagcgcttcatctacatcgagaaccagtacttcatcggatcatccttcgcatggccatcctacaagcaccaagaaggcaggcaccatctgaatttgctgaatttgtctcatcacttgtctgaatcggtaaaaatacatggagcttagtggttgcagtcacctgagtaacaccctgacaccctaaggtcatgagtttaaatcttcatacgagcgaattacaattaggttatttgaggactaaattcctaatttcatattgggttatttgaaggctaagttctcagtttgttagactaag

SEQ ID NO: 91998 - DNA, 1331 bp, Oryza sativa
tcctgcagcccagctcttattttaaaaagattcatatgtccggttggatgtagaggctgtaccaaaaataccattctctaacaaaattgtctgaatatgctgcacactgatgcatgtatatgtgtgtgtgcaggtgctggaaatctggtgccgatggagatcgcgctgaaggtggcgagcaagatcgccgccggcgagaggttcgccgtgtacatcgtgatcccgatgtggccggagggggttccaacctcgggccccatccaggagatcctcttctggcagaggcagacgatgcaggcgatgtacgaggtgatcgcggcggcgatcagggcggcggggatggagggcgcggcgcacccgcgggactacctcaacttctactgcctcggcaagcgggaggcggcggcggcggcggcggcgggctcgccggagcaggagcacaacccggcggccagcagcgcgcggcggcaccggcggttcatgatctacgtgcactccaaggggatgatcgtggacgacgagtacgtcatcgtcggctccgccaacatcaaccagcgctctctcgccggctcgcgcgacaccgagatcgccgtcggcgcctaccagcccaatctccgcgccggcgccggcgccggcgacggccaggtgttcggcttcaggatgttgctgtgggaggagcacctgggcagcagcgagtggcgggagctgaggtcgccggagtcgccggagtgcgtgaagcgggtgaacgagatagcggcggagaactggaggaggtacgccgccgacgacgacgatgtcgccatgcaggggcacctcatgaggtacccggtggacgtcggcgacgacggcaagatcagcgagttgcgcgggcacgagttcttccccgacgtcggcgggaggatccttggctccaccaacaacaactactgggattatctcaccatgtaggcatgtagctgcctctgcattcccaaattactattcggattaatatatgggactttctaggtgtcttttgacagaaaaaacctccctaaatcttgcaaattatgaaccgttggatcaatcgtgcaacataagtaaaacctacttttcctccttccgcttctcagtccatccgtcgccgccgcccggcctcgcgggctggtcggaaggagtcaacgacagcggcaagcccccccccccctcccatggccggcctcctctccctccccccttctctttccaaggttgcacggcccattttccccccaccgccaatgccggctctccgcccgctgccaaccccgcagctccgacgccgctgccggcgcctcgtcgcccgcccgtgt

SEQ ID NO: 91999 - DNA, 2863 bp, Oryza sativa
cccccccccccccccccccagtgttatgggtgtctctccaagacgcctcgctgccgcgatcggtaaatctcgccgcgacgtgacgagcagtagcaccatggctgcgagtgaaggtggtagagatggcgacgccggggttaggggtgattcgtgcaggccaagtgctcggcgaaatgccgcacccggctgttgttgatcggctctcgacaagtcctgggaattttccttttcagaaaagaagtcggcttcggaaattgttgcttatgattctgcatttttgttttggattcaattgctactgccatctctgagtttctttgacacaactgctgttgcctcgtagaatatagaagaggattacgggatgtttgtctggccatgcagtgtcattctagcagagtacgtgtggcagcagaggtcacgcttcactgcctccacagttgtcgaggtactatacttgtcatctttaaattctactcttgagtgtcaatggccaatgatgatctacttgccattgtgatgatcaaccataaatcaggtcctagcgccagcctctgttatgaggtttggtacagccattatgacattctgttagtagtaattgtatccagttcagagcatattttgcactctaattttaatttgcatgtacgactttcagcttggtgccggaacctcactaccagggttagtagctgcaaaggttggagcagacgtcacactgacagacatcgcacataatacagaggttaagttcattcagaggggtgctgtgtttcattcatctaggctcatattaattattttcttcttatgttttatcaataggtcctgaacaacatcagacaagtatgcggtctcaataatgtcaactgcactgtaagtttttttatttagagggaaatgcatggtggtactttgcattctgctacatagcttaacaaatctgcattctacaacatagcttaataaatctgcattctactacatagcttaataaatctgcattatggtacatatagcttaataagtcgacaacactcatgcaggtaaaggacttacctggggagaatgggatgaacctacatttgacttgcatcctgatgttattcttggagccgatgtgctttacgactcagcaagtaagctacacctacacgggctacacatctgtatttgtagttctgtataattttcatgttgactgacctgcacacaactgcatcaatttggctagagtttgatgatctcttcgcgacagtctcatttctcttggaaaattccccgggggcgatgttcataaccacatatcacaatcgcaggttccgggaattgttttacccttctcctcatggaagaattgcaggaattgttttacccttctccttgtgtgtcaactatttgattcctgtatgcagtggtcatcatttgattgaatttttaatggtgaagtggggtttgaagtgtttaaagcttcgggatggcttctccttccttccgtcatgcaaggctgcttcactacaagggaacattcagcttgttgagattgcacttgacaaggaaaaaccgaactgctcttcagctgacgagaacaatctgtagcagttatgttccatgcggttcagccttatgggggctgaaggcaagaacatggcacaactttggggcatcctccgcacacaggttaacttttataacactaggtgatttccaggagcaacatcatgtaaaattgcccgtacaaaatattctcaagtttaaccatggattgtatttgttggacaagcttgttaaacgaagattcaccaaaccaatagttatgacagaatattacacatctctacacgggatgttccaacagaacttaatcgaacatgttttccttagtatcaatgagatgataatcatcagacattgcatgtaggagcagcaatcagttgtaatacaaaatgctcctcattgtgaggttaacatgattccaactcacaaatttgatatgccacttgatatgataggaccgtcaagtattagtgtgtagctgatgaaacttctatcagactgtccagcaaagcacacacgagaacttcctcttcattagcaccagtacggataaatctggaatctggattgttttcaaattccgtaaacaggtaaataaatggcagtggaccatcgtgcaaggatctttcatcctgagggaatggtcgactcatgcctaggctgtgggatcattgtcgaaaattcctggatgtacataaaatacttaaaatgtgcatgcacgaattgaattatgcaagaaaacagtactaattgttaacactggaactgaaggaaacatgaaaaaaatgatggagcactagtccagaaacatgcaccgattaccttttggatgtcagcatgttcccctcaagttcttgtaatcatcgtagctaagaaatttatccttgatttttagccagtcagctggctttggcataaaaattgctatatatccttctctgtcagcctaataaaggtgggaaaagtatatgtgttggtcagagtatgaaaaaaaaataaaaacttgcgcaagcagatacagaatgacaggtcacgagtaaaaggtaatgcaatatatgacaaacacacagtgatccacagacttctatcacaggtacagagctaaatgatatctagtcaattcatttgtgagaagagggtcgacctaaacctcccacttcacccacaatctacgttcatgataaatgcaatagctgtattcatgatatatcagacagatgtgcaactttaccagtgtttatctggaatccaactagtttttttattctaatctagtctgtgatttcctatgtatgacttcatg

SEQ ID NO: 92000 - DNA, 2382 bp, Oryza sativa
tctagggttgcggattcttccgccattagggcgcgcgacgcgtggatctcctccgccgccggagagctcgtgccgcgcgtggccggtgtgggttttgctttgcggcggcggcggcgcgagcagaagagagatattcccgtttagatgtggaattaactttttgccactggacccacatgtcatagacacatgtggagccacgtgtcattgagatagaggtgacaaatagttatttgtcaaatctaaaagtggaaatagttaaaagccccgtgaagagaagggcaaagtgcgtgggagtgtgtgagccgttagatcattcgatccaacggcctacagcggtacagctcgggcgtttcggaatttgctcttttttttgcaaatccccacctcttttcctgctattccaatttgatcctcggcaataagggtacagttcatttttaaccctcgaacattgctcaaagtctgttttcaccattatttttaagaaaatgggataaactctctacgtccaattggatgtacatgtccataagaaccgattgttttttgtcctaaactttaaaaaacaaaaatagacacactgaaacttatttcaagttggttttcatctgtattagtttcatatttgtcaacctacatataagtgacagctacaccattaaaatatgcgtaataaaaggttcaagtcttcaactcaatacatatactcatatttatgcctatttatttttctttttagtggtagacggtgtgttcatcaatagagagacatctacgactataatgacttcgtcgatttctaaataagttagtccaatctctcagaaatgctcattagggtggggatgcatgtgtaccttcatataggcaaatatgcacacatacataagtatatatgtttcgaaaaaaaacagaaagaaaaaatatcctcatttcaaataataccctaatttgagagttgcttcaataatctttggggcagggtttataaaaccgcgcggttaccatgcacggtaaccttttcagtttttgaaaccacggtatgtctcgcggttaccatgtggttttcgcggtaaccacgcggttaccgcgggggtgcggtaaccacaccaaaaatggtaaggggaaccctgttttggggatgcccatagtaataggagacatgcgtggtttcataagggcatgctcaatggtagagacgaaaatggtctcttaaacaatgcaagattattaagagaccatgtctttacaatagttgagacgacaaagactctaatcattaactcaaaaaatattccttttgtcaatattcaatattctttctactttttttaccctcatgcaactttatttccatattacagtgattaagagtcattgttaagccattgtcataaataacagcgatgttttgtctcttctctttctctttcttccatgtcaataaatattcctaattagcaacgctgagagaccactgttgataaccattgtacatgccctaagagcgaatgtgtgcgtgttatataagcattttcgtctgtactatatttcgaacaaaaaaaattggcaagcaaaagtttttccaacaaaagtggaaaaacactcgatagaagtatccacaattctagctagccacatttcagtcatcaagtcattatgcatatatgccattaatcacaaatactagacaactacttatcaaatccattattactagtacgtagcattatgtttctttctcgaataattcgagtgtgtatacactagtagtgagacgtagatggtaaaatcaatcatcatcatcaatcaaacgcgaggtaatgcaggtgctgatggtatccgccgccgacttcgtcgtggtagtgctctccaccggccgccgccgccgccgccgcagcctgcccgccgtcgccgccgtcgaacttggcgtcgtcctcctcctgcggcgacggccacacgccggggtacgtctcccgcgtcacctccagcagcgagtccctcaccctgtccgcctgcaccgccacctcgctgtccctcacctgcaatgcagaaaccaaccagctcggagtagtcagctcgcgagctcgcgttcatggccatggcggcggcgagcggggcgtactaccatgacgcggaagacgttgaggacgagggtcttgtaggtggtgacgttgacgttgatgacctcgaggccgagcgcgttcatggcgtccatgaggcggacgaacccgccgggcttgtgctcccagagcacctggacgaacagctcgttcccctgcacctgacgcacctccagctgcggctccatccggtgcccaccgccgccgcgccgccgaccttgtcgtcggtcattgctgggtccttgttactcctcct

SEQ ID NO: 92001 - DNA, 1409 bp, Oryza sativa
gatggtaaatcatagaaggtaactaaaagtcgatggtatattatagaacgtgacaaagacaggggcaaatcgtagagctatgacaaactcagtggcatataatggattgtctcaaaaaaaaaaaaagtcactgttgtacacaaacaggatgaatgcaacatcttattgatcctaatcaagtcaagcaaccaagatcaagctggatgcaacatcttattgattctaatcaagtcaagcaaccaagatcattagtagtactatcatgtatacaagtaccatcattattaggagtaattggcagcaaatctgtggtattgttagcagtatcatgcaagcatccaggacagagagaatattgatcatatgctgatgatggaatcgacaaggtggtaaaaattatagagtaaccgacaataatcatctttttcatctcggggaaaccacaaaaaggagagagattttgtcaatctcctcgcccaacacacaaaaccaatccagacatcacgtcttcttaacctgaaccagaggaccagaccaactcatagcagcaaaagcatcatcacacgagcagcagcagcagaagttaaaactaaaccgaaatcccaatagcaaaaaaagaaaaagaggtaaaaacaaaaggcaagcggttcctttatagcaggcaacgcgctctccatgtgacccagatcggcggcaaaactaaagcaataattcgacttaggagtgatgaagatttaggcgagatctaagaggaggggggggggagatggtgttgtgaatccatcacttgtggcagtcgcgggcgatgtgtccagcctcgccgcagttgtagcaggagcggtcgcctccaccgccgaatcgcccgcctccgcctccaccgccgccgttgtagcagtccctcgcgaggtggccggtctcgccgcagttgtagcaggcgccgccgccgccgccgccaccaccaccacctccaccaccaccgctgttgaagcagtccctagccatgtggcccatctcgccgcacttgaagcagccaccaccagcgccgccgccgccgccaccgcctccaccaacgccgacaccgccgccgttgaagcagtccctggccatgtggccagactccccacacttgaagcagcccccaccgggtccaccaccgccggatctcctccccccgccccagctaccgccatagctgcggccgccaccgccagatccgcccccaccgcgcgatccgaagcctcccccgccaccgccgccgccgccggcgccgcccttgacgaaggatccgtcggggccggtgacgtcgacggccttggtgcggccgtcctcgctctcggagatggcgaactcgacctgctcgccctcggcgagggagcggaagccgtcggccttgatggaggactggtgga

SEQ ID NO: 92002 - DNA, 796 bp, Oryza sativa
aaagtctaattgcctcaatgctagcaacaggagcaaaagtttcattaaaatccaaaccctcaacttgagtaaaatcttgagcaacaagtctagctttatttctcacaatcaaaccatcctcattttgtttatttttgaaaacccacttggttccaataatattatgtccagaaggtggttcaactaaagtccaaactttgtttctctcaaaaatttcaagttcttcatgcatggcgttaatccacgattcatcagttaatgcacgtgacacatctttgggttcaaaagaagcaacaaattaccatcatgagtcgttaccttagaccttgtagtccgctcacctaaattaccaattatttgttccggcagatgtcgtcgttgaatatgcaaaggagcagcaacttttgaagttgatccacgttttgtatcagtactggtcgaagtagtaatctctagaggaccatctcgatcagcatcaacagtacccgatcccgacgaccttggccggtctgaccgcacatcttgcgccggtctgaccggaggtgtgccggcggtctgaccagccgagccgacctcgtcgttgtcgctctcgtcttcaaaaatacgaccatcctccccctgaacctgtgacagtgtacctgcaatatcgggtctagtacctggactagcctcatcgaaagtcgcaagtctcaacgattttgttagactccaaaataagtacacgatagccacgagtatgtgcggggtaaccaagaaacaatccatcggtagaacgtgcctcagggctgcaggaatt

SEQ ID NO: 92003 - DNA, 586 bp, Oryza sativa
aagcgcgcacacaaacacacaacaaattgtatgtctggcctagaagtagttagatacaacaaagatccagtcatacttctatattccttttgatcaacggcttcaccatcttcatcaggatccaacacagctgtagaaccaattggtgttgaaattggcttgcaattctccatcttgaaccgtctcaaaagatccttcatatacttcgtttgatgcacaaaagtaccttgaggtgtttgcttaatttgcaatcccaaaaagtacgataactcacccatcatgctcatctcaaattccctgcgcatagtctcagcaaaatctacaaccaaagcgtgagttgaacaaccaaagatgatatcatccacataaatctgaacgaacagttgattatcaccatgcttaagaacaaaaagcgttttgtcaacctttcccattgtaaaacctttcgtaagcaaaaagttcttaagcctatcataccatgccctaggagcttgtttcaaaccatacaaagctctagacaatttaaaaacatggttgggaaaatcaggattttcaaaacctggtggttgtttgacataaacttcct

SEQ ID NO: 92004 - DNA, 3752 bp, Oryza sativa
gagcacagtcgccggaagcggaagggaaagacaaaggataaagacaaagagaaagatcagcaagaaaggaggaggcgaactgggaggccatggcgccggttggtctccctccaggctttagatttcatccaactgatgagagcttgtgaactactacctcaagaggaaggtccatggcctcagcatcgacctcgacataatcccagaagtagacctctacaaatgtgagccctgggaattggaaggtaatccgaaaacttaattgctcatccatgttctcacttctcatcatcactcctgaatcctgattcggctcgagatgttttatttgtcttcttgttttgaaagagaaatccttcctgcctagtaaagactccgagtggtacttctttgggccaagggatagaaagtatcccaatggatgccgcacaaaccgtgcaaccagagcaggatactggaaatcgacggggaaagatcggcggatcaactaccagaacaggtcaattggtatgaagaagacactagtctactacaaaggtcgagctcctcaggggattagaaccagttgggtgatgcatgagtaccgcatcgaggaaagcgaatgcgagaacgccatggggattcaggttattcatccatcctcctcaccagctgttagtctcagttaaatcattttgagttgtatctgctatacttggttagctgaggctgcatttcagagtatcaagcatagccaatcttctcagttagcaggatttgtatgtatttatgttatgcaatagtgatcatatttcataatatgcaatatttgagatatgtgcctgctaaaacaaaattggcaatagaaacatacagaagaaacaactagggcatatttgctagttcagggaacctacgttctttatgcatggagtgcatgaaaagttagggctcttctctcttcttttcccccatatccatcagtgatagccataaagtattccttgcttccatggaccatagctactttacaaagtacattagaaggttttctcagttctctaatgggtcacacatggttcacttttctaggtgctcttgataagacaaatttaacatccaattcttggttcatgtcgcgatgatgtgaaatcctacaacatgattgtacaggggttaggtgcgtcatcgtttcatgatgcagagtataaaaatctaggtcagttgcatgttgatgctaccttaaagcttagacatccttcagtgtggccctgtgtagtgtcggtggctttacactttattctccccgtcaacctccaactttactcactagtgaaaaccataactgaacatgaggactgatcccatgtttattgtaaattagatcaaagtgcacatagtgatacatattgtatgtccactcttaaatttacattagtcgtgttcgaagactctgcattagttgaactgttgacatttatattaagtaaacatagagttcaaccaaaaccattggtgactgaaacatagtccgatttcaaacaagtggaatcttgaaatagcaattcagcaactaccttaataaaaactgctcaaaagttatggggttgttcagattgatgctattttcaaccataccattttttggtaaagttaccaaaaaaaatgtctacgtttagtttgttgctaaatttggtaaatacataagaaaattttggcaatattgtcatcttgccattgccaaaatttggtaaggtttattttggttacaatctaaacaagccctatgattgatggtctaagagaaatcaatagcagcataaattcaagttgcaatttttatactgttccctgccgaacttgaagttgaatcctcaagaattttactctaaatttgtttagtactgataatgaacattcaatccaaattgaaaatatgcacatgtaaattagcaaacaacaagcgtagaatgtagaagcatataatccattaactttgtaagattacagctgtatattatcagtaaacagaaaattaaagaagcaccttacttcggttcactagtgcgctgaaataatttttcatccacattgttgaacttgaaatctccccatgattccaatgtagaaaagtccaacctgtgcaaaaggaaataaagtaatttagatcatttattcattttcatcattttagttacaggactcctatgcgctatgtcggattttcaagaagaatgtggtgttgggtgaatttgacaagaaaggggagtgcagttcatcacaggctaaaggaaatgaagaagttacagatttcggggatgctggacaatcctcgggagcaaatgagaatgataaagacaattcatggatgcaattcatagcagaggatctatggtgcaccaacaaactaaagtgaactagaaaactgagagaaaacagcttgttaacttcatctaaccagatatttcggtattagttatactgcgtgtatcttctgtatatgtttgataaggacacttctcactttgcataggaggaccactttaagtttggatgctggttcttaaattaggtttatacttttgttcctttagtactggataatatatctaaaattgtgctactttgtacttcaatcttcaattaacatgtacctatcatctaatgaaatgatacaaaaggagaaatccaattttatatatccaccatgtattctatggatatatgtgcaatgtgaccaatatggattaagcaatcaccatatatcactaataaaagaaagttaaggatggttcagttttgaaaaatcaattgattttgatattccggctaacaaaattttacggtattattaatggcaaattccatcaatgtaataatgtttatgtttcaaggttcttaagttgcacaaattagtataagaatgtggcaaccatgctcacatctaacagctgctaggacctattcagcctaagcctgatacaatttccatgtagttttctagtttttttttttttgacgcgatacagttttctagttgcaggctgtaagtatctgtttgggcgatcttttattctcagagtttaatttagatcaccttttacccaaaaatcttttcactttggactaactaatattgcgactaccccaactctattctcgagccagagactgcaataagtatgggtaactaaacccagatatataagcctaacctttcggactccagcccagtactacagtgttttaatcatatatgtttgaagatgcccacttagcatttctgatgttttttttttcgcgaatgcagcatttctgatgttgcattcaaccaaagaaaatcagctgcttcaagtttttatcccaactaatttaaagttgcagtaatttcctcaaaattagtgtgtgctttcagggattagagtccaatcagtagagcatacatcaattccagtcacgaattaaagggtaatcatatcaagctttagaaaaagacccaaatctagcgtgagaaagtcacaaagcaaggcaaagcagatcaataccggagggaccagccgcacgaattccggcccaagggtgaggactcggactcgagcagcccaaggattgcagctcgtcgcggccacgcccaatgcctcctcctcctccaggcgccgcagcacgatcacacgcttctctcccgtagtctcatcccagaggcgaatacctgaggcaaccacgaatgttcatcagaagcggtgcatttggtggatgcgcagcggcggcggcaa

SEQ ID NO: 92005 - DNA, 1091 bp, Oryza sativa
ttgatgatactaaccaagtaattactttgtaccatgtaatatgccagtatgaaacgactagcacctactccctctgtcccaaaatataagcatttttagctatgaatatggactattgtgtgtctagattcatagccaaaagttactatattttggttcggaggtagtatttcttatacaccaactacttctgtaacttgctgcttctttttcaggtaaggtaaacagggaggtagttgatgaaacagtttccacatatagagaatcatgcataacatgtagtttctgaaatacctgtatgaaatacaaactgaaggtatcatattgttcaacttttttcttaaggcattgtattggtcaatgagctctcttacaataaatcccagtcgtaacctttttatcttcattgtttcctacatatacatacaattttaaacatacatttagattccaatccaaatgtccctatgaaatcatgagcattttacttcaaaaaaaaaaaaacctcgcttaaatggaaatgagtgatccatggatttccttgtgttctctgcatatcagagctgccatatctagataacaaaatgaaaccaacatggagattactaaaatgaacaatattagaaggtgaagaaagtcacggataaaatgtactaacaaaatcataaccgtgtcaaccaaatcagagaagtccactcgctctagatgatccttaacttctagcgatgcatactcaaaaccatatctatacttctttagatacttcgataggaaaagcaaaccagtatgaactgcagattttgtacccttatggcacttcaaaacttcctgcacagcaaagtactaaagttaaaatcctgtcaaaaagaaagatgaaagggataacatgacaacgatagaccattaaagagcagaccaagaacctgcaagttcataagaggggaatcctctaaagcattaactgggtgatccaaagctccatatgcagcttctgaaatggaacaagcggcccaagagccaacaggggcaccaggttcaccttcaagatcatgatcattgttcatgccatcagcagtatcataagaaaactg

SEQ ID NO: 92006 - DNA, 1011 bp, Oryza sativa
tcctgcagcccaaataatggaaaatgtaacggtaggggcatggaagggatcaaactgaaatttcaggggcatagaagggatcaggtaaatttcaggggtatggaagggattgagtgagttttcaggggtacacaaggaatttactcttgtttttttctttttttaacgactcgcatgaaacgatgcgaagttctattgatagaggagaaaaaaattacaaaattacaatcctggagggtcgtaaccagggaaaagaaaaaaatataccaccacccacacaccgacagcgccaacacacaagaccgggagaagactaacaccggaccaggcgccgctaagcgtgaccgaccgccgctagaccaacaaaggaacacagacgagatcgcccaaaagaacactctcacaaccaacacaaagccaactcctagagcgtgcttgcaccaatcgatcgagaggcttcggccaggggatgccaaaacgacgtcttcaagaagagaagcgacggtaaaccgccgccgctgtccgtcggggctcaaaggagcttggactgggctttcgcccagcaaccacctctgagggatgagacagcacgacaacgccctcaagagggggaattaaccatcgttgtcacccactgctcaccacctgcgaatccatggctgacgcattgatgctcccaccacccctcaacctctgccaacatgtgggacccctgcaccggcgccccccgccggccagccttcgagcgccgaagaccgcgccacatccaccagcagctccttctcgtaccgaggtcgcctcctccaccgccggcagcgcctctcgcgccaagccggcttcctccaccggatgcacctctcgcgccaatccggcctccctccatcggccgcgcctcacgcgccaagccggtctccatctccgccgcccgcgcctctcgcgccgagccggcctccgctgccatcggtgtcacgccctgaagtacccctcccttgctctaaattcataaaataa

SEQ ID NO: 92007 - DNA, 7927 bp, Oryza sativa
ttaacatgcaatttgcagggtactcttttccagattatttttgtgtaacaattcttaatgtggtactggtgaccttgaggaaagtgatactgccatctgacttgtttttctgttgattctgttgtagatgctgtaatcgagcaggcagactgggactactctaaaatactagagaaggttcggcgcgatgttgaagaccacacactttcaattcgtgaaggcaagctatcagaattgacaaatcatgctaaggttaagtatggcaagctaaagaaagccctttcttttagcaactcataactaacctctcttctgcatcgatttagcatgtgctacgggatttggttaccacatggtactaatgcaggtatattatacatgcaggagaaactaagaaaagcactagttgaacctgtagagtctcttttcgatgctgcaggcccttcaacctgggcatcaataagaaacctttttaaacgagaaacggaggctatcctgccagagtttcagaaaaaccttgctgggtttgaaatggaaagtgcaacgtcagaaggaatggtatcaaaattaagggattatgccagaagtatcgtagaaaataaagctaaagaagaagctggcaaagttttgattcatatgaaggagaggttggcaaaatcatctattattcgttcaccataccgatcaatttctcgcacttctgacaaagttgcttgccattgccaggtttacaacggttttcagtcatgacaaggattcaattccgagggtctggacagggaaggaagatgtccgtgcaatagcaaaggatgctcgatctgctgtataggacttgaacccttctaagttctaatgggatgacatagttcttcctttgattccccttctttgttaaatggacttgcactcgtgttgcaggctctcaaacttctttctgtattggctgccattcgctgggatgagaaaccggataagatcgaaaaaatcctcacttccacactcctagatggttctgttacaccgaagtcgaagggtgcaagtgcttctagtgatccacttgcttcaactacttgggaagaagtaagcttgtgttaatttttcgcgctgctgtaaatattagaagtgcataaatcatggaaccatcacgattattgaactcttgagcaggtttctccaaagtataccctcatcactccttctcaatgcaagtcactgtggaagcagttcaaagcagaaactgagttcgccattacacaagcggtttccacgcaggtgtgtatccataatttgggaggatctttatgctttcttccaaaatttggatcacgtacatggtttgatcttttcctatttgatcaaagagtcttattttcatttgtcagttccttgaattttcatctttttttactccagcaagctcacaagcgcggcaatggtaggctgcctcctccttgggccatggtggcaattgcagttcttgggtttaatgagatcatgacgcttcttaggtatttgcttgtactatacatatcaattctatacccactcacaaaacaatataacattatatcttcgtttcttcttgttttgcacaggaatcccatatatctattcttgctatttgtgggttatttgctggtcaaagctttagcagtgcagctagatatcaacagagaattccaaaatggcgtggtaaggttttgaacattcaccgtgaagctaacctatagtattgatatgctattgcaatagtatcctatagagatcaacaaatttcccggtactatctgattatgtgttgcatcatagattcatagtggagcatgtacaaggtcattatctattgaacactttttacgaaatttgtttcctatgaggctatgaatcgggaaggataaattgtttattgaacactagtatcctattgctagtgtataaattgtttcctatgctacttatttcatgaatatttagtgcaacctcaacttagaggatcttgtgaaaaatatatagtggcatagtttattctacagagaaagttttcttttgttaacatagcaatctgcttataaaaccttaattttgctctaattttgatgaaacatcaggctataagcgctacacattggtgcagggattgaaattttggttcgaaatttccgaaatttcggtaaattcggaccccccggcatgccaatatctcggccgaatttttcagtttttctcaaacttttgtgaatttaatcaaattcagttaaattgtgtcgaaatttcagaaaattttggcccaaaaatttttgttctaccgaaatggccgatattttagccgaaatcgaaattgaaaaccctacattggtgtgtatcagcaattcagtattgtcttctgagttagaatgttatgccagtgcctcactagtgttaataagtttgcaaaaaaccacattgatccttttctccactaacacaacaattatgctgaatcttatatattgcaggttcctgggatcatctctgttacagcaaaactaatccccacactacagaacattctaaacaaagttgcaacagagcaacaacaacagcaagggcatcaccaagatgctgctgcagaagctccacagcaacagcagcaaccacagccgcagccacctcctctactcctgagccccagaagcccaatgagcgaactgcggaggccgctgcacatgccattcagcccggtgcgcaaggcggtatcgccttcgccatcctcatcgtcttccaccgttacatcgcccaggaacgctggtgaagaccagaagcccaggcaaatggtacagcctgacaacgaatccaacaatgcttactctatagtttgatgatcttgggtgttcagggtcagctggtggtttatactgtccaactggaaattggaaggtatgagcatttcgttgtcctcatttgaatgcataggtacactgattgcagcaatgatccatcgtcagtagggtatcaagacagaataattcaaaatattttgtctcgcaaaattttgtaaggagggtggttaatctgtagaatggacagaacaattgctactgaacaccatttatcagcatgtatataggaaagattcaactgcaatgcctaggatatggtcaatcaaaaagaaaaaaaatatatatatacttctaatgccacttggataaaatagcacatgcaaaggtttgtttcctttcaaaatactctatcctaggtttgaatttgtgctgtcaagacagtgaccatggcctgacagtacattatctagggaatggtgagttaaaaaccttggttacatgactagtactatactgcatgtgtgcatctgttgattgtcaatcagtctggatacttacaaagagagacaggggacactgttgtggacatggggtgttgcctgctctgctgaacgcctgcaagaagccacgacattgcccccatgccgacggcctctcccgagagagatccatgcatccattgttttcttcttcctccagtcctgttggcagcacagataagtggtagattttggatcatcttgtacaggcaggtgacaattgtgacaatacaagcagcatggcacatgcagagattctgcatttgtacaaagcctctactggttttgattctaagcctctactggttttgattctctcttctcccctcctctctgcatgactgcatccatcaccacatggtcatctgctgttttgtggagtagttaagtactctccccatcgtttggcctggcttattagagactaaaaatagtttatgcataaattgtttatatgtgtgctctcagcgacttagaagccagtattgaaaaataaactacgataaaaagaaacatcaagatccgcttataaattaagttttaaaaatcaaattttagctacggttgataagctaaagagcaaacaattctagcgtttgaaatttatccacaaatataatcatttctagagtactattttcccaatctaaccacacatgattctctgtatttatcgttacattgcttggtgttatatctcataaagctagtaaactcttagggaaatcagagtaatttcacctcaacctttatatctgttaaaactcctagaaatgcttatatttatggacagagggagtagctagctgtgactgagatggcatgcaaattcaaccacagggtatggcttacagctcaggtagttaggcttagcttacaaaggccacagggtaggtacatggtatgtgatacatgatctgcacagcatccatgcatgcatctgggtaacatagatttctctgttcttatgattggagtgagctgagagagagctggatcagtatagtgtaatgtaatgtaatgtagtcagagtaagatgaatctggagatcctggcataggataccccaaaccctgctcaaagaaaataatcctggagaccccaccctgcctgctgccaactggatatccttaaccccacatttatatcactacatgattgcaggtgccacatgattacaaaggttctaagatcttgcaagatcttcagcttaacttacagttctactactacaactcctgctgctgattgctgattcctaatagaaagtaaaaaactggaaactagctagagctagaagtagattttgagttaacagcaacactgagatggtgctgcctcccaacagctaaaagtctcaaatcctaaatattgtttaccactacctgagctaatattgcacatgacaaaactggcgattttagacgcgcctgatacaaggtggcgctatgatgccgtctccttgaagctctttgtgagccagatggccgtctccctgggagacgctttctccggtccgaatggcttcagcagaatgcccagctcctcatacctctcctgctgcagcagctgcgcgctgaactccagcagcccttccaatgcctcggcacgctgctggaacgacgaggtgtcgaaccgctgctgcctggagtcattggatccgcggctcgaggcagcagtggcgttgcggcctgaggagtcgctcccgttgtccccatcggtgcgtaacacctggatcgtgcatttgtccttggtgattgaccggttgataaagggaggagtggaacatgagccatggccaggagagagcttgttgtggatggggagcaaggggtcctcagacgatgccagtgggaattccgcaattctgtcgattcgaggggcattcacagagacgtcaggggagtctagttgttccagaatgctgatgctgcgcttggtgggtgtttcatatgttgacagcgggagtgatgctcttcttgctggtcgggcaattttgtttggagttgtttttgagggcagctgtaaaagtggaagaaattggagctcaatgaatattggcacattcatttcaacagacaaataatgaaagaggcagcataatcatgcaaaatgcaagctcgtgctgaagccataaatagcataaagaaacaactgcatcatgacaagatcttaataactctaaaagaccaaaagctgaataacactaatgtagtatgcactgagcaagcacatgctataattgaggctattgtagtttctaaacaaatgaagaacaggttcactggtattattgagtgcacaaataatatagaaaaaaaaggcacaaaatggaatacctcagagcggtatgttctgttatacgatgttttgggaggttcaagctgatttctagctgtataagtcttggctggcaagctcttgggcgtccttaggatgcttgatgtctttgttatgatggctttactggtaacctcatccccagcctcactactgtcaacagagagccctttgacactctgggtggttgtgtattctttgatgctccgtgtagagctaactgaattccgttccggagatggcttgctaaatgtcacagtcctctcatttcccagagagttcctcctggccattcttctgcgtgcagaatcaaccacgtcactaggaaatgtcatcttcttaactttgtcagtcaaagattgatggattggaagtatgttgcgagtaggactagatttcaattggacttgcagcacataaggctgaagttgtggatgcttgagtagctgtgcagcctgtacaggaaatttagtaaatatttataccacaaaacaaataggagtatacatcagcaactattacaaagtagtaactaggatatagtataatggacttacactaggtctgtgctctggacttttccgcagcatgctcttaataagtcccctactgcacgcagaatataaatttaagaagcatgctctatccagataagatggtgggcaaaatagggtgaaacaacaaaaggcaactagttcaaaacttacaaggcaccagaatatttagtgggtaatggtgagactattgatttcgtgatcttgttaatcagcgcttgcatgtcctgcagggaaatgagaaaattagacccttgtacgtttcataacactgcattactattagcatagatgtagtatctaaacatatgctcaaataaaccatcacacagtaaaagtaaagaaaccaaaacagggacttacaaaagctttaaatgcaggcctgagcgcggtcatttcatatatacaacatcctgaaacaaagtaataaaaatgagagttcaatagtaagttttccatttagggcaggaaagtggtttctcaaattgaagtcatatatacctagagaccaaatatctgacttggtaccatatggtatatcagcaagaagttctggacacatgtaacttggtgttcctactacctgtgttgggagcaatatactactaagagtgacatcgaatatgtactggaaatatgaaaagtgctacaattacttacagaagatgccagatcatcagaagtcaatatttttgcaagcccaaagtcacctgcattggtttaaatttggaattgcaacattaccaggattgctaaacccatacataaagtatgatactttttgggactaagatacataccaagtcttatactttggtccctggcaatgaaaatattggagcactgaaacgaatttttagcagctttagtatatattatttccatgccatggaaatataaatactataaggtactcccaagtttagcactactactgaccttgacatctcggtgaagaatgtggtttgcatgtaaataatctagagccatgagaagttgcacaagccatttgcaaagcttctgaaaaaaaaatgagaaaaacatttcagtgcacatcccttgtttgcagcaaagcaatttttaaggtatcaaaggaaatgcaaggtcagaatccacacctcctcagagaaatatgtaccattagctctttaatagcttcagccctgaaccgattatagattgtgttagctaaggaactaaagttcaagaccaaaataaactattttaaaagaatttcatcaaaggaacacatacatgtctcctcccttacaatattctatacaaatgcagacatagcaaccctgaaaaatccaaagataaagaagtgagaatgaaacaaatctattccaccctcccaacttcataacattttcttcagtccttttcaacaacgttctccacccatgaatctttgtactccacgataaacggattcctgaccgtcgcaataagttgcatctgcatgaggagcatttccacataaatcagtataaaaaaaaaggaagtaccgcacaagagcaagaagacatcacatcattttacttcacagtttcagatcagttcagcaccagccaaactaaacacactagcatcatcatcatcaccaccacccaacacaccaatttatgcagctcatggtgaacacaaggcattccccttgaaaccatagcttact

SEQ ID NO: 92008 - DNA, 8066 bp, Oryza sativa
aggggtgatcttgtgcttatatgtcaatgacatactgatctttgggaccagcttaatgtgattgaggaggtcaaagactatctgtccaagagttttgaaatgaaggatttgggagaggctgatgttattcttaacatcaaactacaaagagaagatgaggatgggattacacttgtgcaatcccactatgtggacaaggttttaagtcgctttggatatagtgactgcaagccagctcctactccttatgatcccagcgtgctattaaggaaaaaccaaagaatagcaagggatcaactgagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatctaaagggcactatgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaacaatgattattaaagtgaacagttcaaaggacaacatgaagtcatctagacaaatcaagagaagactgaaatctgtcagaaagcagaaaaactccggagtgatagcattggactatgtccaaaaggctagaaatctggcagatcagtttaccaaggggctaccacgtaatgtgattgacagtgcatcgagggaaatgggcttgatacccacctaaggttgcataatagttgaaacctgtgcattatgatcggagatcccgtgaatttggatggtgaaacaaactattgtgtgactaagagaagagacccttgaaaggggctcattttcatgatgtgcttctcttctttcatgcatggtaggatggcttatgtcttaatgtgatccgagtggcttttccaagcagagatgttgacctgcagaacatctcagaaggaacacatctatatgagttcgactgctagtcacagtctatgaggtttgggcgatctctagttactcatgaaaggcctggagtttgacttatatgctccaaacagaggggatgcaaacggcagcccagtaccagtcaaggttctgagtgaaatctgatcacacaaaactcacaattcaaggcatagtccattgttaagttgtggtctgatgtagctcatttcctaggtggaagttcaacttaacagtctccaccaaaaccctggtatatcaaacaggcacaacattgagaacatttcttatgagccttgaaatttggtggggattgttagaataattgggctaggcccaactataatattaaatctcaaaggcccataataagtgttgaggataataataccacctcaggatttaagcgagaaatatctcaacctaaataaggagttattggaggctccctgttgaccagttgaggtaggggtcggaatgccacacgcgcgcgcgccgggccgggcgtgggcgtggctggctggcggcgtgcgtgcgtgcgtcacgtcgctatccttttgcagccactaacccacgttcccacgattccctccgcaacagcgcgtccacgttctttctcctgatagataaggaggccgcgagtccgatccgtcttcttcgcttctttcccggtgttagtttcttcttctccgcgtctgagttgctctcgcttcctcgcttctgatctcttgcgcgcacgagagattggaaggagcagtgcctccgaaaccacaccttcgcctgagatctgcaccgggtaggcgggtgatcaggtttttggggagtgcttcccgcacgactgctcatcgccatgtctggagttgccgccgccactgctggcggaggtggtacgccgccgacaggagctggatccggagctggtgcgccaggaggtgccgtgaacgacaacaacaacggaggcaattctgccacaccatccagcggagggccattctcggggtataatcttctcctcctgctactgttgttagcgctattcctgttccctttgttagcgctatcgctatactatgtgcgctatgttcttgttcctgttctacatgatgcctctagcatgttatcgcattactggtatgttcctgttcctgacattcatgatgcgcatagtatgctactggttatgttaagatcaccctacactgcttatgccatgatcattgtttcaatttcttggattaaaatatgccgattaatgactatatttccaacatctttttcatattttttttaccaaagattgttttttcttaatcttctccattattatactcctatttgtctctgttttttgcactgataactggagcaaatctgggccgagcaattagtagtatatgcagtcaaatgaacggggaaaaatgagaagtacatgaaaggaactgattttgtgactcaccatttgaatgaggaagggagaaaagtatcaaatctggagcttgatgcatgaacagttgtatatatgatgaggaaaatggaactttgcatgccacaactgtagcctcctataacaaaacttttattgtttactcgttttttttcctctgctttcgtaatgaggatctgggcgtatacttcgaatcatatttcattacgcacataattgactatttctgactgcagcttgtcttattgttgaaaaggaaaggatgattagttgtaggatagtacatgagctatgatgttttaactctacttttttcagcgcaatatggtaaccagcttaatcaaacccatctaatgatttagtttttaagtaagaatatttgtttgagagatagtatagaatggtaaaatggcacttgaactttaaactgagatttttgggaatgagagttctatacattatcaaatatggcacaattcatccttgaaacgatgtgacataatataacagttcatgtcctgagcagagcaagctagtctggatggaaaatacataacagagcaagcatggtatcatttttattatttttttgtcaaagagaacttgaatactctctaattcaacattgttttcttaacctttttcatatttatactcctgtttgtctctcgtttttttgcattgagaatggagaactctgggatcagtagatgtagtcaaataaatggggaaaaaagagaagtacatgaaaggaactgattttgtgtgactcaccaagaagcgtgtgagaaatgggaaaaagcacacaaatcatgcatgaacttctagttgtatacttgtatatgaagggtaaaatggagcagttaaaagtagcaccacataaatatcatctgctatcaccaaactgtgttctttgcatcttcctcctcgcttttcatgatgataaaccagactaaattagctattagtatacttttacttggtgataaagagattggagaaaaactaataaaataaagttatcatgcaaaatcctaaaattattttagagaaaaaattgcacaccagcattcttccacgccggttgaattcaatgcatgtacttctatgcatagatagaatctgcattatgcgaagtagaccaacaatcgctgcccaaaagacttggtaagttaagacataactaaccatgttcatacatgtttaaatcacattgcatttatcacatgtgaatttaattcacaacaaaatcaattatatttatttgttgcagatgtacataagtgtgagcccaattggtcgatctatctacactcgaacatgtcaatggcaagacaatagaagtgtgacaggagtaggtcgcctccacctcgtatgtgatgaccaactttaggctgcaactgctcacctctcgccaccaaccagcatggtaccaagcgtcccaaatggaattcaccatgtctgccacttctacacgctacatgctacaactgcaagatctatactccatatatgcgagagctatagtttatggaagttagactttaggaaatgtatatgtgattcttttagataggtaggacatgtatatgtatgaacattacgcatatatttgttctttctatggactaaaagaaacaaggctaaatatctatcacaacatatgtatttgtaggtactaattaaagattgattctccacagcaaaataatgagatgcgtttaccctgtcaagcgaattaatagctagctagtatttggtctgataaatcctaattatataattttagaaaaagagaaaataaatttagcattcatacattactatattacaattacatctccaaactacaaaacagtcccttgccatttacaaacacccccctaaacttcacacaaatcctcacagctatgccaagccctaactacatcacctagctccattctcagctgctcccatccgaacccctgcacctcgccgccgttgccgtcgacgtcgacggtgacctccagccttagatcgacgagcaacagcggtgactgcctagagacttagtaagttaaactaagttactgagattaacaaattaagtacatttcgtacatgtttgaatcacattatctatcttttctttctaattaagtttgatacgaagtgaaattaattatatttgtgaatcacctgaggtcgttatttatttgtggctatggtatgtttccactgtcctatttgtcccctagttcaggtagaattcaccatgttctaactctgggtggatttgcaatataagtgcaaccgatctagatggtacaagtgcacaagattattatcagcataacaaatcaacaacgcatacacgcatggagctaaagattatggacatacaggttgcattgagtacgtacagaagtctggagacgtatctttttttttattttccatttctcaaaaattaattggtgcttgccttaacaccttattattagatttgtaggactgatctaacaccatatgccattacgcatataattgactatttctgactgcagcttgtcttattgttgaaaaggaaaggagggttagttgtaggatagtagataatcagctatgatgttttaactatactttttttttaatgttaaaaaaaaaactatactttttttcagcgcaatatgggaaccagcttgatcaaacccatctaatgattttgttttaagtaggaatatttttattataatctcttcttgattgagagagattatagaatataaaggcatccatgtggcaccctgaactttaaagtgagcttttttggaatgagagttgctacacaatatcaaatgtgacatagtataacagttcatgtcctgagcagagcaagataatctggatgataaatacagaacagagcaagcatggtatcttttttttcttaattttttgtcaaagagaacttgaataaactctagttcaacattgttttcttaaccttttccatatttatactcctgtttgtctctcgttttttgcattgagaatggagcaactctggcggcagtatatgcagtcaaacaaattaatgggaaaaaaaagagaagtacatgaaaggaactgattttgtgtgacttaccaagaagcgcgtgagaaaagggaaaagcatcacaaatcatgcatgaacttttagttgtatacttgtatataaagtgtaaaatggagccgttaaaagtagcaccacataaatgtcatctgctatcaccaaactgtgtccttcgcatcttgctcctcaattttcatgatgatgaactagactaaattagctgttagcgtgatttggtaatgagaaattggaggaaaactaattaaataaagttgtcatgcaaaatcataaaattattttagagagaaaatttcacacaagtagtaatctatactggttaagtcaaatgcatatacgtccatgttaagtcaaatgcatatacgtccatgcattgatgaatttacattctcgctaactgcccagagatttagttaagacagaactaaccacattcatacatgtttaaatcatattaattttatatcccgtgagctaatttaggtataagaagtaaatcatattacttctatatgccgtgagctaatttatgtataagaatcaaaatcaattatatttatttgtttgttacatagaccaagttagagatgttaataagtgtgtgtcccaatagcaaagataatcgattccacgttacggggctaggtcgcctctacctcggacatgatgtcaacttctggatatagttctttgcctctgttgccctcatcgccgccagcgtgctaactaaatgaaatcatcgccgccagcgtgctagctaggggtccaaatgaaattcaccatgtttgtagcttctccaggctacatactgcaagcccaaggttacatgttaggaaatttagaccatggaaaatgcatttataattttttagatctttaggacatgcatatgtacgagcattatatgcattaggaagaaggggtaattgtctacacatgtattttagatttgtaggtgattgtaaagattattctccccaaaagaaaatattgtgtttaatctgcaaactaagggagttaaggtagcgaaaataatgagttgtgtttgcgctgcaaactaagagagttgtagctagctagcacagtagcacagtacatagtaccttctcataaatcctaataattatatatctctactattataaaaattgaagatgttttgccggtattttagtacgtcatccgcatttgtgttggtttttaagttcattcgcttttggaaatacatatccgtgtttgagttggattgtaaattcgtttgcttttaaaaatacaaaaggggtcatataaggaatctctttaataaaactcgcatgctaaattgagatggaagtcggacttctaaatgcagctaataattttctaaaaaatatctaagcgaattcccacagtgaatttcattatagctaaaccgcacaaatataataagattaaaatagcattcaccacccgttgcaacgcacggtcatttttttagtaattatataatttaaaagaaaaatgttgagaataaatctagcattcatacattgctatattatacaattacatctccaaactacaaaagagtcccttgccatttacaaacacccccctaaatttcacacaaatcctcacaactatgccaagccctaactacatcacctagctccattctcagctgctcccacccaaaccccttcacctcgccgtcgccgccgtcgacgtcgccggcggcgacctccagcctcagctcgacgagcaacagcggcggcgccacctccgacatctccaccgacatcgcggcgatccccgacgacagccgcccccccgccagcggcaagcactccacccctttcttccccaccaccaccacgtacccgagcttcccgccggcgaggccgagctgctccagcgtcttctccggcgacgccgtcgtcgtgaaccgcttctcccttaggctcttgtcgtgttcgccgaacagcccggacaggtcgagcccgggagacatggagatgatgtcgaacgcgttcagcggcggcggcggcgccgcctggaacgccacggcgcgctctggctcgccgttgaggaggccgtcgagctgggagtcgacgctgagcgagcgcttgaaccacgggtggtgcgccgccagcgactcgacggcgacgcgggtgtccgggttcgggtcgagcaggcggctcaccaggcggcgcgccggctgggacacccaccgcgggagctcgtactcgcggcggtgcgccttccggcacatgtcggcgatgttggagtcgtctaaagggaggtggccggcgaggaggacgaagaggat

SEQ ID NO: 92009 - DNA, 3859 bp, Oryza sativa
cggcgtcatatattaaaatatggagagagtacaaattagaaatttggaacaaaggctagtcgctacctcatcagcatcagttacagcttcacgactccttcaccacttaagtaattgattttctggcgcgattaagagcttggtatatagtccagttgggtttagtttgtaccaaaatttaggtttctaccgagaaactgaaacatctcaaagtgctcacgtcatgccgacgcaggcatatcatccccgatcagaaacccccaccaccgtctacaaaaatggccacttcgattttggtccaccaccataggaatataggatacacgcatgcacgggtgtgcactgcacccagctgcatatcgtcgtatatttcataacccgagaagcacccggagccacgggctggtcgctgcagcttctcctccacttcaccaaccagccgcggcgtgcggggaaactcatcggatcatacagatgcatgcactctttgccgtcgcccgtgacacagccttctcatcgtcgccggcggccgacgagcacctccccaacgagcacccaggcggtcacctctggaaccagagcgtcctgtgagtatatgcacatctaaacaacactttgattctcgtattattattattcagttaagttacaattgacaagtcagacgagacgtgcaatgcatgttttcagtagcagggaagaagagcatgggagcaacgacgacagcttcagggagagcctcgtttctttgcttgacaacacgagagactacgtgatggctcccgaagtgttcgagggcgtccccgtggcatgcgactacctcaaggggatggacagcgacggcatggccgcatcagctgtcgccgcctatagcctggacaacaacggccagcacgctagtgttagttcaatcgagcatggcatcgctagctcgccgctgctggcgtaccagctggggaagaacagcgctgtggtgcaacggagcatccagcagcaggaggttggatctcccatggccgcatttctgcagcaactgattcccactagtgttctcgatcagtctggtatagggtttgggggagtttgtctggacggctcagcactggaggcttcgttttgcatgagaacttctccggacgtcagctctttcagtggccacaggtcagcaaccgcagaagaattgatgtctacagacacaagggagcaagaaattacacggctggtaagactgaacaattgtaatgtatcctcaaataagtagaaaccggtgtgaaaaaaccttacatgtacaattcttgcaggcaagatcttgtagtagcagtggaagtgatcgtaacaagaagaaactatcagaggtaagaggaggaggcaaagcgaagaagttcagtcagagacttcacatagtacatcttctcccaaggtaactaacaatgacaaaatagtggattgactttgcaaatcgttctgaggagttggcatttgaagaacttgtttcgaaaccacacgcagcatcaatcacccaaagtgaagctgggggagaagatcacggctttgcagcagattgtgtcacctttcgggaaggtatgaccgtatgagatcattaaacgcacactttatgcttccaaactaatgtaagaagcaaaagtattttctcttcttcaattttggccgttaatcattacatatttcattttaacagacggatacagcgtctgttctgttggaaaccataacctacatcaaatttcttcatgaacaaatacaggtgacaccgtcagcacaatccttttttgctgttttgcacatgccccctgtgtgttttgtctcagatcgaagtttctataaagtagtacggagtagaagatactgccatgagcactgcagctgagcgattcactgtatcgagatatatggatcgttcatcgttgcaccgactacttcaaccttttgccttatttcagattacgcatttgggcatttggtatattgacctcttgctttgtgccttttgccagtggacctccaagtcatgtccaagtttagtatgtcgttttcgtgacactaaagaacataaagaaagtacatttgtactggcacaactattactgatttgccaaccttttctgaacctaataagtcatgctcccacagagataagctgacgaataacccttctatttttctgatttggtgcagttattcagccaaccgtatatgacaaacagcacaaacaaggtagtttttcctattaaaacgatgtattgcaaattctaaaagcacagcgaggccaggactgaatgacggagcatatacatttaccaccatcttttcttcagggtcatattcactggggaggggaagggaagaggaaggcaggtctggagcatgatttgaggggcagagggctttgcttggtccctgtttcctggacctctcaagaatactgtgatagcatcctgccggagtgctgggctccggcgtacaggaactacttttaccgatgagccccatacacattagacagctcacagccttgtctcacttactgcccgtgcaacggctacgttgggaagatttactgtttacttactctatgtttttcagtccccatgttatatgtattgctgagtttgtagcctagaacgaataaaaagagtgaagtgtataggcggtctctaaacttataagagtgtcatatctaggtccctgaactcttaaaatgtattttaggtttttgaacttgtactgcgtgtcatatatgtccaaatggatcccatctcattccatgtattgatgtggcatgccacggtggtgcatccatgtagtggaactacatgacagtcatatagaaaaaaaaaatataacgccaccatgtagtggaactatatgacagtcatatagaaaaaatatataaattagtagagattagaaaatatgttttttatttcttaaaaaataaaattaacattaaaaaagagaagcgatagagagggagagagagggagagagagagagagagaggagaaaatgatgctttatttttttctatatatgactaagggcaagtgctataatgcttcatgtgctgtctctaaaaatgacacataggattgggtgatgaggtggagagagaagtgaggagagatatgatgaaccacccctaaatcaagaggtagcctccacaaactctaagaaaaaagtgagagtactaaaggcattgatatttgtgtattaggggtgacctgttgtatatcttacatcttaatttattggtgaatgccataaataattttagaggtagcaatcacatctattatagtacttgccctaacatgtggatcccactaatatgtacttcctccgtttcatattataagactttctagcattgcccacattcatatatatgttagtgggtttgaggttatttggacctatatgatatatctataaaagtttaagaactgataatgcatttcaacaaaaaaaaagtttttgaaagagtggtatttgagaatgcggcatccgagagagtggtataaagtccaaaattccggtttaaagtgggttagagttaatttctatactttttagcaaaagaaaaaaaattaagaacttgataagattgtaaaagaagccacctgctaccacccctagctgcagcacgtgccacggcaatatctattccgtagccacggttacacgagacggagccattttacttccatctatacgacgcaacgtcatgccatggacgatgcagcggtgcttcagtcgagatcatctcaacgagcgcttgggctcgatcgccgcaggattgcgcccatccgagcgtgggcgccaggccggcctggcgcct

SEQ ID NO: 92010 - DNA, 5280 bp, Oryza sativa
tcgcgcccgcgcgcgtcttccgctatgcgaaccgtcaaacatgaacgaccatgagccgaggcccgagcatctctccattgacaggtttcctagcccaagtactatccggatgggccagatcggtggcgctagccgaacaaatcacccaaaaagaaagatactcgtggtgagacgggttgaacttagaattgtgttgactgtgtgccgtacgcctaattaataacatctctggtttggcgttgacatggcggcgctcgaattatcgatggccgtgtgagtgttcaagcacgaaacggctaatgggcgatcgctcgcctggcgatggggtagcatcaattcgctcccccctctccccctccctccctccacctggtattttttttatttggctccgtataacttttctattttagtaaatttatacacctaaagtttatacatcttaattttacacatctaaagcttagaaacccaaagtttataagacaaaagtttatatatccgattcaaatttgaatttgaatttgaatttaaatattttttatatatagtatttctatatatctaaagtttatacacataaagtttaaaaatctaaagtttataagttaaaagtttatatatccgattcaaatgtgaatttgaattcaaatattttttaatatagtatttctatgcatctaaagtttaaagtttatagacccatttcaaatttgaatttgaattcaaataatagtttatagacccaaagtttataagtaaaaagtttacatacccgtttcaaattcgaatttaaattcaaatattagtttatagacccaaagtttataggtcaaaagtttacatacccgttttaaatttgaatttgaatttgaattcaaatattagtttatagacccaaagtttataagtaaaaagtttacatacccatttcaaaattaaatttttaattcaaatttttattgttgtagtaagagaaaaggggaggtaaagtagtaagggggaggggcgggtgatcgctggggaggggagataacgatcacccgtccattaggattacccattcaagcatgcctatccatcactggtacgtagtatgctattaattagacatcagtcatcagatttcatctcaccaagcgtttggttgtaagcgtgtactgtacctcttccataattgtttgttggttttattatttcagtttttattatcgtctaagtatttgatcttttagaaagaatttcgtaataagtggttgtttcttgtttaaagcaaataccggaattttaatactattatcttaaagaaaaaacttgtactgtaccttcaagtacgtcactcgattcataaacacgtacagtaccattgtgtacggtatgaaaatgaaaaaaagtaaacaatattactccatccaagcaacaggattatatgacccaacagaggccgccaaagttcggacaatcccgtacctagctccaacagtatgacgaaatctacaaattgatacccctctattccaaaaaaattcaatcatatacataaatctggacttatatgtatctagattaatagctaaaaattcatttttttaacgtagtatatagtatacgtacgtgacaataaagaaccaccagattgcacatgggtgtactatagcttaccacatatagaagtacaaaaataaactgattaacgtctaggcatataataattaggcacgctacctgataatagtaaccagactaaaaaaatcacgcgctacgtcatacgcgagacattgactcgaacgggtattatcaactcgcaagtcctccatccatcagcaggaaacaaccaaatttaatacaccatccgtcccaaaatataacaaattttagcccttaaaatttgtcctaaaatataacaacttctacactaacattatcttcctaaccaatcacaaccctccaccattcactttttccaccaaatttcactactcaaccaattacaacccttcatcattcacttttacctatcccttctttctatatagttaagacccaaagctaagttgtggtgaagccacgtcatcatttaattgtcagccgttggatgtaatctgaatggtcgcagatggtcgcacaagcgtgaagcgcccacttctgtagggtttctcggaaaaaaaaaactctatccgcatcgctcacgcctcacggccgatgccgccgcagctgtggtgaagccacgtcatcatttaattgtcagccgttggatgtaatctgaacggtcgcagatggtcgcacacgcgtgaagcgcccacttctatagggtttctcgaaaaaaaaactctatccgcatcgctcacgcctcacggccgatgctgctgccggatgcggcgcttccctctcccttctccttcgccccttctcctcccgcgttccccgtgtgcgccagccgcgagcccacgaggccattcgcgcaccaagccatggagcgccgctcatctgtttggagacagatcggtcgtgggagggcaagcgggtgcgacggcgatccgtgcagctcgatggtggtggggggcggagtcgcgtcgcgccccggcgccatccgccccaccatggtggctcaggcggaggaggcgaaaccctagcgtggggagatgaggtaggctttgatgcatctctatttcgattcttgcgtctcgtgattgggggtatcattcgcggagcggagagggtagaaggaattgaggaggggaatcggggggtttgggtggggggtggtgggatttcaaaaccctaggtgtgagttcttgccatttttcgctagctgtgtggttcaatgaattccgaaaccctaggtgttaggtcatgtttttgcaagatcttgaatccccagttgtgttagactgtaattaggtttcgtgtaagcaattttaggagatgtatgatgcattttgtgggtgacgagtatccctggggatagggcttcatcagcctgcaaacataatataaatgaataatcgatttgaattccctttctgtttaaccaggtgaccacccttgattggtatgtctggaccaatacgcacatagacattggaaatgatctaaagtgatttatgccgtaccaggacgctaaaagtgatttatcactgtaaaacttgaaccataagtactcaatgatctgacagcatgtaatcatgtcaatctggattagaaaaaatagagaaagtaaatatcaaaaaaagtaagcttacctattgtaatgtagataagaataggaagaatatcatcagcccctgatagtggtcgatcatttgacattgacacatctagtagcagcaagttattgatgacttggcaacagcttataatgcaaactaagcttctctgccataaacatcctaccaattgaagcagataaccttgctcggtatgtctactgttcaactcaacatatatttttcatatcttctgtacatctcttctctaatttatccttgcaatattatttcatatccagttacaacttatggatatactcctaaatttagtgtcacaccccgatctggcaccgccgtacaacggcacctgataggagcgtgtcgtaagaaaaacggcgcgaaccgcttcctacgaaaccgcgatctcagtaccagtcccaggacatagcgctggtactcacagtgacaaatatgaatcattgcaatccttaaaataaatagaggacttatttatcttaacttacgttgcagctcagaacagcccgagaaatacaaccgacgacgcggacgaggaaacaccaacaacagcagcagcagcggaaccaacggactaacacccagcaccacagacgacggctgggaatcaggacgaaaccctaatcttcacttcacttcacgacggaggaactatatatatttatatagagcaaggtgagtactttcgtactcagcaagtcacgggaatttaggtgtttaatgcaagcttggagagaggcaaggttgttttgcaaatcctttgtttgaaatccattttgaaaccactaagtgatttatttctttttgagtttggatcgaaaagagacttgtgtctcgattcgacttaagagacgcttttcaacaactcaaatggtaatgtaccgacctcccgggtcagatcattacttctcggctcccagagccatttcacttgattaagcggctcccagagccttattcattttctcggactcccagagtccagctgcccagcagtacaacaatccgcttccactcgggaagcctagtctatgatgcctgcagacatcccgaatcacacagattcgtttctgaccactcaggtcgtccatctgccacataggctgattctggttacgattcccacaccacaacaacttttcacaaagcacaggcaaacaaatctacgcaacgggaaccacctcacatccacccatgaccgtgggcacggctgttcgaacagttagttaacctctgcagaggggtacactttacccacaagacacgaacttactccagacactggccggtgtcagaggttcacgacaaagcctttccaaaccgagtctgggttacctcatgccacatagaaggatcaaatcctcacataaatataggccattttagttttcacaaatcaaactccaaccacctcgatcggtaatctggcaagcttcgcgttcttgccttaccaggaacccgggttggctccaaccgaccccgccccggcgttccccaactattggcatgcgaggttttctcgaaccgactagatacttagctaaggtgtcccatatcaccttgtggttgcactttgttatgcttgatgagtttcccacaggaatcgatccttatatgcgaatacgggacagcgccacgcaggcaccaccctcgcatcgcgagttttcacaattcattttatttttaaacacaccgacaccacatgtcgggttttcaaggcttctcaaacccatttcccaatttttcaacaatcaacggtgtatgtgggatatttggtatacgcgcttagagagcacgaataccgaagtaccgcaagggtggagcgacaaggaatcagggtagtacaacctacaggaattagtgcgactactgggtaggtccgtcggtttggcacgcaaaccgaggccaagtaagttaagtgtgtgattctaataatgcaagttgcaaacaaagtaataatgattttccaattataggagaaattgatcaaagggtgacttgccttgctcaaggtcttcacgaagcttcgcgaatc

SEQ ID NO: 92011 - DNA, 3624 bp, Oryza sativa
ggaggagagcaaatcaggtcaaccagctatggatgcaactagatcggatccttcgccgcgctcgtgtggctcgtgctcgcgctcatgtgggctgttgcacatgtcgccgtgcaatcagtatgccgccgcatacggcgctgctagccggcggccgtggatgaaaacctcgccgagggaaaacggaggccgaggatatgcgcttccaaggcgaggatctaccacaccaagggcatcaaggtgattatttttctgtaatctgtatagtcttgttctttctttctttttttgacacccagtcttgttctttcttgctgtgacttgatggctaaatttagttgacaaatgatttcatacgaaaagaaacaacatccagtacatagatttgtaatagaactagtagtacacttgcattgtgtaaagaaaaaacaatttgaaagggatacaatactcagtacatgaaaaaacaagactagctaactagtgctcaggttggttgcctccaaatttgttccatatatgctcagtcaagtcgttttttagtcgatgatgcatgtctttattccgaatagccacacctatttcaagcaccctatcaaatccatgaattggcccttgtccatatccattcagtggtacaggagagcttccctgctcatagttaaagtcagctcggccctcatatgaatccctctcatcctcgacaatcatgttatgcaaaataatgcaagcatacataatctcaccaagagttggttttttccacatacgtgctggggtacatataatggcaaaacgagattgcaaaacaccaaatgcacactctatatcttttcttgtcgattcttgcttttgagcaaataacttgtgcttctcatattgaggcaatttgaatgttttcacaaatgctgcccactcaggatagatgccatcagctaggtagtaacccatgtcatactcattgccattgactgtaaaatgaacatccggtgctatcccttgacgttgtgctgtgaacaatgatgattggttcaacacattgatatcattgttggacccagccacaccaaaaaatgcatgccatatccacaagtcatgtgaggcaacagcttcaagcatgacagtgggcactccatgatccccacgggtatattgtcccttccatgccaccgggcaatttttccactcccaatgcatgcagtcgatacttcccaacataccggggaagccccgagcctctcccacatgaagcaacctctggatgtcttctgcagtgggcctccttaggtattttggcccaaaacaatcaataatacctttgcagaaattaaccaagctctcaatgacagtggtctcagctatttgtaaattttcatcaagtatatcagcagatgttccatatgctaacattcgcaaagcagcagtgcatttgagtaaaggagaaaatccaactttaccaaaagcatcctttctttgctgaaaaaccggagaccaatgactaagagtttgcacaatgtgtagaaatagatgctttttcatcctatacctccaacgaaactgggtatcgttgtacattgggttttctaaaaagtagtaagccttcaaccgatcctcagcatcttgacgctcccttcttatatactttctctgctgggttggtggacctctctgttgcttcttaatttgataactaatgtcctcttcaatctgagtctcaactggatcattgatgtaatcccaaatcaagtcgaatgggataacatcaaagttgctaacctcagaactatcatgttgggagctaggttgtgtggatatttttgtcgatctggtagtatagagtggatgtgggcagctggtggagtagagtgaaagttgggaatgtggagatttggtggatggaagggatctgcacccttcttttgtagacaagcttcacaacggctagtttcacaacggctagttttataacggctagttttacaacggctagtttgcttatagaatattttgcctctaactttactaatttgattcaatgttctttttttttttttgcagattcaagtgttaggccaatataaagtgtacaaccttaggctagagattcaaaaactacacaatagcacacaagattgactcaaggtaacattgggctgcattctcattcatcacaacaattagatgggtacaatataccaattagattggtacattacaataattagatgggtgcattgccaatacaacaaatacttccctacactacttctcaacaccataaatttcattagataagaagtctagcatcttttcatggcgtgctttttgtgactcactgtatgatgaggtgtcaatcattaagagttcattgaactgcttgattttttccatcttcactttctctttgtcagcttcagcctgaatagcaatggcttgagcatgttctcttgcatcagctgccattttttctattgcctcagattttttgatttacatattattgaattgtcccacactttcatctgataaccgacccttccccaacttccctttccccttccccttccgccgctcttttgctgccttctgcccttgtggtcgacaacgttcagcatcagttgcttcatcagtgtctctgtttgaagaagaagtgtaagctcctgatgaagacaccttatttctcttattcataatgtcaacagcaacgtctcgattaagccatttaggttcatccttcaccactctccaccaatactcaaatgcgaagggcttatctgtttccttcacttttttgtattcttcatgaaccaactccataagttgctaatcagaacgtccactttgatatgtcttgcttaactctgaccaacatccatgaaactttgcaacaagtgtgctgattgaattccaatggttcttgcactgcatagctgttcttttccttcctttaggggcatatgtgttgtattcttctgcgacttgcttccagtaatgaggtcccttctttgaattgccattgattgggtcattggagttgttcaaccaagcacttactagtcgcagattgtcttctttcgaccaatgcatcctcacacatttattttcctcgtctgaacatacatcgctccattcctcaattccatttggatctttgcttgtattctgtgcatgagctattggagaagtgaccggagaagctgagtcctcacatcttgatccactaccaccaccaactccaaacaaagccgcagaacccactggtgatgatggaccagtagccatactacccccatgaaagttgccatggacaggaatatcatgttgatagcttgaagctgggaattgctggtaacctggtggaaatccaaatggattgaaattttgtgggtagtactgtggttgaaagttggggctgaacttgtcggtgacatgggaccggaagtatcatgactagaggcttgggcaggagcaatcgcccacgaggcctgaccccctcgggggggtcgggcccgagggtgatgtagccgcccccctctttgtcccccaaggggtcggaccgctcccgtttcggccccgagggctggggcgccccgaccccttgtggattttgcgccgcgtgtatgggtt

SEQ ID NO: 92012 - DNA, 4075 bp, Oryza sativa
cgagggactccttgcgggactcagggtggcagctggactggggatccgccgcctcctggtgttaggcgactcccagctggtcgttaaccaggtctgtaaggagtaccggtgctctgacccgcagatggacgcttacgtgcgccaagtacggcgtatggagcgccattttgacgggatagagcttcggcacgtgcccagacgggataacacggttgccgacgaactctcacggctcgcttcctcgcgagcccagaccccaccgggcgcctttgaagaaaggcttgcccagccgtcggcgcgacccgaccccttaggggagacggacgcgcctggcaggcccccgatgcccgtcggagtccaggcctcgggacccgaggggagcgctcccagctcccttagattgattgcttggatcgctgagatccaagcatacctcacagataagactctacccgaggaccgcgaagggagtgaacgcgtccagcgcatctccaaacgctacgtgctggtagaagggaccctctatcggcgcgcggctaacggaatcctcctgaagtgcattcctcgggaacaaggcgtcgagcttcttgccgatatccatgaaggcgaatgcggagcccactccgcctcgcgcaccttggttggcaaagcctttcgacaaggtttctattggccgacagctctcaatgatgcggtcgacctggtccggcgatgcagagcgtgtcaattccacgccaagcaaatccatcagccgacccaggccctgcagatcataccactttcatggccatttgctgtctgggggctcgatatcctgggaccgtttaggcgggccccgggcgggtttgagtatctatatgtcgcgatcgacaagttcactaagtggcccgaggcttatccggtcgtcaagatcgataagcactccacacttaaattcattaagggcatcacagcccggtttggagtgcctaaccgtattattacggataacggcacccaattcactagtgaacttttcggcgattactgcgaagacgtgggcatcaagctctgcttcgcctcacctgcccaccccagaagcaacggccaagtggagcgcgccaatgcggaaatcctcagaggccttaaaaccaagaccttcaacatcctcaagaagcacggcgattcgtggatcgaggagttgccagcggtgctctgggcgaaccgaaccacgccaagccgagcaaccggggaaacgcctttcttcctcgtctacggcgcggaagcggttcgcccatccgagctcaccctgaggtcccctcgggccaccatgtactgcgaggctgatcaagatcagcttcgcagagatgacctcgactacttggaagagcgaaggcggcgcgcggccctccgagccgcgcgctaccagtagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctaaagggggatcgggtgtcaggtttcgggctcgggccaaccccgcacccccctcgggcgtgcagggttggccgggggctaccacatatgcatattcttatttctcttatatctgtatttcaataaaagcattttcgatttcctaaaggctgtatctgtgctgttgtttccttttgaaggatcttgacttgaaataggtcactcgtgttcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgctcccggcctggccagtctcgacatgtggatctccccaggcactagccccgacccgagccatttgaggactaggacctgggcacgagcccttgttcaagccaagacacaaaaggatcgcggcacaggcatcctcgtctcatacacacaacaaatagaattgacacaaaaaatttcctctttatttgattgcagattaaattagtctatacaagaagggggcccgaaggcctcggaagaagaaaagaagaaactatttaaagattggcgggggcctggtggcttactccgatgcacccgggtcgccagcctcgtcgccactgtcgcccactccgccgtcatcgtcctcctcgtcggagttgagggcgaacgcgagccgaggggccgaaccctcgaagctgtggacgatatggtcggcggcgtcccggacctgcgcgcgcgcgccatcctcggtcccgggagggaactcgtccagcgccgtccatggggagaagtcgggatccctggcttggtaactcgccagtacgagctccaccgctcctcgggcgaggtccctcgaggatgacttaatcgtcctctcgagctcctcggggagccgttggagagtcccggctatctccgagaggcgctgggcgaggccccctggttggcggcgtacttcgcagtccgcccgccccagaggcccgcctgccggccggcacggtctagacgggagacggcgtcccgaagcatgccgggccctacctcgcctgccaagcggagggcctcaacctccccggcggacgagtctagcgcgccctacaaatcggcgatggtgtgttcggcagctgcgaggcgggcggttaagtcgctttcgcccgcggccgccccgccgctgcgcgccctcgcgtccagctccttctcccgcgcctcgagctcagcggcccgctggttcagcgcggccctctcggcgcgggcaccttccagattacggcgcgcttgttcctcttgcgcagcctcgcggaggacaggctgtccgccagccgttgcgccgcggcctcggcctcctcgagagctcgctcccgctcggtgagcgcgtcctcgcggaggcggagcgcggactcttcttcggcacaggcggcttcgtgcaccgccagtgtgacctcccgaatagcaacggcggcctcgcgatccgccaggtccctctccacggcgcaggcacgctcttccagcgccatggcacgggcctcaagggcttcttcgcgccgccgggatgccacctcggtctccgccgcccgccgttctcgggcagcggcagcgtcaaggaccccccgggcggcgtcgagctttttccctagctccgcctcccagctcccgtattgaaggcggagggtgtcctgcgcctcattcatcacagtggtggcgatgagggcagccccccgctcctcctccacctccttggcgatctcccccagcaccttccgacgggcttcgagctctgagacgtgccggcggtgtgccttgcggcccacctccaccatggcctccaccgagcgacgcccctcttcgacacgtgcccatgcggcgtcgagctccacccgctctgcttgcaaggcctccatctgggcacttaacccgtccaacaccgtggtgttagcgacggccaaggcctgcagaagaggttctgcgctcagtggagcaacggaaggcgtggggaagagccgcctcgaagaggatgccgcgcggcttggcccgccgatggacgtgccggactcggggatgtcccccggacctggtttgtcctgagcgtcgcacgagggagtgagcccaagtgatgcgcccgcggcctcgtcgcgagctgcttcggaagtcgtcgtcgcctcggcctggcgaagtctggcctcctcccgagcggcttcttcagcttggcgagctcggacggccacctgggcggcctcctcggcttcccgtaggcgatccgcggcttctcgccggtcagattcccgcctccgagcctctgtggtcgccgggtcctcggcctcagactggccggacttggaatggcgggagggacgcaacgggatctcgctgaaacagaagaaagacc

SEQ ID NO: 92013 - DNA, 735 bp, Oryza sativa
ccggggaagaagagagggagacacaaggatgggggcggcgcagagctcctcgtagactcctcgtgctcgccggcctcctgggcacgttcggcggaagaacgagcgacgacggcagcgagcagccaggcggcagggggcggcaagggtgctgtgggtggaaacgggagggaacgagagggaggttgagacggtgagggggctcgggttttatagcggaagcgaggtcggttcgaggcgggagcgagcggcaaaggcggttcgtgggcgacgtggagacggcgacggcgtggatgcaagggacgatggaggcggtggatcggacggcgaaaaatcgggtcacgagcacgggtggggcaatatggctcggtcaaggtgggggcactggcgcggcgggacgtcgtcggtgtcctctgcctccgcgcgcaagaagacaaggacgggagagagagaggccgggcttagaagggaaaaagggagggacaacggtgaaaagggaagcctctcccttccgttttgggcggcgggcaggcaaggcgcgtgggagcggcgtccttgccgttcggctatgcgcgagcgcgcgggaaacggcgacaattttggggcggcgtcagcgggaagcgacgccgagagagagagaaaggagacggcgctgtctctcgctcccgaacaggtgcgacgcacgcgcgagagagaggcggaccggggaagggagaaacggcccagcgaccaagaggg

SEQ ID NO: 92014 - DNA, 690 bp, Oryza sativa
attcatagaatcaccagtagatgaggcagacagtgataaatcaaaatccagtgcaaaataggcaccattgagctatgcatattagaacggccaaccaaaagtgtctcgcttaaatgaagaatgaataaggttgacagttacagacatatcctcaggtgaaattatgtaccttcaagcattctatgacaagaacctcacaccaggagaagagatgccaaaatttctcccattgttttctcaggtacatcagtgctatcttctaactctgctccggactggagaattgcagcatctaatactaactttctccttgctatctcatatatgttttcatcaaccgaaccctttgtcactagcctgaaagaaaatgaaatcatcactgttaccatgttgtagagttcaatatttatgaatttatcatcaccacgtcgatatgaatatggtgatatgctcacaatctgaatcacaaaaaacataagtaaccgataaaatatccaaatgaacataattagacatagcacatattacctatagatagtgacaggtttctgttgtccaatgcgatggcagcgatcttcagcttgccgatccatctgggggttgaaatccatgtcatgtattatcactgtatcagctcctattaaattcagaccctggcctccagctcttgtggaaagcaaacatgcaaat

SEQ ID NO: 92015 - DNA, 685 bp, Oryza sativa
gtttgtcagtgaactgggaatacgcccatgaaagaagttgacaggcaattcaaatatctcaagattgggcagagcgctaccgagattggatggaacctctccacttagatgattaaggccaaggctaaggttaatgagagtagaaagattcaagaggacttgtggaaagctacctgacagttgattagaacccacataaagagtctgaaggttgggtaacttcgcaaactcattcggaatgttcccttctatgtgattatacacgcaactaagcacattcagtgaggtgatgttggcaagagaagcagggattgtacctgtcagattattgattgaaagttgcagctgttgaagattaggaggccaatctgcaggaaactgcccagttaggttgttcctgtgcacccacagaaccttgagctctgagcagtttgcaaagcttggtatgcttccttgcagtgtgttgccactcaagtaaagatactggaggcgacgcaaatgtccaagggaaggagggatttctccagagagtgcatttttgagcagtgcaagatacttcaggaatgttaggttccaagtgaaggagagatgtgccctactagagctcggtttgtaagattaagggaggtgacacgacctggattcttcagactgcatgagacaccttcccagctgcagtagttgg

SEQ ID NO: 92016 - DNA, 2040 bp, Oryza sativa
gtcatattatcatccaaaagaatattggtgggcttgatatcacaatggataattgtcccttgatggttgtggtgtaggtaagccaatgcatcagaaacattgaccacaatgcttaacctttgagctagtgaaatatagcacagatctgaagatgtttcgtcgtgtggagttgagtacaacaatttatgcaagtctcctcgtggcatgaattcatataccagtgctttgaagtcatttccacttgaatcaatgcttgagcacgccgtcaagacaggaaccagattgcgatgccgcacatttctcaaagcattacactctgcaatgaagctcttttgtgctccctttgtctctagactgaagactttgatagcaactacatttatgtcttgaaataactgtccttggtatacagaaccatatcttccttcgccaatcaaattggatgttgagaacccattagttgctctggcaagatctttataagaaactttgggaaattctctaccaaatgagggcaaagatatcgagtttgtcctttgttttcccttccaaatcaaatacaggaccaatatcactacggcaagtgtcaccatgctagctaatgggatcactactttcagtagtactggtagcttgcctttagttgtatttgaaggtgtgataggacattcaggtaagtgtaactccagtgcacctccacaaagagccaaatttccatcaatttgcatggaagttgaattcttgaagattcctttagttgggacctgacctgtaagatggttgaatgacaaatctatctgttcaaggagttgaaggtcaccaagtgacactggtattgatccacttaacttattgtgtgacaggttgagaaattttaggctaattaatttgccgaacgaggtgggaatacctccactaaaattattttggtcaagctcaacatgttgcaaattttcacagttactcaaagtattaggtatatctcctgacagattattggatgaaagctgcaaatatatgagctgcttggcattccctatttctgtaggaagttctccactgagattgtttaatgcaaacccaacttccgctattgttggaatcctgaagatctcctttggcacaccaccatgaagattgttatcagtaatggtgattgttgttaggaactgaaggtttccaaagcttaaggtatgtttccaatgaactgatttgtgtctagaagaatctctgtcaagtgtgacagattggaaagggaggagggaagataccctgtaaaactgttggtagacaagcttagtttctgcaatgtcttcagacctcctagccattgtggtacagaacctgaaaatcggttgtaatctagtccaagaattatcaggttgggaagatttgcaatgcctgaaggaaaactccctgacaattgattctgtcccaagaaaagatactgtagctgaactgaaaaattgcctaatgaacctggtacctctccttccatttgattcctcgctatagagattccttgtagctgagtacaattggctacgctatccatgaactcccagtcttgcttgctacgagcatggagctggttcatctcaagatttaaccttgtaagattggcaagcttgccaatggaggcaggtacaaccccagtaaagttattttcagatatatcaatcttgaccagattggaagcattcgccaacgaagaagggatgtctccatgaaagaagttgatgccaatggcaatctgcctaagattgggcagcaagctaccgatgcccgatggcagctcaccactgaagctgttcgtgctgaggctaagcgcaaccagcaccgacatgttcaggatcgcctctggaaacccacctaacagccggttgctgctggcgtagaggatctccaccccacttagcgtcgctagctcaccggggatgctgccggtgatgccattgaacgcgaagctgagcttcctcagcgccgtgatgttgctgagcgagggagggattgtcccgacaagtctgttcgacgagagct

SEQ ID NO: 92017 - DNA, 2050 bp, Oryza sativa
agctcatcaccaccagggagagcgagagcagcaagctggaggaggtcaagctcctcgtgctccgctccggcgagtggagcgtcacgcgggcggagatcatccacgacggcagcaagggcgaggagctctcctactgggagaccgacatggccgtccccgtcggcgaccggcggctctgctgggtcgacctgtaccgcggcgtcatcctctgcggcgacgacctgttcgacgaaattcccccgcggctgcagtacgtgccgctccccgtggaggcccccgccggcgaattcgaggaggacagcgacgacgagagcacgcggagatgcctgatggcgagctcaagttcatcgacgtcttcccccgctgctgctgcggcgaccccggcgccaccctctgcgaccattctcgccacgccttcgtcatcaacatctggacactcaggatcgacggcgacggcgaccacaccatgttgtcatggaccatggacgccatgatcgacgccaccgagctctggtccctcgacgcctacgccggcatcccacgtgtcatcccggagtaccctgtcatcagcacagacgacgctgacgtcatctgcttcctcgtgaccgagccatacaatcacaaacaggggaaaccctatttcgaaagaacgacatgggagatgacgatggacaccaagaacaagacactgctatcagtatgcacatacgatgatgatatttcccaacgagagccatcttatggacacacttacattccaaacaattttgctacaaagccaccaccggccatcatctgcgaggcaacgacgacgatcacaaccgaaatcaacggtaataatctgtcgcaatctttgccatctgccaaacatctgcaggtgtcaaggatggctcctgaggagatattggtagcacttgaagagattcctgagctttctcgcgatgatttgctgaaagcgtatagtattctttgccgtgacaatggccgcctatttaggtctcttcttgggctcccaatgagtctgaggaagaagtggctgttgatagaaattaaggcttgtcgagattgtcccgtctgcagtgcatgtacaactgatggcctataacatgattgattaaaatatttgttatagtggtacttgtatacacttgtgggattaactgtgctaattctgctgaattaagttccttatttgttgtttttattacactttgaaaagaccgatgccaatatttattacgaacttggggttgtcaaggtagaaaaaaactgactgtttattttttttactaactgcttagatataaagtgacctaatattaaggtagaaaaaacatagtgcccgaaaattccattcaaataactattaatcaaagttcagactaaaaaaaaatagtgcagtgacaacatataaatatataattgtcccatgtcccatataggtcatttcaagaaacaaaaatccaatttatcaagatttgcatgatgatacaccgtaatttgcagtcttacatgcatgtatataactagcaaacatacgcccgtgcgttgtaacgggatatctaaattatatataagtattatccaagcgatcagctgaggtaaagcatcaattattgcaggccgtagatacatgttttttttaaaaaaaagaataactctttttttaacagtccatgcatacatttttgtttgccaaatatattaattttctgtaacagtacattaacaatatgaggcaaaacaatcatcagtctaattgtgtaacttaattactggacgaactgatacttcgagatcgtataccggacatatatatgaatctgctccattagaattcagaagagaatctgctggtgacaaacagccctccgaagtccgaacaagggatgcacatcaaacgacaaacgaatccaaagctgccagcacgtcgtaggaaacacttaattagctcgtaatagaaggttgttcaataacagccaataaaattctgaaacgcaacaagtagcatatagaggactctgaccaaaagcaacacaattacttgttt

SEQ ID NO: 92018 - DNA, 5897 bp, Oryza sativa
ccaccctgtgcaaccattctagcaacgccttcgtcatcaacacatggacgctaaggatgaacgacgacgacgacggcatggagtggaccatggacgccattgtcgacgccaccaagctctggtccctcgacgcctacgccagcatcccacgtatcaccccagagcacctatcgtcggcatagacgactctgacgtcatctgcttttctacgtcaacgtgacgatatggaagatcatgatgaacacgaaggacaagacattgctgtcagtatgccgatatgataatgatgtttaccaacaaaagccatcttatggacacacttacattccttgcaagatctccactttatacacaaaccatagtagcaacaatggtgttacaaagccaccagtaggtcgtcagcaagccatcaacaattacaactgaaatcaacggtaatcagtcgcaatttttgtcaccggagtcatctgccaaacatctgcaggtgtcaaggatagcttctcccgaggagatcttggtggcgctcgaagcgattcccgatcatgcttgtgatgatttgctgaaagcgtatatcattctttgccgtgacaatggccgcctatttaggtctcttctcgggctcccaatgggtctaaggaagaaatggttgatgatagaaatcaaggcttatcaaaacatttactctacatgtacaagtacaacaaatgacttacatcatgattgattgaaatatttgatttaaattaactgttggatgcgttggttctgctgaactgtgttccttcactactacaatatcgatttttcattacgtcaacattttttttggcggccacacacgatcaccgccagcgaaaatactccaacggtataggtgggaaaccgtccgctagtctccccgtattgctttacaatctccacacaacgcctatcacctaatagttcttttagcattacactagctcattcatgagcaaggttttaaatctccaactatacctgctatctccccactatctccaggtacaaattgttcaagcaagaactagctatttgttgtcatatgcaatgtaattgctgttaatcaatacagcccactattaattgtatgagagactgatagctaaatgtcgtatcaatcgatttaaaatgctgctcgtgggctaccatattacagtactccttccgtcccaaaataaaccaacttttagtgtttgaaatttgtcctaaaataaaccagcttctaccttcctacctaccatcaatctgtaaatcgagaagctttatctcttcaatacccctcatatacccgctcatcaatataactttgctattaattagggccattttggtcctttgtctctcctcttatatccaccttgggaagctagggttggaatttttgtgggacaaagggagtacgtctcaaggcaacattttgtagtcattatcttggactatatacaaaaataatgtggaaaagttaaacgtgatggagccgcattatttctaggacgtgtctacaacgaggccgtgcgctggattgtcataaccagctatcccaatctcatacctagttgctactagtacacctaaaattgcatgcatttttttcttcttatagaattttctcttgaattacaccattacgttcgttgcaattaaatctttagaacaagatcttatgtgactatatttttataaaagaaatatctatgttgtaaattacttttattatatatgtataagttactttttgattttactaaattacttctcatacattcataatgttgtgagttgtttattttataatcatttttagttaataacataatttgtgctaattaaatttaatttctatatagactcatgtttttaccttcataatagatttacttttaatgtcgtgacaaagttactttctttttgttttaagttacttccataatatatgtaaattacttttaggctttattaaatttatttttatattcaaacatattattaatttaaaaataattcatttaaattgtaaaagtaagttagttatgcaatagaactctctataacattagaagtaagtatattatgactaagttgtagtgagagactgtggagtaaattcataagcagtgtagagaatattttcaagtaaatacatttgtgaaagtaagttcaataaaatctgaaagtaatttacataaatcataaaagtaacttagcataaaatagaagtaagttgttagtacaacattataagtaaatctgttgtagggataaaaatgtgagtctatctaaaaatttaatttaatcaggataaattatggaattgactaaaaacaataataaaggtaatcaactcggagcattacgaatatataagaagtaatttaatcaaatttgaatgtaatttatatatatgataaaagtaacttacatatataataaaaataatttacaaacataaatattttttcatcataatataatcatgtaagatcttgttacgaagatgcaatgagcacaaagatataatcggatcgtagatcaaataagtaatttaagacaatattttataagaagaaaaaaaacatgtatcacttaataacaaaaaaggaagatgtgtagtataacatctctcttttctctctctcctgctcctgctatgtgcatgtgggcctccctgtgataaaaagtagagaaagctacagactagtgaagaagatcgaatggttgtgagtcgtgtcgcgtgataggactaaaacgagagacttctcgatttaaatttcacgttattcctaatcaaactcatttcaggttttttttgttgagtccaaaacgaaacatgtctaggttttataactccgtggatctaccgtgttaattaaggacgaactgcacgcgatctgcgtgactaaccgatcgatcaatctgctcgccgcccatggaaacccaatcgacggcgacaccgtctcctggtgcttcgtcggcgaccggaggcggaggcggcggtgcctacccacggtgggtgatcctcgagcagcgagccgttcacgacgacaaagaggacgacgacggcgaggacgactcccgctgctccgccgccgacgtcaagatcaacaccgaggcagcctgccgctcctccgacggccatctcgtccgcgtctacttccgccgcctcgtggctccgccggcggcgtcgcgcgtatgcttccgctgctccccgccgtgcggcaccggcaccgggagagagagagagccagatgcgacaagccattcttgtgcgtcgtcgccgccgccggcgactccctcctcctccagatgacatacaatggtcagctcgatcgcttcgtctacagcgccgccgactcgccgacgttgacgctgctcccgacccacgcgcggcggcagcactggctggacgtgaaaaccaccggcctcctgcgtcgccgccgccgcgacggcgaactcgtggtggcggagctcaccgtgaagaagggcgacaccgacgacacaccggaggatgccgagctcgtcgtgctccgctctggcgagtggaccgtcacgcgggcgccgatcatccacgacgacggtaaggccgaggaggtgtcccgctggcgaaccgacatggtcgtccccgtgggcgacacgctcctctgctgggtcgacttatgccgtggcgtcatcctcctctccgcctccgacctgttcgacgaaagtcgtccccgccggctaaagtacacgtcactccccgtcgaggctcccgccaagaaattcgacgacgacgacggcggagagtacgcgatcaacccacgaggatacccggagagaaaccggagcgtctgcgtcaccggcggcggcgccgcgctgaagttcatcgacgtctcgccgcgctgctgctgcggcagcccaggcgccaccaccctctgccacaactctagcggcgcgttcgtcatcaagacatggacactcatgatgaacgacgacgacgacacgacgtcgacgacatgggcgatggacgccatggtcaacgccgccgagctctggtccctcgacgcctacgccggcccaccacgcctgagaccagtataccccattgttagcatggacaacccacacatcatttgcttcatggtttgcaaggaacactgggagtcatgcttccactgcgaaaggacaatatggaagatcatcttcgacatgaagagcaagaaactactctcaattcgctactacgatgagtcccagtgtcaaacttggggggtacattatggagatgattaccttcctagcatgatctctgattacttcaattctaatggcaaatatacaagtcataatgcgacaacaagcattaacgatctcatcgtcactaattatttaccgcagtcatctcacaaaggtttgaaggtggtgtcatcagaggtacaagtttctgatgaggagatctttgcggcgcttgaagagatacctgacttgggttgtgatgatttgctgaaggcatatagcattcttagtcatgacattggtcaacaccggtttagatctcttttgggcctcccaatgagtttgaggaagaaatggctattgatagaaatcaagagtagagaagctagttccatctgctctgcatgtgcagcaaacatgcaacatttacatgcttgaaactcttggtgtacaattggagtacttttgctggtggtagtagattaattgtgtgctgaacgtacggttgtattgtgtggaattgtaaattggagtactactacttttgacacttgacacttaacaacgtatattttggtattgaagttgcattcacaaaaccacactatcgacgaatgcatccacatgtgagataacgtaattttttatctacatatatttaggatgtggacgtggcatcgcaaatgtttcacttaggaagaagctcccaaatcaacattctaggaggaacaaccatatcatcttgcgggtggacctgctcattgatagtgtaattttctaaaacttcaatataaaatatactccctccagttttttttgtttgacgttgccgaccggttcgattaaattaaggaagctgtgaattgacttgtttgcccttcacccttatccctttgcactgatacgtttcgtctctgcaggggggagaggggaaatttgcggacgggaggagggcttctgaactgcgagcgtcaaacaaaaaaaaacaccttttgagtatgaactggaacgtcaaacaaaaaaaatagagtatgtagttaagtgtcaagtgtcaaaatgtgttgttttctgcaacttggaccataaaatatgtagctttgtgaaattattctttcatgtgacactaatttatatagttgctaataatataatatgaaatacattaatagttaaaggatatcgctaaagaccgtgtaaaaaggagaaaaaggacaatacgccattccatttggtgggtttcgacgaaataccacccaatacgatgcaaagcataaaatgccactcaataggttatctttaattaggatattttgccactttgagaggttttaaaaccaaccctggagagagaggaagagaggggagggggaggggagcaccggcgaacgttgaaggcggcagcgtccgttctcgtcgccgatgagtgctaagcgcgagcggtcagcacgtgtgggcggtgccggaggcggtgagcgcccgtaggcagcgtggaggcgagctgcgagcacacgcacgggcagcgttggagagccctccccgtcgtcgtcgtcgtcgcctcctcctccctcccgtcggcgttgccctcctcccacatcgccgtcgctgtcctccctgatcagcgccgtcgtcttcctcccccatcgcagtcgccgtcgggctgcaggaat

SEQ ID NO: 92019 - DNA, 1113 bp, Oryza sativa
tgttattattctggttcaggaatcaaattatccaaatattctgcatgcttttaaaatttaaaggtaataattaagcagaaaacttgattctctgtaagaatatttggataggcttgtgtagactattctgacagaaatgggcatggaacattttgtttgtacagtagagatttaatgttattgtttaatatggtaacacatggactgacgtgttactatgttactgttttttcctgtctagtatttgaaaagatggcctgcggttctttcttcactaaaacatgccattcattcttgcagggaatgagccaacttgagttggaagatgcagtccaagatgatttgaaggctgctactggtgaatttacaaaagatgcagatgacgcaaacagactgaatcgcattcttcaactaacagggttcagtgatcctgtgtatgctgaagcatatgtaactgttcaccactatgatattgtgcttgatgttacagtcataaaccgaacaaaggaaacacttcagaacttgtgcttggagttagcaacaatgggtgatctcaaacttgttgaccgcccccagaattacacgctggctcctgagtcaagcaagcaaattcgggccaacatcaaggtttcatcaacagagacgggagttatattcggtaacattgtttatgagacctcaaatgtaatggagcgatcagtggtggtcctaaacgatattcacattgacatcatggattatatctcacctgctacttgtgccgatgttgctttccggaacatgtgggcagaatttgagtgggaaaacaaggtagggttctttctcaagcttcagcttttgcaaatgcttgttttacaagattctttcatgtattatttgcagctgctagattttcttcttcactgtgatctttttgtctggctcctctttattaacatattcttttacttctgttattagcttgtgaacaccaaaattgtaattcactatttgtgttatgaagaggtaacattgtgggggactggtggtgggttacttctgttttattttggaatgactttgtctagtaattctgactagcggtttgtttatgctggttgttgtcgatttgtt

SEQ ID NO: 92020 - DNA, 728 bp, Oryza sativa
attcctgcagcccatccagacaggttgttgtaagacaagttgagaacttttagagtctttatgttttctagagatgcagggatgcttccactgaaaacgttgtggtccaactctatgtcttccaaactttcagagtcacccaaagtgctaggaatatatccagatatattatttgatgaaagctgaagatatgtgagttgttttgccttgccaatgtcattatggaggggtgcatctagattgttgaaagataagctaatttgcactatggttggaattctgaagatctcctttggtatgctaccatgaagattattgttcgagacaatcaatacttgaaggattgggagggttccaaagcttggtggtaattggccaactaactggtttgagtctaaatatagttctcccaattgagacagatttgagaaagatgatgggatggctccagtaaagaaattgctacccaaagataccttttgcaaagttttgatggttccaagccattctggaagcacacctgtaaatagattagcacccaacgccacaataatcaggttctgaaggtttgctatacctgaaggaaaatcacctgaaagtttactttctgccaagtgtagctcctggagttgatcagaaaggttacccaacgaactaggcacatgcccttgtagacggttcccagtcatggagaaaacttgtagctcagtgcagttgcccaagctttg

SEQ ID NO: 92021 - DNA, 695 bp, Oryza sativa
tacgaggactgccccaactgcagtatggacaccatgatcagcaaggccccagtagaagccttgtttgcttcagcctttgatggctggacctcctccagcctcagcacaagcttggtgagggtacaggcaacaacagcagctaaaaagaaatcaccagacagaatgagagatctgagattctgtgtggaactcagtgaccctggagcaacagctggagacgaaatggcagtctctgtggcagcactctgtgtggcataagtaccatctgcaagaacaacaggcctcctagaagatactgtgacagagttcaccacaggctgggctggctttgacgcatcagttgattctccttcctcagagacagtgtagaatggcagatcaccaaggcactgcttgatggtggaaatggcactctcaacctcagatagtgaaagggagtactccccaaggatccagagagcacatgagcagacacgggatgcacggatctgataaaatgtatcaatcagcctctgaatcattgacacacggagcttggggttggtctcaatgatctcgcgcacaaacaaaacaacatcaaccgctgcagcaacattagtgtcaccaaggaagtccatgaggaggtggaccaccgatccagccacctctgggtactcgacagcgcaggaatggatcgcctgcaccagcatctgccg

SEQ ID NO: 92022 - DNA, 803 bp, Oryza sativa
gttggctatactatttttcagtctgatcgccttcacaaagttctggagtatgtgaatgaagtgcattgtttgtgtggagtccttggaattgattttgggaagactgtaaatgggattcatcccagtttacatcagaatggtcttgagcaatccacaaacatcagcaacagcacactggaaggccttgctaatacaatatcaaatctaaaagcagaacagagatctagaatcgataaggtaatctcaaggctcttttcttcatggttttgtgctagttgttaattattcataacatattgtccaacgacaattccttatagatgagagagacaatggaatcattgtgtaaactctggaagttaatggactcccctcaagaagagagaagacaatttaacagagtacttagtgttctcatatcatcggaagaggaaatcttatcccccggggttctctcacaggaaacaattgaaaaggttttttaccagtttgccttgttctaatttctactttgtttacagctaaccttcatccttttaacagcttcatatttaaattatcatgcagatgggtgctgaggttgagaggttaacaaaacttaaagctagaagattgaaagaaattttcatgaagaaaaggtcagagttagaagagatatgcagatctgcacacatagaacctgatgccagtacagcccctgagcaaactaatgaaatgattgactctggtactatgctatgtatcttgctgctgctaagttcacttgttactattgtatataagttgtaattatcttgtgcatg

SEQ ID NO: 92023 - DNA, 5948 bp, Oryza sativa
caggaatatttaggatgcaaaaacttgtgcagaaatataccatcattgtcacacttccgttgcgtgaaaatgacgtggggattacgtcgcgggcagtatcgcgcggtgaaagcatgagaccgcacggtctcgcgcgacaacggcgcgagaccgtgcggtctcgcggaaagaaagagcgagaccgaacggtctcgcagaagcaattagcgacactgtcaaatgggatccatttgattagtaattaattacttaattaacaattaactaataataactagtgattaattatcatgattagtgattaactaattgttatttaatctctaatcaggataattaaccactaattaaatcggcaagacatggtatcgctctctgcttgagcgatagcgttggttgcttgttcggtatcgctgtttccttgagcgagaccgcgtggtctcgtgctggaaccacgcaagaccgcgcggtctcgcactttcactgcgcgataccggtcgcgacgtcatcttcatgtcattttcgcgcaatggtcgtgcgagaccgatggtatatttgtgcaaaagattttgcatcccgaatatttctaacaaaaaattgaatgaatagtatattttcaaatttaattctgctcccgtcactgcttggttatatggagggaaaaattggcgcgacacaatagacgagggaaaaaaaggcgccctttcggctgttgctctgagctagacgatgcagacgatgaaccaaggcgcagcgacgatgcagatgatgcactccgatagtgagtaagtttcaattggttgcctctcttctactgtatcccacttgaatgccttgttataattgatcaacctcttgttattaggtttcctttgatcaagctttcttcttttcacatggaagaaatatctaagtgaagatacatttaaatctctgctgtcaaaattgtgagatggaagaagaaaggtatgtcaaacaacttcatgcttatctttgcaatttttttcagtcatcttgtgtatgcgctttgcaaattcttttcactatgtgtgtacacaagtcatatacttgatgatgatgtttttctatatagagagaggctactgccatgtatggtcccccatgttggtatggaattcaaatgttcagatgaggctgggatgttttggcatagatatggaggtcaaaaaggctttgaggttagaaaaaggtacacaaagaaaatcagatggtgaagtaacatcatataggtttgtttgtggaaatgagggtcatcgaggaaatgacaaaagggatcatctaacaaagtgtcctcgagctgaaaccaaaactaattgtcaagttcgtatgagtgtagcaatggacaaaaagaagggaaactataaagtgtctgagttggttcttgaacacaatcaccccttgcacttgcatgaaaccttgcacttgatggcctcgtaaaggaaaatttcagatttacaagcttttgaaattgaaacagcaaacgattctggaattgggccaaagacggcatatgagttggctagtcgacaagttggtggatcacataatctaagctacaacattcgtgatcacaagaactatttgcggagcaagcgccaaagggagatggcatatggtcaagaaggtagaactatttgagaactcaaggatggatgcttgctttcgctataaattcctctcccacaaatttctcaacttggcacaacaagctgctagctatccagagtgcaccttgttagtaaacaatgcccttgacaaccttagcaagcaaattgaagagcaactcagtggatgtgctagtatctcggatccaagtataactcacacggaggttacgcccccaaacaatttgttgagtaatgcacacctaaagaaaaaggatcggaggttcgtgttagaagttcaaagcgaacaagaaattggcttgataaaaagcgtaggactaggaccagacaacaagggaaagggaaaaagggaaaaagttcgaaggtatgttatacaaaaagttccaacactatgttactattcagtactatgttttatggatcctctgatactcttttcttgaaaggaacaaaataatgggggagatgcggaccatgttggtgcaatggcacaaatggtagaggatagtgtttccagggaccaggagaagcttggagaatacagtttcttttaatttgcaggggcctattaatgatgatatttttactgaagtaccattttgggaataaagttgtgctgtggagaataacccaagtttagctgcacttagtacaagtctgatgaagttggggcaaaaatttcaggaaaaacttattttgtgtttactgttgattttattttggttagatcctggtgaaggattccaggtatgcaagaaagagtgccaagattaaggtagtatgcatgttctttttgccttttttcaccctttgggacaatctgtatacatgttaagcctcactctcacatgttcaattcagcaacaccagcacattctactgtcagcaacaacaactgtctcaaatatttggcttaattcaatttacaatcacaatccatatcaatttatattctcctctcagcttctcgagcagttgctgtaagcctccttcagaaggcagaggtgatgatattagcctcctctagaaaatgcagcagccagtgccttcctcctgtcgtggtgtggcccatgatagtgctctgctgaggatgtggccgaagagttcgacgagggcgccgcctccgccgccgtcgtcgtcgaggcacgccggtagcagggtgactctcgtgcaggggaggccgcgggcaagagatggggatgagggtggtgggctggtggtggagaggcttccctagatctatggtcgagctgaacccgcgccgagggaggcggcgagcttgcgagcagaagcgagcagccggcggccatggagcaaggcgagaaaggagaggaggaaggtcgcatcgtcggtctttgattgttgactgtgcttctgtgggccggattttgttgtcatgggccgtgtgagccagttcattttttcacactcactgattgccgtctgatgcagatcgtgcgctccatcttgctgctacttccctctgacgtaacttcgactacgtcagacgatccgaatccctttgcttgtgttggagttggtcattgttgtggttatactcgtctgctcacatttttacagtgttcaacgatgtggattatctttgttctttcctgataggtctatttttctcgaacgctttcctgataggtctaatatttttttttccaaaacaaggttgtaatcagctcttatatttaatcaggcttgtttcggaaaaaaaagattaggtcaatttggaaccaagatggctgcaaacctgcaaattacacatgaagggtgtgtttagttttttgtgtaaagtttttgaagtatacggacgtatatttgaagtattaaacgtagactaataacaaaataaattacagattccgtctataaactgcgagacgaatttattaagcctaattaatccgtcattagcaaatatttactgtagcatcacattgtcaaattatagcgtaattaggctcaaaagattcgtctcgcaatttatatggaaactgtgtaattggttttttccccacatttagctaaaaacatttgatgtgatatttttagttaaacttttttggatctaaacaaggccgaagtgaacatggcacaaaccctccaagtatatgtctggcacatatatagactcccaaatcatatctagcataaacttcagattgttttttaggcaaccacagaaattttcttggcttcaaacccaacccctaatttcacgctcaaatcatacatttacacacacaataaataaataaataaataaataaataaataacaagggaatagaatccagtggactgaaactcgtcactttcacgaacaagtctttagtggcaagataaaattgcatccagtgccagtgaagtcctcggaaacacattagactgagacctcttgatttctaaaattccaatggatcatgccagctgatgtgctccagtaaaaagcttgctggaaaagacaggaaatactgcaggctgctgctttcggcgagctgctttggataagaaaacgcattgctatcgttggcactgttacgactcggtctgtggttctgacttccgatcatatccacaaatccacaattactccagtttgttttgtcaacagacaacagcataaagcatagatttctatttgaaggaaaacacgttgaggcaaaatatctagattacgaagtagttttatttcccagagaaaagcatccctcctaaaagaccacaaacgatgtttttcttcaactaaaatgtactgtaataacaccaaaggagcattctgaaaattgtcccgcccaaattgtacagttgacacgagtgaagcattagtgttactcagatttacagtctggctaatcaactctaacatcatttccggaattatcagaatcacaactcgtcatttactggagagttgtcggccatcagctcctcaagggagaattcgtcctcttcaataacctcaccatctttgccgtcccatggttcagattggactatcgttggggtaccgtccaaaggaagattacccttcccaccgcgccctgcttccttcacaaactcactgcaggagaccggttttgttatcaaacatctggcaaatgaaccttaagcagcaattaattttctatgcacaaggaacttacgttatttcatcaagctggaaagcactacggagtggagcatatgcgccttttttcacgttgagagcaaccatcgctggatagccataaccaccaactccaacttgcttctcaagatcagcttgcttcccagcagctgtccagacaaaactgcaagacaatgctttttctagctcagaatggctttctcaagaaacggaagagatttcaaggcattaactaagtgaatggatttgtctgaggaaacttctcaacatagaactcagtcacatggcagatttgcatatataatatataaaatctccattatgtttagagcttatagtatacacgccttggcatataacattatcgaactaagtcatttaattcttttaaggtgtttcaaatatatgaaggttactatcaatctttttgtcaatcaatattcaatagcaaaaggaaattaatgtatcaatttaactgtggatttttttatctcaaaagacataacaagacaaggaatgataggtagaatggtataaagtccacaacaagtttagttgaatcttgcctgtatggactctttttaaatttctcagcaacagataatagcagctcaaggtacttgtttcttccttcggcctttgaatccaagatatctggaaggaaagatacaaagcaaatggcagcagaagcacatttctcttccatggcgtcctacagaagccaaaccacctcgtcaaaacatcaatcccagaccattgtctccacaaaaggataactttgttaatatcacgaaaacttactgggccagtcaactcagaaacttcaggtggagcagcattggcttccaactgctccaatgcaaaggactcgatagcagaggcaactctagccccctggtaagggaatgggctctccttatcggcaccaaataccaaaatagtaggaaagccttctaccttgtacttgctcatcaaagactgcaaaattcaagtcacacgttatgttacataagtggtacttgaaaactaggttgtatagtttgacaaatgttgtacagaacgcacatgaatgctttaaaaaggtcaaacattaactgtgttttataaatatactgatacactgcctgaattttctgcctaagttcatttaaactcactcggtaa

SEQ ID NO: 92024 - DNA, 6972 bp, Oryza sativa
atcgccgatccggcttcaccgatggcgcctcgtggacggatctggtggcgacgacgatgttggtggctttcccggtgatgtttttgttcttcttcatgttctttttctcaatcggttgattgtccgattggattttgttcagtaatgaatcgggtgcgaatttatgggtgctttattgggtttctttcttcttttttttgcaatttttttcatcgctaacaaaatcgaattgggatagaacggacggacgaaaagagaggtgacgaacgaaaaattacgaatctttaattagttataagatatatactataatatttccaaattacaattgtaaaaatgatgaatcgttcttgatcaaagaaaaaaaaggaaaaaaagccttgtctgcaatacgagtgcctgactgcctgtttctgttttttttaaaaaaaacgcccagagcggtggacctgagcggagtgagagaacggcgcacggctcccagagcgagggcgcatctcgatccttccacccagctagaaggaggggaaacggcggcggcggcccagtggcggctcggcggatccctggagcagcagccggtcgacggctcccggtagcaaggcggcgtggaggtccggcaaggagcagcgctcgccctccctctcctgtgtgatttgttttgtactataatttgttgatttcctatgatctatttttttggtaatttagacccatgccattataattttgcaaagtttaagatatgtcatcgatatctcaatgacatgtaggacccacgtcattgaaggacccacatgagtcctaatggcatatcttaaattttacaaaattataatagcatggttccaattttcggtattttagatttcagatgattttgtgatgattccgatttggattagtattttgtttttggtttggattatggtggtttgggatttggagagggggcacgcgtgatgtggctgacaaatgaagaggattttttttatcgtccttttttacgggttttttttgtccgcgccattgattgaatcgaactttcttttttttcgctcgcgattgggattcgggggcgggggttgctggtgcgcaccaacgattggaaaaatatgaatcttttaattagttaagttataagatagattagattggaattggtgtgagtatgtgcttgtagatggacctagaatactgaaatcacagtttgggcttgtattgtaattctatatggaccgaaccaaaacagaatcgggtggatgaatcggatcggatgagtttagcgtgattaatgacggacgaaaatctgtgattactgcgatgtgatgaccggaaaaatccaaatatttatattagttatagataagaaagggacagggtaggtcggtatagaaccgcgttttttcgcagatcgaacatctccacgagaccacgacgaagattattaattaattagattaaagaagccttgccggccgctctgtcatagtatgtgccggctggcttcgcctcacactcacaatctcttcgttcttattgagtattcaacggaattacgaaccgcaaatcgctttaaagctaaaaaatgtggctaaacatgtcggcatagtcatattatatatgtgccccggcgccggcgcctcatctgccgctagccgacgtgttgttcagattggcgttgccctccgttacagctggatatgaaatacaaatagaaatgatagagcacaatatacctctgcatagttagtatgcgctcactcccgtgcaagagctaagcctttgctcactgcgcctgaaatccgagccacacgcaaggttagtttgcacgatcccctccctcgtccacctcggataaaaacccccctcttgtcgcgagcatgcttatcatgaaaccatgggcgaatagtgcccaactatggtaaacttgtatatataggggattggccgatgtataaggatatgtacgtacgaaggtaaaaaaataaggacaaatgagatatgagttttcatatacgtacagtttgtataatacaaaatttatatatatgtgtgtgtgtacacacacacacagacacacaaacacacacacatatacgtagagacaagagggggcgggactgatcgtgtccgcgcggatcagcggccccgactttgtgcatgcaagcgcaagcgcgagcgcggcgcctttcgagctccactctcggcgtctcgccgcctagtcgccgaaacgccgatgctacctgcgcgcgtggcggcgtgggcgtggccgcatggataagccgggaatgcgtcctcgcctgtgctcccgactgccgctcgatgcgggaatccttccgtttcggcaggtggttgttgagtttgcggctccgcgctgggccgcgtgggcactcttgccgactgcatgcctgcatggagcccttcagtttctcccgagggccatatacggaaggaataagtttattttgtgaccctcaaaagtgatcgaaatctaatccgtgaccttaaaccataaaaccggatatcttgaccccaaaactcctaaaaccgtgcaatttgactccctaggcggttttggaggacggtttcgctgacgtggcgccacgtggcacctacgtggcgatattaaccaagtcttcgttacacgtggcgttgacgtggctcttacatggcaataaaattaaaaagtatacgtgggacccattagtcattcacaaaaaagaaatgtgggccaactgacatgtgggccttcttcctccctctctcccttctctctttctctcccctttagacggcgggcgggatggcagagagagcgagcggcagtgggcggtgacggcgaggccggagctgcggaggtgggcggggagggcaccaacgccggggagcgccggcgtcggcattcggcgatctggagcccgccacaacgacggggagcggcagcgtcggcatccggcggtggggacgacgtccggcgtcggcatacgtctccgccgcttcctttttctttgccgccgccgccgctccggtggagccgctcctagccagccatcctcccttgccatgctccgttggagccgatgcggttgccgcgatgccgcaagcccacaaccccttttcccgctgtggcacggagagggaggcggtagggcagagcaaggagaggcggcatcagcgaccggtggagctcgctgtggcttccatctcggtgatctacggatctgctgccgcgaggaagtggtgaggtcgaagctcgagcgggcaagaaatgaggttggagatcgagctcccatccggcgacgggaggcagcgagatagggagagagaccacctccgccacggcaagagatggcatgcatctcgcctcccagagcacaagctgcgcaagagagggagctcgtcggattgggcatgagcaggtgagctcgacggtcgccgcggccaatatctcacgtcagcgcccaccacaacgacgtccacgatggccgcgcacacccagctcacgtgctccgagtggctcgaatctgagtgcgccggcgggtccccctcttcctgctcctcctccacctcgtcgtcgttgggaaagcgcaccgccggccacctcacgtgccagtggtggaggttggcaccggcagcggcgcctcggcatctctctcgtcggcgccgagaagagctgaaagagagagagagagagaggaggaggaggagacgggcgagcgtcgccattgccagggtgtcctgaaggcgaaggggcgagccgacctcgccgtcgccgccactcccctcgtcctcccgtcgccattgccaacgagaagagagagaatataggagggtgtcactagcaggtgggccccactttatttttttaatttatttgatgactgggatgccatgtaggcgccacgtcagcgaaaccgccctccaaaaccgtcgagggagtcaaattgcaccggttttaagagttggggggtcaagatatccggttttgtggtttagggttgcgaattaaatttcgatgaacttattcctatacggaacgtgatgggctggactgcggttggagtaggccggatggcagagatgtgggctgttcagcctctttagtctagagccctattgcctacatgggccgtaaatagttaaccaaccgagttggagtttaaactgggttgtcaaatataatgttcaaactagaacttctatcagaacgaaatgccagtcagaataaaatcatgaagacctttttaatcgttcaccgtaggggcgcagtgatttctgtattcgaatttattgattacaaagaacagggactcttgtcacgaatcaggaattaggcaattggcatgtacaaagactgatttctcgtcccaattctctgtttctcctcttacaccgcaagcaacgaatcaaccaaaccattaataatcggagatattaaagaccaccgcagaatgctcgcaccatagcgattctgcggttttttggctggcgtgtacgcttctggtggtatccacatcggcccgtgttggaactggtcatcttgcaaaaaagtcctcgattaacttgataattactcttacgtccctcaccctatgctcctgtgttttgtagtctttcgtaacagccctcaatgtcttggtatatactatgtgaaggagacgaaattctagatataggaccgcgctatgaaaaaagagaaataagggtgttttctgcaaaagagaacatccctatcctatcctctccattcccctgaaaccctatccatcactgttctcctgccctttctcttcctttcccctgtccttgcgccgccgccgccttgccttacctccccggcttctcctcgccgacgacggctttcccctcacgctctcccgtaccctcctcctctcttggcgctccctccatcaccccccctcccagtagagcaaggggatttagggactggatggcgtagcgttggatttgggtgcggtgatggagtttcgccggcgacggcctccccctcgcgctcttccatgtcctgcccatctcctgccgcaccctcaagcactctccgcctgtttctcctcgccacccgttgcagcagttaccctgttttgtgttgggctccacggagctgcgacgacggtagcctcggccaggaagcgacccatggaccaatggtgggagcatttggcaaggacacactcactcaagaaccagacattggcctgtgatgggaaacaagctcgaggatgctaggtacggtcgccattgaggtggttcccctttttatttgcttttcttcagtttttactcgctttgcctaccgtgagatagtcttgatctggttttttcctctatgtcagatggctatagacttgatccttccactctcacagccgtcaacaacatcggggcgattcgttttgctgcctggtgggctattgtttactgctgtctgcttgctgctgaatgaagcagctagcaaatattgttccaaactaaaagttgtagtggtttggtgtgatgaggaagccagaaaattaatggttaggattcagtggcctttcattttatctttatataggacttcattcccctaaatcttgcctttatatattgattttaattatgcagattttctgtacaattggcactggacattctttctgtatccagattcattgaagcatgtaatatttcatctttgtaccatgcttctatttaagaggtgtgcagactctcactgtttcgtttgaatatgccaaccatcatgtttattttgcaattacctacgacactagatgaagcacttatatgtaaatattactgcagagtgtttatcattttgcttaggttgcttcttaaaatctagcgcaggtgattggaagaaggtttagctgatcttggatatgttaggattattagaagctaaatgtttccctgattttacttaaagtagctgtttgccgcttgattttagcgattaaagtttctggtctgaaagaagttagggtgtgtttggttggtgggatatacccggataagacatggccgccgctttttggagggtgtttggatgctgggcgagagtgggatagggcagcccagaggggaatattccctccacatgctggatagagggatccggctgatttggccggatgcaaccgcccgaggctcgggcgagccgggcaagcgagttgcgtgactcgcgtcacccctcaccaccacgacgcgagcgaggcgacgagcgcggtggccggcaagagggacgacgagctcggcggccggcgtgggcgacgagaggggagatgagctcggcggccggcgagagaggcgacgagcgcggcggccggcgagagaggcgacgagctcggcggccggcgcgggcgacgagcgtggcggccggcgagagaggcgacgagctcggcggctggcgtgggtgacgagagaggaaggcggcggcgggaggaggcgagcctcggtggtgggaggaggcggccggcggcgggaggaagccggcgggaggaggctgccagcggcgtcggcgagcccagatctggcgctgctttttttttctttttcttttttctatgtgtatttataatggaatgtgtatttataatggagtgtgtatttataatggaatgtgtattatgtattaatttgatggggtatattcaccatctcaagtgagaggtgaccacacctacaaatccaccatacttcctccaaccaaacaaaaaattggatcaccaaatccacctttgtctctacaaccaaacaaaaaattagatcgccatattcacacaaccaaacaaaaattggaccgccatatccagcaaaatatggaccaccgtatcccatccaatcttgaccaggaaccaaacacacccttagtgttctatacaagcatgttgactgtttgataaaaaaatcacaatactgactgtggtttttgaaagaagttagtgttct

SEQ ID NO: 92025 - DNA, 720 bp, Oryza sativa
ccccccgagtgcacttgatgcttctgaaattttcgacaagctgagagtcgctccgaatacatatttcaagaacatcaaagaagctggaagtatgggagcaagtctggcgttggcgatgactaaatccctttatccaagagttgatattgacgccattgatggctttgcagacgggacgagcgaagaagctgctcttgacctcatcagtgatgcgcagaaatcggctgacaaaattgctgctgatgtagttgagagatttcaggacaccgatcttcgaccgactggtcctgataattctgatgatgaaaagactgatactgattaatgtaccgataattttgatgattaatgatgatggaggcacaatttgtacaatactgatgaatttatgttgtgcttgatatcttaacttagctcctgatttcttaaaagtttttgtcaaaccttgttgagcctaaaatccgcaaaagttgttaaaaaactttcagtcctcattgactaagccaagaaatcaaacagggcaatgatacatcaagtaagcaaattaaattgataaaaatcacactccattattattatagtagccccctgactgaaaacttcgaggaaaaacttgaagttagcagtcaaagaggaaagatacaaacgaaatgtctaagcgtaaaatcgacgaaggtgttcaatattccaagaatggtgatgatagtaccatcttcgcgc

SEQ ID NO: 92026 - DNA, 670 bp, Oryza sativa
aataaactttggtcaaagcctaacaaaatggaatattaatgacttttgggagttgtgttttgaaaaaaaaaaaggaagatccccgcaaaaaaaaaaggaagatgcttaacagtcataacatgacaaaaaaaaacaaacaaacaagacagtataagtggacaaacttatcccaggaatcctaaaatggattaaaagcaaaccaactaaccatcaaccctatataaatatgaccaagagggcataagtattctaacaggttactgcacaaatgtatactgcatttgaaatggtgagagtaaaataactccaaacatcatggctaattctcaccgaagaacatgcgaagccattaacagttctggttcacctccccacacatgtggcttcctaatccgagagacatatgcatcgaagtccccctcaacaaacctgtgaattaatgtcatagcgaagcataagaatgcgtaactcaacaatatttagatgcagagtaactaacagaataatgaggacaggtagaactaaccattcatctctgcccgtctcttgataaattcatcggcgacctaacagtgacaccatttaaatagatcttttacatgataaattcaccagaaatggctgcgttgcttccagagcaacatttagcatctaagaacagaatggatca

SEQ ID NO: 92027 - DNA, 500 bp, Oryza sativa
tttcggttcgtcgagcactcttttttccatgctttcagtgaaacaagatattttatcaattatcgtgtgttttgctcttgttgatttgtttgtgcccttgttgtgttgttgatcaaaattccctttgcttgtaaacagaaatgccacgtgaagaacaaggatatcaggaagttcttggatggtatctacgtgagcgacaagggtaccatcacagaggatgcgtaaactcctatcttcacctagtatcatgaagtgctgtttcttgtctcccgtgtctgatcatcctctgagttgcaattttctgagagactgaattttgtaatggtgggttatttaggatgtaatggagcatggtatcttatcctacatattgtttctgtttgcgattatgaagtctatttatcatcccctaaagacagtttactggaagcattcgtggttagataaacagcataatgctacttaaaagtgtgagctggtatgttttcccctgcgtatga

SEQ ID NO: 92028 - DNA, 2201 bp, Oryza sativa
atttcatcaaagcagccggcctctatatatacacccctcattccctctttccatggaagtagttagagtgtgtatagtgagccaatcagttacagtgccacgctcttgagcaagaagacggcgggctccgattttgcggcgcaaccatacctaaatgtgctgtactttctatgaactccagtaagcttcccatgtcctgctttttggtggagctcaaccatcatcttggagcactccctgcaaggcaaagataacaaaataactgtcagtacaagaggacagttttagtttatatggtactgaaatgcaggaattggggacagttttggtacatcagctgttcttcagagtattttgtatgcagctcacagcatttgttccaggacttgaacccattaatggtgcactgagcagtgtagatggcagcagccgccagcattgacggctggaatttgagcatctcatactcgacaaggctcagctcaattatgaagaaagacatgagctcaagctgtttcagtaggcacttgggtcagacaatgcactcacatagcaaagctactgtatatcaatacaaagatggatgcaccagtgtgtttttgtcctaccttcttgtcagattgtgcagccttgaggaaccttctcatgaaacagtatggagttggaactgacatatcaaactgaagagtgtttacaatcatcctctcctgcacaaatacaaatgacactttcacttctctgaacatatatcgatcgctctggaaaaaaacaggtacagtattcttcttaccatttcgagaatatctgttcttgtgtaggcgcggtcgcagattaggataagatcctccactacaggaacgctcacttcttcatacttgcaggcgagcagcatggcagtcacgccaaccaactgaagcttctttcgcaccacattttcgcgagccaagaatcggtctatgatattcacagtaaggaagagggtctcatccaatagctctaacttgtaatgcacctgcattggtcaagttattgtcagaaactaagaattcccaaaccacatgatgaatatgctgaatgaaatacttgcctctatcagccaatcgatgagaatgccgcgcatcttctcatttatgtcattttggctcaacatgtaattaggagagacacagctcaaaccctgtgcacacagaatttgcaatgagattgattacccaggtaacacatcaaaacaacttctcaggttccacaaaaaagttacctcactcctcctgtagaagctgtaaatttcatcaacatattcaactactgcaagggagttatttgcatcacagctgtcaatatcaggtgctgcctcctcaatgtcttccatctcaatttctttcagttcagaacccatctgaaataacaagttggactgctgattagtgatgaatcctacctaccaagtgctaattgctaaataatgcattccaagtatatcatgtcatttaccacttcgtccatctcagacatcattggcaatggcaaatcatcagatgtgatcttggtgcactccatatctgctggaccatgaaatgcagaatctgctgtccttttttgcctctcacttccaatgggtgcctgccacaataaagacagcttcttcagactactagtatttgttcaaagcagctcacagaattgttgttctgctatgcatctgtaaatttactagttatggaatatgtaaatagaagtcagaaaactgtaggcgttaagtcctagagctgtcattcgaactaaattctacatcactggattaaattagaagatgcagtgtacaggcaacattaatatctcatttgcaactttccgatttaccatttcgagtttctgcatgtaaatctgaataaccacatgtactaattcaaagttaaacaaaatcaaatagaaagagcacagcattttcagagcatatcaaaacaacagcaaacctaaagaacaattaggaaagcattggatatatgatggggaagttgacatatcagaacagcagcagtatcaatatagcaacaactttaatatggctttcatgagtaattaccaggggagcactggagggttggtttgccagtgttgcagcaaatttcctgtcaaaaaatcaaacttatcacaaaacatttcacttaattcagtacagaacggtaagatcaagaacagct

SEQ ID NO: 92029 - DNA, 1120 bp, Oryza sativa
aagaggccaccgctgcctcgcctatggacttatgggcctcaccgtcatcgtccaccgtcgctagctgtgagtcgaggatgagagaagagggtggagatcgatggagtacttgcgatgttgacttaaggcctggtttctcttattaattagtcgtactagctagctaggcacgtggatgagtggaaaatcgttcctatcaataccggtttttggctaaaccggcactaataaagcgtatatataattgggccattctattgtagtagtagtgtatgattttattcttaactgatcatatatggagtatgtatgtacgtaatgtgtatacaggacgttgcgagtggcaagcagtaccttgtgacgctgacggtggggtacactgagaaagacaacatcaatgcaactgttcacaaggtcgctcgctcattaacttattactcgatcctatatatttgcagacttaatgaataataataggaatataatacatgcagttatcggacaagtttgacatagtgctgttccattacgacggtcggacgactgaatgggaggagttcgagtggtccaagaaggttgttcatgtcagcgccaagaagcagaccaaatggtaattaactacctactccaattaatccaactgttaattaattagctgaattgattgatcatcatatcgatcagtatatagtaaatgcatatgaattgaattgaaattgaataggtggtttgcgaagagattcatgcatccgagcatcgtggcgccatacgagtacatattcctgtgggatgaggatctgggagtggacaacttcagtgcggaggagtacatcagcatcgccaggaagcatggcctggggatctcgcagccggggctcgacgccaccaaagggaagagatcacgctacacggccaccgccaggaggcccgccggcgacatgcacacctccggcaggttcgtcgaggtcatggcgcccgtcttctccagagacgcctgggcatgcgtctggcacatgatcccggcaagtgtcctatccatcgcattcattatattaattctgacttacagtagtattggttagtatttcagtcagacataaacgaactaacgatcaatata

SEQ ID NO: 92030 - DNA, 1769 bp, Oryza sativa
atttcttatttttcttatatcataattataaatgatgatggatatttttacctgtatgttatgttcttttttataattcctgtttgattaactcttcgccatcttactgtatccaatataccattatggttcctgtaggtattccgacgcaaaagaaaggaggataggacccaggagttgcttcaggtggacagggaggctgaactcaacatgagaaatgtggccacagacagatcaaggaacttcagtaataaagtaagagccagctacaacatatggaggccggggtttcaccatactaacacagattcaaccctcagactcatgaaagatcagattataatggccaaggtgtatgccacaattgcacattcccagaagcaacctgacctgtacgtgttgctcatgacatgcataaaacaaagccaagaaggtattggggatgcacacatggattacaaacttgatttgaggtactttattctacgcctttgaagacttaccagttcagttgcttgtttgctgtgactctaaaggttcagttatttattgctgtgactctgaaggttcaattatttatcacccacatttcttatgcagtgctttagagcgagcaaaagcaatggggcatgccctgtcttcagctagagatgttctgtacaactctggtgaagtatccagacgattgcgtgttatgctacagtctacagaactaaatatcgatagtgttaagaagcagaactcattcctggtgcagcatgctgcaaagacagtccccatgcctttgcactgtctgcatatgcagctgacaaccgattatcattttcgtgatggtgtggtcaaggaatattttcgtgatgctgctttgaaggaggaagaagataaggcaaagcgtgaggatcggtctctataccactacgctatattttcagataacgtccttgcagcctcagtagttgttagatcaacggtgacacatgccaaggaaccagagaagcatgtattccacattgtcactgatagacttaattttgcagctatgacaatgtggttcataagcaatcctcctctacctgctactgtccatgtggaaaacattgacaacttcaagtggctcaattcgtcatactgttcagttctacgacaacttgagtcagctcggctcaaagagtactatttcaaagcacatgatccatcgtcactctctgatggaaatgaaaatctgaagtacaggaaccccaaatatctgtctatgcttaaccatctaaggttctacatgccagaaatacaccccaagcttgacaagatactgtttctcgatgacgatgttgttgtgcgaaggacttgacaccgctatgggatgttgatcttaaagggatagtaaatggtgcagttgaaacctgcaaagaaagtttccatcgcttcaacacatacctcaatttctcacacccaaagatctcagagaactttgatccacatgcttgtgggtgggcttttgggatgaacatgtttgacctgaaagagtggaagaagcaaaatatcactggaatataccattattggcaagatctggtaagtagtggaacaagaaagctgtgcttgattatattgttcgaatacatttatcccaccatgcattctgtctatgaactgaaggtcatgcaactgcaacaattggtatttatcttttgtttgtttcatttgataagagaatgtgtttttgcagaatgaggatcgtaagctgtggaagctggatacattgcctccag

SEQ ID NO: 92031 - DNA, 1537 bp, Oryza sativa
ttctgcaaagaagttatcaatgtttttgttcaggaccagtccgtccaactggctgcagggggatgatatcctctggccatgtcttggtgacatcaagaggatcgaagtcaaatctgtcctcatgatcaggatcaatagtctggatgtaaagcttccactctgggtaattccctgctgcaatagaatcagtcaagtccttcgtggcatggctgtggcaggtgccgccaacagtcacagcttcatcatccaacaggcatttgacaccacaggtaggcttccagtggaatttgacaaggtgaggctttccatccttattgattagggtgtaggtgttgacaccaaaaccctccatgtgcctgtagttgagtgggatgcctacatcgtcaaagaggaaggagaacatgtgcaggctctctgggtggtgtgaaaagaaatcaactattctccagttctcctgcatattggtctttggacttggcttgaaagcatggaccatgtcagggaatttcatcccatctcggataaaaaagacaggcatattgttcccaacaagatcaaaattaccctgaaaagcattgactcagaaaatatcaaaatatggcagcactgaatgcaaatcagtaaataaacagtaagacaaagttgtaggtgacactggttagatatatgtccaatgtgtgagacttttgagatatataagaccaaattaccctcatttgctttagtagatataagattaagcaatgcactggacctatggagtgtggaggtaaaggacaaccaatctttcatgttctacttaaccaactgagaacaactagacatttgattctacagccttatgcttgaagaatacattatactgaatgtctccctcctacaatcctatgaaagaaagaagcgaaagagcaagtacctctctagtgtaaaacttgacagcaaaccacgtggatccctcaatgtctcagggcttccacgctcatgcacgactgtggagaaccgaacaataactggggtctgaacaccaggagcacggagaaaatcagcacatgtgaggtgagaaatatcatgagtaacctcaaaaaatcccttggcactggctccccttgcatgaacgacacgttcagggatacgctccctgtcaaactgtgcaagcttttcaatcagatgatagtcctcaaggaggatagggcctgtcgattgaagaattcatcatgtcaaaccacaaaacagccatgattacagattgcaaaaatacaggagttgctgagtataaataaagggaaaacactagaaagaaaacttcacagatcgatgatagaagcacttagttctagatgcaaatacatctttgtcagagtttggtacttttagtgaccatgacatttggaacatgacttccagtcactttcgaaacttgagtcatgttggatatatgtatgaaatagacttgtgcttctctggtactccagtaaatttgatcgtcatcagattactttgtaaagtgaaccgataatggtaaaaaacccccaaaaaa

SEQ ID NO: 92032 - DNA, 1191 bp, Oryza sativa
gagagtgtacagggaacggagcaatgggaggtgattatcatgtcccaccaattgcttatctaaacatatttcttttgttaatttcattataaattgcttaattgattctcaggaagattctattttttcttgaaatcagggggctaaggcagccagtgttcaatattctcaaaccattggtagatttagttttgaaaaatactgtcatatagtttggaattgctcaagctgcaatcaccattttcatgctcatgacagggtggagcttgctggccctttgcattacttgccactcttgtcatgatctgataatattgcactacttatgtgatgtcttctctgtgccttgttaactgttatgtcggttgattctattaataaccagcaataaaaatctctggtggctctagtttgtttttcttgcctacatcatttcatactctatttacttacttttagagcataatccagtaccgttctcccatgagttgctgatggtaaaagtggtactactttccatgcttttctgttacgtgcttctctcaaaaggaactatgtgtttccgatcagtctgaagtgaatttccttgggaggatttcacaccccaaccttgtcaaactcttgggctattgcaaggataatgacgaactacttcttgtgtacgagttcatggcaaaggggagtttggagaatcatctgttccgcagtgagtcttttcttggattccctttttttaatgataatatctgaaacatttctttttatgtcaatttgtttacctctctttatgcctactctctatacaatgcatcactttgcagatgttggtgcaattgcaacatcgttttcatcatgtattatatattaagcaccatattccatagtgctatacaactaatgaaacggactttttgaggacatcagcatcaacgaaattgtctggacctagacagttccttgttgctgctaccttcaattattctttccttgttatgttaatgtttcaatataatatgaaaattattactctaatttttttgctagggtgtcaagggaatttatgatcaaacatcctattttcctagttctgatgctaattcttcatcatcaggaggagcagtttacgagccactgccttggagcctcacactgaagattctcattggtgcagctcgtggccttgccttcctt

SEQ ID NO: 92033 - DNA, 689 bp, Oryza sativa
ctaatattaggataaactaaggaaataatctatggtttgaaatttgagagaatttgcttaaattcactagggtttggaataaagggaataattatggtaaattagtagggctctaagaaagtaatacttgaaccaattaaagagtcaaataggtttttaaagcacactaatttaatcaaaagccagcatgatgcagtcaaattttagtttaaaatttgaggatgttacaaacctaccccccttaaagaaatctcgtcccaagatttacttaggagtcttcgaaaagatacgggaattcgaattgtaaataatcttcctgttcccaagttgcctcatcctctgtatgatgattccattgaactttaaacattcttattgccttagtacgagttgttctctgtgcttcttccaagattctaataggatattctggataagttaaatcctgattcagttcaacagtacttactgatatttcttcttctgaaatacgtagacatttctttaattgtgaaacatggaatgtaggatgtacatcagatagataatctggtaaagccaattgataggctacttctccatgtttagcaattatttgatatggtccaatataacgaggagctatttttcctttgactttaaatctttttatccctcgtaaaggtgaaacttttagataaacataatca

SEQ ID NO: 92034 - DNA, 2176 bp, Oryza sativa
catttttgtactacctggatgtaaagagtaagctgaatcatgtgcttcctttagtattaccttcctcaagtttcctgattgtggtacgacaattctatttccgtaccataatattccttccaggtcgatcttcagtaatatctgcagcctttccttgcaccttccgttccttaaaagtttgtattcagaatcttctttctgatattcttttatttgatccatcaaggtaggttttaactccaaggtgtttaattctccaaacttaataatacccagatttagtttaagcatttctgcttgcaattgttctgatactatttcttgttgtaaattgtaataagcttttcggcttaaagcatcggcaaccacgttagcctttcctggatggtatagaatttccaaattgtagtctttaattaattctaaccatctcctttgccgaagattaaggtctgtctgggtaaaatatatttcaaactcttatgatcggtatagatctttcaatgattcccaattaagtagtgtcgccaaattttcacgcatgtaagattcatgaagtaagcaggagcgttggttaatccaaatgccattactgtaaactcatataatccataccttgtcacaaaaccagtctttggtatgtcctcatgtctaattttcaactgatgatatcctgatcgaagatctattttagaaaatacacttgctccttttaattggtcaaatagatcgtcgattcttggtaaaggatacttgtttttaatagttacttcatttagagctcggtaatctacacacattcttaaacttccatctttcttctttacgaataatacaggagctccccaaggtgaagaactgggtcgaataaaacctttttcctgtagctcagctatctgtttcttcaattcttctagttcattaattggcatcctataaggtctttttgatataggtgccattccaggaagtaactctataataaattctatttctcgatctggaggtaatgaacttagttcttccggaaatacatccaaatattcttgcaccactggaacttcttcttttggtataagcatacagatgtctgtcatatgttgttccatagataaattggatttaactattatccttgtatttattcctcattcatcagtaaggataacctctcttgttgcacagttgattagtccattattcttggctaactaatccatgcccaaaataatatctatagtttgggtaggtagtaccatcaagtcaattaaaaatatttgatctcctaatttaattggtacatttctacaaatagatgatactaatacagttcctccgggtgaatgtattagcatagccttatctaaattatctttaggtaaagactgattccaactggcttttgcagataaaaaggaatgagaggcaccagaatcaaatagaacaataactggtttagagtttatggtgaacatacccatcaatatattaggatcttgttgagcttcttcttctttaatatgatgtacttgaccacgtccaagattaggtccattcttaataattggaggatttttctttataaaacccgtagcagatggtttctgataagaagtttggccacccatattttgacgattagggcaaagtcttgcgaaatgtccaattttcccacaaacataacatggagagtcttccatttttaatccaggtcttggtagtattggtggcatgcctggccttgcattgggtagagatggcttaaatggataaggcctccgaacttttagtgaacttctagttggtaattgtcattgtaaattcattcttttcttacggagtccttccaccattctacgatcattttctagcctaaccactttattgactaggctttgaaaattttcatgatcttgactaatcattggtcctcaaagttcatcacgtagaccttctataaatctttcaatcttctctttttcatcttgaatatccgaggcagcatatcgagcaagttgtgtaaatttattcaaatattcttgtactgtcataaagccttgcctcaatcttcgaaattcattctttttcatcctaatcacaactgtaggtataaaagcatctctaaaagctgtagtaaattccatccatgtaataatatgtgtaggatcttctatag

SEQ ID NO: 92035 - DNA, 592 bp, Oryza sativa
gtagacgccctacaacacgggcattacaggccatccgtgtaggcggagacaccgttgggcggcaacggaggcaggccggcggtgaagtcgtacacgcccaacaacggcggcctaataggccagccgtgtaggcggagacaccagtcggcggcggtgaaggcaggccggcggtgaagtcgtagatgcacaacagcggcggcataataggccatccgtgcaggcggagacacaccagtcggcggcgacgaaggcaagccggtcggtgaagacaccggtcggcagcgatgaaggcaggccggtcggtgaagacgtggatacccaacaacggcggcgtaataggccagccgtgtagggggagacactagtcggcggcgacgaaggcaagccggtcggtgaagacttggatgcccaacaacggcggcataataggccagccgtgtaggcggagacaccggtcggcggcggcgaaggcaggccggtcggtgaagacgtggatgcccaacaacggcggcgtaataggcctgccgtgtaggcgcagacatcggtcggcggcagcgaaggcaggtcggcggtgaaatcgtagatgcccaac

SEQ ID NO: 92036 - DNA, 701 bp, Oryza sativa
ttcctgcagcccctcatttctggtcagggcttatggctgttaaggagtccttcttctcgtatggatcctttaaggttcacaatggtactcagttgaggttttgggaggattgttgggttggtgccacatcttttggtaagctatatccatcactttataatatagttaggaagaaaaatgttgttgttgctgatgtgttaaacacagagcctcttaatgtctcttttaggagggccatcgtaggggataatctagtggcttggcatgaccttgtgtcgaaagttgtgtcagttaacctttcagagcaaaatgatgtttttagatggagagctaataaaaatggaatcttcactgtaaattctatgtataatgctctcatgtattgtgatgtagttccaaggaggactttcatttggaaccttagtattcctttgaaaattaagattttcctgtggtacttatggagagggattactctaaccaaagacaatcttgcaaaaaggaagtggaagggtagcattaaatgttgcttttgtaattctaatgaaacaatacaacacctctttttttattgtcatttggtaagatctgtttggaacaccgtttttataacctttgggattcgaccacccactagtgttgctaatatgtttggtagttggttaaatggtgttcaatctagactaaagtaccaaattttt

SEQ ID NO: 92037 - DNA, 4659 bp, Oryza sativa
  unsure (1)..(4659): unsure at all n locations
ttcaaactgcatggataccaatcccatgttgacacaaaccagtacgccgccgacagccaccgcgagatttaatgcttaactgttgcctagaaatcaattagattttcatcaccttctgccctctcctcctcttctcaccttccaaccgatccaaaacccaggcagctcctctacctggcgaaggcagcaaccgtggcgcctagctcccccccccctccgtcacgtccacatgagtctctttgaggaaattcataatatgttttatatatgctacatactgccagtatattaatcataaagtcctctcaactattgtaggacaggggagtacaatgctagtcattatgtggtggctgcagatatgattaacaaaaaaaaaattatctacccaatcgagggaaggagacgttgaaacggtttataaaactgaaggaaaccggttgattttcccaaaagttactttcggatcgtctcgataacataaactacttggttttcaagtaaagttttaaaaaataaaactgaattttaattattttcaacaaaatttgatcagattttgttgggagtcagcggttacgttttttatataaaaaggagtaaatatcatagaaccctacctattatgattaaagttacacaaacacatgaattttggcacatgacacatactcaggtatttatggttatatataaagtttcacataacccgttaaccaaactaacatattcctatttcaaaattttaaaatgttttagttatgtcatgtaatattttcatgacgataaataacttataaatttgaagtgattataagactaaaaagtgcggtggatcacagttaaaatgattaatattttgtttgtccgaaactttgtaaacatggtaccggggggtaatgtatacaatttactttaagaaaagacaatgaccctagggttttggcttaccaacgattttatgaattaatttagatcgaatccaggggcggatccaacgtgggtgcgcggggggggggggggtggcgggggactcaagttaagtccccctacacccaccggaccatggataccccctgagtccccccttcaaatttttcgtcatagttgataagataggaggtgctaaaggtctcctaatagtattttagtatagtttaatactccctccatcctaaaatataaggtataacactcaaaacacaaagaccaagaaaatattttatcatcttcatggttggatcacttggatgcatgcaagcaatgtgattgggaggtttaatggtataagatttaaaacaaatcaattttatagggtcaagagatgctagttaatatatacatgcatacacgccttatattatgtgacatgagagaaaaaggttgtgccttatattttgggatggagggagtattgagattatgtttttatgtcgatgtactcggtatgttgagtcccccaactttctgtttctagatccgcctctgatcgaatctatgatgagtgtgggtaattaattaattacacagatgagtgagatgacgaggagctagatagctgaccttatacgtgtggggggaggggggggggggcttcgtcccttggacgtcggagctgtagagacgccgtggtggggtctccatgaggcagcggggagagaagctgagctcctcgagagcgcgcggaataatcggccgctgcagcagcgagcggccggtggatcggaggagcactagcgatgccgtcgccatccttttgcaaaaccctagctagcgagtagcgagcaatcgatggatcgcggtggacatctgtcggctctgtctgcagctattagcgtcgggaggacggccgctgggcactgactcgagtcggtacgtacgtaactccgtatctgtatccgtatcgagctgagatcgctagctattcgatttccctacctgcctttccgcggagatccaacgttttgtaagtcaggagtaaaaatatttgtgcgttacacaggtgagataattcactactaaaaatcgattnttacatgccgacaggtagcctgcaaacgcccaaaagtatgcaaaaatcagattttcgcacttaggcacttaagctgacctcatgcgaaaagaaaaatcaagaaaaaaaaaatccaaatcctctcatcatcgccactgctatcctcctcatcctcccatcactgccgccaccatcgttggcgtcgtcctcctgtcgctgctgccgccagatccaggcacggaagagccaccgccaccggatccacacgggggatggcttgccaccccgccacccgccgcagccgctcctcgcctccaccaccgggcgggggagggccgtcccctgcgcgttgacggctgggggaaggggcgcccgttgctgccgctcctctcctctgccaactgcccgttgctaccacccaccgtgcgcggccctcgccggctgccattcactcaggaggaaaaagagatcggagagaagtgaaataagacaggagtttgagagagagagagaggagtaatatgaggagaaggttgactcgaaaatttttttaaccgctgacagggaaagaggggcaagttagacttataggcggacttttagggggcccacatgcatgtgaaaatagactcattcttttgcatgcggcaacttatgagaaaaataattgtgagataaatttggaagagaagaaaaggataaaaatagagaaattagaagaaaagagaggatcaggatgataaaaaaggagaaaaaacgaaaaaaatgggagagagaaggtggctgattgggaaggggcgtgtgtggcaccgagtggagacacgtgggactggacaacggtatggtgtgggcctgttgggttgggttgggaggtggtgtataatagttactgtagtctcatgttgaattagatacaagcgacatacaaccaactcaaacattaatgacataccagaattttgacagaaacatcttcaatatttataatatagtagagattaggatcctaacgcctagtagataaaaataaagcagatactaatggataatgccagatacaggtacgaatagctcggataaaaaataaatataaattatctcgaatacagataaggaccgaatttgatcggacgcaaatactagaacaaatatttctctcaacatgaaaaccgcctaaacttctaatagaaacaaatatcgtcacacacataattagcttattttattaaaaagtttgatcataaactaaacaatactaattaaattcaacatgtatagcaatgttggtataaatacatgtcttactgatattatcatatataaaaatatattaataatttataaaaatatttatagtctacgtaacattaatagaagaaccatactgtttcacattctgaaacagctccacagcctcatgagtgctagcagctgaaaatctggtgcatacgatggctgccaagtaatcacctgccatggtatcccaattcccctataacattttgctactctcccctgcaggtgggctaaagccaagtttatccactgatcaacaggtgtaccagtaatttcataaaacttttcacactgcttcaatcagtcaacaagatcttcaccagcaaacaaaggaatttgcatgacacctccccaggccatttcattgcttttaattgtttggttgcctgtattctcccttttaccattctgatttatatggcactgggatagtcaaaatttcctgcattctagtatctcttacacacccagagattatttccctgtataaagactttgtggtgaaattccctgatttagtcaagctccaactcattacatccctttcttctgtaagtgtaacatcccttaagatctccaacaaaccattacattcatcaaggtcctcttctccatgagttccttgcagttctatattccactccccatttgtacaaatttgcttgaccgctgcccttggctccctacatatactatatatatatatatatatatatatatatatatatatatatgggaattgaatcttcaatggagtttctccaatccacacatcatcccagaaaaatacggatctcccactctcacttttgtatttactccctgctctcatccaatgtttgaactcatgcagcccccttccaaaattgtgaaacccctatgtcagtagattggaagaaacctcccttcgcacagtatttggttctgagaagtctacagcatgggtcatttcccctctgactcaatcttgaaaatccacttgcacaataaggcttcattcattaccttggtgtttatgaaatccaaaccccctaggtccttgggcctacataattctttccacctaatcatatgatattttattttgttttccaatcattccaaaaaaaatctagttctcaaattatccatcttatgatgtgttgtctttggaaggattgctcttcccccatacgacaaatggccacttttccatgttgctagccttttctcaatcttgtttgctgggatacttaaatcaaccgcaatcagcttcccccatacaacaaatggccacttttccatgttgtagcctttttctcaatcttgtttgctgggaacttaaatcaaccgcaatcagcttccttcactta

SEQ ID NO: 92038 - DNA, 6689 bp, Oryza sativa
cgactacagggcagatatttcagaggagataaaagtgctcttactaagaaggcaggctcaaatgatctcacgcaaatacgaggcaggctcgaatagggctgtaagtgggtcagccgcgaacccacttatagatcaaaataaacgggttcgcggcttattttagcctataagtgggtttcgcgggttagccacttacacccatgggctcaaatgatctcacgcaaatacgagggccacaccaagtagggctcgataagaagccatgctcattttgcattggctaattagttatcttagcaagttaggtcggtttggctcgctgtgctataaaagttattcgattttgcggaatgatgacaaattttctcgatcgcttgaatcattaatcattcaagatatgtcagatgacgatagagtaacacacgatatttgttaacaaggttcagtcgaagtctacatcccagagatctgattatgggtgttcctccccaatcaacatagcacctagccattacgagtccatggcctcgctgccatcatctccctgcgcatgtctacactacattatagtagccatgattacattgtggtgtcccctcctctctatttaagagagagcatatgatagagtccgactctaactctatcctacacctgttccaactcctagtaggactagtatattcgacaaagattctaacacgttagctaaatgtacgagtcggctgacgagctggcttgttaaactcgttaacaaattttatcttatttctatcacctttataatttaccaatttatcctatgtgcaataaactccccctataaatacggatagtttagaagtaactaaggagtactagttaagaagcacatgtatgaaaaaagtgatgacctctcatactagcaagctaaacatagctagcgagctaaaagctcagctcagatcactataactacgagttcgagtggatcagaacatatctccaaacaagccaatccaagctacaagcttcatttttttttctacccctaacaccaaccttcgtacttccgataaaaaagtagaggacactccccctcgtatatcccttcatcccttgcctaaagtatatggtgtacatatcgaaggaaaccctaaatcctttggtctgtctgcctctattaaaactgtcaacaaaagcaaaattaacccagagagcaaagaaaagcaagcaggacacaatataatatgaaagcattcaggagcaataagagtatgcccacatcaggggagaggaaaagacgtaaacgatatcacgagttggatttgtagaatcattagatgattaatcttgatgatgaacgattatcaaaaggtgagtgtttgttgaaaatatggtgaagagtgttttctatcggtgaacagtgcgtcgacattatgttgccggtcaaactgggtagtgggcgccggttaaatcgaaggtgtccgggcgatctgaccagttagcttgacggttagaccgacagactctgagagggagtcggtttatcgtggtaagattaataagtggtaagattaatcagttgaaggtaaagatcttccaatgtagtacagactaaagaccttaaggcgtactatcgaccaaacaccgagcatcaggcaaacacgtatcaacaaaacatttaaaagtagatcaactttatttcatcaatatgtgtttacaaagtgcatctaaagcactcctctctcaactcttgaaccagaatcgaagctaaaaaaaaccctaacttttctctctaaaaaagtcaatgtcttctagtctcaatccctcatctatttatacccatgacatggttgccccaaaccatgaatccaactagaactagaactcttaatcacatagtaaacctaccaaaccagagaaacaacatccccatataactccacacttcaatcttttcaaacttggacttcaatccaaatttaacccatctttccgtgcgcacacatcaccacatatatgccatatgaaaaccttcacctctacatgcattgctatagttgtctagcttgagtatcccgcatgatatccttgatcatctagacctcatttctcccaagcatagtcccgatccatcactggctatactcccatagccacaagcaacacctgcaaacaaatctatcatccactcatttctcatcaaaattttggtttgctccaacacctcgtaacaaaatatggatagtttttgtctatatttccatttggttaacttggtggtcattaatcacaccagctacaactagcaagcacagtactatgccaatttatggcacactaacaatctaacattcatatatgtataaaacaatgaaagataaaagataatgcatgaaggactcatgcatttcttcaaactgcatttgtttgtgtttttctatagataacaagggcgtgaatagcttgctagatgttaatgtgtggacacggcatctgctccaattgtcttgtgtttgacaagatatggttgtagaatatcatgcattcaatacttatcaggatcagtactccaggcatgaaggttggcaatggacaggagtcgagttgtcgatgacatcaaaatttatgcctgcaaaatcatatagagaagaattggcatatgacaatatgaaaaaataatgtactcttcagttatttgcaaagtttggtttttaggggcaaaattatcattcaaaggggctgacggatgtgagtgacaaaaacttgacatcggtagaaaaataggacaaaagtactagtacaacactatactgtagaactcgacgaagtcaatggcaatttgtagaactaagcagggatgggaaaaaaaacaaaggatttctcattataaaaacattatgcatcaacggaactggaagagtcttccaaataagataaatgtactcttactaagaactgtacctattctaaagaagatcactgaaccaaacaatctaacataaccacaccaaccttcatatttattactataggaaactagagcgcatcaatcctctcccctcatattacacatgcaattctgcaaacatataagagggaaagaatcatttgatctgtccggctctaggaaaagcaagatagacaatctaattagtcagcaaaactgaacgacgctggggagcaagacaaaaagatgaaaacgatatcacacatctatactttctatatagttggtaccacctaacaattacttcctccgtttcacaatataaatcattctagcatttcccgcattcatattgttgttaataaatctagacacatatatatatatatatatatatttatttatttatttatttatttatttagattcattaacatcaatatgaatgtggaaaatactagaatgacttacattgtgaaacgaaggaagtattagaaactaaagctcaacatgcaagcatgccacatcatcacccactagcaattactattctagcccatttaaattccatgcaagcatgccacatattcactcactagaaattactattctagcctatttaaaatctatgcaagcatgacacatcatctacaatattatattatagagatcaacaagtgtatgtcaaattatcttcctcacattattttctcaacatttcaacttttatcatttcaacaatatttaacattaatcatccatgaataccgcagcaaagcgcggggtatcacctagttatattagatttggatacttggtgaacaatacgaacaaccaagaatttgattgcagtggtaaaacttttactcaatgatatttaccgattccacaattaaaactaaacctaattcctcttaggttgattccattttttaatagaaatatgcatattatcccatgttatcttttttttatatacaaatatgtatgttatcccattttttttatagaatcatgtttttttattttcaaagtgtccaactctccgctctcattttatccctatattttgatctcattttttataaaaatctacaactcttcctactcatattatccctatattttgatctcatttttttcttacaatttgtaactctccacgctcatattatccctatattttgtggatcatactttttttttcaaaatgtcttcttagtagcttaatcctatatttgttcgttttaaaatgtcttcgtagaaatctgcaactctccatgctcatgttatccccatattttgtggatcgtgttatgtagagatcgtttgcattaaaatgtcttcatagaaatcaacaactctccacaatcatgttattcgtatagctctatagatggtgttccttaaaatatcttcgtagaaatcaacaactctccacgatcatcttattattcttcgtatagttatatggatggtgttccttaatatctctagtttgtcccaatatgtaaagatcttttacttcaacatattaatcctaatacaatatcaatggattatggtaagaaatgtacaataaatttatctttcatttattcatcatcaaaatattggtttgctccaaaacctcataacgaaagttagtagggcatagggatgaaaacagagcggataatgctcataccatagttgttttcatatcttttgccggatacggaaacaaatacagatagcttgaatatggaaacaaatatggattatctcaaataggaataagaatcgaatatgatcggacacaaatacggaaacaatttttttctcagaacatgaaaaccaagtcaacttctaatagaaacaaatatcaacatatataattagctcattttatataaaatgtagtataatttataaatattttaaaattttaaataatattaatagtgtgaactagtgttaaaagatgaactactattaaaacctaaaaaggtatattgaaggtcatagagttataaagaaatggggtgtgtctcatggtttctgcggatatccgaatagcactgttcactagatatccaaattattatccgtattcgacgtaaaccccgataccatattcgtattcgtatccgtgaggaaatatccgtattcatatccgaactatctgagaattatccaatccgagaggtatccgtattcgatttttctccggagcggacggaaactatctgcttcgttttcatccctagtagagtaggcttcgattcttatattattattctctccatgataggcaacgttaatcacgatcagtataaccaggaaacagtgtaatgtgcctatttatatagacacaacaaaattcaaaattatgcatgaaggactcacacaatttttcatttttcatactgcatactttgtgtgtttatatgcatcacaagggtgtgaatagtttgctatatgctaacatgtgagcatgccatctcctccaaattgtcttgtgtttaaccagctttggttagtactccctccgtttcacaatgtaagactttctagcattgcccacatacatatagatgttaattaatctaatacatatgtctatattcattaacatctaaatgaatatgggcaatactagaaagtcttacattatgaaacggaggaagtatcatccatgcaggaattatcaggttcagattaggaatgaaagttagacctgtcctgttcatttcgactacaaggagtggataaagtttcggattttcgtggcacgctttgcaaactgctaaacagtacgtttcgtgcgaaaactttctatatgaaagttgttctaaaatatcagattaatccatttttcaagtttgtaataattaaaactcaattaatcacacgttattaccacctcattttgctgaaatacttaatcttaatcttaatcttcatctttaggagattcaaacacctaacaattacccattgcctcacctttttttaccggacttaaaagttggcaaagactattttttttcgtgaacgcgcaaaaggattgcacgtcaatattagaagttggcaaagaccttcagtaaagacgaaaaagaactagtaaaaaagatagtgtagttctagttgaagtgatgggcaatgggtacccattcctgttcctagctcagatgtttagctaaattgacgataggttttcatcaattacattgttagacaatcaaactgtaaacaaacaagcaaaatgagaggaaaaaactagcgaaatcaaaagatgaaagtccacagcctcggggaaacttcgtagtggtttcttgaaacttatttctttccatagaattcctatgttccaaagattttggatgtgtttcttggtatggattgggaacccatctcctagcacggaaaacggagtggtctattagcgcgtgattgatgaagtattaactgtttttttttaaaaaggatcaatatgattttttaagtaactttcgtatagaaacttttttttacagaaaatacaccatttatcagtttaaaaaacgtgcgtgcaaaacacgagagaagtgagttgggaaaagaactcagccgtagtggtttctcgacacttatttcgtttccatagaattcctatgttccaaagaggccttatttgatgcataccttttgccaattggcgttatctagcccgaatgcttctcaatcaattatagtagtatagcatatggaaaactctgtaaagagggctgcagga

SEQ ID NO: 92039 - DNA, 3160 bp, Oryza sativa
gatttggcagggtacaggcccttgagcgctgggtcgaccatccggtccaacgcatcgatgtcatgcagctggggcgttgcccaccggacaagtgactgctctgtccggagtctagcgctgagacgatagtttgacacaacagtcaggggtcaggactaagaaattaggaatcatcaaatgtaggcataaacaattcagggatgcagaatcagagaaaaataggaatacctgtcaaatggtttgcggcctgtcaagagctccagcatgacaactccaaagctataaacatcactcttgagggtatactgcccagtcatgtcaacttcaggggcactatatccagaaccctgatctgaagcctattgagatttatttggaaacatgaaaaatatggtaagccatatgttgtgtaacatcttggatactcaagaaaagaaccaatccattcagaacttaagtttccttttttaagtaagaccataaatttctttacaattgaaaatatatatgtttgttggagcaaaatgatttgagttttacctggaattcagaatcaggaacactgctggcaagtccagcatcagaaacatgaggattgaactcggtgtccagcaagatattagatgacttgaagttcttgtggataatagaaggagaacaaatttcatgaagatacctacagaaagttaacaggaaaggtgattaggtgttgacagaattccatgcaattaagagaatttacaagtgatttgtgcatatactcgttatttacctatcacattccattctattataatggcaagtcagatcaattttcacaagtcattaagttggaaaaaagacaataatttatttgaaaagtatccaacagatagggagagagatcttagttttcacttactctagtgcccgtgcagaacctaacgcaatcttaacacgagaattccagctgagtggtttgctatattcatctgggaggtgaagcatatcatgcagcgaaccatttctgtggaaatcataaactagcaagtgctgtccatgctccatgcaatagcccacaagctcattgagattgggatggtgcaactttgaaatgtttgacaccaagtcaaagaaatcgtctgaagattggcttggcaacacagtactgtttagtttcttgacagctagtacctgattcatataaggagaaatgtaagccacattgatcatgtgaagaaatgaactgtctttgtatatccaagtgtgaaacacttggtaacttccaaggcagaacaaatatatgatggtggaaatctgaattggtaagaaagcaatcaactcaatattttcatttacatattgtactataaatgaatgaagttttgtcactattgctaggaagaaatggaaaccatgtatgaatgtattgcttctgcctctaagattgcttaggtgcatttatgtaggaaaagttactctaaaatcaaatttacagcacagttttaaaaactgcacagtaagatatcttttgctattctctcaagcaaatggcaagtgcaatcatgcgtacctttccatcactgaattgtgccctgtaaacacgtccaaaagtaccctctccaacaagattgtccatgttgaaactatctgttgccatctgtaggtctgcaactgaataaactgttgcttttactgatgctgaattacttttctttgcaacaggcttgtttgaaaagtcatcatcatcgtcatcaaatgactggttgcgctcaatcttaggaggtggttttagactaacggccacaggggaaggcaaaggctccacctctatcttggtggattctggtataggcttcacatctgcatttgtagaaccatgcatacattataacttacaaaactaaagtgtcgatcatggtatatcaaacactgcaacactcaaacactgacctttaacttcattggaagggtatgaactgaaaggctgtcgctgttcaacatgttcttgccttgtacctttgcgttttctctttatcaagaagaatgctacaactgctccaatgaccagtagagctacgataattcctgctatagctccagcacgtaaccctgaatttccaccagaacttgatgagctaccactgccattggagtgtctgcctgggctttttttacggttgcgtgatggtggaggtgctgtgaatggtggtggtggtggtgccggacctgtgctccaagaattgccatcggttctgttgaacataacattagttcaagatgcagccatccaaaacattagggaactaagacataagcaatacttactgaagactatttattttctttagctcattaggaatccaaccagtaaaacggttgtttcccacatttctgcaataaaggaggaaaaactggacttagtacaatattgtgtgatataaccgatttataccttcaaaatgatttgcttacaaattatccaggggaagattagcaaggacattgattgatccagtaaattggttgttctgcagatacctggtaagatagaacataggttataggtataagagaacttataaatttattatattattcaaagttccttcttacaaagttttcaggcttgacagagaagtgaaactttgtgggagatcaccagtaagagaatttaaggagagatcactgtagcaatgtacagaaatatagtaagagcaaagatacatcgtgacttgtaagaaatgcaaacagagaagttagaagaattttgtgtgcacattgagatcaacctagaatacttgttttaagtaagagtactcacagtgttgataaacttggaaggttggaaaagacatctgtcatatttccttgtaattggttatgattaaggtttctgtattcacaaagaaaatccaattaacccatagagtacaatatgaatttcaaggcaaatttgtatttgggtcaaaaggtactcacagatacttaagtttaggcattgtggaaattgagtatggcacatttccagcaaactggttcccagcaagattgctgcaaataaaaaattcacttaaattatcgccataaataacaaagaacaattagatagtatgtgtcagtacaatttttttccctaaaatagattataaaatggcaacatctgaggaacttacagcct

SEQ ID NO: 92040 - DNA, 786 bp, Oryza sativa
cacgcgttgggatcttcctcgcccaaaaacataaagtggggcggggtgtatttcgcagtcacaaactcgtacagttccggcctggcagctggttttggtttttctggttttttaaattcgatgcgatgaacttttacagcttcattgatgaggtctgcgaaggtcatgcgaggcttcgttgtctggtcgcagataccagcggcgatgttgttgaaccgagcagtcaaatctgcatccttgctgacaattctgttaaacacggttgcacagagggacgccaatgcttcctgcaatttccagtcatcatcttgggtaccttcaaggcctgaaactgccactcgcagtatctcttctcctgtcaacccccaaccaagtgcttctcttagcacctgcaacattacagtgctttcggtcattccgatataaataggatgcatataaaagcagtatcccatcttttggagactactctgatggatattcagtaagcatggatgaaattttaatgatacaagttgtgcttcagttttgctttaaacaagtttgttacccatggattgctgcgaatgtagaggttgccaaactatttaatgagctatggtttcgtgcatctgacaatgtagaggctgccagagttatatttcattatcatgaaaaaaaatgtttgttgacataagaagtataaatgacagcgactaacgtaccttgggtatcaaatcaatgatggcctccttcagattctgaagatgttcctcgtcagtggagtagggactacacagatgattg

SEQ ID NO: 92041 - DNA, 2477 bp, Oryza sativa
atgatgattactttgatgattttgatgatggcgacgaagaagaaggtggcctttttcggagacgaattgtcattcaggaggtgaaatcctaaatatttataatcaaatacatttatttctaaatactggaaaatattgaaacctatgtgctgattatttcttcttccattgtaccagcttttcaatagagagtttgtggatgctgtgatgcaagagtggtgtaaaacgatgagtaatttgcctgctggtctccgccaagcttatgagatggtaagatttcatcttttgtttctcatggcatactttggtaccaaagactgaattgcattgactgatcatgatatatgttatctagggtttggtaagttctgcccagatggtccgatatttggcgatatttgcaaggcctactcattctaggtccttctcacgagctcttcctggatggctttccagaggtcttgttggaaggtaacagctagatgtccacacttagtttcttgtctactacattgtgtatgttttttgcatataatatttttttggcattcattcatatgccttctaaggcataattcatgttgtaacaggcataaattaccttgttgtactatgattagattgctaatattttcttggttgcacattttgctgcaaggaatatacagagagaaaagagataacctcactatttctaggtttattcatataccttttttgttgtaatgccccaaccacccaatttgtgagaagtttcgtttaccagtcaaactacgaaaataatatttttgtatataccaccggaacaatgtttcagcttgctgcttcatgccacactgcaccagctgaacatctggggaattagttaccaaggaccacatgttgaaacattgaccagagtgggaagctctttgaaacaccaaaatggaagtcttttccctctataccatatccgttctattccacagctgtgaccgtaactcatcattgtttcctccaaattccacatcttgcttgccccgtgcaacatgactgctagctatttctcaggtggcaccccttagaagaatgctggcatggatcccatgtatagacatggacttgcctcagcaccatcacctgtgcctatgtgggagagcatagagtatggtttggcacaatcagaacaggactaggggtggttgatctcatttgaagtagggtgcaccttgccatctgcacgtttctgttatccatggcattgtgatgtacttgttgatgctattccacttctagttgcacctttccatagtacaccactgaccattatacagacctcacctctgccatggcgtgcggaagataggtaacatgctgcagattttgcttagtagggaagcattgataggatgtatatctagaattcgttgtggaggtgggataaagctttcattgagtacaggcggcatgaatactattggcaacatgtgcagtgggcaaccttaacattttaactcaaccccgcatggtttatttgcctagctggtggaaagtgccatcaagcagcagttttagtcattccagtggtatatacaaaaatgtgtttagcgactgcatatgcaaaaagcagctaatttctaacagtatgtgcaaaatctgctctcatgaactaatgaatcagagtggaggtttattttagtgtttatacttttaacgtcagtcctgcagtatattgtctgttcctatgtattcctggaagtcttgtgctcatattttgtcgatagtagccacacagtttctgtcttaaatgatatggagtatcattgttcaatattttactgaacaaaaagaatggcaagcaaaaactattgataacaatagatgtaggggtaaaccttgatgtgctcttagctgtatatgctctttattttaaagaaatcttttctcatcatgtaattatttacatcattttaatttactcatgctcattgaatggccttcatagctgaaacaaaagaagcttattttaaataaaagtttggggaagggccaatataacatatttggaatatgaaagataaacaaatatgtagtagcttgggtggcactataacttatttgaagatgataggtgacacctagctctctttgcctcattttgtttgagggaggggtgttttatgctggcagtaggaatggagatttagttatttggacttaaatgcaagccagaaagcaaagttgagatgttcccctcctttattagaaaagcgtgttcatgaatactgtctcaagaagtgctttttcttcttatttggttttatgattgaaatgactgaagttggtaaccataattttggttccatctatataggatatatagatttatcacttagcttgtaggttttctgaatttaaaaccaaactgtaacatatttcttgttttggtaccttaagaagtcttaacttccaactttatatcaagcttagcttgtatt

SEQ ID NO: 92042 - DNA, 5194 bp, Oryza sativa
acaaccagggttttcaattctgaatcatcaaatccaagtatcacaactacaaccagcaggctctattcctcgcaacatggttagtaaactgtacttttttcattggtgttttcccatgtataatcatcattataacttttagcaccattgacaggttattcctgattctctcacaactcttttggagtatatcaaccgcatggatcaagtactacagaataacggtatcgtttgttgcaatttgttagtttgatgtgtgtcataaaatactgtcatgttcatctttatgttgcaaattcaggcacaccatctgttgatacaaatacccagcagccaccaagatcggatgatgcttatctaaatcaaagatttccaagtcctgaggttctggtgtcagtcattgaaagagcccaacaacttcttggtggcagtgctgcttctgctctttcagtatgttatcctctctggtacttatattaagttctttttagcttcagtggttcagcctttatagtgatatcttgtcgacgtatagtttatccttctttgtaagtactatattttgtaatgattttgccttctttctaatcagcaaaataattctctttgaacatcaatatgttgccaatgtactacttttcagttctcttatttgagacaaaactatggagatttaaaccaaaataaatccattgtcccattccgtgaccataatcctgctcacagttatctctaatggaccatatacatttaatggctgatactacttgttacaatatagatgattaggctttataacaactactaggaggaacttttagccacttcgtggtacaaaaataacactctagtgttgtgttttgaatataatttttgttttgccttgggtactaggtctgccttagtgccgtgtaacactgctctatattatccctgaatattatatgaggattcaaatggtatttgtaaacgttttgtaccaccactctgcattatccctgaatattatatgagaattcaaatggtatttataaacaccagatgttatttgtttgagagactgatgatctgtttttcattcttttctgcactatccctgctaacattttcctttgggtgccgtacacttgatctgtttttcattcttctctagcattgattgacatgtgaaaggtctaagtggacctctcaaaggtatcaatgggacattagtcttcctagttcggttcttttctctttttttattatgatacccacatttcatacttctcaacgcttattgattcaaaggggtcatatgtacgcagcttcaagactgagtacagtgaaatagcttacctttgaattcacagacgcatgcttctatttggaattttgatgaccttctgtttacctgatatttgtttcagcatctcgcacaacgaatccagagagattctggcaccagtgatgcatctatacgtagccagatccagaatgaatcagctcagctgggagtagcaatgcagcatttgggtgcaatgtttttggagcttggtcgaacaatgatgatgcttcggatggggccatcccctgtatgcttaatttaaattctctattatagtatttaactgatttctgcatgtgttaatttcataacgcttcttattttggtaggctgatgcttttgtcaatgctggatcttctgtttatataaactctgcaggaccgaatccaatcatggttcaggtgacatacattgagatgctttctcatgttgactttaattgttgtgccactttaatgacaacacacattctattgctctgcagccatcttttcaaaatactcctccttttggagtttcgagcataccagtcctcggtggaatttctggtgcctttggtattgttgatccttctcgtacatctgctgtcaatacccatggtaagatcacatttcaagttctcttcagtggctctgttgagtgtactcagctgagtcatgaagctaccatttcaaatccttaatctctactgagaagttcaaatggttatggttatggcctatgattacaaactattacactaataggttagtaggtaaattatctgttagttatttcccttttttttttcttgaacacgagggagttcttccctatattacctgcttcgtcctgatttacctctaaccagaactgaaagatcataacagttttcatatatttatgggatttttcacagggtttatttacacctggatacaatattggtggcctttaattacgattcttttttcaccatctttgtgttagttttcccacatattaccccctcctcctgatttacccctaaccagaccggaagatcataatagctgtaatatatttatgggattttccacagggtttatttacacctggatactgtcatcttggtggcctttgattacaattcttttgtcacactcttgtctgtcctgagcttccactcagacttgatatgatcctttactaggtacttctacaacaagtgggtcatctgctggtatgaccactgcttctgcaggcgctgtcaatgaaggtcgtcaaaatgtggaaagaactcaaggaggtaacccatctgctacctcaatgcatggattgccagcaaggacagttattgcggctattcctgcacggtccacggctgaggctccaaaccatgtcctgagtgttatcctgcctgttcaagtgaggagtcaagtagcaatgcctaatcaatcaacagtttctcaaggttctcagactgcagtgggcggtggatctcaaccacaagcctctgtaggtggtgttgctagcattccttctatagtggcacaggtaactgcacaagtagccaatgcattgagtgcaaatcaacaaggccaggtttcatcatctgcgcagaacacagtagatcagggatctcgctcggtcacaactaatggagttgacaatgtggattctctggtatcagcaagtacgcaactgcaaaatgagctgtcagattctaacaatggacgcacttcactaaatgcacaatctcttgtagctggagcaggtgcctttacattctttttaatgtatcgaacattttctctaatggaaaatgtactgaattgttcaccattcctgtttgttttaatttctctaatcaggtatttctccttcaaacacatctgatcccaatttagcatcggaagacagcagcactgaaaatgctcccaacatcggcagtattcaacaacatccagagatggaagggatccatgcagataatgtcagaaaaccttctgaggaatcaacaacagccaacttagtggggcagatcacaaccacctgtacagatgatatttctgtgaacagatcagcagaaaattcttcacagaagaacattccattggatggagtatctgcacagtccattaagccatctgcaagtagtaggtctgaaccagtaggtcttggtggaggtttgcagcctaaggtattagttaattattttagtgtttactttttagtaataatgtttcctgtaatttgattgtttagcctgcattttgttatccatatcttagcggggttagaatttgccatggttggcagcagtttagttgattggtttaatcacttcaccatttggtctgaatgaaaatggcagacattttactgttgagaaaacgtagtatgccattcatacatgattatttgtcccaaatatgatatgatccccccttctgaaactgctttgatgcagaggcggagcagaacagcaaagccacctgggagtagcagtgatactggcgaagtcgtcaattcctctcgcatcagcaatagccaaaatgctgtttcaatgggccagcaggttctgcaagcccttgcttctcaaaatactaatgtaaacagaagccatgttacggattctccacttccatccactacttctcagttttctggtggaatgcctccgagaagacagggtggtgaaggacaagttgattttggcagtatgatatccagtgtgctaaacaacccagcttttggcaatctgttgtccaatgtagcagagcaaacaggcatgggttccgcaggtgatttgagaaacatggtggaagagtgtgcacagagccctgcaataatggatactatgagtaatttagtccaaaatgtggatgggtcaggaagaggtcaaggtggcattgacttgtctagaatgatgcagcaaatgatgcctgttgtatcccaagttcttggtggagctggggctcgtcctgctggtacaaatagtggacaatccagattgcagcctcggcgcagtgacatgagagtggatgatgcttcagattatggaaattctcaggtaagtcatccagctgaataggttggaactgcctgtatttgcatttgttcttcttagtattatggcttgtgcttatatggtttatttgtgaagaaaaaaattgtgatgattactaatacaccatatctggacaaatgttcattctaaagggttgagaatgtcatatgcaagactgacaaatggaaaacaatatcttttttttttaactttttgataattcataaactaccatcctgctttttcatgcacagattgatctacaccaagctcgtgaacacattgagcaacatgactcccccagggatatcttcggtgcggtcctcgaaactgctgcacaggcttatggtgaagatgagagtattgaggacatgcttgaagagcttgtcagtgacccagaacttacagatgtatgtttccaaaatccccccatccaaatttagaataagctctaatgattttcataggatgccatatagttgataccgtagggtgagattgtttagaaacatacattaggagattatgttatactaatatgtatacatatataaaaaggcaagagatcattttgtggtaaaataagtggtatatgcttcttatatgatcttttgtcaaaataaataaaaaatctgataggattttgcagtaccttgtttgcctttttttttcttttaaaaaaactttgtttgccttctgattaaccctaaactgctgcaaatatatgctaggactacctgaaacttctgctccaacaagttcgccagaggatacagtcggcatctcaatccgggaaccagtcttgagcaatcatggcaaagaaggtgatccagata

SEQ ID NO: 92043 - DNA, 931 bp, Oryza sativa
acagcgagcaaaaggcctggttacgggagtatagtgagtttcgtgatgggcaaagagtacgatcgccaacaaacagcccagctctgtaacgatcgtagcccgtaacgtttacaccgcgtgtcaacaaacccatgttgcctcatgggccaacgcggatgcttagctactttagaactgtaaactgttggggatgcattggagtgggcaccaggtgttgtagagcaagtttaagggcatatgttcaggggagcttttagctgctgcagtttcttccagaattagaagctcctccaaacagttcagcttttggtccagattctgagaagttgtagaatccagaaaatgaactagaagccaaaagctaggaaaccaagcttttccaaattctcagaagctggctactaatcaactgcttcttataattttaagcttgagaatacgactaaggcaaagagccaggatcacttggttaaagcatggagacgttaactctaaattcttccaaatcaaagcaaatggtagaaagagaaaaaatcacatacagatccttcaaactccagatggctttgctgtaactaaagatcaaaaggaggaagaattgaagcgttacttcacacaaaaattaggagcctttgctctcagaaatcagagattaaacttggctgctctcaatctccctacgcttgatctctcagatctcgatgataacttcactgaagaagaactcaaaaatacaatctctgacttgcctttggaaaaatctcctggaccagatggatttattggagcctttttcaaacaagcatgggacataataaaaacagatctcattcaagctatttccttctttggagatatgggatgtgcaagactgcaagaactcaattcggcacatatctgcctcatccctaaaaaggcggatgcaacaaaa

SEQ ID NO: 92044 - DNA, 748 bp, Oryza sativa
  unsure (1)..(748): unsure at all n locations
atgttttcgtagaaaaacagaaacaaaacttaagaaacctctgggttgagcagtaccgtgcgaaacaggtgccgtaggtcgaggtcctgctccgacggtaggcgcgcgaggccggggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaagtaatacaaattggacgtaccgccacgaagtagtctcggtcacggtgcatgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccccagtcggtcaacgggtactgctgggtacacgtntggaagcccnnaaaagtggcgccctgcatagctgttcccccgtcgaggtcaacctgtgaagagaggtaaattatatggctcgatgaagtaattatcataaaaatttaaaaatggggctgcaggaa

SEQ ID NO: 92045 - DNA, 1265 bp, Oryza sativa
ctttgccgttggctgcttccgatgaccggcttgccgtcggcaagacgctctcccctggcgccaccctcgtctccgatggcggcgccttcgccatgggcttcttctcgccgtccaactcatctggactgtaccttgcatatggtacaacaatgtccccaagctcaccgtggtgtgggtcgccgaccagctcgcccccatcaccgaccacccttcttcttccaagctcgccatggccgacgacagcagcaacctggtcttgtccgacgcggccggccgtgttctttggaggactaatgtcaccgccggcggcgtgaactcgtcgggtgccgtggcggtgctcgtgaactccggcaacctcgtgctacggttgcccgacgacaccgccctgtggcagacgttcgagcaccccagcgacgtgttcatggccggcatgaagctcggcatcgactaccggtcgcactccggcatgcggatcgtctcctggaagggcgccggcgacccgtcgccggggagcttctcgttcggcgtcgacccggagaggccgctgcaggcgaagatctggaatgggtcgcgcgtgcactggcgcagctcgatgtggacgggttacatggtggacagcaactaccagaagggcggctcgtcggcgatctacaccgccgtcgtctacaccgacgacgagatctacgcctccttcaccctctccgccggagcgccgccgatgcactacctcatgtcctactccggcgacctccacctgcagagctggagcaacgtgtcgtcggcgtgggtcaccaacgccaggttccctcgccgcgactgcagcctcttcggctactgcggcgcgttcggctactgcggcaacagcaccggcggcggcggcggcgccgggcggcgtctcgacgtgccactgcctcgaagggttcgagccggcgagcggcgccgactggagccgcggcgacttctcgctggggtgtcgccggaaggaggcggcgcgctgcggcgacgggttcgcggagttcccggacatgaagctgcccgacgggtacgcgctcgtcgggaacatgaacgccggcgagtgcgcggcggcgtgccgccgcaactgctcctgcgtggcgtacgcctacgccgacctgagcaggagcacgaggagagatccgaccaggtgtttgatgtggggcggcgagctgctcgacatggagaaggtgaacgagagctggggtgacttaggcgagacgctgtacctccgaatggcaggtgcaggtaaa

SEQ ID NO: 92046 - DNA, 17684 bp, Oryza sativa
accagaagggcggcaggtcggcgatctacaccgccgtcgtctccaccgacgaggagatttacgccgcgttcacactgtccgacggcgcgccgccgatgcagtacacgctgggctacgccggcgacctccgcctgcagagctggagcaccgagacgtcgtcgtgggccacgctcgccgagtaccccacccgcgcgtgcagcgcgttcggctcatgcggcccgttcggctactgcggcgacgtcacggccaccgcctcgacgtgctactgcctcccggggttcgagccggcgagcgccgccggctggagccgcggcgacttcacgctggggtgccggcggagggaggcggtgcggtgcggcgacgggttcgtggcggtggcgaacctgaagctgcccgactggtacctgcacgtgggcaaccggagctacgaggagtgcgcggcggagtgccgccggaactgctcctgcgtggcgtacgcctacgccaacctcaccgggagctccacgagggatgcgacgaggtgtttggtttggggcggcgacttggtggacatggagaaggtggtcgggacatggggtgacttcggtgagacgctctacctccggcttgcaggtgcaggtatgtaaacgtacgtaccagtgtttaaaatagcgggctaagacatagcaagctaaatggagctatagcggttaattgtatatgagagcaaatagctagaactcttctcagacaagttattgccggagatagcgacggctatagctggagatttaaaaccttgatatgtacctggtgtttggatttttttttaattttaagattacacggaagacacaccactacacatttgtcatcatttgtttgggattttgttctgcagccttgtctcaacactactgatcctctgtaaatatttttataaaaaaactctataagaagaaaaaactgatcacaatttcatatatagagtggaattatatatgctttgcaaaagtatttcaaacactagttagcttgatgcaaattaatcaaggttcttactttgcaggtaggaagccaaggactagtgcactgagatttgcacttccaatagttttagcaagtgttcttatacccatatgcattttaatatgtgctcccaagatcaaaggtacccatatttattttcatgaagtttagtactttaggtccatgggtaaggtgatacatgttcaatgcattaataccctacctcatttttcttcgcgaatataatgaagaaattatcaagaaaaaatatggggagaataacaagaggcgggccttgcgagttttgagcatttctgatgatcttgggcaggaaatcccagccaaagatcttgagtttccatttgttgaatatgacaagatcctagttgcaacagacaacttttctgaagcatctttgattggaaaaggaggttttggcaaagtttacaaggtaactcattcatatgctgacctagataatttctgaagaaagaaaatgcagagtcaagctgatcctcctgaactttcagataaacaaacacccaaagtttatggtgtgatgtaaatttcttaaaaaaaagaagaagaaaaagaaaatcattcaaaatacaacatgtgagtattcagtgatgatgtttcttttatatttctgaagggagtgttagatggccgggaagttgcagtcaaaagacttagcagttggtctgaacaaggaatagtggagttcagaaatgaggtggtcctaattgccaaactacagcacagaaaccttgttcgacttgtcggttgcagcatcgaaggagatgaaaagttgctgatttatgagtatatgcccaacaagagcttagatgcttctcttttcagtatgttctctactagcagtctatcacaccacaagttgcctaattgtcacacacaataaaccattgatgctaatcaatagtgttgcttatttgcagagggtaaaagaaaatcagtgttggactggtccacacggttcaagatcgtcaaaggggttgcccgaggacttctttacctccatcaagattcaagattaacaattatccatagagatcttaaggcaagcaacattttgttggatgcagagatgaacccaaagatatcggattttggtatggcaaggattttcggcaacaaccagcaaaaggaagtcactaaacgagttgttggaacatagtgagtattgtccaaaccatttgcacagattaattaacctttttttttttacaattctatgtgtggactaactatttgaagtggtatgatccaattagtggctatatggctcctgaatatgctatgggaggtatcttttcaatgaagtccgatgtctacagcttcggcgttttacttctagagatagtaagcggttctaagataagctctattgatctcattgaggactccccaaatcttccagtctatgtaagcattccattttatgattttgcaatcacttatacaaagatccattttatgaaccggtaatcacttatacacctgaggtgtaaatctgatggatgcaggcatggaatctatggaatgaagggaaggcagacattatgatagactcaactatcactgcaaactgcttattggatgaagtcattctctgcatccatgtggccctcctgtgtgttcaggagaatctcaatgacaggccactcatgtcagatgttgtgctcatcttggagaaaggaagcaagtcactcccagctccaaatagaccggcttattttgcacaaaggaacaacaatgaagtagagcaagtaagaaatggtagccagggcgctcagaattctaacaacaacatgactctcacagatctagagggacgatgagaacactgttgtttgttaagagtgatattataaggcttaaggtgatcaactcaactagatgggctctaaacctacccaagaaaatttgatagggaaaggtgttttggttatatcttaatgtgaaagaatggcaagaatgtttagcatgaaaaaggatgataagaaattgatgtcgttactcatttatccttaacattcattaattaatcctcttctttttcgcatgcctcagctttaagaaagagatatggtcgatatttttgcaaacactagtactccctccaggctgataatacttgtcgttttagacaagggtgaggtcaaactttagaatatttgattatgaatcatttttaaaatatttgtcattcaaatatggtgattacgtgtatagattagccttaaaaagtactttaataaaatcgtatatttgttaacacttttatacatattataatggaaaataatagtcaaagttgtattttgaaaaccgtgctcttgtctaaaacgacgagtattatcaacccggagggagtagtagcttttatagctggggggtaatttcataaactttattcttttcacaaaatatatatactagtacaagtttgagtataactaaccgatgaacattttcaagtcaactggatgatcggttaattcctctagtacgctagtctagagagaaaggggaaaaaaaaaagaatagttggttattttggttcagccctaacgcctaaactcgtcaactgcgccagattgaacagttgtcaagcctggtttggggaaaaagtccacttcgactcccttcattgtaggccgaatctaattcgtgcccctcaaccgaaaaaccggatagaacgactccccgaactattaaaaccagtgcaatttgactccctcaacggttttggacagcggttttgctgacgtggcgctgacgtggcaatgttgacccggtcttcgtcccacgtggcgcttacgtggcattataattaaaaaaaatatctatgggacccatccgtcattcacacatacaaatacattgtaggacccactgacatgtagagcccagatgtcatcctttcttcttcccttcttcctcctccctctctctctcccttctccgtcttttctctccccattttctctctagtgtcccctccaccccaaggcccagccgccgcctcctcccttcctctcttctttcttcgccgacgacgccattccccaccggcgtgcggcggcggcgagggatttcgccggccaactagctccatcctcaataagataaaatcgaggggttggttgctcccggtggaagagccccgtggtctccgccgccgccccgcagcctctgtcttctccatccaccgccagctggcgccgcgtcgaaccaccacaagcgcaagaagctggcggcaaggcggaagaagggcaaggggcgcctcggcaagaagcctaggcgctccgatgaccccgccgaccgccctcgccgccgcagcaagcccagcgacaagttcctcaagctgctccgcaagtgccaccctacgccaccctcgagcccaacgtgtcgcggcgaggcccaccacgcgtcgcacccacggcgtctagcgccccgcgcgcccgcgcccctgggacggcggcctccgagcgcgcccgccgggtgcttatgcgtcgcttgccgtactcgatcattcctgcgatggcatctcagggcgttgtattgctcgccgtggtcgtggcggtggccgtcatgtccgtgtcggtggcgtcggcgccggtggacggaggcgtgctgccagcgccggcgccggtcacgggcgcggctgcagtggggcgcggcgtcagcggcgctggccgtggcgtgctctgtcgtgctgtccatcctcgtcgcgggtgggaccatgcactaggcacgcgaggtagtaatggatggaattggttcgttgataatctccgatttggacactgctcgttttgggtcgtttccggcgatagagtagtagtactagcactctgttcatttacatttcagggcctgttcatttactccgacgacgagaagcacctctcggaggaggatgaggaggagtaggggtggaaacgagccgagccaagcccaagcgggcttggcttggctcggcttgcaatggcttgcaacaagctaggcttggcttggctcggctcggttagggaaacgagctaaaacatgagctcggctcggctcgtttcctggctcgagctggctcgcgagccttccgttgaagctatataatttgtaatcattaagaaaagcaataacaaatcatcaacatgtaaaattaaaataactttatatattaaattcatcaaattatagatgataaattacatattgacaaataataactccactagtaaataaaattgtcaatataaatacatgatggctaggctcacgagccaaatcaaacggctcgcgagccagctcgggctcggctcgtttcagaaccgagcttaaaaggaagcttgggctaggctcgtttggcattcaagccgagccgagctaagcgagctcgagccaagcccgagccgagctcacaagcccaagctttttttccacccctaaggaggaggaggagggggcctccagctccgccgacgacgaggccgccgacgccatcgtgcgtccgaaggggaagagaaaagggggagagaaaagagagagaagggagagagagggaagaggaagaagggaagaagaaatgatgacatgtgggcccacatgttagtgggtcccacaatatatatttgtgtgtgaatgacagatgggtcccatagatattttttttaattctaatgccacgtaagcgccacgtgggacgaagaccaggtcaacactgctacatcagcgccacgtcagcaaaaccgttgtccaaaaccgctgagggagtcaaattacactggtttcaatagttcggggagtcgtcctatccggttttctagttgaggggtatgaattagattcagcgtacaattaagggagtcaaagtggacgttttccctggtttggaggaaccctggtttggatcaggttgggtcaaaaagtagtcaaatgtgggcttacggcctataagaccaacccgtttgttgcaagtccggactctcctgaaagccttgaagaagcccaacctttttctttgagtggactagcccagctaaatgcacagctagtgggctgcttcagtcaagcccagtaatttgatgaattacttcaaagcgaaactgtaatactctctttcaaattactttgtctcaagtgtttgatcctcgatcatcaactcctctaaactcatatagttcaacatatatttttaaattcatcatgacaaatattttcataatatataattcactgttattaaattgcacgggtttttttaaaaaaaataataatcaaagaaaaacatgttcgacttagaaaagaaccaaataatttgaaatagataaagtagaaaagtttaataagcttacgatagtatgaagtacttttaaatacaaatctacgaccccatcgtttgtcttatattggaatcagtcgctacccaaatttaaattttaaaaattgatttctaatttatttttacagtattggtttctaaattactacttagaacatatatatatatatatatatatataaattttacttatacattattattattttgctaatatgtcatacgacgtattatccacatatgcacaaccgatgagcccgacatataccgtatttttatttaaagttaagcatttgaacgtatacatttctttaaacgtactacatgtctttcgtgtaattaaaaatgttcgcttttgctaagaaaccctgtaaaaatttggttgatactgtgcacagaggacagcagtactaaccgtatccaaagcgcaaaccgcgcagtagtaggctagtagcacatctccatagtttacccgcgcacgcaaccaacagcagccagctgcaacgtgggcccacctcgcccactccagtgctcccgcacacgcgcctcacgtgctatccctcccaaacactaccaccaaaaaaaaaaaaaaagaaaaaaaacacaccgaaaagtccacccacccgcacaccgcaccaccacgcctcccaacacgcaaacccgactcctctcgcacaggccaaaacgccaccaaaattaaagggcaaaaaaaaggaaaaaaaggaaaaggaaaaggaaacgcctcgccgggaatgggcaagcagcagccgcagccgccaccggcggcgatgtcggcgccaccgcggaagcggaagaagaaggggcggccctccctcctcgacctccagaagcggaccctccgcctcgagaagctgcaggagccgccgccgccgccaccgcccccgcagccgcggcggtccacgcggaggaaccccgccggcgtcgactccggcgacgaggggacggcacccggcggccgccgcgagaagaagctccgcctcgtcatgggcctccccgacggatcggccaaggtgggcatcgttttcgttccccttccctccccttacccgatctgagaccccccgctccgaatccgcgccaatttggccaattccgcgcggaatttggcctaattctggtgccgccaggggttcgccgtacggatctgcgcagccgcgcgccgcccgaggaattttctttgctattttgggcatgaaaaggtcgccctttatttatttatctttgtgacaaggtgcagtggtcaactcagctcagcggcgagctctcccaatcatttggcgggggataaaccaaaaaccctcgcatctcccgcatcgccttgcctgcggcgacaataattggcgcacaattctttttttttaaaatggctcagttcgaagcttttaaagtcgtgccctttttatggggggagggttttgtctgcttctcgcgccaaattttgctacatttcacggcatcgctagatctgtacttggttacaggcgctgtggtaaacgaaagccccacttttttcttgtgcttttatctcctccattattttggattcttaatctgagttttttttttctgtctgttttgattttctttttatcttttgctgttgctgccgcagggagaaaagacgaggaaagcgacggatgggagtgaaggttggtgttccttgctcagatgcatttattcttgagatttctaggaacaaaaaacacctgggcgaatgtgtatgaaagatgccatttttaattcttttagtgcctgaggcattccagttattttttctggtttaattaatgcttgtgcctctgcctctgattgttgctgtgctcgtgctcgtgggttgatttgttcactcgccagagccgtcagattccgggcccacgacacctttgccggacaaaaagttgttagtcttcgtccttgataggctgcagaagtgagttgctgtgctctctgcttgctcttcctcgggttcagttcattcacagctgcatgacctctaacctaaggtggatttcctggtttcttgcaggaaggacacatatggtgtattctctgaccctgttgaccccgaagaggtttgtgtttgaagatgataatgtttcagatattaggttttctttgttttgtttctctggagttgattgatctgtatcttaatgcgtatccatggccagctgcctgattaccatgatattatcaagcatccaatggatttttcaacaattcggaagaagctcaataaaggggcttatggcaacttggagcaatttgaggtcagtgtcagagcgtatggtgatttttgttggcctttcctgtgctgtttcgattttccttcgttaacagtcaggtgtgtggtaggcaattagagtaactcttggtctgttgcagttggatttgaatgttgggtctttaacttggttatgtcctttggctggatcagctagtttagcctcctctgctacatgtgctgcccagtgccaatgtttttattttgttcttctttcagcatccataaatatattttctttcatatccagaagttcattaatgaagttttggtatctactaccgtggtcatttaaaaaaagtctattttatactggtgcactaatgcaccgtgctttttaggagcagatattcactctctgactcttaatcaaaagagctagaaacatttaatatgaataatataatagaaaccttcgagtttgctgccaagttactttcagtgacaatattccatctgtacaagattttgcagttacacctgatctccctaggagaatattgaaaaatctcaacaatttgagggctagtacagtaaaatatagctacattttatcttgtaaaagtgcacataataagtttcttccaaagggtacctacgcagctgccaggagttactgctattgattgtattaaaggaattctaacagaaaaagtatgaacaaaattcacaaacctatcttatgcagttttcttggtttgctctatttggacatttgaccgaagaaaacctgtatatcttgaaatgggaaacaagaaggatatatttgtatctatatttggcgcttgagttatccttctttatgctgcagttcatgcagtgtcattgacttctggatgtggaatttctgtcagctaattgtggtaggctatcagaggatgtattgtctatcattcctgggtggtgcttttctcaaagatcatctttggtttctgtgttatgcttagcttgctgaatttaaattgtaccaagggaaagtcctttgccctgttaatatgcatggagggaactcttgaatactgagatatcccatgccactgtatgtttaattctactgtacttgtggtttctggctaaatcaaaggatttttgggccatttagccatgaagggtgcttggatgatatcatctaagttagttggtagtatctacaataagacgagagtttttgaatgcctttcttcttttatgaaatttgctttaatactctgtatgacactggaatttatttgtcttatgcatgtgtgtttatgtttgcagtacatattcaagtcacactcaaaagaaatcacaagtacttaatatgaaaatgctgctaagtgctaacacatcaactgttataaagtgtgttgagcctcaggttggaattatgtgttgttggaaatatgagatagacaactgtaaaatgagaatatatgaactttctttaattatgatgctaggaaggttttctgtgatatctgctgcagcttctatcaaatgaagttttacttgtctgctaccatctcctaccatttcagacatatctgatccacttatttgtaccagacatcatagatttgtattttcacagggtgttagactttcttttactttaaataacaccaacatcattcttttgattagttttatgccatgcctttctgttttaaaacattggctcagccgcacacaccacaaacaatttgattcatataccactcttgagtactgcatgtgctactgttcggtccaagttgcaggctgcactagttgtaaccgtgtacagtttacattgtgttgaacccactatttcatatctagctaaaaggctgtcacgcacataatatttttgaaaaaaatgttatgcattcctaaggctcatcctaatgtgaatacttcttttttttttttgttattttcatctttctgcaacacactattccttcagtggaccagaatgctactagtgctttcttaagctcgtatgacaggacctgaagttttaatttacaggatgatgtattcttgttaacctcaaatgcgatgtgctacaattcaccagatacaatatactatcgacaggtaaagaatcatgcttgcatgttttgtttttatgtaaccataacgtatgctgcatatgtgatatttgtgtgccatgtattataggcacgggcgatccaagagcttgccaagaaggactttgagaaccttaggcaggatagtgatgcaagtgagccagaaccagaaccggaaattaaaccagatcctgaaccaaagccacaaccacggaggggcaggcctccaaataagaacactatcaaacagaaagttgggaagccaccggtagaacgcgctactgcagacttttctggagcaacactcgctagtgttggaaataatggacatcgtacgcagccaccatttgatctgcaacggcaagtaatgaatggatcctttatcgcagatgtactgagagcttcttttgccagtcgaaataatggatacaattggtctaacgagcgcaaattggaaagaattgaagattactcaggttttatttattttcttttatcaaagttttgtgttttgtatgggtcaacactcagtgggaaattgctgaacattttgacaaacttaatgtcttctcctgaccacttgcaatgccattcgtttgttgcagggtctatcggtaaatggtcagcaaaaagtgggagaaaaccaattctgacagaagaaagtagccgaagcacttattgtcagcctcaaccttcgagttcaatatatgagctgccggtgtcgtcctcatacaacgagacaaggaagctgctagttccagttgagtgtccgaaatatgagtcctgtctataagtgcttcaccatatatgtttatataatctcaacctttttctattaatgtttgtcaacagcaagacatcatcactgacactaaaactctttttatttgtcaggttggggttcagttgcagcagtcctatccccgcagcttggcacgttttgctgcgcagctaggtcctgtcgcttgggagattgcgtccaaacgaattgaacgtgcccttcccccaggaacaaagtttggccgtgggtgggtaggagacggtgaagcaccgaacgcaactcagccaccagtgcttactacatcttcaacagccttgatacacccaagtagtacagaaacatcaagtgaacagccaactcataacggtacggccagcacaagccattcagcaggacctcagccatcttccgcaccatatgcctcttctacaatcacaactcatagggtcaattgtcagtcattaccaagccagcaacacggatcagtgccacaggtttcagcagaaagaggtgaacatggtgctgaggtgaagggcaaccataataatcttcatgaacggccagccattcagcacactgttaatggcttcagtgctgtttcaggtactaacccagactcataagtaaagttcttctgatctatgtctcctgttagttctggttctaagttggctactcctaatgccctgccaattttctcctgtttttattttccttttaaggatcaaacatattcccttctgcggcacagatggtggcgaatcggatgcagacacatacagctgattagctagctagtagagagacctgagatcaacatagtgaatttaacatttggatgcagagctccagtgaattgtccatcatgatcaccaagcaacaagggcctgctcacactaggcactagcaactcagcaccaactgtccaaaaacctcggatgatccaagttctgacaagtggcaagtcttgtgagccatgtcgatccaccacgccgtgaattggcattgcatttgcgaaaacatgttgtgtgattgattagaaacataggatagcatgcagaaaattgcagagtaatatgtagggggaggtgtattcagcagtgtgtagtaacagcggtgagttccagttggagattcaacgattctgatgtgtagaaaccacagggaaaactttctgtatagattattcatcagtgtttatgattggttgacattatctgttctccatttggtagaattagatagcatagcagatcatatataggcttgcaagatatgaaagttcatcacaaactctcatcaaatacattgagatgcagttttcttttttctttttttcatctcacactgctggctgacattgctacaaattaataactgtatcagcaattttttttttattttttttagagaagggtattttttacccggtctctatatccaaccggatatatacggccattgaaataggaaacttagccccacaaacaacccaatctgaaattcgctccatagaagatttgaactaaggaccttggggtactactcaggtcaatgtaaccactaggctacacgtcctttcgtttattgcaatagggaactgtatcagcaattgcagaaagaaacaaggcaaattcgtttattgcaagtttgctgatgatgatgcatgtacttcctccgcccgcttgagctcctgctgctcacgccagatgaggacggcggcgagcaggaggacggcggcgccggcgagccggccggggacgaaggcgtcgtatatgacgacgaggcggcggaagacgccgtacatgaggacggagacggcgacgcagcaggagacggccaacttgagcgagatgtcgtcgtcggcgtccgtggcctcgtacagctcccctcgcgcttgctgctcctccttgtccggcggcgacgtcggcttccggcgaggccactccgccgctctgtcaacgtcgtcgtcaaaatactcaacggcaaaacggacttttgtctcggattgatcctttttttctcttttgatccggactcggattgatcgttggttgcatgggaaacggactctgactcagtcggtatccatccaacacgcactgatcacgtcacgctctgtttagatcaaaggttgggtttagatccaaagtttggatccaaacttcagtcctttttcatcacatcaatatgtcatacacacataacttttcattcacatcatctccaatttcaaccaaaatctaaactttgcactgaactaaacacaaccaaaaataaaaatttggtctaaaacgtcacatcaaatgtttggacacatgcatgtaatattaaatgttgaaaaccaattgcacaatttgcatgtaattgcgagacgaatattttgagcctaattgcgccatgatttgatagtgtggtgctacagtaaacatttgctaatgacggattaattaggcttaataaatttgtctcgcagtttacaggcggaatctgtaatttattttgttattagtctacgtttaatacttcaaatatgtgtccgtagacatcaaaataattttggcgaatgaagccttagtaaatctgttaatttttgggtgaatagctagtttagtctagtcgttgctcaagttttaccgaaggctcaatttggtcctccaggtttcattttgttcacataggtccccctaggtatttgtttcacataatatgccatatggctattgctagtcaatatttatgttagaaaatatcccttttgcccttaatttgtatataactatacactagataagagaaaaccaagatgaataaacaacattgcatatgtattttccattgttacaacatgtgcacatgaaacttaagcaatggctatcgtatacacttgcaagtacataatttatttttgttttacataaattactatgcattatctataaaaaaatcattgcatgcaattttttctcatatatgtgaacgagggggtacaagtgtcatttatcaatagagttgttggttatgtttacccatgtggcttctaagtgggttcaaagataagtttgaactaaaatgaaaacttgaaggactaatatggatagattgaaatatcgatgactaaactgagcctcggatgaaacttgaaggaccactttagctattcacccttaatttttctcacaataaccacaaaactttgtcacaaaggactgttttgttttgttttgatgccaaaacttaccttatcaaatagttggactaccttgtagataccaaattagggttattggtctcgtgttagccacttcaggcaccttaaggattgacacagacatttccataattttgacaaattggtccttctcaaaagtttatttcaagaataaaccatgacaaaaacttattttaagaataaaccgcgacctcagcgccatacctgatgacgctgaggtccaacataacagcgccacctattttggcgttgagatatatgccgagttgacgtgttacaccagaccagcagaaggtcagcgccaacccctcggtacatgttaaataaataatatgccattctatcgaacaaactatggtgatttaggaggatggtaacgttgtagttggtcatgggtcaacgccaacccttctggcacatgttaaataaataaggaaaaagtacaaaaataccccctaactatcgcgtacgatcgaattactcgtgatagtttagggggtaattcgtacttttttccatatgtcattctatagtacaaactggtttgggaggatggtaacaattaatgccaagctgattttactactacgatgaaaccagatgaaaccagaacttcgatttagttgggcaagtaggtgtattaacgcatgtttgaggtcagtgccaaaatacatggtgctgttctgttagacctcagcgccatcgggtatggcgctaaggtcgcggtttatttttagaatatatttttgtcacgatttaattcttaaaataagcttttgagaatggtcaaattgtcaaaattgatggtaaagtaaaatacttcaactattttttttttctgaaaatcacaatatttgcacaaccgctgtgttctccagtgattctccatcttcttcctcatagttttctctggcccaaagtaaccgatctcccaaatacctgagctatcatgtgataagcatcagaatcttcctcctgtcatgctccccatctgtcatgctcccctaaactttgtagccctcgacgcgacctacaactttgtagttgaaaaatttttgaataaaaattgtttatggtcccaaaatattgttgcatgtttatagattttgattaattttaaaattacattttgggacaaaaaatgactaaaaataaaaaaaaatcaactacaaagttgtagatcgtgtcgagggctacaagtttgatataaagtttgtcttcattagagttcacatgaaaaagttataaattatttttaaatataaagtctttagaccgtcctatttgacctagatgatattcaaatccaagtttagggaccggggtgacacaactaaacaaattggaggacctaaacgagtgatctgtaagtttagggaccgggatgacacagtcgaacaagtttgagaacctgaacggtagattggcgagtttagagaccgggatgacacaacggtacaagtttaaggaccagtgataaactttattgtgtttctgcagttatgtatctgttttttctctctctgctgaatcttgttcctttttgctgtaagactataaaatactatgtagttttctcattttgttaatgaaatggaagaggtatatcctctctttctcaaaaataataaaaaaaaactcgtatgaactgtaccagtcaacgttacaaaattaattaaacaggaggagaaagcagaaagttctcgaggacctttcgcgcgacatccctggtcaacctggcccgcctgcgctcacacgcatcaatcacggcgagtacggaggtctccactagtatcactaggccccaagccaagagagtcagcatcaaacccttggttccgcggtagacgatggcaagcgcgaacatgaacaaggtgccgaagaggccgaacagctcgaacgggacgttctcgttggaccaccaggtgtctcccgcgacccgatgggtctcggagatagcccccgcggtcacgctcacgtcgctgtcgttcatccccgccgcctgcagcctcggcaaccactccagtggcatctttccggccgcgaacgccgcatcgatctcggcgtcgatgttgttgttgcggctgatgctcatgctgtgatggatgatggtcgtttaattcttcaattcaatttatttggttgcgaacttgcgcattgcgatgccaatttctatagctcgtgtgctttgggccggaggggtcccttttgggtgatgtatatatgcactttgatgtaagctggaaaacccagcaagacaaatttgctttctatataagcaaggtcgtttcgaccttttctctaaaatttgtagctcgtgctgccacaagccgcatccgactcggaatcgttacatctcgaattcttggtggttgccgggagatcgacgcggaaccaggaatgcgaatcaaacaggagaaagcagatagtgtcggagaacagttcgcgcgacctccctaatctccgtggctcgccggcgcttacactcatcggacacggcgactagggccattgctacgtagaacacgcccacagccaagagcgtcaccatcaagcccatggtttcccggaagacgacgacggcgaccaggcacaggaacagtacgcccatgacgccgagcgcgatgaacgccattttctgcgtcgaagaccaggtggttcgcaggatgatcaggtgggtgttggcgatggacgccgcgatcacgttcacgtcgttcccgttcagccccgacgccagcagcagccgccgccactccggcggcattgctccggccgcgaacgccgcctcgatctcgccgtcgacgacgttgctgctgctggtggtgctcatcctgccgccgccgaatcgccgatggatcaatgctccttttgtccgtacagtttccgttgcgaacttgtatgtatgcaagtgccacggcccaaatatgtaaacaaag

SEQ ID NO: 92047 - DNA, 2159 bp, Oryza sativa
gttatttttagtttgctatgtagagctccttcctttgcttataagtgattcaacgaatgcaaactgtggaagatatttaattttgccttaacaaatttatcatggtgctagtagtgccagtatcagggctctagattgtctgtgctggaacttttcatccttttatttccatcctggagatgcatttagctgtacctgaatgccaatgctaatcatcaagataataaggatatgtctgccttttccaatgacacttgaggcccatgctgctttctttctaaattttgtagtcaaatgtatgttctcaaggacaatgagttggaaccttcgttgcgttgaagggggctaggatgttcacaacatctgttctcaggtctctggccttaaatttggtgagcaaatctgttttcatgaatgacaggtactaaatgtgcttttagatatcctgcatttgaaagtcttctacattatttgccctaactgatagatactgtagacaatttctggatagtatctcattgagagaacataggtcttatctctactttggctgtttccatcagctataagaacatgaaaaccagatgattccatatatgcaactattatccctgtctacaggtctaaaaattactcctcacaaaagcacatgtttacctgtcagtgtgaacttaaatttgtcattgtcaagtactccctccgttctaaaatataaggcacaaccacccttaatccaaagaccaagaaacaattattatcacctcctaatttgaatcaccctaataaataaaatgcatgcaaccaatagaattagagatcttgagggtggaggattttaaaaaatcataatttatgtagaagaggtactagttaattgcatgcatgcatgcacgccttatattatggaacatctgaaaaaagtagttgtgccttatattatggaacggagggagtacattttagaatttagacatactaatggcatttgttacagttcagaaaatccaatcttcttaaagaacacaattttttgcgtgaataacagcaacaatctctccaaaaagaacacatcatcatgctgtacgagtgcaccatacatttttgttttccaatggacaaacaaattgaacaaaggaagcatcctatcctccaatatctataacttattaagaaccattgctgtgtcaaactgtattttcagagaagcatgccaaagaattgaagtccttgctgctttttttcggcaaaagagggggaagaagactttgctgctggtcactcagacgaggggcaagtgctgtagtatcctttgaagggactatcacaggtgatcaactgatcattgatcaatgatcagtagccagcaaggattattgcacataagcatgccaagaacgtaaatatacttggggctaacctggtttagatatatttcaccctatgatctcaatcaaattacactggcttggaaaatatcaggtccatcagtgagagtatttacaagtcaatggtttctttggtatatgctacttttcaaaactgtattcccattgtcaagtactccagtgtaatcagcagttcctaatctcagcaacagattaaagactaatccagctaacaggagacctgcatctgattgtggcacttggtaccttgcacaggctgccaaccattttttgggtttccctgggtttctgaagacatcccacaagctagtgaggctcattgtgtcttcatgagaaaccagtgtgaccaatggtgatccttgttgttggactagcagccagatgaactgaaatcttgattgtttggatatctgctagtttataaacatgaaaacactcgtgtaaatctgcatcacatgtcatcaagacccattctgaatcgtcatccaaatactttacaatcaaggaattcatgtctgctatactcagacgttttgatatctcctgcttcagttcttgaaagtcacactcaggtttcaatctgaacctcaccttttctgagccaaaagtgacctttactctcatacctacatttgcagtctgcttgggggatgatggactttgagacatgtgctgttcaccatttgccttttcagcaacatcctgtaagagatctattggtgcttcctgacctgagaaatgttcatttattga

SEQ ID NO: 92048 - DNA, 2008 bp, Oryza sativa
tgatattttagaacaactttcatataaaaagttttcgtacaaaacacaccgtttagcagtttaaaaagcgtgtcacataaatccaaaacttcatccagtctttttagtggaaatgaacggggcacagtggtgttcttttctcctgaagatgaagattaagttttttacgcaaaacgaggtggtattaacgtgtgattgattgagttttaattattacaaacttaaaaaaatatattaatatgatattttagaggaactttcatatagaaagttttcgcacaatatgcaccgtttatcagtttgaaaaacgtgtcacaaaaatcttaatctccatccaactcttgttggagaaaataacggaccgcttgttgctgttagcatgtcaactcttggccggtcaggttacagccaatgagtgatctactaatctgacagcagcaagtagtaattagtagtaacacattttcttctggctgaatctgcgaatcagtgatgaaacatgaaacatgacactggcatacaatacgactcgtgtgcgaagaaaatatttcacatttgcacctcatcttaactagttcaagatgaaacatggcaatcattttgcacgcagaagaaatatcagcacagggggctatgaaatttgcaggttagttgaagtagatgaagtgatgaaccatccgtctatccagagcatttctttggctacggaatggaatgcacactacgcactgccgatatgctctgatacactgagagagcatcagttggcagatataaatggcttattgtcacaaaggcaacacatgctaaccatgctatagcattcaggttgtcagctgggaagatttcagaatgaacttcttcaacacctattatgccgtgacatggctgaactttcagcttctcgtcagcggggtggaaatgccagatgcctaacagaagcaggctgagttggtaatggtagagcatcagtaggtgaaagcttgttcagtacattcagaactttcatcttctgcagctctttccctgacaagaggatacaaaaataatagtcaatccaaatgatcctgcttcctaaacaaattcaggatgactgatagctgaaaaaatagcatggaaactgaagtaatacactaatactgacaaacatgttcgaagcttcaacaatcagagtgaagaataccttcttcaatcaagagcttgactgctctgttctccagctcaatggcaagcttgcttcggccaacagatgacaaagaccgaagcactgcagtttagtgaaaggaaacagcgtattagatagaaattgtggcaaattgtattgaactaagataaacataaacttactgtggatatattcttcctgtcctgattgctcgttatttctcaagaaagcctgcagcctaataaacctctctttccaatcttgattgcttgatctttgtggatcaaccggataacatgctggagcagcaccacgagatgctgtactagtagccgaaacactagaagatgccaaattagctgctatagaattctgagaaactttagtagtagacgccagattgcgaggtggactagcagccgcaacactagaagatgccacattggctgctataggatttcgaggaactggagtagtagacactagattgcgaggtggaggactagcagccgcaacactggaagatgccaaattagctgctatagaattatgaggaactggagtagtagacaccagattgcgaggtggaggactagcagccgcgacactagaagatgccaaattagctgttatagaattacgaggaactggagtggtagacaccagattgcgaggtggaggactagcagcggcaacactagaacatgccaacttagctgctatagaattctgaggaactgaagtagtagacaccacattgcgaggtggaggattagcagtcactataatacttggctgaacaaccacctttcctagagattgctttctgagaaaattttgagg

SEQ ID NO: 92049 - DNA, 2466 bp, Oryza sativa
tggtgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtattgttggtaacattggctttgaaccaaaatcaattattatgcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacgtactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaaaagaagaaatttaatgagttgtgggacaagttggatgagttgacaacgaagcaaacagatgagcaatctcgcagaccactagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttcgggtacttccattggttgctattgttgaattcatccttcacggcacgcaagcctactttagggatcgatacaagaaaattggtccgtccatggccgataacaacatagtgtttggcaacgtagtgacaaagtacatggaagataaaatcaaaaaggcacggagacatcgagttgttgctcaaggcatacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcaatttaggaaataaaatgctgttgtgatgtaatgagtgttcggactaaatacttctatcgtgtaatttcaattcaatgttgttgtaatgagtacctccgactattgttgtactagtattattgcgaactattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgtgcgagtggttgcgtgtcgacccccgtcacgttccttggtacgcgtatgtcgagggtgcacagaagaagccgtcgctgcgagagcaccgctaggactttcgtccttgtgcacacgcgaccaggcttactggctcac

SEQ ID NO: 92050 - DNA, 736 bp, Oryza sativa
acggcggatggcgacggcggctatcgccggcgagcaaagaggggtttctcgccggagcgacgaggggtcaattcgccggtgctggagcatctacgcgaggtcgcgaactcattccaccggtcgagagggcacgggcggcgccgagagaggccggcgacggcgagttcgtgcgcggcacagagcgactacgcggcgtcgagcactctagcagcctaaggaggaggaaaaacagagagaggggcggagggagtcaccgcgacggggagaggcggcgggggacggccggtggcacgagacgcgatcacggcgacctcgggtcgggcaagggaagaagacggcgcccggagtcccgcgtcacgcgcccacgcacgcaccggctcccccggtgctcggcgacggacggcgacggcgagaacagcgggaaggcaacgatggcacggtggaggtggagagtgaagcgggagggattgtgaggaggggctcggctttatagcggaggcgaggtcggttcgaggcgggagcgagcggcaaaggcggttcgtgggcgacgtggggacggcgacggcgtggatgcaagggacgatggaggcggtggatcggacggcgaagaatcgggtcacgagcgcgggaggagcaatatggcgcggtcaaggtgggggcactggcgcggcgggacgtcgtcggcgtcctctgcctccgcgcgcaagaagacaaggacgggagagagagaggccgg

SEQ ID NO: 92051 - DNA, 1341 bp, Oryza sativa
gaattactaggagagtcgtcggaacatagtgagtaatgctcgaaccatcgcgaattaacatttgtttggaccctgtgcacggactaattttttgaagtgatatgatccaactagtggctacatggctcctgaatatgctatgggaggtatcttttctatgaagtccgatgtctatagctttggtgtgctgcttttggagatcgtaagcggttctaggataagctctactgatttcattgaggacttcccaaatctttcaatatatgtaagtattccattctatgaatttgtaatcacttcatttacttgcagaaggatttgaagagaagcaagttatacttatataattaacttatcaatatgatggattcaggcgtggaacctatggaatgaagggaaggcaaaaaacatgattgacccatctattgtggcaagttgcctattagatgaggtcatgctatgcatccatgttggactcttgtgcgttcaggaaaatctaaatgataggccactcatgtcatctgttatgcttattttggagaatggaagcaattcacttccagccccaaatagacctgcttactttgcgcaaagggatatcgaaatggagcaaccaagagatgacactcagaactcaaacaacacagtcactcttacagttatggaggggcgatagagtactaagaggtggtcaaatgggctcgattacgtcaacagcattcaagaagttggtagtgttaggtacttcagtgatgtcttcatgtgaaagacctgcaggagtgcccagtgcaaagatcccaataagaaagacactcctcaacatcaactgttttcaatatggctcaacattcattgaatttgagatcagaagacatgagtcttgataattgacggtttgatatgtattgttgtcacagaatgtgtcacttttggagagaagatagaaattggggatttcaactattgcaattgacttagctcaaagagcatataaatatgtacaagagaagtagaaatgtctataataccctcaatactcttaacagaatgagcatgctacatatacatgtaaaagagtagaagtaagggacaaaccgtttccaagtatcggatgcttcatgttttcaccatgccagctatcagatggcattccctggcacatctgatgacaattgacaagtacctcattagtcctgataatgtctttgtactaatgagcgaactaaaacatctgaataaatagtaagaacctgttttatgtctcaggggatacagttttcacatgctcgatgtctaggtaattagaccacaatccatcaccttggcttttagcttcttctt

SEQ ID NO: 92052 - DNA, 2494 bp, Oryza sativa
tgctcaggaagtgaatgcgctcgccacgtgctcttcccaggcgagggaatgcgagagaggtgatgaggaggaggagccgaaagccaagcggcgctgcagcttggctgagacggtgagcttcgacggcgagactccggtcgccggagcagattcaggtgaaggttcagagaaagaagaattagctgcggatgcgaaactgcgtcaggagaacggcggcattcaggccacttcggaggtcgccaagagcaccaatctgaagcgtgccagaaatgtcagttgggagattaacagctcctccacatgatctttttccggttggtttgggttatttcagaaagctgatttggatcaattttgtgcgaactgtctatgcagctggcggtctcgatggccggaagagcggctgctctggcgagggagctgaagaacatcaaatcggagctgcacttcatgcaggagagatgcggtttgcttgaggaggagaacaagaggctcagagaggggtatgacaatggagttccccctgaagaagatgacctggtaattatggcttcgtgctggcctcagttcttgatttgtcagaccacttgggtttcacatccaacaatttcaacagcctgaaaaaatttcagcatcttggatcacataacttctcttgatttctgtttaatgagatttgttagtctgtcacactacttgggcagcccccagcatttcgcagtcaagattgagcaagacaggctgaaaaattcagcatcttggttgacattatttctgttgatttttgtttaatgatactttatttgttagtatgttaacaatttccggacaaaattttcaggtgaggctgcaattggaggctctgctcgcggaaaaatctcgactggcgcaggagaacgccaacctgtccagggaaaaccagagcctgattcagctggtggagtatcatcagctgacctcccaggacctcgctgaatcttacgaggacgtaatggaggggatgcggctggacttctcgtcgccgctaggcaagatcgacagcgatgaagaaggcgagcgtgagaaccgaagagttgctgtcactccatctgataagttggaagccttggagtcatctgatgagtagataaatctgaggagaataagctgggtcttctccagtggtggatttactgatcagtaacagtatgatcttctatttctgctgttgtatgatgcttcaatttggccactctcggtggcaatatttatgtgatcaattccacttcgtaatgtgacaataacaaatgtggttctgaatcttaattctaaataaaattttagtctttggaaagcagatccctctaacttaactgcacatgcagttgattcattggcatgtggatcccgctttgctatgtctcacatgtcagtggctcaatttaaatgtagttaagccagaggatccctttcttatgaaaattcatcaacaatgtgaatgccacaaaagcaggcatgagtaatttacagatttatgaacttgacatctccaagacactctgatattctatctcctgcctgactttggtgctagtttttcattgtttataattatttattcatttcttgtttgtaattatatacacttcctaagacaaaactatcttaactcagaaatttgttcaactataagagaatgttcatgaaaataagccaaaaaaaaaaagaaaaaaggggtcaaatttcatcccaaaatacccctgaaaattttcatttaacaggctttacaattcctgcagtaaattcattttctgcccattattctgctttaaagaaaagagcttcatcggagtaatctggaacttcaaataagttagaacaacaaccttttcatttctacacataaatcagaaccatcaaaattgggcgttaatagtatacactttatgacaatgcgatgagtattgataacgaaaacacaaaggctgaaaagggaacttgtacagtgagccatcaacaattggcatcacaaattaattgctttcgacacaatattgttgatccagacaaaggagataattttataaggaaagatagtataattgacaaggaaaaaacgaagaccgaaaacggaactcgtacagtgtgagccatcaaaaatcggcatcacaaattaattgcttttgacacaatattgtcgacacaaaggacggtatttacaggacgtgtatacagtactgttctctatgttgtattctctagtcagcttctagtgcatctacagtaatcgtgataactaatttacattcaggtcatcccgaaacaaattagaagaggatcagagcggccaaattgaccaaaagaaacctgaagactaaactatcataccacattactgggttggaattactaaggggtctcaactgtgtaacgcttgctgggttcccaccctttgtttcctcgggggagtaattctcaggtgctgaaggggagaaacctgaagaattccgtgaat

SEQ ID NO: 92053 - DNA, 3022 bp, Oryza sativa
cctgctacgcctaaacatgatcacccttaatgcagaattcctaggtttcacttaccgttgtttgaagccattgatgcggttctccttttgttgtcaaccaaagtggaagtagaggatggagaacctcggaccacctcgcttgtcggtgtagaggatgtagtcatagtagtgaggacgccggcttgatcctgaagggctcgctggagatcacttgcagggtagcaacgcccttccggtcgccacctacactgtcccagaaccaccacatgtttcccctccagtgccaatgttgatcagggtttagggttttgttgtcggggagattgagacagagagagatcgtcatctactcttgggccggcctccccttttatattttgcgctgtagggaatcgggggtgactaaaaagaaaaaaattgggcgccaccgatcatggcgcgtagttaatcgggaattaacagattgaatcactgtgattgcgcggagacaatgggtggaacggtctagcgtgatctcctcccggttttttcaaaccgagagatcaattttcccaacattttcccctttgatcttgaaaagaggttaatgaattcattcttaataaaatagttcactaaggcaacgtgtcattgcagttatcatatcctaccaagacctaactatagtacctatagtttactataaaatttcgaaagaactctatctaatcttagtgggagttagttgagactaatgtccctatttccaggatcttagtcttaatcaaaggcagtcagttattaccatgccggctatatgatctttaattaagtcgggaggtaagcctttggtaagcggatccgcgagcattgacttagtactaatatgctcaatcttaatggtttgatcctggattctatgtttcacaacatgatacttaatgtcgttgtgtttagcaacactactcgacttgttgttacttgaatagaatattgcagctttattatcgcagtataatgtaattggtctagaaatgctgtcgaccactcttacactcgggataaaattcttaagccatacggcctgtcccgttgcttcataacatgccacaaattcagcctacattgtcgacgatgcagtcaaggtttgtttagagcttttccatgaaatagctctgtttgtgagagagaatacataacctgatgtggattttttagtgtatacacatcccgcaaagtcttcgtcagaataacctaggacttcaagttcttaagacttcttatatgtgagcatgtaatccttagtgtcttgcaaataacgaaagacctttttaacagccttccagtggtctactcctagattggactgaaatctgccatgcatcccggtaacaaatgctaagtctggacgcgtacagactggagcatacattaggcttcctatagctgaagcgtatggtaccattttcatctgatctgattttaatttatttttcaggctttgaaataatccaaatttatcgcccttaactattgaagcaggtgttgcagagcacttatattatatctttctagtactctgctaatgtatgatttctgagataatcctagtactcctttagacctatctcggtgtatttcaatgcctaaaacataagattcctcaccaagatccttcatataaaaattagatgacaaaaaatgtttagtctgatgcaacatatcaatgtcgctgcttgctaacagtatgtcatccacatagagtactagtattataaattttccacccttagtcttaatgtaaatgcaattatccacctcattctccttaaatctgaatctcttaattacttcatcgaatttaaggtaccattaccttgacgcttgtttaagtccatagatagatttcttaagtttgcaagccaaattgtccttgccttccataacaaaatcctcgggttgtgccatgtatatacatgctcatgcaggtcaccattaagaaatgcagtctttacatccatctgatggagctctaaatcataatgagcaacaagcgccatgacaattctaaatgagtctttcttagagataggagaagatgtctcattgtaatctattccttctctttgtgaaaaaccctttgctacaagcctcgccttgaacctttcgattttcccttttgagtcaagcttagttttgtaaacccacttatagcctactgttttggctcctttaggaatttctactaagtcccagactccattatgactcataaattttaattcatcttccatagcttcaagccatttggatgaatgttcactcgttattgcttctttaaatgaggtgggatcatctatcttcccaatatcttcacctaaataaacatcataataatttgggatagcagatcttctctcctgttgtgatcttctaagtggttcattttcgatcaccggcggttgagaagattcttgtggaatttcttcattatgtgcctcagaagtctgttgagtgtcattatttaattcattattattatcaactgagtcggtatcaccagaattttcatctggtgctaccacggtttgagtcacaggtacaatatgaggtaccaaatttattggaatattatcctgttggatttccggtgtaacattagcccgaatttcctcaagattaatttccctttcttgtgagcttccccagacttcattattttctaagaatacagcgtgtctagtttccacaaatttagtgacatggtccaggcaataaaatcggtaccccttagatgtctcagggtatccgataaaatggcagcttacaatcttaggatctaatttctttagctgtggattaaatattcttgccccagcacgacaaccccacacacataaataatttaatgtcggttttctaccggtccataattcataaggtgttttgggtaccgacttacttggaactcgattaagtatgtgtgtagctgttttaagtgcctctatccgtatatttgttggcggatgttaaatgccgattc

SEQ ID NO: 92054 - DNA, 2005 bp, Oryza sativa
aatttctgagcttgccctccatttcttctatcatttttcccatattaaccaggtgcccatctgccacagcaagagtcatactcatctgaaaagagaacaggtggttcaggattaggttgcttggattttccacagcttagcagagtctcctaataaaaagaagtgtcttaagaacgaatttttttattatgttactgattcaatgattgtgccacaagaaatctgcaaattgataagttatgtctttataagtgttgcttgtctttcaaaaaataagtgttgcttgtctttctaggctttctaagtttgcaattaacttgtaagtttaattctccagaacacttttgaagaattcatctatttcttactccttgcgtaggtgatcccaaaatgtgagccaatcaaacatttttatgtttgatcaccattgcacggaaaggtgtttacacttcagtttggccccataaaattaaattgttatcgctagctttattgtcaagtactcattcataatatgtatcttctgtatctaaaaaaaaaagtatcttctgtgatttttgatattatgatagaaatttgtggccgaattgtagccttgtgaccatgcaagggtctaaaattgtgagagcaaagttgctttacatccagaacgacatgtcttaagactactgatacactatagaggtacatgtgtaaagctatattgatggttcaaattgttttatttatgcacaaagtctgggttctacaaagtactgaggtagtaatacacatcaataactgtggaaaacagggatgaaagatgcccttgaactaagggcaacttaatatgacaaaaaggcggataagacaggaagggagatgttacctgccgcctgattgatcccgacaagttgaaagttccagattgcttgttatctgttgtcaatgatagcatcacagtgctgttcaagcagtaatgcgctgctccttcttcttcaggaccaacctgttaaagttacataaattttcaatgagtactacaaaacaacatagccagaaactaccagtaaaataatcagcgactgcatgaacagttttgtcttaagccacctgaatgacatgaatagcatcccatgaaccaatctgcatgtgccctctttttccttctccatctgcagccacataacaggaatactagttaaagaatttcagattatctggtcaaataaacgagatctcatcgagtgttcctacagacctttctttattaagaagcatgcaataaaactctcatcttcatcctcccaaatatacacagaagagatgccaccttcgtaatacctatttgtcaataggaaattgtactacttactttacatgcacatagcagatataatcacctgtatgctaaattgagaaataacgcaagtgcaagcaataacattattccatgctggtgcttagcattactgaatcaaagagagtatgaatcttactggtcacggtagacagagaaaacatcatttgcctcaacttcaagattcctcatctcttcggagggaactgttccatcttccaaaggaggatcgtatttgtttgaccaaggagacctgcaagccatccccacaatcaacaaatcgggagctacaatacagactgcccaacagttaacatccccccccccccaacttaagtgtccgtggtgatgagaatcataattaaatgaaagcgtttgcaggtctttgcattggttttctcgattgatgcatttgcttgttagtcaatttgtagagcgagtacaggtatagctgcaactatcactaagctgcattcctgaacaattgattatcctgtgtgcctgcctccgcgttctttgatactgcttgaagctttcggtattcataaggtggatgcttttcgcaacactcacaaagaagagataactataacagaaaccgtgagcgtatcgacggatcgctgacctgtaggagtcagcgtcacggttgtactcgcataggatgta

SEQ ID NO: 92055 - DNA, 780 bp, Oryza sativa
tgcacacaggggtgtaactatgcgttctaggctcgtggatgacttgaacgtgaaacacgtcgcagaggactacggtatcaaggccacacaaagcacagcactctggtatgcctccggccggtccgatcgaacgctccgggttggcgtacatacgacatcgacctcctgctggatcacgtatggggacgcccacccgacgaccatgggacgcacagatcactcaagatgagcgacaggggcgaggggaagccgcatggattacatctgcgcaaccggggcgaagactttatcaaagttgattccatggcactggacatagtcttttgccatgagccgggcctcgtgccagatcacggggccggtctcgttgttgtttaacttgaacacccacttgaggtcgattggacactggccggccgggagctcagtgagtatccaagggctgttctcctcaatggatttgatttcatcttgcatcgcttgccgccaatgttcatcctgctctgcttcagtgaggttcgccggctccttcgcgactgccaggtagagctcgtccgaatcgagctccaccagcgccgtcgtgtcgaggatgttcgccatgctccggtagcgacgcggcgcgccctggtcatcatcgacgtttggcgtcgagctcggcggcgacacgaactcaactgggggtgtgtcagaaggtgttgccggtgtcacagaaagcactggtgacgtggccccgacgctgggaggggggcttgcaggcgcagtgcttgaggccacctctta

SEQ ID NO: 92056 - DNA, 675 bp, Oryza sativa
ctattgtgaaatattaatcgtgccaaccacaagccagcgtgggcaacggctttaccttttgtatagcatggttcattgcggagcaccagactgagaagtggcggagaataagcccacgggggtcgctggggagtccatgccttgttttataagggggtgattatgatccaggaatggtgcactatggtgagttgtgttgtacaaagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgttttcctgaactctaggagaagaaggggagaaagctctccggagttaaggaacccttgtaactgttaaccatcatctcaaacacaggagtagggtattacgctccacagcggcccgaacctgtataatccgattgtgtgcaagctagctagtagtattagaggcggatacgtgatttctaagaggcgagcctcttcccccggccgaactcacgaaaggggggtctcacgacctcccgctatcgagggacttccctcgacagctggcgcgccaggtagggggaaggtcgcgcgctttgaagtgaaggcgttttc

SEQ ID NO: 92057 - DNA, 653 bp, Oryza sativa
agtttcgccccaacctcacggagaagtatgatggcagcatcaatccttccgagttcctccagatctacatcacgattatcgtggcagcagggggtgacaaccgcgtcatggcaaattacttccccatggccctcaagggtcaggcgcgtggctggttgatgacccagccccccgtctccatccactcctgggaggatctgtgccagcagttcgttacgaactttcagggcacatatccccgcccaggagaagaggcggacctgcacgctgtacggcggaaggacgacgagtccctccgctcgtacatacagcgcttttgtcaggcccgcaacactattccatgcattccggcccacgcggtcgtgtatgcgtttcggaatggcgtgcggcataaccgcatgttagagaagatcgcctccaaggagcccaagaccaccgccgagctttttgagctggcggacaaggtggctcggaaggaggaggctgggcctggaactctcccggcaccggtgcggcggccacagctgcccccgagtctgccccccgctctaagcggcgagataggaggcaaaagaaagccggcccgctctgatgacgagggccatgtccttgcggcagatgggcccgcacgggccccgcggggctgcaggaat

SEQ ID NO: 92058 - DNA, 14656 bp, Oryza sativa
ttgtcccggttctaaatcagtcaggcctagtcaggccccccgatatctttagtcccggttgataacaccaaccgggactaaagatcctatctttagtcccggttggtgttatcaaccgggactaaagatatcggggggcctgacaaggcctgacagatttagaaccgggactaaagatcatttttagtcccggttggtaacaccaaccgagactaaagatcaaatatgcccgctgtagccaccaaccgggactaaagatcatctttagtcccggtttttagtggaaccgagactattgtggatttcgggcgaccgaccaaagatggtttctccaccagtgtgtcataaacacattacgtcttggagtccgtgctgtagctggctacaaatttgcagcccgctgcttttctctatctccttttatctctttaaaatatgtttatagctggcttatagcctgctattgtacctgctctgagggattaacttatatgtacacggatcatgctaatatcttataagagcaggtacaatagtagactataagtcaactataaacatattctaaagagataaagaaagagagagaaaagcagcgggctatgaatctgtagccagctgcagcgtggactccaagacgtaatgtgtatatgacaggtgggactaaatattaatattatagtaaacaactattatatgaattggctattacattggctacagatgatttgaagctagtatttggctatactattaaacttgctctaaatcaggttgcagttgagtactgaaggttttttttttaatagacctgtgtgctgaaatggaccgatcgaaaatcagctataaatcttcttaatttcggcccataagaaaaaggaaatgcattgtgcttgaggttttttcctttcatgttctgaaaagtaacatatggatggcaatattcatgaagcgcagtgtgcagttatatatgtttactttaacataaatttatgccaataaatactcccttccgttacataattcttaatgttttctatattataataatatactccctctatctatttttgatagtcatatttccaattctgaaaaataaaacaacctatcatcttaatgattttctcggatttaatgcgtgactctctattcttccacacatgattgattacatgggcattgagaaatataaatattaataaatcgcttgcttatgagaaatggctagtagcatatttaaatggatgataaattgataagtagaattacttatcattggtctgtgtgccaagatgaaatatgactatcaaaaatagattgagggagtagaataaaacaatagatttttactatttcattactttataagataaatattatattatttatatagagatgtactatactacaccaattgggtgcgttataacgaaaacgcccacgtcataggtaacccccacccctaccgcaccccagccttaagctacagtcagatatataagtttgatctcaaccttattaaaacatcgagaattataaaaccgaaggaagcgtcgtaccgtgcatgtaataaagcaaggagacaacaatacgtgctggctgttctacaaaaccgtgtgctccgtctcatcattgtacatagctacatgcttagtgcgcatagttaggttatacgtcctccatctatctggggttggaaggcagcaggaatggtcgatgcattaagcaaacatatgttcctgtgcaaatccgttgttgagcatgagggccgaggcatgaaagctcaatggcacgaacacgaccgccatggatgcctccaccctttgcaccacagacagccaccacaagcacataccggcacccagtagtctgacgcacccatggcagctgcatttgcccaggagagttcacatgcagttgtgtaccgagcctcaaattccaaggtacggccctgtacccgatgtgccaccctgcagcacgcgagcatgccagcagtcggctccgcttcttccaaaagagagtgcacggcttgttatcatttcgttgaggttgttgacttttgaacattgctgatagaatgcagatatatatgttgcatgctcccgtcgattcggagcactaagtacatttattcgttgcgatgttagacatatcaaactattagaggtataccacgagaaccttcggccgggcctaccgaaacgaaggacataagcaaaggcatgagccggaggcaagcagcgacggtcgaagggagaacataagcgaaagccgtggtatcgagctgacaagcttcgccaaagatggactctgccggagggtcgtacggttgaagtccgcgaggcgaaagcccacgaagggcatgggtttcgccaagtatcgaaccttgccaggagaaggcccagcgggccgacacgccttccagaggcttcgccaaggactgggccgagtcacttggcccattaggagcccatacgagcaaaagacattgtatgcccataaagatattcctatcataagggcaaccatgtaaattcccctgtaaagcctaagccctaaaaggagagtctgtaatagggctataagtagtcccctagggccatgtaacaaggggatctgaaaaatttctactccctccgtcccaaaataagtgcagttttgcactatttatgttcaacgtttgaccgtccgtcttatttgaaaattttttatgattattatttttattgctattagatgataaaacataaatagtactgtatgtgtgactaaatgtttttaattttttcacaaattttcaaataagacggacggtcaaacgttgaacgtgaatagtgcaaaactgcacttattttgggacggaggtagtactaagcaaattgtctttacttccaaccactgttaaaagaaccacgtccttcgacgtgacacagttgtctattcgacaatacaaactaacaacactattgcaaattttatgaaaaagcccttgagacccagagacaaggctgaatccgcagcatcatagtttggttgtgtggtggttttttcactgaaagactagatgttctttatggatccataaataaaagaacggtaaaatttgctataggatacttaaaaacgtgtaattaaccgtgggacaccgtaaagatgtgaattagttataagacaccataaaagagcagtaattagctactagacactggaggcattattttattatttttccggcattgtggccgtgtgcgtgccgctgctgctgctatgcatgcttgtctctgcggtcggcgtcgtcagggcctttgctgcccaggctatcaacgccttgccaatgttcgcgtacaagccctctagcgcggtggagaaggatggcgttggcggcgccgcattgtacacggtgtaccatgtcgggaggaagaggacaagaaaatagaggagaggctgacatccttgacctacataatcaatcctccaaatcctggccaatagtttactgacatgtggtctgtggacccaatgagtttaaaagctcttcttggcccacaaatttctttctctctccatgttattcggaaataataaaataatatatccggtgtctattagctaattaccactcttttgcggcatcctatagccaattcatgtaggtgtcccacagctaatagcatgtttttttagcgtcttattgcaatttttgccatggagaagttatgagaaattagtggttataggtgaagttatgcttacaagtctttaacacttgggtttaaaccatggtaccttcaaatgttgtgcatcaggaagttatgagaagttagtggttgtaggtgaagtcatcaggaagtttggaatttaatgaggtttgagatttgttactttttcaaacaaagttaaaaacaattgttttgtaatcatttttaaatattatttcataatgaactatttcaaaactcaattctcagcctgttgtatataggacaatagtcacccgagaagaaaaaagcgagatcctacggttgccacggcagctgctttttctactttctagctgcaccgctgtcaaaacacatatgcaaaaccaggtaatgtgacacttttgtccattcgcgattcccctgccttcgttgttgctctccctaagccaccaaccaccatcaacccttccccgccctctctctaaaccgatgaaatcctcaagtctctatggaggatatgggtatacccacacggcgtgcatatccgaacgggtagtaggtaggctgaatccatataatatgtaatagagtaggacacggttatcatgatgtcttatattcaaagacagggcatcgagtcctggctagatgctaccatgtataaaattaggaaactgaggtcgtgcctagctaggttttcctcattgtaaccctatccgccaacctatataaggtgggcaacacgtctctcgaggacaacaaccacaacaaaatccacaaatcattacacttgatgaattcaatccaccaaacatgagtatggtattatctctcattgagagtgtctaaacctatctaaacatttgtctccacgcatcgatccggtttttggatctcggacgtagccacataaatttagtgccaatcgataacattgatagtctcccaccccctcccacgccaacaccaacttcgaaatctatctggtcgaggatgtcgcctccatcatctgatcagttcctcgatgtcaccggagatggaagaaaaagttatcgatcacaatgcatattagagaggaagaaatttgtgacacattgcccctaattttcatgcgaatatagtttaccatttctgtagtgacaatggccattttgtcaaaaatcatatttgtctcggttcgaataggaaccgggactaaagaatatctttaccctctggttcaaaagcccaacagtgtccaaagatcacatttgtgtaattattttttattttaagtatatttaatgctccatacatatgtccaaagattcgatataacgtttttggaaaaacaaattaggaactaaacaaggccatactttctgcactcatctatgctctctctcctcccttggcaagagtgccaaattcacggtaaagcgagagacagaggagatcagaaagagcaaagcccatcggaggaggtctaggcaccggaggcagaaggagtgacctggacaacagggacaaggagtgacctggacaacagggacagcccgaacttgagggactcgacaaggttggactccgacgcggcgcctagcaacctcgatttagaggcaagctgtgttggggaataaccctgtactcagggtgttgtataaactaatgtataaaaggactaaaatacccccaagagtatgttgtacatatatagcaaatcaagggcaaagatgtaatttcctgtacatatgaataaaatgagtcctccaagggcaagagagggggatctcccaccctcccaatccattccattcttagccatccaaaactccatcatcttcctctcatcctctctccagaagaattcaagcttgggttctctcctatggaggagggggcccttgtcatgcacgttgggttttgttccaacgagcgggatgtcaggccagttggtggagaccgatagacgacagggccgacacaacctcagacgttggaagcgaggaccagcagggaggccggctaatggagacgcgtggtgagaagctggaggcggcgctgaggttggcggagtagaagtcggcggggacacaaatcgaggcaatcggacggggacgcggccaaatgacggcggtggtgctggaagctgcggagtcagcgccaacagcctgatagtgacccaccccatgcacggaggttggggatgagcatagggcaccagcaatttgaggcttggaggtgatgcagtcggcccaccatgtcgacctgctctggtggggatctggaggtgaagtggcggcctccgtcctaatggttggaggaggccggccgatccacgcagagtggcggcggaggctttgtggcgtggaccccggtggcggctccaacgaggtcacaaaggacattgatgaggttgagtagaggggaatagagacgcaacgacggtagatcgaagcgggtgaagaggcggcgacgataggtctcaccggcacggatccgggaggccgttcccggcggcgagcaggagccccgcgaggtccatgacgaggaagatgatcaccagatcagttaatcgcgaagatgcatgctacagctgcttgactgattgatatgacaacgaagaaaaatgccttcggagatgacgacaacaagaacaaaacggtgaccgcatccaggaaatcgctactaccagggtcgatgatgcataagcatgacaccccggccctaaatcgtcagctctggtactatgttgaattgtagagcaggaagagaatactgcgtaactagataatagtattgagccccagagactgctatatatggagattccatgggtagagacaaagaaggtactagagataatgaaagactctaattaaatcaattatatcctaatattcctagctacaactaccatatatactcgaagtctctgtgtcgactatttcttctatccatcatgggcaatcatgttatgcaaagctctttgctctgtttttcctccttatgggatgtcttctgaattgtggttggaaagtagatttttgtcctttgaggggatatcccctcgttttatgcatggcattcaaaaagttatcaaaaaaattaaaaaactttgtcaagatagataaatatatgatatatcttttcacaaacatgagttaaacttcgacttacacaattcgaaacaaaaataacaaatttggctgtgaattacacgttctattcatagtcaaatttgttatttttgtttctacttgtataagttaaatttgaatttgcttgtttgtgaagtgacatatcacatattgatttatcctgctgtttttttcaaattttttgataacttttatgtgacatgaaaaatgaggacatatctcctgaagggatgatttgaattttcctgctggcatcgtagcagtaaatggctgtgaattctaaacatcaaaggttgcacagttcagtgtgagatccaaaaggtggattcagacttctcctgcatgggtataattgttgatataggagattaagtggtactcattagtgcattatgttaagtttatcttacaatcaacatggcagtacacgtgcaattaatatatatattagatcatcattcatgtctttgtctttgggcctgtttgaggagcttcagattctgacaaatagctgattgatagctagaaaatctggaaaactaggttttccaatattttatggattctataactgcagcttctcagaatctggacaaaaagctatactatttagggagcttctgattctaagagaaactgtagcaactagaagttccccaatcaggccctttgtttcaatggatgattgaattcacaagtttccaatatcaccttggaccgtattagttattgtgctgtaattcgtttgatttttttccccagcagaaagctcttttggtttattttaactccgactgaataacaagctctacccaccaggaaggcaaccaactaaattgaactggaataattaattagacttcgtgactttcactcgttgtcaggctccatgcttctcctctatataagtgtccaatccattcggtcccaaattatctttgcccagtctcccaccacttggcttgaaaaaacgaatcgtgtaaatgtaatcgaaagtgaactgcttcgagtaggaatgatcggcatcaggtattagtgcatctcactaaccagaaagaaacgctcaagatattttgctttctcaagtcactcccaaaaaactcgtggaaattaagcaccagcgatagaattactaaggtccacactgaaatgggaaacagatttgatgataatagtgtccatatatgttttatttcagtttagtttgttttcctcagcagtaggtaatggcagattttagctgcacgtacacacttcatctgctaatggccagcccgtacaactgtttgggcctcattttattgggcaagattgcgctagagtgattacttttttttttaaaaaaaagattacagtacacaagagaggtatactctctgccctttcaataatcagtggctttggcacttattacagtcaaggtcctgtgttagtgccttgtcgtcttaaaataatcactattaaaaaaaaactttcataaggaccagccatataggtgccagtttgacagaaaccgacacctataagccgtttctcacccaccatttctataaccggcagctataatgtttaataggtcccggttctttgagagaggcaccgaaggccctcccgccgatggtctaaaaaagtataggtgacggccgttcgtaaaaaacgggcacctattatcttaatgacgtgtgttccggcccgagacaataggtactggtttatagtaataagtgcgaaccggtattaccttgcgatgtgactcgcgtatggttataggtgccgagttttcatataatttcttcatacaaaatcatatgagtataaactttataccaaatgagctagacaagatctataaaaaaactttttgaattaaggtcgtttggacgtttaaaaatgtgttataatgtgctataccacacttgactatgtacatatgattagatgtacagatcgggtttattccattttccgaaaaggtaaaataaaagcaccacatttacaccctacatgttacatgttactatagatatgtagtcattccttattccttcgagataacttctttcctctttctcaatctccggttcgcgaggcagaagcaacgtgactagaaattcatcaacgcaataggaatgagtggtatttggaataaatcgcttagcaagattgtctcggggtggctcgtgctatcaaaacagtgttcattgttttcacataacgtcgaagtggttgggacttgggtgtccactaggcggtagcaataggggaatgaatgttgtgccatgtgtaaaatccggacgaatattaaaataaattcaaatatatttggtcatacttccagaataacaaaagaaaaagaaagacagcgttcaaccgaatagtcaattggaattaatcccgatttgatttaacagtgttatcacattttgatttttttttattcacagcttttggtaggattgaaagtgattcggatagtttctgtccgaccggacattttttcggattcggatagtttcggtcggatacatccagaaattttcgaattcgtatttttttcggaaatgaaaacgaatatgatattggtgatatccttcggaatcggataatggtcggatactatttgatattttccatcagatatccggtattcttataaaaaatatgtttttcttttctctacttaggtggaacaaaacaaaccatataaaaagatacaagagcaattaacatacaaacaaatggaaaaattcaattctgaaaaataaccactcaaattttcaaaaactttcaattcaattcttaaaattttaaaaacttttaattcaaaaattgaaaagtttcggttcgaattcaaaacactcaactcagatttgaaaaattcaactcaaattctagaacgtttaattcaatttcaaaattctcaactccaattgaaatgttcaaccaaaaatttaaaatattaaaccaattttcaaaaatttcaatgtgcctacgaaaatttcagtgatacacattaatttatttgtttcatgataacataaatttgtatggaaagtaagcacactattttctatctcccccttgcccttacaaatagagataaaatttgaaaatgttgatgttttgtttttgaaaactaatggctacatctcttccttgatttaagaagcttactttgaggagtcttgatatttcgataatcattcgttgccgtatttgtttctattcatattctctccgtatctgtattcgataatattcgattctattttcgtatccgggtttccgactccgatttcgattcggagaaaaaaaatatgaaaatgaatatgatagagcttgtttctgaccatattcgatccgttttcatccctagcttttggtgtgctctgttagaaggcgtaataaacgaccattcttttggatatcctgttctcatacgttaacgagattatgccttatgtgtacatagttgcccacactagtacacaacgggtttttctagacagcccagcccgaaacctattttcgcgtgcataagcctgcccctacatatctgccctaaatagtgtgcgaaaatctgattttacatacgggtagcgcatccgcacgcgaaaatctggttttcatgtccaggtgcttatgtcgtccacacggaaaaaaaatccaaaacaaaaataaaaattcaaaaaaaaatcaaaatctagggatcccgtcagcggcggcatggatctggatggctcgtgtgtgcagcggcggcagcaacggcgggatagggtcgtcatggggccgatggctgctcccagccacctcctcctcgttgtagtcggcggcggtggcagcggcgcagatccggccatcgcggggctggtggtgccgctctcggccgcctcctcctccttgtcgtcgacggtggtgccgggtggggacggggatggcaccgctcccgaactgcccaccgcccgctcccggacgctacccgaagtcacgccgtcacccgtcgagccgacacccgctcactgtcagccgctgcccgatgtcgcgccgccggtcgttggccaccgcctgatgcgccaagccgacgcccgcccgcccgctctcggccgccgcgcagccgtctgccctctcctggccaccgtctgctcacggccacctcccgcgccccacgcacagcgcgttcagtggaggagagaggagacatgaggaagagagagatgattgaaaataaaagggaaaaaaagagagaggagtgataataaaagggaaagggagagagaggaggtttaaaaatttggagtgagagggaaaagagaacgaggaggggagaaaaaaaatgtgaaggagagtgaatatttttgcatgcggtacacttaagagaccctatctgtgaaaataggctcattttgatgtgcgggtccttaagaggcctgcatgcgaaaatagaattttgcgtgtgtgccacttaaggagctgcatgcgaaaatgaagtacgtgaccaattacggtctggtttgcaatctaaagtggtgcttgtaacgaaaatttgtttttgtagtactgccgccctagtcatcccttacaaccttaagttgaactggttctgtttcaattgaatagaagagctgatagcttgtttcttcttactgcctgggtgagctgatgtgttccctctttcctgttggctgaggtcctttgagatatgataatggaggggaaactatagcacccaaatttggtttagtcgatacaggcccataatttatcgggtggccgcattgacttacggtagggccattgctattggcagcctgcaaaacaataaaggtcatgaagttttgatttcatgaagtttgaagaaattttggaagtgagaatatataaggactattacctcggtatcagagtcaacattgtccaggtcaggcgtagagtagtaattggtagggatgaggggggaggggggcaagcaggttttttttaacccacttatctcacttctagtttattttttcttttaaattttgtactaccatatgagaagtgaactagtaagcaggtttttatacgggtagcaggactatccacttgcatccctattccctagtaattggtagtggccaagctgaaaatatgggatttccactcagtccaccattggctgaaaagtctcgagcttgatgtgcacggttcaagttataagaattcgtccattgaaggtccttcgattgacgatattcaatcaaattccaggcagcccaggcccaaggccgtgcacgcccccgtatataagcgggggagatgtctccccccagtcgtcgctctcgcctcttgctcaaccctaaccctagccgccacatgccacaggccacagtccacagccatcggccaccgcctagcggcccaccgacccacctccgccgctaccccacccaccagtcctcctccaccgtccaccactcaggcgctcaccgattcgcctcccttcctcttcgtctctgatcgatgccttgcctgacgagggcgacggacggcgtcctgctaggggcatgagggccaccagtgaatccgtcaactctttgtctctggctgccagatcgagggccgcgcgcgccatctctttcccttttgttcttcttcgtcagatccacccccaagtccccaatatccctcttgagtattgtcttcttgtagatccatgagcttattgtcttcaacggcaactccggtgctccggcttattatatttgatgaagtaattgtgaatttgatgaagtgttgatgtatttgatgaagtgaatgtgaatttgatgaagtgattgtgaatttgatgaagtaaatgagagtctcatgagtttgatgtgctatgtacaatattttgtcaaactgagttgttgaagggtctatgccaagtcgtgtttggaccggcatgggcacgatgggctggccgtgccttagggctggtatggcacggcccgggactatttgggctgtgcctaggccgtgcatgtagcctatgggctggaacagcacggcccggcttgtttgttgggctatgccggcccgactgaccacggcccaggccgaacaagccccaacgatacatccgccaccgctctatcctacacatattctaactccaaatccaatacaaaattgaatacacaattttgtacctagcagtactagtatatttgacacattctaatatgagcaatgctacacgtactgaatttttcttactaaacttttactaataatcatctcaaccgtttgatttaagtaaatgaaagttataaaaaaatctagatgcactcatagcatgacacatcagtgttaataagaatataataagaaaaagttactccctccatctacttttgatagtcatatttccaaatctaaaaaatttatttttgataggtatatttcaatccaactacttatcatcttaatgactttctcggatttaatgcgtgactctccgttcttccacacaagattggctacatggacatcgagaaatgtaaatattaatgaatcgcttgtttaaatagatgataagtagaattacttattcttggtctatgtgctaagatgaaatataactattaaaagtagatagagcgagcagtacgtatagccttttccttctaacacatgtagcatccaataaaaagggagctattttaatgtgaattaatgttgataaatagtgcactatgcatgtaaagtagagagacgatgaataaatgcatgctcgctgctctacaaaattgtgtcatccgcctcatcactacacataaccacacgcgtagtggcgcatggttgggatctatgtcctctgtctatctggggttggaaagcaccgggaatcattgatgcacgatgaagtgagatccatccgagcaaatcttttgctaagcaagaatgccgacgccaggaatctcacgggcagggtgacaatggccatgcacgtctccaccctctgctctgacagacatccacggcgagcaactgccggtgcccagtagtaggacgcagggccggccctggggcagtgcggacggtgcgaccgtactggaccttcaaaaattaggggcctccaaaatatgtatactatagtattaggtctgatgggcttagagaaaagacagaagaccaatcgacgatcgagtatatcgtgactgcttgattgtattttaaacttattattgtgaaatttgttaataacaatgagtttttaaatattatcttattttttacggtgaatgggggctttcagtttttttccgagtcagggccggccctggtaggacgcaaaggaagggtagacagagtcgctgccataccagatgtgttaggcagctcgtgagccacgcctcgttgctgcttcttccaaacgagctagtgcacatctcattgagggttctgaagattgaaggcagcaggcagctatcaaacactaacaaaaatattggaaattttatattagttatttgaaaaactgagacccggaggaaagggtgaaaccacaatatcataggaaagtatgtgaggttgatagcgatggtaaaaggagaacataaaagtttagttgtacggtggtctttttttttttttttacacagaaagactaggtattcttaatcgattcagtcatccagtgaaaggaaaaacatgttcgagtaatgtaaacatttcctaatatgaatcatatatttctgtttgttcttcagtttctcttccgactaaaatttgtattttaattattccttgatatatttctctttcgaaacgaaagactatgaaaca

SEQ ID NO: 92059 - DNA, 1157 bp, Oryza sativa
aggggggtttatttcacacctcaataggtgtgaaatatatatatagtttttgatactgtcaaaacaataatttgactcagctaatagcataatattcaatgtccactgaaattcattcaggtaagggagaaacgtgcagaatttgtacttctaaagtgcacatttgtgcggagggcatccgagtttttaaggaattactttcccagtttgattgattttatgctaaatgacaaaggcaacttctcacaggtaaatttagtctagtaattgcagattatttaactttaaccggatcatttttctcaacataattccttttgctttcagagagggcaactccagaggcctgaccatgctgatatgaggtacaaatgcaggacatatgcccgacttctacagttcatcaaggttacatgcaagttgtcctgttgtgaaaaacgatactattttacaaacagtactgttatggctacaatatgtgaaattttgcaccatattctcatgctttatattataatttttttctagaacctggacaagagctgtttgatgcctttacggaaatcttactgccattctcttaacttgttaattcgacgggaggtacaattcttcaaaaccttttttcaattatcatgatatatgttatggcatggcgttagacccaacctattatggattgagcacagttgtggttcattggagtatgtgctttatatgcatgatgacagcatgaatatatggtagatagtaccaacttgctagttgaacaagttgcaccaacatataaaaccacacatttcaaccagaaaatcttcagttaacctacattttcgtcctcattccatgtctgcaagcttattacatttagcatgcatagttcatagcctcttttgtggcatctagtatggaactatggacctatgcagaataaatgggtgcatgggagagataatgaatggaatcttttgtccatggtactatgaactgtacactctatagctccttgggttaattgggccaactccttggattaattgattattaaaccggctgattttttagtgaactgggaattaaactgcatgcatgtccagtatttgtttgcaaccggacagtggcaggcgctgtttcccttttttttggttgaagcgtcg

SEQ ID NO: 92060 - DNA, 703 bp, Oryza sativa
ttcctgcagccctgaagcgcaagtatataatgatgcaagggcctaggcaacctagcaacattatcgatgtctagttcaggccattagtggatgatcttaagttactatgggaccggggtgtgcagatgtgggatgcatacaaaagagagtacttcaccttaagggcaatgttgttcgttaccatccaagattaccctcggctagcaacacatccgggcaaacagtgaaaggtggttgtgcatgtctgtagtgtatgctggaaacaatgagcatgtggctgaggtactccaaaaagaccgtgtacatgcgccattggaggtttcttccagccggccaccactactatagcaatacaagagatttcgatagcataatggaggagggtacaactccaacacaccatgacgacatagccattttttatgaggtaaaagatattgaatgcatatttggtaaggggcatggcaatacaagcgcagcgggtaagggtggtgagaagactttttggtcaccacctgggatgttaagtctcctaagatgtgtaatacatctggtcaccaccttcgtgtggtttgacgggcacatctcaggctggagttgactggcacggtgagtcccagcactatctcttatgcaatttagtgatgaaattgtattcgtgtatgtttacacattgtggagatgaaattcacttgtgtatata

SEQ ID NO: 92061 - DNA, 1017 bp, Oryza sativa
ttttctcacatgtttgaccattcgttttattcaaaaaattaatgcaaatgtataagatataaatcacacttaaagtactatgagtgataaaacaactcgtaacaaaataaattataattacgtaaattttttgaataagacgaataatcaaacatgtgagaaaaagtcaacggcgtcatctattaaaaaaacggaggtagtagtaaatatgttttgaccacctgccaaaatgtctcgactaacttttttagaaaatgaaaatgtctcgactgatgcctctagcatgcttgaattgctcaagaggcgggaggaagaagatgcattggccctcgtgggagtggctgtctacgccaaaatatcttggcggtatgggtttcagggacttggtcatctttaaccaagcgatactgaccagacagggttggcatcttctcacagatccaaattcgctttgctaagggttctgaaagttaggtacttctcaaactcagatatttggtctgcccctaaacctcgatctgcctctttcacctggcgtaatattttgtttgggcaggagttgttaaagaagggggtgcactgggctgttggtgatggttcatccattaagatcacgatggacaattgaatacttggtgtgcaagcaggaatatatggtgaatacccgcttccctatccctgatgatgttactgtcaattcgctcacactggtggagaaaggggatttactcctggttcgtaacccccctgtagtcccggttttcaaacgggactaccaatccgggactaaagatcactatcttttgtcccgggtgaaaaaatcgggagtaaaaatacatctttagtctcggttggttgttaccaatcgggactaaagatagagcctttttagtcccggttggtagagctagcctagctagatccggttgctctattattagtttcttttcttcattgtgtttttaatatattgatttcactccatccccatcccaaaatcccaaataaattatcccc

SEQ ID NO: 92062 - DNA, 742 bp, Oryza sativa
ctggccaagaaaatgaactagtaaggaataaattaagtgttccaattttggaaaaaatgaaacaactagtgctagagtcagaccctgctaaataaaatggatattctagtctccaagtcatctagcaaaacatgcacatatcctgcaacctctgccttctgaccagaaagatagcgatctgttatgccatgcattgatatacaactcaatggatctagcttgaatgcccagtcaactatagcatagaagtcctcctgaaaaatataagatacaaaacatgtgaacttgtgaagccccatttcctatcacagcgatttcattttatcatttcaacagttcatatagtaggataactgtccaatttacaaagggaaatgccaaaaatatcaacctgaataccatcaagcaactcttgaaggaattggtttagtactcccaactcagctgaactgttaactggaaaaaagataagatgttaaatttacatcacactgaaagcaagaagaattaaagcatgcaaggagcactattagtttaacagttggtggtttatattacttggtttggcactgcttccaggaggttctgaaacagcaacaggattattgttatctgattcatctgacggagctagcgcagcaacatcaaagcacataaaatgtgcaaagaatgagctctacatcatagatatccatcaagagaaaattgaattgtaaacaaaactgcattttgcactgtaaaa

SEQ ID NO: 92063 - DNA, 2526 bp, Oryza sativa
gaagcgcctcttttctgagatccgggaggtgaagggggagctggagagcatccatgccttcttgcaggcagccgagcggttcaaggacgccgacgagacaacctccgcgttcgtcaagcaggtgaggagcctcgccctgagcatcgaggacgtagtcgatgagttcacctacgagctgggggaaggagacggccggatggggatggcagtggcactcaagaggatgtgcaagatgggcacatggtctcgcctggctggcaatctgcaggacatcaaggtcaacctgaaaaacgctgccgagaggaggattaggtatgatctgaagggcgtcgagagaggcgcgaaatcgatggcgggaaggaggagctcaaactggagatctgactctgtactcttcaagagggaggatgagcttgttggtatcgagaagaagagggatttgctgatgaaatgggtgaaagatgaggagcagcgccgcatggtggtcagtgtgtggggaatgagtggaatcggcaagacggcactggttgctaatgtttacaatgctatcaaggctgactttgacacctgtgcttggatcactgtgtctcagagctacgaggctgacgatttgcttaggcgaactgctcaagagtttcgcaagaatgatcggaagaaagacttcccaattgacgttgatatcacaaattacagaggcttggtcgaaaccacccgctcttacctggagaacaaaaggtatgtccttgtcctagatgatgtatggaatgcaaatgtttggttcgatagcaaagatgcatttgaagatggcaatattggccgaataattcttacatcaaggaattatgatgtggcgttacttgcgcatgaaacccatataattaatttgcagccgttggagaaacaccatgcgtgggatctgttctgtaaagaggcattttggaagaatgagataaggaattgtccgccggagttgcagccctgggctaataattttgttgacaagtgcaatggcttgccaatcgcaattgtgtgcattggacgccttctgtcatttcaagggtcaacttattcagactgggaaaaggtgtacaaaaatcttgagatgcaactaacaaacaactctatcatggacatgatgaacattatcttgaagattagtttggaagatctaccgcacaacattaagaactgcttcctttattgctccatgtttcctgaaaattatgtgatgaagaggaagtccctagtacgactctgggttgctgaaggatttattgaagaaactgagcatagaacacttgaggaagtggcagagcattacttgactgaacttgtgaaccgatgtcttctgttgctggtgaagagaaatgaggctggacatgttcatgaagtccaaatgcacgatatcctccgtgttttggctctttccaaggctcatgaacaaaatttttgcattgtcgttaaccactcgaggagtacacatcttattggagaagcacgccgtttatcaattcagagaggggattttgcacaacttgcagaccatgcaccacatcttcgatccttgctgcttttccaaagttcacccaatgtcagttcgcttcagtcattaccaaagtctatgaagttgttgtctgttttggatctaactgatagttcagttgataggctgccaaaggaagtgtttggcttgttcaacttgcgttttctgggtctcaggcgtactaaaatctccaagcttccaagctccattggaaggctaaaaattctgctggtgttggacgcttggaagtgtaaaattgtaaagcttccattggcgattacaaaacttcaaaagctaacacatcttattgtaacttcgaaagcagtcgttgtttctaagcaatttgttccttcttttgatgtgccagcacctttgcgtatctgctccatgacaacccttcagacattactactcatggaagctagttctcaaatggttcatcacctaggctctcttgtggagttaagaacctttcgtatcagcaaggtgcgaagttgccattgtgagcagttgttcatggccatcactaatatgattcatcttacccgtcttgggatctaggcagacagtagtcaagaagtgctgcatcttgaatcacttaaacctcctcctctacttcagaaacttttcttgcaaggtacattatctcatgaatcattacctcatttcgtgtctgtaagcaatctgaataacctcacgtttctacgtcttgctgggtcaagaattgacgaaaatgcattccttaatcttgagggattacagcagttggtaaagctacagctttatgatgcatatgatggaatgaatatatacttccatgagaactcatttccaaagctcagaatactgaaaatatggggtgccccacacctgaatgaaattaagatgacaaaaggagctgtggcaagcctaacagatctgaagttcctgctctgtccaaacctgaagcagttgccttgcggtattgaacatgtgaggactct

SEQ ID NO: 92064 - DNA, 504 bp, Oryza sativa
acaggtttagcaagcacatgacgcaccaggagtatatagtacaaacatacagatggaacatatttatggcaaaatttatgtacaagagcggccatgtcttgttcatgaaagccgcgctaagcgccaggcggcgcagcctgtaaaggaaaaataatgctggctgtcatgctgttaagagagaaagaacatgtgtgaaagagcaacgaggacatcaccgcctgtagcgcagcggatagtatctcagtgtaaactacgtttcttgtttggtttccacatgagccatcatcattctggataagcactcttaaacctgatcggcttgttgctcttgaaaaggcaacatagagctggccgtgcatgaaaacaggctttgtaaggtatacgccaacttggtcaagtgtttgcccttggcttttattgatagtcatggcataacatacgcggactggaaattgccttctctgaagcgtgaaaggccattttactttcgatgtgctcagtgtg

SEQ ID NO: 92065 - DNA, 812 bp, Oryza sativa
agggcctcctcctcgacaccgtcggcggcgccgtcgccttcctcgcctccggcatgtcgccgcgcgcctccgtcgtttttttctcgctgtgcacggcgaagggcgtcgacgacactgcggcctgtggctgccggcggcgagcccgctccagcgcgtgttccggaacaacgccgcctaccacgacgtgcaccatcagcgccgcggcggccggtacaacttctcgcagccgttcttcgtgacgtgggacaaggtgttagggacgcatatgccctacgtggtagaggagaggcctggaggagggctccaagtgcggccggtggccatgtcgccgtcgtcggcgactgcagcggcaggcgccagcgggaaatgaaacttaaactgtacgtgtgcgcggtgaagggccaccagctgactccacagctttttcaaaaacaatgttcaatttttttctcaaatttaaattagttgataattcgttcattagagggttattttcgttacacgcattttggacccatgtaaacttcatcttcattaaaaaaagtatgattgtactgtattacagtacttccaactattcaaattacactactacaaaagtgatttttctatacgaaaccccttgatttttacaaattgaccataactagtggcgtctgcaaaaaatcgagctgcattttcacagacggctcctttaagacgcccatatggaaaaatcgattttcccatacgagcctcttaagaggtccgctcatttttgtcggacgaagaaatgatccaacctaaactgtacgtgtgcgcggtgaagggcc

SEQ ID NO: 92066 - DNA, 729 bp, Oryza sativa
acggtattcctttctgtggaggaatcaaaacaggaggagagctaagatactccttaatattatccaaagccatttgctgctctgccccccaagtaaactgctgatcgcctttcaacctcaataacggtgtaaaaggctctaaccttccagacaaattagaaataatccttctaacaaaatttatcttgccaatcatctcttgtagttctgtcttattctccggaggctgaatcttcttgatcgcattaacgctcctttgagttacctcgatccccctttcatgaacaagaaatcccaaaaactggccggtcgacacaccaaaagcacattttgtcggattcatcttcaagccatattttctggttctctcgaaaactttccttaaatcggctatgtggtcctctacttctctagacttaacaaccacgtcgtcaatataaacttcaactaaccagccgattaaatcatgatatatataattcatggccctttgatatgttgctccagcactcttcaaaccgaaagtcatgacgacccactcaaataagccgattgcaccagggcatctaaaagctgtcttatggatatcttcttcagccataaagatctgattatatcctgcgttcccatccataaaactcaaaattttgttccctgatgcagcatcaaccagctgatcggctactggcattggatattcgtcctttggtgtagctttattcagatctc

SEQ ID NO: 92067 - DNA, 528 bp, Oryza sativa
tttactaaaggcattcgccacgaggacctagtcggcaagttcggacgcaaacctcccaagacggtcaagcagatgtttgaaaaagtctatgagtatgccaaagccgaagatgctatcacggcgttcaagcagtcgggcatcacttggaagccaaagaaggatacgccgaccgcaggagggagtggaagtaacaaccacaaggatcgcaagcgtaagcccgaagaacttgtggcaacgacctctccgtcttcccgacaacgttcccgcgtcaacaccttcgacaagataatgaactcccaatgtccgcatcatcccaactccaaccacgtggccaaagattgcttcgtctacaaacagtttgcggagcaatacgtcaagaacgcacgtaagccctcagacggagatcaaggcacatcaaagaagaaagatgatgaagacgatgccccgactggttttcaagatcatcgcaaaaactcaatcacatcttcggcggacccctgacttatgaatctaagagaaagcagaagc

SEQ ID NO: 92068 - DNA, 559 bp, Oryza sativa
tttatcgggaatgcttcacctgggtggagaggaattgaacagggttggagctactcaagaaaggaattatttggcgggtgggtaacggacagtccataagagtatggcgagatccctggttaccgagagatattccagacggcccatcacccgcaaaggtaattgttgtatcaagtgggtgtcggatttgctacaggatgatggaacttggagggttgataaagtgcacgaacacttttggccgatagatgtagaaatgatcctgaagattcgcacctcagcttcacttgaatccgattttttggcttggcatcctgatagattgggaaaattctcggtcaggagtgtgtaccacttggtcgtttcgcttgcagagaccggtgattgctccagttctacagaggtgctagtaaataaatcttggaagcgtatctgggcgtgcaatgtcccacaaaaagtcagaatcttcgcttggaaggctatatctaatagtctccccacgatgaagaacaaaaagaagacgaatctggagttgttgagcacttgctgcatatgtgga

SEQ ID NO: 92069 - DNA, 4071 bp, Oryza sativa
tgacaatcatcttggtggcgagataccggcctctctctccaacctgtcgaagctgcagacacttgacctgtcgtccaacaatcttaccggcagcatccctgcttcattggctcaaattccaggcatgctatcactcaatgtgtcacaaaatgagctcagcggagagataccggcaatgcttggctcccgctttggcaccccgtcagtgtttgcttccaacccgaacctgtgcggtccgccattggagaacgaatgcagtgcgtaccggcagcatcggaggcggcagaggctgcagcgcctcgctctgctgattggtgtggtggctgctaccgtgctgctgcttgtgctgttctgctgctgctgtgtgtacagcttgctgcggtggaggcgccggttcattgagaagcgagatggtgtcaagaagaggcggcgcagcccgggacggggcagcgggtcgagcggcacaagcacagacagtgtcagccagccgaagctgatcatgttcaattcccggatcacctatgctgacacggtggaggcgacgaggcagttcgatgaggagaatgtgcttagccgaggccgccatggtctcgtgttcaaggcttgctacaatgacggcaccgtgctggcgatcctacggcttccttccacctcatctgatggcgccgtggtgattgaggagggctcgttcaggaaggaggccgagtccctcggcaaggtgaagcacaggaacctcactgtgctccgtggctattacgccgggccgccgccagatgttcggctgctggtctatgactacatgcccaacggcaacctcgccacgttgctgcaggaagcgtcgcaccaagacggacacattctcaattggccaatgaggcacctgatcgccctcggcgtctcccgcggccttgcttttctccaccagtccggtgtcgtgcacggcgacgtcaagccgcagaacatcctcttcgatgccgacttcgagccgcacctgtccgacttcgggctggagccaatggtggtgacggctggtgctgccgctgctgcggcggctgcatcgacgtcagctacaacaacagtcggttcgctcggctacgtcgccccggacgccgcggccgcgggtcaggccacgcgggaaggcgacgtctacagcttcggcatcgtgctgctcgagctgctcaccggccggcgccccggcatgttcgccggggaggacgaagacatcgtgaagtgggtgaagcgtcagctgcagcgcggggcggtggccgagctgctcgagccgggcctgctggagctggacccggagtcgtcggagtgggaggagttcctgctcgggatcaaggtcggcctcctctgcacggcgcccgacccgctggaccgcccggccatgggcgacgtggtgttcatgctcgagggctgccgcgtcggcccggacatcccgtcgtcggccgacccaacctcccagccatccccggcgtgatcgccggctcccctcggccggcggcatcacccgatccagtccactagtgttgttccatccattttccgctaattctttcttctttagttcagattagtcttagcttcatccagccgcggggtcaaaactgacatgtgagcccgggagcaagaacacctgcatttcccgccaagcagaccagaggcttggccccaagtgggaaagtagccgttgagccccttcctaatctcgcggttagtggaggtgtcagtggctgccggggaagcaaatcaccatgtggactgatgcttgcgcggcatgttgcggaggaggaggttggtggtggtggcgtcgtggactcgcgcatgtggggttccccatcgcaacggctactgatgctccatctgttcttggctgctctgtaccctgtactcccttctctctctctctaggaaattgatttcgtgtaggggggcctgcttggcttcttcggatcttgtcttttattaatctccattttttaccatgggcttagatcttttgtaatgttgtgatgtacatcttgtctgtattttgttatcccaattggttcaagaggatggtgggggatgaatgatgcttcatactactagccgttaaatctttttttcccctctgcatggaatgatttgtgtatggcagtatctagcagtagtacatccaaaatactctgtgcacttgttttatccactgtatgattagttggggaccctacctatctatcggatgaatggatatatattactctgtggtcaccttgtttttctttgtcaattggagaaagaaatggttgaaacagtgtattataggcttgactggccagcaatgctgaacgtttgcttggcagttgaggagatcttggtaccactgtacttggtttgagccccagaggcccccttaatacttttctttacctcctgaatccggtcatgtgcgccattgagtaataattagcacctgcgttatatcagtacataaatgcattaaatcatggacttcaaggtgcgtaacgtacactgaagagcacgacgttcgtggatagaccatctcaatgtatagcagtgaatgagccttcaatttggccgagatggaaatcatggaatacagtcagcccctctttccctgtgtctcaatgctgcttgcttgtttttccggaatagtaatttcttacgagcatcaggcggcaggggcccttgctacatttcggaatccagatcatcgcactgaaattttcttcgtcagggagggcacgggcagattggcatgatacgatgacgaagtgcaggctgccatgatcacacgcagcactgcgcgactgcacgaacacacttgaaaagctcacaccgtttttcaggttcggcgcaagtactgtagtagtcaacagccaagcaagaattgcacaattagcgcgcactacgagtctacgattcctctccttttgatctctgactcaccttgtcctcaagcgtgtagacctgcctgtaactcgggataccacatcaaagtttaggcattagcaatcccggatgtcgatacttctaacctgagcagagagaggccgtgagtagggggagagaatgcaacccatggcgtcttgtcaacaagatggcatcaatagtcgtctatcctagtgcctagacctgaataaatcctgaacaagtagcatgtggcatgtataaaacaacacgaggcaaggcaccaactggcaactcggccatcctgttgcgtttgcgcatacatcaccgtagagcaccagggaagattaattactatagctgtaaacttgtgctaacagaatgggggaggataactgaccatgtattctggctgcaacggtggtcagagagaaagaccaccaacaccaggcgtgaaatttgcactgaaactctgcagaatgctgtaaattttgctgtagaggtacagaaaaggctgcatgccgcatgctgaattattggggagccaccagcccgtgcaatcagtggcactgtaaatttttgctgcaggggagtaaactactgagttcactcacggactggtggaaccgaaatcactttggcagcatgttttcctctgtaaccaggggacactggctttctgcatgattgcaacagtactatatacaattctggatggaacacagacgacatttatgtttcggcatgtgcatacttctgttgtcacaatttcacagattcaagctagagtgtttttactactctcccatctcgccctgtcccggcctacatccaagcttgaaatgctcacgttggaatctcttgaaagatgaaatggcccatgtaaaacagtacatttacaatctactccagtcatggaagagaacagacatctatgtcctcctagttctcatattgttgcatgctcaattattgtttcattgagcattgtttcctaccatacacacacctttgcatcattgctgccctactttcttcagtagtttgaaacctttctgcgccactagctcctaattccaaaaccaagtctagtatggtgtactctagatcatcttggaaacttggaaattggaagcacgtcctatgcattcgcatctt

SEQ ID NO: 92070 - DNA, 673 bp, Oryza sativa
ctgcagcccatcgcccgctatccgaagggcgacaccaccgcgatggtggtcggcaaggacaacaaggttgaggtgggcccggtcaaggtcagccgcacggtcggtgacaagtggctggtcgaggacggtctgaaggccggcgacaaggtcatcgtcgaaggcctgcagaagatcggccccggcatgccggtcaaagccaccgagaagggcgctgcgccggccaagccggcggcggccgcccagcctgcggccccggccggcggcgcgaagtaagcggagaaccccatggcacgctttttcatcgatcgacccatctttgcatgggtcatcgccatcatcatcatgctcgccggcggcctggccctgttcaagctgccggtggagatgtaccccgacgttgcgcctcccacgattacgttgaccgccatccatcccggggcttccgcgcgcaccatcgaggaaacggtgacccagatcatcgagacgaagctggttggcattgatggcctgcagtacttcacctcgcagagctactcctatgcgggctactccaacgtcactctcgtgttccacacaggcacggacttggatgcggccctggtgcaggtccagaaccgcgtacagcaggccatgccggcattgcccgaacaggtccgcatgcgcggggtgagcg

SEQ ID NO: 92071 - DNA, 613 bp, Oryza sativa
gcgatcgtgctgaccccggcgctgtgcgcgaccatgctcaagccgctgaagaagggcgagcaccatgttgcccatcgcggcctggccggtcgcttcttcaacggcttcaaccgcggtttcgaccgcaccagcgaaagctaccagcgtggcgtgcgcggcatcatccaccgtccgtggcgcttcatgggcatggttgcggcgctgttcgtgctgatgggcgtgctgttcgtgcgcctgcccagcgcattcctgcccaatgaagatcaaggaacgctggtagtgctggtgaacggagtggcgggatcgacactgcaacagaccacgcatgcattgcaggcggtcgagcactacttcctggagagcgatcccatggccgaggcgatgttcacggtcgccggctacagctactcggggatgggccagaatgcgggccttgccttcatccggctgaaggactgggcgcgacgcggctcagccgacaatgctgaagccatcgcactgcgcgcaacccgggccctggcaacgcagggaatggccgatttccacgtgctggcgccgcccccgattcccgcgctcggcaatgcatccgggttcggcttcttcctcaaggatg

SEQ ID NO: 92072 - DNA, 9183 bp, Oryza sativa
atcgtgtttgccgtcaaattcaaaagctgtgcgggatctttctttgattggagctaaccggctttttatgaagtgccgagtgatttgttctccttgcaagccttgctctttcagctttatcatgcgctccatcagttctactgcttgggcagcctcatcccctgtaggcaatgaattccatgtgtcttggtacaccggaggaagacaagagtactcaggaaggactggttcaggattttgaacatagaaccagttggcgtgccagcctttgttcgaggtcttgaagggcatggagaaatatttttggcttagtgttcccctgagttgaaaaccaacgcccccaacaacacatggtttgctcttgtttggctgaggtttgaggaagaagatgcggcataacaaggcgaaatgtggcctaatacctaaaaaggcttcgcaggcatgaatgaaattggcgatgtgaactatggagtttgggttcagatgatgcaggctgattccatagaaattcagaattccccgaaaaaatcttgaggttggaagggagaaaccgccatagaagaaatgagcaaataccacgatttcatgcgtatcgggggttgggaatgcttcgccgaatgccggtcgccaaccgatgatctccttcgctggaagaacgccgtgcgccaacatctccttcagattatcttccgtcacatcggagggcgcccactgactctcaaagctttctctttcttccgccatgaatgtgaactggatggtttaatttggtccgagatatggctggaaagggatgaggaatcagagcggtggacgcggggagaaatttcgtgaatggattggggcggattgatgaaccctagtttggccggcgcagttttgtactgtagcaggaaatggggaaaatggcgagagtctcggcggggaagacgaagagacgttttctttcacttcggtgttattagggtatagggagtgctaacaggcctgggtctgtacagtacttcagcccaatattattaccagcgtggcccgttgtgatccttagggacttaggcgctttttgctttggcagtttgtgctcacaatgatgtggcccaatgctgttaaaatcctttttaatgtggtttgataattctttggaattaacacgatgcaaacaaaagatgtccgacaggaaggtgttatactatttttgtaagccttattaggctgcaaaagctgtttgggttgattcgagatgacttatttattaagagtcattctcttagcatgttatatgcttaatttggttacgatgagggttatagcttaggctattagactcgttgattaccatgatttttatcatgtttggtggatcattttaagagtttcttactcgtagtcctatcaaatgtgtttatttttggaccttttgagtgtttatcactcggcccttttcgtattttttatccttgatacgttcaagttgagaaacagtcggctgggtattttactaagtaccatgcatgcttcgctataaaaccactcggttcttgactacatgtttagtttttcaactaatcacatagtcaggggctacacctaattaggtgcatctactcgatgcaccatgttttattttcgcccttcgcagtctttgattttagcactcggcaagctagagcaagttgaattgaagcactcggattactgttttttgtttcgagaaggctattttgtcaactgcgaaggtctcgggggctactgtggagattatggataccccatatctacatgacagttataatttagtcggatatacggtaccaaatatagatagaatatctttacgaggactcgggttagtttctaacttgtatgtcaaggaaatacccgaaatcttagtcggttacgattgtattttatctgtgattccatattttgttaagatatggactgtactttgtaaagcggactccttcccctatataaggaggttccgtgtgcctctcggggcacggttcttttttcccagtttatacaatcaataacacactcggcggaatcatccccggacaggagtagggtattacttcttgaataagaaggcctgaacctgtataaaattccttgtctccaaacccatccactttccaagcttgatagccacctcttttattattgccgaaatcttgtttcgacaagcaacatcgttgcacagacaaatttcgcatttcacgcactcttcaaaggtaacagaaccaattcgacccaaaaggagaacaagattgaacggtgcatcgtacttctgagatcgggacgacggcctacctctgcgtccccacgacgcggcttgtcgagccacgttgccggcgacgacgctggcgtcgccacgttctcgacctgcttcgcctcctcggccctcctccgcttgttccacaggacggccgcgctcgccgccacggcgatgccgacgcagaggagcagcaggtttagcaacgtccttgccgcccacgggtacacgcggttgctgttgccgtcgacggggtatatgtacaggcgctgcaccgcgccgacgagcaagaggaagatgaagaatgaggaggagacgacggcggcgagccagagccagccgttgtggccgagcaccggggcgatgggcgcgtgcgacggcgacggcttgaacaagacctcctctgcgggcaccttgtgcgcgattgcgacgacatcgcccgcggagggcacgctttctcgcgtcacgaaggcctcgatgcgcagttcgaggcgggagatgtcggagaacccaccggaggcagggacgatgaggtccagcatggccaggtcagccgacgtcttgaacacggcgatgaggagaaggctcggcgtcgcggcttctgccgccgtgccgctccggtgaacgagctcgcgtatgacggagatgaacggcgtgatgccgccgccgccactgatcatcaccaacgagtcgtactgaaggaagcttgctggtgtggcctggctgtaaggcccctcgaccgagacgtcgaggtgcccgggctgcgacggcggcagggacgagatcgtctcgtacagcttctccgtccatcttcctgctctcttgacgacgacgcttaacctgtcaggctcaaggctgctgctcgacgtcaccgtgaatgggtgccattggagccgcgaaacgcatgggacgttgatgaacaccgtactcatcggactgtgcgtcaaatctgcaagtgatcacgacatcaagtgtcagaacatgcttacttgcaccgtgaacgtgtcggatatatgtgacacctacgggggcttttgcagaagttgagctcgacggcgtcgcacgctaggaggcgggcggagacgagtcggacgcggacgcgggactgcaggaaccggaggtagcggtcgaccatgaagaggaacacgccaggcaggatggagcagaagaaggcgacgccgacgtggagcgcgaagagcacgaggaagagggcgtagaggtggtgcgcgtagaagaagagctcgaacatctggcgccggacgcgcggcagcgccgtcacccacatcaccagcccgctgagcagcgcgagctccccggggacgtttgcaactttcgttcttgtccatttcagcatctggaatcacataattggccgtttattaagtcccgacattggacatgtctaggacgatagaagaaatcgttagtttgtattacctcgtggatttgatcagtcgatgcccagaagacgatgtagcagagtccatgagctgtgaagaagagcataacgagattgcccagccagacatggtacttgatgctggcttccgacgtgaggccaatgagcggcaacagggacgagccgcgtgcgactggaaagaacaggaacgcgcagcagaagctcccaacgtggccaagccgcagcgctgctctgtccagcttcgcctgccacctaagaacatttcgcatacttacaaaagttagcacacaagtaaattacagatcatagatgaaacatatacgagtattattttgcttttttttttggacggagttaatgcatggttatcgtgagttggtcgacattttctcgacaggcttgacatggatcttggagaagtcgaggttgatgaaggcggagtaggaccagaccaggagtgccaggaacaagagaaagaaggcgagttctatgcctgtcacaattcccagtggacctctcaccagcacaggtctcctccaggccgccattctcgtacagaatactcctctgcaggaacaaaatcaagagaggaacacgcagaaaatttgcattagtactagtacatttgatgcggaatgtctgatgagattgatctcctctcccagtttagccagaactgaccgtacctctgactttggaccccagtactgtcgccgctcctcttcagcaagtgcaggtaaatgcacgcaactacactgacaaacagtattggcaaagtcagtgtagttcacgattcagacatgcacaggtattgggaacacgtagatcacgattctcgtccctgcaaatcccgaaacgaagaacacgaagagatgatcacggcggcaatgcagatatgcagtggaatggatatacagctgagctgatagtacaagagatggggaaaaaaaccttgtttgccaaagtaggtggaatttgtgtgggaggcgagcgtcggcgcccacgtcgagctgaatgtcctggtcggcaacatgacccacatcatgagccacccaacgaacacggcggcggccaggagaagcatggcgctcctggtcgccggcgcgccattcctgtctcggccatgcctagtgtccatcgcgtcgataccctgcgcttaacctgttaattaaccgctgtatctggtcaggattagattgtcactcactgggacacaagtcacacaagtaaggacgtgtgttgtgcttatataggaagaacggacggagagagtgagctgcacttttaatgcgaaatgataccgaggagatatcccttgctgtaatgctgtcatttgccatatttatgaggtaagatttggttgtggagatggcaataataactctttcgattcatcaattggcatggactgacgggggtaaagggtgtacagtgtactaacacactgggaaatatttaaccgagtgctgcatgaatatttttggaggggcatgaaaaatgcatttccgtcgtttatctctgtacggatatacaggttggatttctatcttttaactcgtgaaaaagaaatctgcatactagagaaatactaattcgataggcataagatatatgttttcattacacagtgtcgttgttctaggctgtgtgtttagatctaggggtgaaaatttttaccgcgtcacattgaatattcagatacacatttgaagtattaaacgtagtctaataacaaaacaaattacgtaatccgcctgtaaagtgcgggacaaatttattaagcttaattaatccgtcattagcaaatgtttactgtagcaccacaatgtcatatcatagagcaattaggcttaaaaaatttgtctcgcaatttacacgcaatctgtgtaattagtttttctttttatctatatttaatacttaactagcggggtgacccgcgcatttgcgcggctagcacccaaacaaaatcatatatttttcagtatgattttacttaaaatttattaaatagctatgtcgttgtcttaagactttaaaagaccaaaccttatcatcctcgtatttctaattatatagtttttaaaagtcacaccagctgctacctattacttttgtcataccgttatttatttgcttgcttgatttctatttattctccttgaaaccttatactgccattatactctacggcccgtccacggtcttttctttgtattgtcattgggattttaaaaatcaaacataattattattggggttcattttttactttatagaagtcccaccaaaccgtcagcggttttgctattgcacacctttgtggctcacccgctgcctcccttctttattgtcactgagattttaaaatcgaacacgattatcatagttttttttactttttagaagttacaaacctttaaaaattagtcattatagtttttagagtttattgttcattatagtttttagagtttattgtcttgttgtgtttcttttttataatttttagaagtcccgtcaaacgatgccactatactcctctacggtccatccgccgcctactctttattgtcattgggattctaaaaatcaaacgtaactatcgttggaattcattttttattttcttgtagtcccgccaaccgtcggcggctctgcaactacactcctatacatcccgcccactgcttctccttgtcattgagattttaaaaatcgaatataattatcaatggggtttactttctttgctttctagaagtcgtagaaaccgccttgcccgttagcttcacgggcttatcgtttctccttttaatcgtcattaagattctatttggtgttttattaacctttttatatgtcgtattaaccgccaccactctactcttttataggcgtgttatttaatttatctcgtcatgtgttttagatggtctttttatttcaatagtctttattttttatcaccaattttagttatttataaattttattcctaattgaaatctttttttctttttttctaatttcagaatttattttttatttttgaatttaacttgtttcaaaattttattcctacttgaactcttttttagtttttctaactttgaatattattttattttttattctgaattttaattaatctcgtattgggttcttatatagattcttctttcaatatggttttatttttaattccgaatttcatttaattttaaattatattcctacttgatctcttcttttctttttgctaattttggattttatttttatttttattccgaatattaattaatatcgtattgggttattatatcgactcttctcttaatatcccttatttttaattccaaatttcagttatttttaaatgtattcctacttggactcttattttcttttgtaattttggattttattttatttttattccgaattttgatcaatattggattcttatatggactcttatctcaatattgattaattttaattccgaatttcagttatttttaaattgtatttctacttggactcttcttttctttttttccgattaatgtgggaatttctagcccccacagcgaacgtggtgtcttctttcaaagttgttttaataatatactccctccatattttaatgtatgacgtcgttgattttttttgtccaacatttgaccattcgtcttatttaaaaaaattatgaattatcatttattttattatgacttgatttgtcatcaaatgttatttaagcatgacataaatattttcatatttgcacaaaaattttgaataaaacgaatggttaaacgttggtcgaaaagtcaacggcgtcatacattaaaatacggagagagtaatagatatatgtgtcaaacatttgatgcgataaagatgaaaaaacttgtcagggtctaaacaggtccctagtccacttgcgttgcgtcgcgtcgggtccgctccttttcttcctctcctcccatggtcaactgtgatgctagtatggtacagtactatacattgctactcgcgagcgatgtgtgactcgtgcgaacgagacggcaggagatgcaccgaacacgtacgcttgcaccttgcagggccgcgaccggtgcggtgaagatgggacaacgaaattgcgccgcgcgcatcggctactcggcagacgacgaccggataaggagagcaacggtggtggtggcactgtgcggtggccggtgtagtcactgagaggcgaaagaggaggccggaaaggggcagggcgacgcgcactcggcgccgcgtgacgggggcgcggcgcgcacgcgccggcctgcgccgcgccgcgcgccgtgccgagctgccatgcgacgctggccggcacggtggaacagccgcgccaccgcggacacgccagccaggcacgatattgggcctcaatttcttctttatcaacgacatcggcccaaatggaggtacagtaatacggtccacaaagcatagtaaagctgcacgtgttgtagtacagctcggcctgcaccagggctcgatggaagcctggaaggaataataagttcagtagttgtccctaatctttacgttgagcttacttggtatcctaaactacaatatcataaatcttcaaccccatcttaacaaaaccattcgagtcaagtgccatgacagtatagatgggtggttttactaacgtagtaacgtggcatcctagttgaaaaaataaaataaaaacatgtgggacccacttaaagtggcatacatcttcttcctccgctcctttctcttccacaatctctttcgatcgaacgcaacatgcgtcacgaagcacaataggtgagctcgttgtccgctcgtcacacaccgacggccccctagcgtgcgaagcaaaggggcttatgctcggtccctgatggcgaagatagaggtgatatgaccatcagcaacctcacaacggtgcctctccctcaacgagcttgtcaccatttctaccatcgagcacaatttttcttgtagagaataaaaaagtgggtgctaacggctaacatgtgaatcccacttttttttatattcttttccggactagggcgtcatgtcaatgaaaccatccatccgtactatcatgagatgacttgaacaaattttattaagataggaggtgatgattcaactatagacttaaactttgagtttatttgctgtggctgggtgttggtacgttggtgtgtcatctttttatttatctttgtttctgtctattatatttttcttataagattgatccaagacctagggccggtcctatgattttgagggccctatgcgaactcatcgcgatgggccctctaagctatgtataaaattctatgatatatatagacgctaattttacttgcaaaaacaaaaacaaatacatccatatatatatatatatatatatatatatatatatatatatatatatatatatatatat

SEQ ID NO: 92073 - DNA, 519 bp, Oryza sativa
catggggacatcacacaagcccaaagagagagaacattaaaaggattccgtgaaggccattttaatattttgattgccactgatgttgctgctcgtggtttggatatcccaaatgtagacttggttagtgttttccttgattattctgctcttctaattttgtatgaaatagctgtttctaggttggttttctttcgctgtgttttaggttgtttttttttaaataaaaatagcaactacactttgtgttgaacagtgcttgagtgacttcccttccttttacaggtgatacattttgaattgccaaactcctcggaattgtttgttcacaggtctggccgaactggccgtgctggaaagaagggtaaggcaattgttatgcacagctatcaacaaagtagagctatcaggatggttgagaatgatgttggctgcaaatttacagaggtaagacttgattgtatgcaaatgcaaagctgagagccaatgtatcttagcatatacagctttctatgcaag

SEQ ID NO: 92074 - DNA, 8695 bp, Oryza sativa
aaaaaaaacaaaatcagctctaaatttaaagttgaaaattcaaaagttgactgataagcattagcattagcgaaaagataaggccgtatacaaaaaaaaaaaaaggtgctactccctccagttccaaatttcatgtcgttgaagaaattttgtgggtagaatgaaaatttctgtcgttcgataaattaatgaacattttagacgagtccaaatttcctgtggacccaatgaaaatttcacttgtcgaatatattaattaatttttcatatgagtatactactgaggtgagtttggttgggtgaagtttttaaggagggattgaaagtttagggctcattcagttcagaggattttcataggattattgtacgaattgaaacattaggagttcttttctcatacgcatcattcattccataggaatggatcataccaaattcctaagaattgtagttccaaatttcataggattcttagaatgaggtaaaacctctaggaaaaattcataaggaatggagtgcatgtgacatcttagttttttttctattcctttgatttggaaatcctataaaccaaataagccttagagggatagggttattaacggtttttatcaggggacatgtatggattgaaaattgtggaaggaactcgtgtttttaactacctaggtaggtggcgagagttgggaagaaatttcttatttacgtgcctaaacaaatctctaacatctaaatgccttgtcatgtgcactacctttaccaaataaaagattggcgaccttatagaaagggattgggagtttaaaggagagaattggtagagaggttggtcatggtagttttatttttactccttgtccctggttaatgctgctgtggtttctacttcccagtgagaaatgccaagttcaaaaggcaagttcaaaaggtatttaatataggtaggacagaaaatagacactaattaattgctcctcgataaataagatcatgttcaaaatgaccagaaatatggacaataagacaacacataattcacatttcacaattgattcaccataagaacagcatgctccattgatcaatccaaatgttcagacataggttcaattaccatcatccatgcattaaaatgctatagacataacaagtggaccaccctcacacggttttattattgtggttttgattctttcacaagcttttacataacaagatcatcagcaacagcgcagcaaagattcttcaggttctcgaatgcgccatcttggagtgtgactgacgccattctgttggaaatttcattctcagaagctctgtcaaaatcgtacttggcgcgataaatgaagtagccactgcactcccaggcagaaagacaacatccagtagccagattcttcacctaaagccaaagatattaacagtattcatcctcttattggttgctgaaacaaaaaaagtttgcaaaggaaacactgcagatcaacgagtttcacctgtggaaacaagaaaacctttgtgccattgttggagatcagcaggctgtacgcagtattattgtcatgcagagttaaagatacttcactgacaaaattggcaagcgtgtttacgtccttgccagttaacacaagagccttcataggataatcaattatttcatacaggtgaacggctgatgtggctttgccgtggtaaattgcaacagttgatgcagactccactggcaacgggtttgcgaagtaacaagcctgtgatttttataattttgcaaataaataaataaataaataaattctccttcacacaacctttgcaagtagagaattacagtatctcagctacatattattacagagaacttattcactcactagtttccataccgaacattaaaccattcaaaaggcaaacggtacaggatatcatggctgtattcaaatgtactgtttacaatcttacatatcatagcaaattaaagtagaagattacaaacaacaaaaggcaaagattaaatattgatatatgctgcaaacactagagatacactataacaaaaagtacaggatagcagttcaatgcttaacatgagtgttctacttaaaaaactgaatgttgcttccatcaaacagggatacaggatgcttaagtgaacaacgcatgattgaagtaatagaaagttctttgagcatcagaactagacagtattacctgaaaaaacatgtggtctggcatcgtggatgtgcaactatcaaagaaaacccggaatgctgcactatttacttcagaggcaatccttgcaatcagactaaacatccttttgtcccagaagaaggatagctgattggttgcgcttgggaccaagaagatatgaccatattcaacaggatatgccttcagaacaagaaaatgcaggtgtcaactagcagttatatagaggaaggtaaggcacgagttatttgaagctcatcctgcaacttacatttgcaatcagcagtagtccatcctttggtggttttgttgaaggaacaacttcaggtatatccttgtcaccttgagcaatgcacagaagcaattcatcataactattcatacagtttggcttcaggcatccaacaggttcaaggaacttgtcatgttccttgaggacacatgaattccacttatcattcagctgaacaacaaaactccatccaccttcaacaacctgcagaaacaggcaaacacattgttacaatcaagttcatgtctaagggcatcacattgacctagagatattgctaactgggctggcatccttttttttataatggaaataataatattggtttcacagccatgcaaagcctctgaatgcctattaatgatggacggatagtagggaggtggttatatatccaaaagaaaaatgtttaattatatcgtgttcaaaaagcaacttaagcatgccaattttacttatggattgcatatcataaaccactataaacaaaaggaatttaataattttctatcatccaactttggaagagatggatgaacaaaaagatccagtaagcaccttgagattgcaagcagttacgtcatatccaaaatggcccttccaagcataatcctcccactgttacaaaggaaaatccatgtattacaaatggggcaacgagaactctgaaaatgatgtggaatcctggatgatacaaacctgagaaagaatgattgtatcaagcaaacttgggctgccctgatcagtatatgcaaagcttttgagggtaccattttcatgttctgcaccgagacggtaaagatgtgtcttcacacctgaaaatccaaagagttcatgactattgcaatattaaggataaaacttaactgaacctatgctgttattctaaatttattcgacgtgcttctgagaacttattttggtgttctcattctaaactaacccttgtagaaggaaggcatttatcatgaattaaaactgcaaaacagctagcttatctgactcatgtcgtgtaacacagaattttattgcaaatgcaatattattcagcttacacaggctaatcctattgtgatattgctgtgttttcagtgtcacacttgagtagcgagcactcccagcaggtaacgttttggcagggaatagatataactcagaatataggagtaaagaacagcatggatcagatagacaattattgcttaccttcaaattgatcaagaggagatttcttgcttggcaacgaatattcacctttgaactccgtggttgataccatacttacaatgcttaatatctgtactactactaaaaaaatatctacaatgctaaagcctaattcagacttgaacagcaccaccaccggcaaggtaggtcaaatcagaaggatgcccccctgcagatgggagggcaccgcgaccaccgtggaaagaaggggacgcaagaagaaacttaggaaagcgatgggcacattgtgttccccttcttagtgcaacacgggatcctttctttggagccgtggttgctcttttcaagccagccctaccggaccagctaaccacctgagcaagaccaacttggttattctttaggagcctccaacaagttcttggattatgatggagcctttatgcagcctcacagggcaatctggcacatgatagaagtcagaatcaaatcgagcacttaaaaggagtagtcaatctgaaaatgagttttgagcattaaaagaaaaacaatccatgagtggatctatggttgcatgaagaattcgcataaatatactatattcatatgccaaaacactgtagagatactccaaacagatcagtctcctaatacacctggacacttgtaagcaaagaggggaatacataaatttgtctcaagtaaaggtagtgacttctgaaatcaccgtgtatattggattatattcacatatctttatgcaacataatatctaacgctgaagaattcttattactgtccaaaaaggtagacacctatgcacattcttcaaaacaatcgaggaaaatatagcaattagagtatgtataacacaaaggtagattttttttccttcttttgcatgtattgccgcatcaggtgtgtaaaaccagaagcctttgaacacacactatcatcagaattctaacccaataaaattgggacgtgacaaccgtagaagctaccagattgctccacaccacggtgcaaaacccaatctttccccccacaaatccagattggaccaatcaataccaaaattttcccacatccgccaccaatctcgcccaatccaaacaccaccaaaccaagaatcggcggtaaaggtaaaaaaaaaaaacatgcatgaacaggaacccaagaaattgcatcggatcaagaagaagggttggggtaaagaattggtaccaagaatgaatcggcggcggcagagtgcgcgcggtcgtcgtctgacccaagggcaggaaggggggaggaggaggaggaggaggagatggggaagtggacgtgtggacggctggtcgaggagggagagagagaccgtgaaacgtgcggacgcctccctctcggccgctctcttctcctcttcttcggccttatctacagtgctccccagcggtgaaaatcttaagccttgttaaatcacgagtaaatttcacttttaccatattttattactttttttttgtttggactaccctttaacaaatattttcattttgaattgaataaatttaccctggtagcactttagaccatccttaactcatctatccatctacatcaatttgtcatatgtcgaaacgttctaaaagaatatttctttgaaaaacattccataaagatagtttttggctgcttgaaaccgtggcaacccaatggccttcagaacccaattaggcaacaaaatcgtcatatagggatgcatcggaatggtaaaaaagacacatagcccttccaaatcagtagatgattgtggatcttgtcgataagttgttgaaagaatctttttgatgaaaagagggatacccagatacttgcacgggaactcggccataataaaggggaagacatcatgtattgctagcaggtcgctccccatgcagtagatcggcgtaatttcaatcacttgtcaaagttagtgaagagttctgatgtaactctaaaacaaacaagaatatcttaatgcctttcatgtgtcaagggagaaagaaagagcattaggtcatctgcatatagagaatctcgatgtgagatggcatatacgttcagtggttgtaggatatcgaagtctcccgtgcttcacaaagggagagactttttgataaaaaaaaatgcaatccattgagttggatttagaggagcatagttagccataaattaactataagcccatacgagaaagagagaaacaaaaatatgaagcgttaactctaaagcaagagctaactatatacatactcgaagacatatattaaaatcatagtaatagaaagagagaggagggaaaaattagagtaattttatagctaatctattcagtgccttgctctaacctgagcaacatgtgatacttgtgctaatcataccccagacagggagacattaactagttctagctgcctgaaacggaggtaaactggtacttggcttcttgattctacatgggcttcacggttttgttcactttttaattaaaaaatagttgtttatttattacacttttgtattgatccgtgcagaaaatgcctgtaactagaaatgttttgtgggatatttaccataaatgacagttatttccctttttttcttttattattttcatggtcagttgagagactttgtaatatcacactttacacttgcatttgcacagttttatttcagaataccaggagacgcaaggatcaactgaatacacagatttcattaattagccacctgatattacaactcctacctactgccttccattccacaaagaatctttacaaagccatctaaaaaagatcactgacaaaaccatctataactatagcaagctgcactttgttgcatgcagacaagtaaactactcacagtgaaacctgaaactacaaccaatacaaatagaccctataagcctgtactactgtactcacaacaccactaactgaacactgatacaatcatataaatcaacagatgcggttggtaaccctatcaatggaacaatggtagctagctagtttactatgctttgcctttgtgtgttaagatcttaatctttcttccctgtgagacaatgcaaaaaaaatttgcctacggcaatcaggtaactgaagtattgaaaaatctcagtcataattctatccatgtcaagccttttcatgaatagtgttaaggtttttcctgatcctactaaatactttctcctttcaatgctttctgaaccagattcaaaatctctgtaacctgaaagcaatatgaaaggaaaaacgtctttatattgaatcttgacagaaaagaaaagcatattcaggacatcaacaaaaaagtgctaaatcgttgtcaggagatttatggattaattgtcttaccccaggataatgcttcaatacaggagaataatgatcaagtgctatgtagatcttcccaagaatactaagaagagcatcaacttcatccccaagtatatcaacctgggtcacaatggtaaaaaggttgaatgaatgaatgctattgtcacatgaataaaactttattttgtaaaataaatattattgtgctttagtctctatatacttcgcttattattttcgataaaattcaagcatcatgtgatcactacttcgtgcctagaagatgaaaatcaactatagttttcaaggaaaaaatgtttcttagaagtttaaaagtgaaatgaacagaaaatagaaagagcataaagagaaggttaaacctcagcttctgctttctggagattagagcatttaatctcgagtatctgtttataccagaattcttttttctttaatacagcaacttgctgcaccagtgggttaaactggcaaattatattagtcaacctgcatgggaataaaaaacaaagaactcaataattggcaagttatactagtcaacctgcatgggaataatatatgccaaaatatgaagtggacaatttaacttagctagcattcactaacatgcagaatattacaatacattaagtgatgagttcaaatagtcagacaagtgagcctaacttatctagtattgctctaagtaaacaaaaacgaccataacaaatattcaaggatattaattaatttacatacctaatttcatttctcttcatactttgagccaatctgctttcaaaatcgctgtatgatttagataacttctccatactaacaagggcatattctaggtgccctgcttgtcccttatgactgttaatgcttggcgccgatgttttcttcatttcctggatggtggcatcaagtgaggcattctgttctttggcttcctccaaagcaatagacatggcagttaagttgtcagtcagaccatgtatctcttgcttgcatacattaatttgctgcaaagcctcatacaagctactcttcattgaattagactcactcttggactctaagatcaacaactcttgctcgcacaccttctccctaaaattggtaaggtcattaaccaagttgacttgctcatggtgctgcattaatgttgatcctgcaattgctacaagttgattgttttcatactttagcttctgtctgtcttcatacataatactcaactgctcttctttttctataagcaactctctgaggaaggtctcctcctgattagcatcatcaatatgattctcataattatcaaaaacttctcttaatgtcgacagctccaataaatctttaatgtggctctcaatctttaaatcttcaagttcatggctaagcttctcaacttgtttcacaagttttaactcggacaacgagtgctgtgccattttcctctctgcatctaatacttgtaaagacagatgtttagccaccatttttttgtcagctagcaaaccttgtagttgttcattttcatgaagtaaagagccgattctgtcctcaaatccgcaaacctcggcatcatcataattatcacaataagggttatcttctctca

SEQ ID NO: 92075 - DNA, 583 bp, Oryza sativa
aagatcggagatagctcgtcactgaagatcggagaaggatcgagctcgggtgccgccgagcgcgtcatggccaactccagcgccgtggagctcccgctgttgacaaggaccaactaccacgaatggtctttggtgatgcaagtgagcatggaggcgttggagcagtgggacgcagtggaggcagtgagcaaggaccggggcaaggatcggcgcgcgctggccatgatcatctgtgccgttccaagggagatgaaggccgggctcgccgtgaagaagtcggcgaaggaggcgtgggatgcggtgaagaagatgcacgccggcgacgaccgcatgaaggctgcgagtgtccaacgtctcatgaagcaggttgagaacatgacgttccgtgacggagagaacgtcggcgacttcgcgatgcgcatcaacggtctcgtcgccagcctgcgcgagcttggtgaggagatggaggacagccgcgtcgtgaagaaagttctgcgcgtggtccccaagagactgaagcaagtcgcggtggcgattgagatgctcgccgatatcgacaccatgaagatcgaggagctcgtcg

SEQ ID NO: 92076 - DNA, 2496 bp, Oryza sativa
actcccatcttcaagtccacttgtgtagcggagagtccaaaagtcgcgtggtgccgccaaagttgtcggtgcatatgtctaaggaattgaaaagggcaatggttattaccaaaaacaaagagtagctagtgatgcttgagaaaaatgcaacacatgagtcacgattgggtatatttacctgcatgtagattagctcaatggttccgccgttacccgtagggataacatggatgatatctacgcatcggcaatcacggtaccaagaggggcgatccttgaggatctctgcaacctaaaatgaagcttatcagggtctgtagcatgccagttaatgggaaatgtaacacaatatcaaggaaaacaaatcatacctttgtgggctcaaggctcaccaggccgcaagctcgtgctgctacgccactgcaattgtgcgaaacagcgatgattccaatggaatccggaccaggctgtaatcaaattttcatttcagttgatttgaacaaaaaaaacatgaatggaaagagaaaatcaacatactgcacagttttcttgtacaacgaatacattaccttcatcccaaccatttgcacccattcgacagcagttcctgtcgccttcgacatgaactctgccaaggtctcctcagcaatagcgagaagactgcgcaaataaaatcatctcagcaatctttcatacaaaaaagcacggcctaacaaaagaagaaaatagaccaggttttgtggataccctgctgggttgttcgcatccctttgcggatgcagaactgctgggttttgctgttgatggtgctgaccacttgtcaccacagactcacagcttgtatctgtggtggctgcagaaggctacaaagtacatacaaacattactgattaagaaaacaggatgatcaaaatatgaagcaattgtaagaacaaaagcctgtaagcacagggagctcacattgtgcagttgagtccgcatgtagccgttctcgtagacgagacgggacacctgcttctgcagccggtcattttcctccatcaacagcttgttcatcgcattcagcttccggttcacagtttgcagccgggaggcctccttgcgctgcttctcccggcatctgccaattacaaggaaggcacaatttcagtggcaaaagtacatgaataaactatctaaaggatggtgtcttctaatacacaagattccaatacttgttaatggatactgattggcacagcccaaatgagcacaaaggaagttaggcaaaggcattttagcaaatattccccaaggttaaaagggggatcattgaacaggaacaagcaaaaggtcatttgcaaaagagacaaatgactatatactatgcaataacagttagtattccatatgtgaaaatcattgcctaattgacagtgatgtttctgtctgcatctgtgaactcaactctaaacaagagcatcctctacctaaaaaggattcttgatttatatttggccttcatgagtacagtaatagtatataccaaacttgctcaaaatgttgcccttcacattcttccacagtgacaccaccagtgacaaaactattgccctacttgtgatccactgaaaaaagaaagcgagatgataaccaggaggtgatgcttatggaggcctatagcaagaaaacatgaacactaccacagcccacaacacagggttaaaaagatggcccttaaaatggcaagcacaggaaacaagaaatgacctaaggcaattttgctccaaccaatcattggtcaccacaagcaacaaaacaatcagagagcatatatttacaatttaaaccaaacaaaattaactgtaaagtctgtacagagatccaggatatttggctattcacatcaccacaaaatccaagaggaaaccaacgaatgatgctgccatttcgctccctacccaccacacaacccagcagaataatgcagcgaagaacagtgtgggcacaggaactcaaatcattgccgcaaagttttataaaagaaaatatcctgataaatttcaagcaaacagattgcgcttcattattgcacaagacgaactaaaaaaacaaaacccatcatataggatgcaaatcccagaaatgaaccttctcgtcaccaatccaacacattgcaagccctaaaatcaacacccaaaaagttacagacatctacaaatcaaacagaaaaaaaaaactcatctcaagaacccaaatcttcctcacaaaggatcccccattcccacaagaacatgaaaaaaaactgcaaacaacaaagcaatcaatctcatcacattacacaaaaccaagaaaagaaaccgaagaacacacgccatggctgctgaacaaacccgagcagaaacagatcgaagagagagaaggagatgagactgacctgcgattctgaaaccagaccttgatctgcttgggctcgatgttgctgaggatggggcactcccggatgagctgctggcg

SEQ ID NO: 92077 - DNA, 687 bp, Oryza sativa
agaaagacaccgccttttcagcgtcggagtccatcaagcccccggcgagcacggttggcggctcggggatggagctgcgatacgcgaacatgatcgtgtgcgccgagatgctgctcaggcaactttggccaacgatccacagcaacgaggtggacgccgggatggatctctcgaagagagacgagctgtacaagatgctgcctgtgaccatccgcacggccgtgaaggcgaagctgagagagagctggagagggcagccagtggacgaggctgcggcggcggcgtcgatggacgcggtggacaggatgctgcggtggttggggcctatggcgcacgacacggtgcggtggcacgacgagcatagcatggagcgggcgcagcggttcagcatgcggccgcgcgtgctgatggtgcagacgctgcacttcgccgaccggcacaaggcagagaatgtcatcgtcgaggtgctcatcgggctcagctgcgtttgctggtacgacgatgagcgacgccgtccggccgattgggacgacgacgactagactgttgggtctggcgctctactgcccggtatattggcatggtatataagcataaagcatttgtatccaccattatggatacaccgcaggacaattttttttgttatgatttgaagagtgacctgtaaacagctagctaaatgtt

SEQ ID NO: 92078 - DNA, 3701 bp, Oryza sativa
tgcttgcctggggagtccaaaattttaatcactggtcaactcgccgatcagtgatcaaaatcccctaacaatctaacaagtgatggtcatgtggcagatggtgatcaacctgtacgggtgcaacatgaacaggaaggagtgggagtcgccggaggagtgggtgccggagaggttcgccggcgggaggctcgaggtggcggacatgtacaagacgatggcgttcggcgccgggaggagggcctgcgcggggagcctgcaggcgactcacatcgcgtgcgccgccgtcgcgcgcttcgtgcaggagttcgggtggaggctgagggagggtgacgaggagaaggtggacaccgtgcagctcaccgcctacaagctccacccgcttcatgtccacctcacgcgcagaggaaggatgtgaaccattatattcattggaagctgttgctcgttgaataatgatatatagttatctttgagatgtatttactattagcaaaatctccatgctttgttatggataggagaaaacatattataatatatcatggactatatttcttttatcaaatatggttgtatataacttgttacttgtttacttattctttgttatggataggagaaaacatatattataatatatcgtagactattaattttttatcaaatatggtagtataacttgttacttgtttacttattcaaatatatggtatttatttatgtgaactattcaatagtagcagaaaatatcagggtgccactgtagccttttaaaagagtgcaggcaaagaaccttacaatgttagcagtgaatctttcttgaggtaaacctcaaaagagcacccaatacgacaaatcaaccgtttcaaggctgagatattataatttgaccgacatccacatatatttcaaaccaatttcactaaaacaatcatttataaagccaattgttcattacaaaatattaatcatgacaatgatttcacagttacttatatttttctatatatatacttactttctctaatcgtacggttaagagttacttcgatttctttacggtgttatctaatcctatgaaaaattacttctattttttagttcctctagcagtgtacttgcttctaatgccataaagaattacttctatcttttaaaaagttactttcccctaactatgtaattacttttaataccatgaagagatattaaccactctaaatgccgtgggagcgctgagattttagagcgccatgtcagcgattttttttcatagaagtccccgtacttctggttaattatacattgatcccagttgctatccaccgtgaaccgtttgatctctctctagggttgatcccttgtggtggctcttccgcatgcgtgaaattaatcgttggatgcggaatggatggtgccgatttcgccgactgcatcaaaccctagccccgtcgcccccacccttgcatgagccctcgccctcgccctcaccctccaccctcggtgcatcaccacgctctcctcccctcgcatgtgccatagttgtcgctgccgccgcagtttcgcactcctccaaccatcgttgcggcgccaggcgccgtcctcctcgccggcgtatccggccacccagatgagatggatgcgagtcgctgccctcttcttccctttcatctctacgccgccacaggccatcgcttccctatccctcgccctctccactctgctcggcgaggtgttcatcagagtgtcacggttgtgccattgccggacatcacagtggcgacaaaggaaggagaacaggggaaagcgtaaagtgagaagacgtgtcttcgccaagaaagcgtattgtgtaaagagagtggtaggtgtgtgtgaatgccaagtagggcacaggagacagctgtgtgagtggaggataaaatcccctcgttgttgtactgatacgattacgaaatgagaaatgaaaaagaatctcacctcccccaagttctgtctcttcttctcgcctaagtcttcttcttcttcttccccatgctagttcgccgtgtccctcaactccggtgagctttgccgccgcggattgggttgtgacaagttggtatcagtcgctttgttcggtctcggggctgtctctcacattctctcggctcgatcagtaaatcctgtggctccgttcgtggtcttccttcgggttgtcgccgcggtaaatcatagtttggtttgattgggtttggaggagacgacgccacggcaccagcaaaacctagtgcgcaggttcggcacatggtggcggcgatggaatctatggaggagcgtttgatggatactctcaaggcactagcactcaaggtggatggtgtggaggacatctccaagcgtttgacgcagatcgacctcaagctggcgcagcaaggcgagtggctagatcgggtgcagacgaaagtggatctctccatgacgtccctcggccaggttcagcaagaacagagtcaggtggcgcgtgcactgaaggcggccgcggcaccaccaacaccaccactgccgccccctccgccgcctccgcgtcctccaccactgcttccatctccggagtagccgttgggagcatcttcatcttcatcaacaccaccaccaacaccaccgcctccaccacctgttcatcggtctcgtcaggtaccaggtcatcaaactgctcctgatgtttctgattttggggatttggggcgacgccagtggactccgaagatggattttcctaaatttgatggtactggtgtccgcgtgtggattgataattgtgaaacgtattttgccttttatcaaattgcggaggggtttatggtgtcagctgctgctctgcatctagtgggggatgctgctaattggtaccaggtgtggaagttagaagtgggttggcatgattggaccatgttaaaaatggctatcgctggagaatttgaggttaatctcaggagtcttaagatggatgaactgattttgttgacacagacggcacagtaactgaatatcgttccaagttcaatcagttggtgtatcagattaggctctatgatccttctctgtctggttcggggctaattaatcattttgtgttgggattgaaagatgagttgcgttcttttgtctaagcggtgcatccaacttctattactcaagcatatttggtggctttggctcatgagggggcacagcttggtaatgtgggcaagagacattttcagaagagagatcctgttgtttggaaacaacctgaaaagcctaagttagccactggggagttatggaaagcacagcaactcaaggaatatcgtcgagctcacgacctttgtttcaagtgtggggataagtatgtgcctggacatgtgtgtgtgaaaccagataatgctcagctaaaggccatggaagttcaggaggatcaggtgattttgtctgatgataatttggatgctgtggtggcatctgacatggtggaagatgattgcaatttatctttgcatgccatggctggtacatgttctgcttctactttacagttgcgagcaatggtgggcaatcaagttattctgattttggtggattcaggtagttcacacaactttgtgaccgctgatttgtgtactaggttacagctgcatcctgtgtcaactgtgccaatttctgttaaagtggctaatggggag

SEQ ID NO: 92079 - DNA, 2171 bp, Oryza sativa
actgaggcatctgttcatcaggtggttaagtggactcaaggcaattatatttgggctatggcagtacttgaaccagatttctctaagggctccccacctgttgaactagctgttcagtcagtattggataagttttcttccgtctttactgctaccaattctttgcctcctcatcgtgtgttggaccactctattgctttgattccaaattcggtccctgttaattccagaccttataggtattctccaacacaaaaagatgagattgaaaagcaagttttggagatgttgaatgctggtttgattactcctagttgcagtccatttgcttcacctgttttgttagttaagaagcaggataattcttggaggttttgtgttgattatcggcggctgaattctttaactattaaaaataagtttcctctgccaatagttgatgagctattgaatgaattggctggcaccaagtttttctctaaactggaccttcgcagtggatatcatcaaataaggatgttagaaactgatgaatttaagactgcattcaaaactcatcatgcccattttcagtttcgggtgatgccatttgggctcactaatgctccagctacttttcagtgtttaatgaattctattttcgctccattccttcgtaaatttgtattggtattcatggatgacatcttgatctatagtaggagtttggaggataacattcaccatatagagttagtgttacaattgctgcagcaacatcaattgtgtgctaagctttctaaatgttcttttcctcaaaataagttggaatcttggggcatatcatttctgctgagggtgtggctactgatccagaaaaaactagggttatgcaggattggccacttcctagcaatgtcactgaattaaggggctttttggggttaactggttattataggaagtttgtcaaacattatggcatcctggcaaaacctttaaccatgttactccaaaagaatgctaagtttgtatggacacctcaagctcagtcagcatttgttgctcttaaagaagctatgtgttctacacctgttttagcccttcctgactttgctaagccttttgtgattgagactgatgcttgtgccacaggaattggtgttgtgttgtctcaagaaggacatcctgtggcattttatagcaaggcattgggaattgtgaatcagcggctgtctatatatgaaaaagaatttttggctataatgatggcagttgatcgttggagatcttatttacttcggggtccttttgttatcaagactgatcacaaggctctttgtcatttagatgatcagactttggacactgagttacagaaaaaggcgatgactaagcttattggattacagtacaagttccagtataaaaaaggagttgagaacaaatctgctgatgcactatccaaagtagggcatttttttgggatttctgtggttcaatctgtttgggtttaggagattctcaactcctatgctgtagattcatctgctcagcagttactttgtgagctagctgtctcttctccaaatgctaagggtttttctttgtctaatggtttaatcaggaaggctggtaaaatctaggtgggtgcaaattctgctttatagactaagttgattgctgccttccatgcatctgctattgggggtcacactggtgtgctagtcagttatcagagagtaaagaagctgtttgcttgggttggtttgaaaaaggctgtggaagaatttgtccaacaatgtttgatctgtcaacaagcaaagcatgagcattgctcttatcctggtctcttataacccttggtgattccctctgcagcttggcaagatgtttctatggactttatagaaggattacctctgtcaaaaggtgctaatgctaatctttgtggtggctgcatagatatacaaagtttgcacactttttgcctctcaggcatcccttttcacccttgcaagctggctaaggtctatctgaacaactgctggcatcattatatgggtttgcctaaatctattgtctcacatccgtgataaagtctttactagcaacttttggcagactttgttcaagcgctttgagattcctttacatctgtccacaacctatcacccacaatccgatggaca

SEQ ID NO: 92080 - DNA, 1607 bp, Oryza sativa
caatcagcgactacggtgactaccaaaagatggcgaagcgtaatattatgattggcatgttaggttttaatgcacaggtacaaatctcagcaaaatttaaattcaatagtggattttgggtaccattagcactcagttaattgagctctaacaatgaaatgcttgcataaatttcagaaacagtttcgcggtacaagagagaggatgatcagtaacgtgttaagcactttgcataagttggtttctcttgacccacattcccctctgaacttcagggatgtttacattaatgagctgttcagcttgtccttgatccaggtttgtattacctctgaacttgaactctccagtggtccgtttgttacttccaatacctgtcatgattgttatgaacttataattgttgcaatttcgtagttactaggactgatcttgattgttatgaacttatatatatttgttacaatttcagagtttaggtgaggatgtgagttcagtttatgtggaagagtttgggagggagatatccaaggacgaaatctttgatgtccttgtgcatgagatgatgatgtgtgcagttgaggctgactggagggactacttcccctacctcagctggcttccaaacaagagcttcgacacaattgtgtctactacagaattcagacgagatgctatcatgaatgcattgatcaagaagcagaaggagaggattgcacgcggagaggtgacacaaaacttctattcgtatccaaaaataactttttttttctgcagatcatctgaactgaactgtaacgtattgcatgcaggcaagggcatcctacattgacttcttgctggaagctgagaggagtgcacagctgacagatgaccaactgatgctgctgctgtcggagtccatcctggctgcagctgatactgtcctggtgaccaccgaatggaccatgtatgagattgccaagaaccctgacaaacaggcaagaaattaactgatactacctccagttttattttttggtttcggacaacacatgttttagcatgttttctttgtaacttgtcgtaaacgtcaattaattttgtccggagggagtactttcaattatcttttgtatatactctttcttgtattgtattgtgatcctctgacataactttctcttgatatggtcattgacatgtcagcgatcatgtctctataactttacgagaaagaaagtcagaggatctcaatccctctttctttcaaatgcatttcagcattttgttgccaaccaaactaataaacaattgattgtttcttgttcttggcacatcgatcaggagctactctaccaagagatccgagaggcgtgcggcggcgaggcggtgaccgaggacgacttgccgcggctgccgtacctcaacgccgtgttccacgagacgctgcggctgcactccccggtgccggtgctgcccccgaggttcgtccacgacgacaccacgctcgccggctacgacatcgcggcgggcacccagatgatgatcaacgtgtacgcgtgccacatggacgagaaggtgtgggagtcgccgggggagtggtcgccggagaggcttcctcggcg

SEQ ID NO: 92081 - DNA, 1242 bp, Oryza sativa
tgatagaaaatttcctagtattaggatagaggaaatgtcatatccgattctaggcttctatattttaggacagagggagtattggatttcaacgggatgtgccaaggcaggtttgaaacaaggatatagaagaaaagtgtagcttaatcttgtgttatttttattcaaagcttgttttcttatggtccactgtggatatagaggtcagatttctatcaattatcttaaaaataacgcccaaaattttcagaattttccaaagttttgtgaatttggtcaaaattttatacaaattcggttaaaaactcaaataatttcgtgcaaaacaagtaccgaaaacacgaaagtttcggcccgagtggttgtgcttacctcggtgccggcggggacgtcgtagccagcgagcttggtgtcctcgtggacgaacctcggaggtatgagcgggacaggggagtggcggcgcagcgtctcgtggaagacggcgttgaggtacggcagccgtgggaggtgctcctcggtgaccgtctcgtcgccgcacacctcccggatctcttggtaaagccgttcctggcatgacaacaagaagaaggccaaaaataaaaagctttggttgataatgccaagaatgccaacaatgagctggaacagagtaacaatatttcttgcctgtttgtcagggttcttggcaagctcatacatggcccattctgtggtgaccaaggtagtatctgcagcctctatgagtgcctcccacactagcatcatcagttgctcatctgtcagtgtgttctctgccagcaagaagtccagatagcatgtctttgcctgcacatatatctcagtttcatggagttaaaagatgatctctgcaagtttttttttttttttggcatagaagcaaatatgaaagatgtcatttgtcaaagtatgcctttcctcacctctccacgcacaatcctttccttctgctgcttgatcaaggcgcgcatcaccgcagttcgtctagtttctgtagtaaacactcttgtttcgaagctcttgtttggaacccagctgaggtaggggaagaaatctctccagtcgacctcaattgcgcacatcatcatgtcggtcacagtagcattgtagatttcttccttcgaaatgtccctcccaaattcatccacatagactgaactcacatcctctcctaagctctgaagtttgcgacattaattgttagtgccagaaataacaaatcga

SEQ ID NO: 92082 - DNA, 1745 bp, Oryza sativa
ggaggggaaaaatcgggcgctgacatcagcatgacgcatgcgtgcaaaaccactttaaactattttttctcttaaattatttatccaaattaaatcatgattcgattgcaccattaaattcgttgcaattaaatctttaaaacaagaccatatatggatatattctgacaaaaaaaaatttagcttattattgaattatttttaaatgttgcacgatgttccaccaagtatatcagaattgtttcaataagtagatcgaaaatgtttcaatcgtttaaactagacgttgtttcactttatataaaaacaatgtttcaacaacgaaagaatgtttcagttcactgtaacatttgatctatacatagtgaaacattataaatacactagttgaaatatttttggtggaacaaaaaaagaaacgaattcccttaatagagggtttctaaatatgtgggtgatttgttgcaaaaaaatgtttcaatttattaaaacattagatttatacatagtgaaacattgtgaatatactaggtgaaacattttttgtggaaaaaaatgaaacgaattcccttaatagaggttactgggcctaacatgtagcggttgcaacatacgggtaaatttcatccaaacaattcaaagtgtggtccagtgattctcgaaacaatttggcccatcttttatttattcctttatttagaattcaatcctgtcagtgcaatgcctatgtttggtttgccaaaatactaaacatcccatcattctgttcgcagataatggaaatgctttacattttcggtctctaccatgatcaccacgaggtatatcgttctacttgaatagaaaaaaagaataacatgaagaaaaggaaaaaaaggcaatgtaaagcaaaggagaggatagattcttctgatcgtctctgcctaaaggcaggacaaaagcttctgtttccatcaaagggagatcaaaaaggaggggagaaaattcaagatgttcctacgcgagcagtggcatcaaccgctgtctccgtctccgcctccgtctccgagtgatatcaatggagagatcaagagacagagagtgagaagagacagtgacggagaacggtgcgaaaattgtggcgaatgcaaacttgattggctctcaaatcttcaaagggaatcaagagatcagagtttttgatttcaagcagcaacacacatctccaattcctcagaaactcaccggtgcgatgcgaatctcacctctctccaccaattcgccgatcgcgcgccactcaccgaggcggcattccatcaaacagtgacagcgggtgagtgagagagatgcagagattggtgggggggcggctgacctgggggcgcgttggagcgtttccttggcgcgatcacgccggccctctcggcgagcgcggccgcagcgacaaaccctccaactgccgccaccgctgctgccccgaccccgccgggagtacaaactaaagatcctaactttagtcccgattggtgttacgaaccggaatacaaaggtttctccacctgtgactcgtccaggaacagcagccagagctacgtgctgaccaagggatggagccgattcgtgagggagaagggcctctgcgccgacgagctgctcttcatcgactgctagaagaacaacacggcggcggccaccggcgacgagaagccaattacaagcagcgaagcagcacgtgtcgtgaggctgttcggcgtggacatcgccgg

SEQ ID NO: 92083 - DNA, 3183 bp, Oryza sativa
gtgagtggaatcctagatctctttttgttgttgtgttgacaggtcttctgaatgtctttctgatgtcggcaggacggcctcgacgatatctgcacagagcggggatgaggtcgcgaccagcgcgactcccgccgctgcttctcctcgtgcgggcaccacgcccagcgtcgccgaatccgccccatcccccgtcgtgcccatggctgccctgccacctcctactccaacgggaccatcaacctggtctcaaatgatggccgagagccagcgccttctcgagacggcttctcgagaggtggtcgccgagatgggccgtgtggccgcccgtgcaacagcgtcggatgggcgggtggcccagctgatgtcggagctcgatgtcgcccgcgacgaccttcagaagataagggagatcgtggccggcaatgagatgcagcgccaagggttggagctgcagatgaacgatatccaagatcacatcatctccatccgcgagtcactccggaagagcttcaccagtctgcactagctggccttggcgtgcggcgtgaagtctaccatcccggaacaccccgacgagacctctgtgacatcgtcgctgtccgagctggcaaagacgatggaagttatcccctccaagcacgctgccaaagtctcggaggagatctctaacgggatccacacgggggcttgtcacgtgctcgcgtgtgtgaagctcgctctccctgatgctgatctaaaagagatcttgtaagggggcagctgatgcaacacgcgaggacgtgatgtcagacatggcggatctcggggaaactgttcccctctatttgaggagtattttttttcttgtactttgtgtccattgtataaacactttgggtttgctctgtccttggtagaacagttgtccctttttatgccatggtaatttaatttgtagcttgtttttccttcatagatatcttgataccgaggacgtccagcaaggcggacgccttgataccgcgatgatcgctccggctttgccagccacggcacccgcttccgacgttgtcggggatatcatcgtgtttgagggcacgaatgtggtccctcgccgtcgggtttaggcgtggtttcgctccttcaagagaactcaggtgggatatcttaggactttcgctctctacccttctgggctcgcgaggcgaatttccttgaacccttgccttccgcagacctcaagagcatggtggctgagcgagatcatcgaatcctttactggaagacgaaatttgagggagtggagcttgagcggtccgttgtggttgtaaagaaggaccaggctatagaggcgctccgaggtcgtgaagtctggttgaactcgtacctcaatagctgctgcagtgctatgactgaggtttgtcgccagctaaagatcgatcgtgcggagcccgaggagactatgtgggctatttgtcttggatgaggggtgcgtgtgctcagctggaggacgtcgggcagcagattgacaactgcctaaaagaggagtgtcgtcgtgctagccgatacgctggaggtcacattctcgcctgcatcggagatcaccgctcacagatgaatctcgagttcctacgcaaagggtttcgccattcgtggctgtcagcgaacgagattgaccagctggcgtgttcctttgctcctttggctgagagggtcttctcgtccatgaactagcaatggccgtcgtggtagactccagcccctgtaaaagaaacgcctagagaaggatttgtaacatatggatatttgtgtcagaactttataattagaatggaaatccatctactaaatgtttgaacaagttgtgctgtgtgcgagtactactctttatacaggctgttatttgcctgttgtcgagttggatactctccctagcccccagccttgtccttggaggagcccgttcttggaggagaaggctcgacgacccgaaacctaccgagctgaaactgcgatttacctagcccccagccgtgaagttggaaaaatcaatttccgattacacggcttaattaattcgccaccgttgagcactcttacatgactaggttttacatggtcgtttggctcttagaatccgacaaaaccttatctgctctgggcatccccagccgaaattcccgtgggtttcttggaggcttgtcggaatggcgtaaagggtcaataggtccgattgcaacatttggtgttatcgtggtaagggatctctgggtgaaacactgttagagttgttttgttcataaagaactcaaatacctttgggtagcttttattgatcggatatttatgtagttgatcaatgtttcaagagttggatgattcacggccatcgcaatctgcaatcttgaatacacctggtcgtaagactggcaccacagtgtacggtccttcccacttacgcgagagtttgttccgccatgcctgggtttgaactcgtcggaggacgtaatcgccgatggcaagtgtacaagctctgatgcgcttctcgtgatatcggcgtagggcctgctgatatgcggctgctcgaacggcaactcgttcacgatgttcctcgagtagattcagatcgtcgctttgcctttcctcttgctcctcgtcataatatttccgcactcgtgtactctgatgcggctgctctgtggggagcatggcttctgttagttttagaaccggaaacatctttagttaccgattggtgttaccaactggtaaaaaatgcatctttagtaccggtttgtaacaccaactgagactaaagatatttttagtaccggttggtgctaccaaccaatactaaagatgccagttaccaaccgggactaaagatatttttagtactggttggtaaccggtactaaatatgcctctaggaatagttcgaaaagaaagcatatctatccaagtcagatgtgtgtagtaggtggaatggtaacgcgcgtgagggctgaggtgagagatcttgagtttgaatcccacatcccacatattattttttatttagtatacatatttattaccggttccttcaaccggtaataaaaatcgagatctttagtctcaataatttagctccgttgctataattggtaataaagggggttacaaaccggactgaaaatcgcttctccagtagcgaaggaaatg

SEQ ID NO: 92084 - DNA, 1373 bp, Oryza sativa
gtagccaagcatttctctcacataaagataatctgactatttgatgacccagtgagatttgggctcacatatatagcttaataactttagttgtacatggaatcctacataagttcttgatttgaacatcctgttcttttgacaatgattggatgttggcattatagtttttgaatttttatggagaaaaatccatatggtatgctgtagagcaatttacctgttcatttttttccatggagacatttttgcatcgctgaatcactgcttatttgctgattacttttaatctccagggtggtgaagatgacaactttgctatcgtgtttgctgctatgggagtgaatatggaaacagcccaattcttcaaacgtgattttgaagagaacgggtcaatggagcgggtcacctttttctgaatctggtacatatagcagacttttgaagttctgattcataccaatttgttatgcatggaaactaattctgctagtgtatatgtgcttattttctgtatggttatatatgcatcatttttaacagaagttgacctgattgttaaaggtagaacatattttctaacaccaggctactctgtttacaggcaaatgatcccaccattgaacgtatcatcacccctcgaattgcactgacaactgcagaatatttggcatatgaatgtgggaagcacgtgcttgtcatcttgacagatatgagttcatatgcagatgcgctccgtgaggtattttgctttttatcttttatgatgttgtatactttgtttctttctgttttattacctattcttagaccttaattttaaggaatcatatactaatttgatgtcgttacttaactaaaatgtcatctgtcatccgtttggttgcaaattttcatgtttgaatgaattaaaatcatgaaaaggcacattttcgattacttcgcagcatgcatggcacttgtacaaacatatgtggcatctagactgatcactttatcagaaatgacactagcttggttatgacagtgaaaagttcgtgcattttcatttgatgatgtcaccgttgaccaaaatggctaaatgtggatgttaaagtattcatgtttctatttgcttctaacagtgtgttgtggttttctctatctaaaatggtagtattgcattttccatgttatacatctccttttatgttcgactgcaataaatgataaattgctgaaattttatttattgtgattggcactaatacaacacggtaattgtgcttatatgtaggtatcagcagcccgagaagaagtgccaggtaggcgtgggtatcctggatatatgtatactgatctggcaaccatatatgagcgagctgggcgtattg

SEQ ID NO: 92085 - DNA, 677 bp, Oryza sativa
atctagacaaaaaaaaatgtgttatgcagattctaggtgtaaagcaattaacttttgagcaagatgattttgtttatttaaaagtttacctttgcgagggataaaaaggttcaagtaaaaggaaaattagcccctcgctatattggaccgtttcgaataaatgctaaacgtggagaaatagcctatccactagctttaccagattatttgttagaggtacaccctacattccatgtctcacatctaaagaaaatttttctattgacatttttctattttattttgtacaactcttattttaggttcaaaatatagacattacggatcatgtatttttggtttgattatttaatagagcaacaattaaattaaaaattagatttatagctttcaatattattgatagtttgtgttttagtttgagagcttaaagtagaaagggggaagtagtggagagcggagagtgtgagccaagggggaatggggcgatgcattggggactttatttttctaaacaatttaattaaaatcaatgatgatatgttttgcttttttcttatagtttctaagagtttttctacttttgaagacatgacacatagcggcttaagatttttctaaaggtagacctaatggttaaaaataataaatccactaatttaagtgaaaacccattg

SEQ ID NO: 92086 - DNA, 829 bp, Oryza sativa
tgccatagcacccgttacaatgcaaggacattttttctaatatattaattaagaaaacagagatggtatgatcattatttagccttcatcatggaaccgctagcttcttctggctcacatcgatcgatcctagcttcctctgggcttgaggtgcacgtgcagcgggtgaagcttcaaggcagtgtactgcatggtatcctccttatcaccgtcgccctccctcagcgtccactggagctcctgcacgaagcgcgcgatggcgacgcacgcgatgctcaccgcctgctggctccccgcgcaggtcctcctcccggcgccgaacgccagcgtcttgtacctgtcggccaacttgaacccctcgccgaggaatctctccggcgaccactctccgggcgactcccaggcctcctcgtccatgtggcacccgaacacgttgatcatcacctgggtgcccgcggggacgtcgtagccggcgagcgtggtgtcgtcgtggacgaacctcgtggggagcaccggcaccggggagtgcagccgcagcgtctcgtggagcacggcgtcgaggtacggcagccttggtaggtcctcctcggtcaccgccttgccgccgcacacctctcgaatctcccggtaaagccattcctggacaaatttttaccagttttaattggttggcaaaatataatgctcaaattaattaattaatgcatctgacagacattaagaatataaatatatatatacaagatcattcttttttcttgcctgtttgtcagggttcttggcaagctcatacatggcccattcagtggttaccaggacagtatccaca

SEQ ID NO: 92087 - DNA, 872 bp, Oryza sativa
ataaatttgatagaacattaacatctgcaggcttcacagtcaataaggcagataaatgtgtataatatcgctatggtgggggtgagggagttattttgtgcttgtatgttgatgacatactattatttgggacaaaccttgaggtgataaatgaggttaaatcattattgtatcaaagttcgatatgaagcatttgggagtagctgatgttattctaaacattaagataattattggtgaggatgggattacattcttgcagtcccattatgtagagaagatcctgaatcgctttggctacattgatagtaagccttctccaacaccttatgattttagcttgttgtttcacaagaacaagataattgctaggaatcaattggaatactcccaaatcattggcacacttatgtacctagctagtgcaactaggcctgacatctcctttgatgtgagcaagttgagccggtttacctttaacctgggagatgatcattggcgtgcgcttgagcgagtgatgcgctatctaaaagatactatgaaattggggcttcactatactaggtatcctgtggtactagagggataaagtattttaattggatctctaatgtggatgagatcaaagccactagtggatatgttttcacactatatgatggtgctatttcatggaggtcctgtaaacagaccatttgacgaggtcaactatggaagcaaagctgaatggcttgcaaacagaccattttgacacaaccattctgctactgttgagatagaatggctgcgtaatcttttgatggatctgcatgtggttgaaaaaccggtgctgggtattcttatggactgtgacaatcaaacggtgattgtca

SEQ ID NO: 92088 - DNA, 575 bp, Oryza sativa
aagtttagccaccatccgtactgataaaagaacatgcacttaactatgaatttccatagcagtgcacctgaattgagcaaaaacttaccagagatatccaagtaggcctctggcaaaataggtgggccattatcaatgggttttccagatccattaaaaatgcgcccaagcatatcaagtgagacaggagttttcaggacctatagaaagaattaccacacatattaagcaatgccgctacttcagtgctacatgcaaacaaggaaaagatataaactacaaaaacttatagattattcaagtcatgcaatactcgacaatcacaatgacatgtgctttgtcgatactcctttgttttatcaattacaaccaaaagtgaaatcattctccaaattaacactgttcagctcaaagtgattaacctattagaacacttaaatcactatggataccaggaagtgaagataaaaggaggaagagatgaataagaggaaattacctctcctgtgaactgcacagtggtatatttgttgtctattcctgaagtgccttcaaagacctgaaaatcaagtaag

SEQ ID NO: 92089 - DNA, 5009 bp, Oryza sativa
cggaatttgaatcccaagggatttaatgtatggcgagagttgggatttacaaggattgatttaatcaagatctttggcacaaaatcctaaatgcactcaaagaaaacacatgttctattgtgcgagctgggctaggcccttcagggaggaaaactagacgttttcatgaattatgttgaaataagatctttttatatttaggtttgtaaatagagttttgatggcaaattctcactagcctttatttatagaacaaatataaaagattatttcttaaaaaggattttcaaatattaattaatcaatattgataaaataacttcctccgggaattgtccctaaagcggttttctttaaagatttaatgattatagacattcgtaaatcaaacacccaaagggggttctaaattataaaaacaaggggaggaaaatgatttatctttacaaatactttcttatttcataatcatagttcttttaataatatttgaatccaaaatagattttattccagattcccatccttgtggtccaagcacaacagaaaaggtaaaataagatccaataaactccagcacgaaggaatttggaaaaagatttttgattattccgaattttgtttttgtatttcaaattcgaaattttcaaggtgttacagaggcgccaaagtggtggctgcgcattgaaggttttcgaacggtggtggcagcagagtgtgacgggaacctttcgtgggaggggcgaaataattatgggcgaaagctatgccttcgggccggcaacgacgacgcctgtgggtgccgtcttcctcttggggcattgctgcataatctcgtctctcctagttactttcttctcggcgtcgttttgaagattgctagttcttgttttcgctctcatagcaggtgttgtggtagacgtgcggtgtggctgttttttcttttctgactatagtcttacaggactatagacttgtatttttctcctcctttatcaatacatgaaactcgcgctgtcttgtgcggttcgtttaaaaaaaaattctttatgtagaagcaagtatgctgctagagtacaagcttacatgtgtttaatttatctgttcgaagtaacaattaaccgtactttagagaaagtaagtacatatagagaaatagaagtaactgtgctaatattttgtaacgaacaattggctttacaaatgattgtttcagtgaaattgggttgaaatatacttggatgttggagtgaatgtgacttactaacgtcggtcagttgtgatatcttgaaatagttgttttgtctaattgtgacgctcttttgaggtttacttcaagaaagattcaccattaacattgtaagtttctttgtctacaatcttttagaaggctacagtggtacactgatattttctgctactattgaatagttgacataaataaataccatatatttgaataagtaagaaggaagtcgttttgacattagtcaaaatcaaaatgttttaggtttgaccaagtttatagaaaaatgtagttacatttttaacccaagacaaatatattatgaaaatatatttaagcatagatttaatgaaactaattttggttgtaaatattactatatttgtctacaaatttcttcaaattaagtttaactttagccaaaatcagaatgtgttataatctgaaacggaaggaacggaaggagtaacaagttatactaccatatttgataaaaaaaatattccacgatatattataatatgttttctcctatccagaacaaagcatggagattttgctaatagtaaatacatctcaaagataactatatatcattattcaacgagcaacagcttccaatgaatataatggttcacatccttcctctgggcgtgaggtggacatgaagcgggtggagcttgtaggcggtgagctgcacggtgtccaccttctcctcgtcaccctccctcagcctccacccaaactcctgcacgaagcgcgcgatggcggcgcacgcgatgtgagtcgcctgcaggctccctgcgcagaccctcctcccggcgccgaacgccatcgtcttgtacatgtccgccaccttgaacctcccaccggcgaacctctccggcgcccactcctccggcgactcccactccttcttgttcatgttgcacccatacaggttgatcaccatctgaaacagatgaccatcacttgttagattttcaggggattttgatcactgctcggcgggccgaccagtgattgaaatttcggactcccccagcaagcaattatatcccgcccgagaaaactttaggagaagtcaataacaacaagtttgtccggtacgattaaaatataagaatctaggaccagataggatatttcttaatactacgaatcagaacagaggaaatatcccatccagttataggctcttatattttggaacgggggagcgtatcctatgcacacaggccttcgcgtgtacacaccgtgtacaccaactaaaaattatcacaaaaaattctaggaaaatttatacatgtactttcaatagtattacatctacgtgcaaagtcgcatcttcaaattcattctacatagagaataacaaaaaagataaaattctgacaaaatagcaaccttaaaactgtcagattttttctttgttacggctaaaatataatgaatttgacgttaagattttaaccctaggtgtaatacaattgaaagtatgtgtatgattttttctagattttttggtgacattttttagttggtgtgcatgtgtatacacttgagggcctgtgtgaataggatatgttgccttggaacggagggagtattgaatttaacgggatgtgccaaggcaggtttgaaaaaaggatatagaagaaaagtggagcttagtcttctttttttttcttagactagaaaaaatacccgggtgaagtctattttaatcttcttattgttatatggtttagttaagatgaaattcactgtgagagttcgcttggataaatatatttttagaaaatcatgagctgtagttaggaatccgatcatcccaagttagcatgcgagtttttttaaatagatttcttatatgattccttccgtattacgaaaagtgaacgatcttaaaaaccgactcaaacatggatatgtatttccaaaagcaaacgaacttaaaaaccgactcatacacgatgacgcaccaaaataccggcaaaaacatcttcaatttttataataactagaaaaaatacccatgcgttgcaacgtgtgaagtctattttaatcttattattgttatatggtttagttaagataaaattcactgtgggagatcacttgtatatatatatatgtatatatatatatatatatataatcatgagctacagttaggagttcgatcgtctcaagttaacatgcgagtttttttaaacatatttcttatataattccttctgtattaccaaaagtaaacaatcttgaaaaccgactcaaatacggatatatatttttaaaagcaaacgaatttaaaaaccgactcatacacgcatgacgtaccaaaataccagcaaaaacatcttcaatttttataatagtagagatagagatagagaagatatatagattaaaatcagaacataaaattaaaaccgactcaaacacggatgacggatcgcagaaacatcttcaatttttataatagttgagatttcttgttttcttatggtccagtgtagatatagaggttgtatttttaaccattatctttaaaaaagcctttcattatcttgcaaagtttttatgaatttagtcaaaattttattcaaattcaattaaaatttcaaataatttcgtgcaaaaagaagtaccaaaaacaccaaagtttgtgaaatttttggccgaaaccgaaagtgcaaaccctgccggcccgccattgtcacatggttgtgcttacctcggtgccggcggggacatcgtagccggcgagcatggtgtcctcgttgacgaacctcggaggtatgagcgggacaggggagtggcggcgcagcgtctcctggaagacggcattgaggtacggcagccacggcaggtgctcctcggtgaccgcctcgtcgccgcacacctcccggatctcttggtaaagccgttcctgtcataaatgccaagaatgccaagaaaaagaccaaaaaaaaaagtattggttgataaagccaagaatgccaaaaatgagctggaacagagtaacaatatttcttgcctgtttgtcagggttcttggcaagctcatacatggcccattctgtggtgaccaaggtagtatctgcagcctctatgagtgcctcccacactagcatcattagttgctcatctgtcagtgtgttctctgccagcaagaagtccagatagcatgtccttgcctgcacatatatctcagtttcatggagtcaaaagaagatgatctcttcaattgaatcattttcctgatggctttagattgaattaccatcaaaatggtgtgttttcagtaaggccaatgtatttagccttaatcaataatagttatattgagagaaataagatcatttgaaaacttaagatgccgctcaagattaaaatcttcatgtggtacttgctcgaaggggttgttttaaccaaagataatttagcaagacgaaattggaatggaagcttaagatgttacttctgcatgaaaaatgagactatccaacatctgtttatggattgtcattttgcgaaatttgtttggagggcggtacagtttgcttttggtttatacctccctaataccatatcccatatgtttgatggttggcttttggggttgacaagaagaagagcaaactaatacttgtaggagcatctactatatgttgggctcagtggttgagtagtaatgatttgattattgacaaattaccatctttctcatatatgcaggcaatttgggctgcaggaat

SEQ ID NO: 92090 - DNA, 678 bp, Oryza sativa
cccacccatcaatgtcttgccatctctctctcgattgatgaaggtgagattactcatcaatataaatttcacataaactggtttcataacagttacatgctacaataatttccatttgcgttctaagaactgtctaataattcttgcagagtgctattggtgagggtatgacccgtcgagaccattcagatgtgtctaaccaggtaaacatttggactccatacatttgatttcatttaagctatggcaaatacttacagtggagctcatttatgctgtttcatgttacagctttatgccaactatgcaattgggaaggatgtccaggccatgaaagccgttgtgggagaggaggcgctctcttctgaggatctggtttgtcactaataactattgaaataatcccatgctgatgtctcttttagaagtaaatttaatattctatctttatctgcagctttatttggaattccttgacaaatttgagaggaaatttgttacacaaggagcatatgatacaagaaacatctttcagtcacttgacctagcatggacattgcttcgcatattccctcgtgagcttctccatcgtatccctgcgaagacattggatcagtactacagcagagatgctacccactgatctatgttcagaaaaatcaaatgttttctctcaag

SEQ ID NO: 92091 - DNA, 1342 bp, Oryza sativa
cctgcaccccgtggtagctgtataaaccagatgtagaggcgagggcactagtcagcagtagacgagacgaccggcgatgaagatggtaaggccaatcaacactggcagaatcatgcagccatggaagtgaagaaaccagtcggcagccatggcaaacgtaggcagcttgtgttgaagataccgatgcctattagtagtgacggtgatgtagccagccgtgaagaagatagcatcagttggcgttataacaggccagccgtgcaggcggtgacaccagtcagcggcggatgcggcggccggtcggtgaagacgtagacgcccaacaacggcagcataataagtcagccgtgcaggcggaagcaccagtcggcggcggacgaggcggccggtcggtgaagacgtagacgcccaacaacggcagcataataggccagccgtgcaggcggaaacaccagtcggcggcggtcgaggcagccggtcggtgaagacgtagacgcccaacaacggcggcataataagtcagccgtgcaggcggaaacaccagtcggcggcggcgaaggcaagccggtcggtgaagacgtagacgcccaacaacggcggcataataggccagccgtgcaggcggaaacaccagttggcggcggcgaaggcaagccggtcggtgaagacgtagacgcccaacaacggcggcataataggccagccgtgcaggcggaaacaccagtcggcggcggtcgaggcgagccggtggtggtgttctgactgatccattcctggagcgtaagagataagcttaaagccatgaatcccttttatgcatatctggatctggatcctgcagaacaaacatataggatgagtagtatctgatataaatataatactcgagaaaaatcaagtattttaaaatatttataaatatgtatttctcctcttgtcaattttgatttccccgagcagatgactctgtacgtttaaacactctgtctgactagtcatagcccccaagcatcgggagtcggcctaggcatttcccaaacatggatatgagtgacatgagttcgtcattaatggaacaaagtttcacggatcagaatttactactcaggtacttttgcaattattaagagcaaaaataaattatattatctctatgcttttgatttcttccgagtaatattagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagat

SEQ ID NO: 92092 - DNA, 1199 bp, Oryza sativa
ttcattcggtaccgtgtttccttctgctatcatcacatcaaaaagccccaagcactcacgccaatccctcagctttgcatacaacgcaagaatgacattccaagacacaatgctcctctttggcatgccatcgaacaccaacctcgccatctctacgtccccagcctgggcatatccatccagcattgagttccatgacacgacatccctctccggcatcgcatcaaacatcttcctggcgttctccatgtccccgtgccgagaataccccgagatcatcgagttccacgtgaccacgtctctccgcgccattccatcgaacagattcctcgcaccggccaagtcgccctcagccacatacccagccaccatggagttgtacgagacgacatcccgctccggcatttcgtcgaacaggcggcgggcggcagggaggaggccaagccggaggcaggcacggaggagcgtgttccaggtgacagcgtccgggcgggggatgtcggcgaggaggcggcgagcggacgccggggagccgagggagaggtagagcgagaggagggagttggcgatgcggaggtcggacgggaggtggccggaggagacggcgagggcgtggagcgcggaggcggcgggcagggagtgcgagtggtgcttcgaggagacgaggaggagaagcgtgaggtggtctccggggaggaggcggaggagcgcggggaggaggcggcgcggggcgtgggggaggagggagttgaggaggcgggatgagagcgcgcggccgcggtgggagtgggaggccgaggcggagaggccggaggtgacgacgagggccagggactggaggaggacgcgccatggcgaactctggccagcggcgaggcgaaggcgcggcagcaggtcggcgtccaccggcggcgagcggcggcgcgggaagcctgtggtcgagggaggcatacggtgtacggcccgggcggtttgagaagagaagcactttacaaaagccaattcacaagagttgttgtacgcaaacaattttctccacgttttcgtttggcatcgactaggcaaatcgccggtggatcattcacaagatctatcgaatcgagagactataggcctgtttcaaagagcttctacagaattagaatctagaaaataaagtataaaccaaagctgacaaacctagttttttccatttctta

SEQ ID NO: 92093 - DNA, 846 bp, Oryza sativa
gaccatttccaggctacgcagccagcggggcaacctattacttgggctcgcttcaccgccgctttccggagaacccatgtgcccgccggagtcgtggctcttaagaagagggagttccgagagttgaagcaaggcaaccgctccgtgatggagtatttgcatgagttcaacaaccttgcccgttacgccccggaggatgtgcgggaagatgaggagaagcaagagaagttcttggcgggaatggaccctgagctgtccgtttgtctagtctccagggactacccggacttccaacgtctggtggacaagagcatccgcttggaagccaagcacaaggagctggagtcgcacaagcgccgcttggcgaatttccgcaatcaacagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagaatcaacaagggactcgtgcgccccgtcctcctacgccaactgtgcagcctggtcaaggccgcagggacacacaaggtcagcagcgttgtcacgtcctgataaattcatcccgaaataaaagtcattctctaaaaggaataatagaattaattaaaattcgaaaagaaattggcaaacactaaaatacgtacaagaaaaattcaaatgtggcccggagaatttttgttaaattctccttggtctaaaaagagccctcaaattttagtggaattttcagagcacaaataataattgagaagaaataaacaaagttgaaaaggttt

SEQ ID NO: 92094 - DNA, 657 bp, Oryza sativa
gcaagggatcatattatggctgggcaaagtacgttcttagtggagctcatggaaactgcttctgtgcttgtaagtttctcctccctgatatgaatggcaaacattaattttcatgttcactgatctaatattttgtgtgccactttttcttcagtcatcagcaaccaagaattctcttgtggctttagatgagcttgggcgcggtacatcaacctctgatggacaagctattgcgtatgttgatttaaaagatcatagcattgagttattatgtactaagatatctcattagtcttgttgctgtgttttatgctccctatgagaatattaattgagtttattaatttgctcagggcatctgttctagaatatctagttcatcatgtgcagtgcctaggcttattttcaacacactaccataggttagcagcagaaaataaggatagcaaggtaattgattcatatcttgtaccctgaatagacattatttatgcactgaattgtggaactgaatatcgcacatctcaggtatcactctgccatatggcatgtgagataagcaagggagaaggaggtttggaagaagttactttcctctacaagttaacgcctggttcatgccccaaaagctatggtgtaaatgttgctcgattggca

SEQ ID NO: 92095 - DNA, 715 bp, Oryza sativa
gtttgtagatggccggcagcgttacccgtcgtggtttggacatgactggcttcgtcttggagctgcgaggcatgtgcgtggtcttggggtatccacatggagtggattaccaggccaggccgctcccggagcaggagggtgaggatgcagagcctcacgctggttgggaggtcactgcagtgatcctctctggctctcccgagcggacttcgctggcagtcaccgcgggtggagattccttccccgccgcttgccagaacgccgctctcctcgccatcggcaccctccaccagcgctacccggacgagttgcagcactcgccctaccgctaccacccccgtcgcggaggagccagcgaccacgccaccttccgagacgccagctcggaggatgacgctaccgtcgtgcatctggcacgcatggtggaggcgtacgacgcggctcgtatcgacttccaccagatggtgcgtcgtggcatggtggagaacaacctgaagatcctggagctgcgtcaggagaacctgcagctcaagaaggacctcgacgcagtggaggcgcagctgcaccagctcaagatcgcccagggagagatctgccgccccaagcgtcgccgcgtctgccgcagccagaagatcaccgccgtaagagcacctccaggcctgagcttgttcgtcagtccctggcgtggacttgcttcgtcgagacccctcgtgcc

SEQ ID NO: 92096 - DNA, 2792 bp, Oryza sativa
agccctgccgtccctatagaaattcaggggataccttttccctcggatctgattctgctagacaccaagaacttggatgtgatccttgggatgaattggttggctcaattccaaggggtagtggattgcgcgaggcgcactgtcactctgtaccgagggccggaacaaccggttgttttctttgcacccccaacctctgtcagaagttcagaactgcatcagatagggctgtcagaaatccccatagtcagagagttcggagacgtgtttccggaagaactacctggtatgccgcccaagcgagagattgagttccggatagatcttgctccaggaaccactcctctgcacaagcgaccctaccgtatggcagcaaatgaactagccgaagtaaagaaacagttggaagagttgaaagaaaaggggtacatacgtccgagtacttccccatggggtgctcctgtgatttttgtagagaagaaagacaagacgaagaggatgtgcgttgactacagagctctcaatgaagtcaccatcaaaaacaagtaccctcttccccggatcgatgatctgttcgatcagcttaaaggtgccactgtattctccaagattgatctccgttccggatatcaccaattacgtattcgtgaagaagatattccgaagaccgcattcactacgcgatatggactgtatgaattcacggtgatgtcgttcggcttgaccaatgctcctgccttcttcatgaacttgatgaacaaagtgttcatggaatacttggacaagtttgttgtggttttcatcgatgacattctgatatactcacaatcagaggaagaccatcagcaccatctccgtctggtgttgggaaagttgcgggaacatcaattgtatgccaagcttagcaagtgtgagttctggttgtccgaagtcaaattcttagggcacgtgatatctgctaaaggagttgctgtggatcccgaaacagtgaccgccgtcaccgattggaagcaacccaagacggtcactcagattcgcagtttcttgggtttggcaggatactaccggaggttcatcgagaacttctccaaaatcgctcgacccatgacacagttgttgaagaaagaagagaagtttgtgtggagcccgcaatgcgagaaggcgtttcaaactctcaaggaaaagctggtttcctcgccagtgttaatcttgccgaatactcgcaaggacttcatggtgtattgtgacgcttcgcgccaaggattggggtgcgtgctcatgcaggacggtcatgtggtagcctatgcttcacgtcagctacgacctcatgaaggcaactaccctacgcatgacttggagttagcagcggtggttcatgctctaaaaatctggcggcactatctcattgggaatcgctgtgaaatctataccgaccataagagcttgaaatacatcttcacccagtcggatctgaatcttcggcaaaggagatggttagaactcatcaaggattatgatgtgggaatacactatcatcctggtaaggccaacgtggttgccgacgctctaagtcggaagagccactgcaacactctcaacgtccgaggcattccacccgagcttaatcaacagatggaagccctgaacctaagcatagttggtcgcggattcttggctgcgttggaagccaagcctaccttgctcgatcaaatccgcgaggctcagaagaatgatccggacatgcatggactcctcaagaatatgaaacagggtaaagccgcaggtttcacagaggatgaacacggaaccttatggaacggaaagcgggtatgcgttccagatagcagagaacttaaacagctgatacttcaggaagctcacgaaagcccttattccattcacccgggcagtacaaagatgtatttagacttgaaggagaaatactggtgggttagcatgaagcgggaaattgcagagtttgtggccctatgtgatgtgtgccagcgtgtcaaggcagagcaccaacgaccggccggacttctccaatctctccaagtaccagaatggaaatgggatgaaattgggatggatttctcaccggacttccaaaaacccaaggcagatatgattctatatgggtagttgtggatcgattaaccaaggtagctcgatttattcctgtgaagaccacctatggagggaacaaactagccgagctctacttcgccaggatcgtgagtctccatggcgttcccaagaaaatcgtatctgataggggaagccaattcacctctcatttctggaagaaactccaagaagagttgggaacccgattaaatttcagcaccgcgtatcacccgcagacagatgggcagaccgagcgtctaaatcagatcctagaagatatgcttcgcgcatgtgtcctagatttcgggaagacctgggataagagtctcccctatgccgagttctcctacaataacagttatcaagccagcatacaaatggcaccttataaagcgttgtacgggcgcaaatgccggacaccactattgtgggaccaagttggagaaagccaagtgttcgggactgatatcctgagagaagctgaagctaaagtcagaaccattcgggataatctaaaggggcacagtctcggcagaaaagttatgcagataaccgacgccggatctggaattcgcagtggatgactttgtgtatcttcgggtcacgccattgcgaggtgtgcacaggtttcagacaaaagggaagctcgcacctcggtatgtggg

SEQ ID NO: 92097 - DNA, 1280 bp, Oryza sativa
taaatgttacagtaacagaaatcttgagaagattgtccaaataattcttacgactcatgctgcagagttaagcctttactgctatcaaagttctgagcaaactgtaataatcatttagttggttttcacattatcatcaaaagaacctcaccgaacatcatcatactagtatcacttatacatgcaaaacgtgtgctgcgaaattttaaccagaagatactaatatatatatttgggatataacaaacctgtggaatgatatttttctccatggcgtccttgaaaagaggtggaggtggtaggtcaaggccaagcatcaaaaatgggaccctagatgtttcagtaacaatatctgaacctgcatcaccattctgttcatcgccgtcctctttcttttccacaatatgcttcttgtgaaattccttaactacttcaagttctccctaacaaaaacaatgctgtaagaagttgcacgcaattttattaatcaaattgttggtatagacaaaaactatacctgaaagcaatcatgtatgatgcttctgtttctcttcctactttttagtttcgagtgcattgtgttcaagagccatgacataaattccactggatcagactgaacaccaatctggaacctcttatcactggccttcataactgcttgcagaaactcatgtggactaacctgcacaaaaagcaacatgttaacttttgagtatttgtggaggtagaggaacagcacaaatatgctggcatgcagctatctcactaaaaaaccaacctggcccttgaagttccttgcatgccagattttgcgagttagttctccaaatcgatgaaccaatggggatttgctatgccgataattttcagggatgagaaagaaatttcttaaaggagtaattctcattaatgactgtattgtgacattcacaaaatctgtctccttgatgttgtttagaccaacctgcaaatttaagcatagagaagtgactactgccataggataataatggtcaaagcagagagaattgcaaatattgaggtgcaataggaaatctgcaatgtttttaagttgtgacatggtgatggtcatataacaccattataataataacttaatatagaatgaaataacctggctaaaaaaagctcatgaccaagttggctgcttctattcaagtccacaattttttaggctttcactgtcattgtgatttttttccagaagatgctttttcatttttgtaatttctccagatagaccaactaaacaaaac

SEQ ID NO: 92098 - DNA, 678 bp, Oryza sativa
cggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcacgccggcggtgaagtcgtagacgcccaacagcggcggcataataggccagccgtgtaggcggaggcaccaatcggcggtgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcgtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgcgtaggcgg

SEQ ID NO: 92099 - DNA, 9446 bp, Oryza sativa
gggaggggggggacgaccgggtcatggcgaattatttccccatggctcttaagggtcaggcgcgcgactggctcatgacccagccccccgactccatccactcctaggaggacctgtgccagcagttcattacgaacttctagggcacgtacccccgcccaggagaggagacggacctgcatgctctgcagcgaaaggacgatgagcccctccgctcgtatatacagcgcttctgccaggtccgcaacactattccgtgcattccggctcacgcgatcgtttatacgtttcggaacggcgtgcggcacaatcgcatgctagagaagatcgcctccaaggagcccaagaccaccgccgagctcttcaagctggcggacaaggtggctcggaaggaggaggcgtgggcctggaactcccctagcaccggcgcggcagctgcggctgcccccgaatccgttacccgctctaagcggcgagatacgaggggcaaaaggaagccagcccgctccgacgacgagggccacgtccttgcggccgatgggccctcacgggccccgcgcaaggaaaaagccaccggcgataagccgagctccaccgctccctccggagagggtcggtcggcagacaagtggtgctcggtgcacaacacttatcagcacagcctcgccgactgccgctcggtcaagaacttggtcgagcggtttcggaaagccgatgagaagcggcagaatcgacgggagggcaaagcccccgcgacccccgccaatgactggcgaggggaggccaagaagaaggcccccgccgatgacggcgatgatagcgaggatctggaattccagatacctcagggaaccgtcgccactctcgacagggaggcttgcgctcacacctcccgccgcggtttcaaggtcacgaggtgtgagcttctggccgccgtcccaactcacaaggcggcacggaaggcgcgctggtcggaggtgaagctcaccttcgaccagagcgaccatccaacaatgctcgctcggggagggaagttggccctcgtggtctccccaaccatccacaacgtcaagatgaagcgtgtcctggttgacggggaggctagcctgagcatcatctccccggctgcttttgacgcgctcaaagccccggggatgaagctccagccgtcactgccgatcatcggcgtgacctcgggacacgtggcctctgggtcacgtttagctcccggtgaccttcggcgactccaccaacttctgtaccgagcggattgacttcgatgtggcggacctcaatctgccctacaacgtggtcctgggcaggcccgcgttggtgaagttcatggccgccacccactacgcctacctccagatgaagatgccgggccccagcggccccatcaccgtctttggcgatgtcaaggtcgccctcgcctgcgcagagtagcgtgccgacaacctggcggcagccacggagccgcaggtcccgaaggcctccacgtcccgcgcctccaagaagcgcctcgcctcggccgacgaggtgcccgtcaaggagattccccttggcgatgatccatccaagaccgccaagattaacggtaccttggacgccaaataggaaagcgcgctcgtctccttcctgcgggcgaactccgacgtctttgcgtggaagccgtcggatatgcccggggtccctagggaggtgatcgagcaccgcctcgccgtgcggccggatgcgcgacccatccggcagaaagtacggcgccaagccccggagcggcaagccttcatccgagaggaggtgacgtggctcctggaggccggcttcatccgagaagtcatccacccagagtggttggcaaatccagtggtcgtcccgaaggccaacggcaagctccggatgtgcatcgactgcacggacctcaacaaggcatgccctaaggatcccttccctttaccgcgcatagatcagatagtcgactccactgcggggtgcgaccttttgtcgttcttagatgcctactccgggtatcaccagatccgcatggctagggaagatgaggaaaaaactgctttcaatactcctgtagaaacctttattatacaactatgccttttggtctcaagaacgcaggtcctacttttcagcgcatgactcgcattactttgagtaatcaaatagggcgcaataggcgcaatgtagaggcgtatgtcgatgacctggtggtaaagacacgccaccaggacacgttgttgcaggatggctgagactttcgacagtcttaggtccacgcgcatgaaactgaaccccgaaaagtgtgttcagtgtgccggcgggcaaactcggttttctagtctcctcccgaggcataacccccgcacatccttcggcttgtgcaggcttggccgagggctaccactgttaattatgttgtatcttttcccttccccagcaataaatttttccgctcaagcggaggctattgcgcgccctttcttactccttcctatggctcgtcctgcttcaaaggatgattcgcgcttatcccggaccctaagtggcgttgggcgacctgaaaaccgccgaaagggagcctaaacgcgggccgcgccccgggctgcggcgaaccctgggggctcggaagggcctacacacggccatccccgacccccggtcgtcgtagcctcggtctggccagacctgctaggcagctccctcggggcgacggcattgcccctcgccacctaggtgccacgggccgagcgtgagtttcccttttcaccggaacaagcccgaggagggacataaagagggtaagaacggcaacttaatcataagaaagtcaattgaatacgttcgctttggtttcttcttctttctttgccgcagacattcaaaggagaaagcaagaatgtaaaggcgcgaaggagaagctttgtttacaaacagtatggcacgatgacctaaagtttgaagcgttcaccgcgagcacataacaaaataaaagaagaaaagcggggatagtcacggagtgcccgggaccccgagtccggcgccgctgaccacctcgtcccagtcctcgccgccgtcatcgccaccactgtcctcgctcccctcccctcgtctgaagcaagcgcaaggttgaaccgaggggccgacccctcgaagctggagacgatcgcgtcggccgcctcctggacttgctcccgagccctcgcctcggtccccggggggaagtcctcgagcgcgcgccacaggacgaagtcggggtcgcgagcttgatgacttgcgaggaccagttccaccgcagcccgcgccaaagaagccgacaacgacttcacgacctcgccgacctcctcctccagcctctccaaatccgcagccatcccgtccagccggagcgcgagtgccggctgtgtgggcgggagcttcctgtcccgacgcacggagatgcctacccggcgccccgcgcactccagccgttcgacggcgtcggagagttggccaggtccgatctcgttggtgaggcggagggccgcaatctctccagcttggtcctgcaccaggagccgcaggtcggcgagggtgctttgaaccgcggtgagttggctcatcaactccgcgccgccgggctgcccgcctgccgccagctccttctcccaggcctccagctcggaagccctcgccgccatcgccgcgcgctcagcgcgggcaccttctaaatgccgggcctcgcgcccggcaacggcctcctcgcgtttcgcgagttgctcgcccagccgacgcgccgccacctcgcggcgattcacctcggcctcgcgtgcggcaagcgcggtgtcccgttctcggcacgcctcctcccgaagccgcaaccccttcgcgcgatgagccaccgaagcctctgcggcaagggtggtctggttgcgctcggctgcggcctcctggcggaggcgaagggaggactccgcctcggccgccgttctctcgggcggccaaagtggtctcgcgctggtctagcatgcgcgcccgctcctccagcacccgagcatgctcctccagctcccgggctcactgcgcctgttcccgactgcgcccgtcctgttcgcactggttacggtcgaggacctcaatccgtcgatggatcgtggcctcgaactcctgcgcggagcgggcgcactcgtctaaggccttgcgattggcctcgagcgccgccaaccgagcccgcagcgaggcgtcgacctccgacgcccgccgctcttaggcagcagccgcgtcgaggactccgcgggcgtcttcgaccctcttcgccagatcctcggcgtgggcctcgtactgcaagcgaatgtcgcccagcgcctcatccagtacgctcgaagagataagcaccgcctgccgctcctcctccgtctcccgcataaccgagtccagcgtctcttcgcgcgcctagttctccgccagttgggcttggcgcattttgcgccccacctccaccatgtcgtccacggcgcggcgcccctcatcgactcgcgcgcggtccgccgcgagctgcgcccactccacctccagggccgcctgctcgtccgctagggcttgaacttgggcattgagcccctccaggacggtggagtcggcagcggcgagcacctgcaggagtggctccatgctcacgggagtcggagaagaaaaagacggtccgcccccgagatgacggagtgctgctggaccccccgcgagactgggggctgctctcggcccctcttccgcgcggccagccccgaggacgccccaaatgcagaggggaacggttgcccccgtcaccccccgcctcggcccctcgggcagactcggcctcggcctcgagttcgggcccgcccccggcctcagcctccaggccgtgccccgcctcggcccccggagcgtgttccacctcggactccgagccacgacctgctttggcctccgcccccgagtggcgctcctcgtaggtcgcgccctcgggatcgcccccggggggacgccgtcgccgttgctatcacccgcggatggttgcacctcggctgtggcgggctcggaaccagacccggcgtgtggcccgggggccccaccagggtactgcgaaggccccgtgacaccgggttggccgggtcccggtcgatcccaccgctcggattttgacccctacaagggatcggacgccgagaccccctgggaaggaatcccgctacaggagaaccccaatcacgttaaaaaaaaaagaagaggaaggaacaggaggccgagatggatagagagcaccgagtcggatgctggcgatcattcctgcgaggagggcgtttgaaggtccacttccggggctcgatgaagctcccccggcacggctccgtttgccctatcttccggagccgcttcttccgtccagcctcggacgcggcggggcgtttgtggcccgccggtggtcggtccgccgttcgctcggcgccccctccacgcgggggagaaggcagccgagattcgaacgccttccgcttccctttcgggtcgccggccgagtcccccccgggtccatggctcggaccgggcgcccaggagccgacgcccccgccggagccgccggcccggctgccgcctacggtcgcgccgctgctacccgcgccgtcgccgccaccaccggcgccgctccggcgggaccgacccctgccagcaccgactgccgacatcacagccaggatactctcccggtcgcggtcgctgcagagggggaggatcccgtccggaatcagcgtttgcttgatagtgtccaggcccagcactcgccggatcaccgtcttcgcgtcctcctcgccccagtcccagcgctcacccacgtgggtgcgcatgggatcgttgtgcccagtatactcccacgcgccgcgggaccgctcctggagaggcgcgatgcgacggcggtagtcgccgaacaccatcgcccccgttaagccttagcttcgcaggcccctgaggcgatcccgcacggcgtcgtactcctcgcccagttccgaaactgccaaccacgcggcggatcgttcaggagggccgacggggagccgaagtcgcggatgatccggtagcgcggtgtagaaccaatccttcttccaatcctcccacttcttgcagaggtggctctcgatgtactaccccgccattcccggccggggctggaggtagcatcctcccaccgccgcgccttgctgcagctgcgggatgaagaaggactggaacagccgcatcgtcggccgcaccccgacaaacatctcgcacaagtgcgcgaagatgaccagcgtcatcacggcgttgggtgcgagatgcaaggcttgaatctcgtagaaatccaaaacctcatggaagaacctggaaaatggcgggatcaaccccaccatggcgaaggacaggaggtgcacggatcgctctggataccacggccgcggccgtgactcccccaccctcacggcggcgtcctccggcatgatcttgcggacgaggctaagatgcatctctgccgtgatgcgcgacgccgggagcacagcgtcaccagcgtcatgggccatggtgaccggcggggaaacgacgaggagcttggtgtacagaatggcgtggagcgagagaagcgatggggcttgaagaacgagtgagcgggcgagcagtcggcgagaagaaggggacgaactcgcccccttatccttttatccccgcctcgcccgcgctcgtctcctcgtttcacgcccccgcggttgtctcctcgattcatgcgcctcatcgtttctcgcgtccactcatcacgtcgcccactgaatccgcgccccgcgttcagtgaacctgtcagcggcacactcagcgcggggcgtgcgatgttcgtgggcgcggattaggcgggcccgccgtcggtcccgtcgcgtgcctggcaggcgagggagtcgaggcggcgtggctgacgattctgggcgtggtctggtcgaccccccgattttcgcgccttaggcgcccccatcatcagcgcggttaatggcggtcaaatcgccattatggctaatgcgccagcctggccgcgcggcggcaaccgtcaggattccccgtcgggcccacaacctcggcacgggaagacgtgaggcgccacgtcagactgccctcacaaggccgatgtccgacgtggtgccgggggctactgtcggagatatgggcccgggggtatgcaaagtgaggggaagttaccttcccatccagccacatggctctacagcctggccctacccccgcacctcgtgagtcgcaggtcgcagaagcggctggggggcctcggggtgccacgtcatgcccctcgagctctcgcgttgccttgccccgaggccctcccccagctgctatgtggcggggggagcgaggggaggaagcccaggctgaacagccatcaatgcgcggcaccccaactatccctcaccgcgtttaatgcggtaaggacggacgtgcggtgccgcaccactgatccacgtcaatcgggtctgactagtctgtgaccggcctgtcgccggtcacgttcgactgaacgggcggcagtgcccccacgtcgcctctgtatccggcgaagtggaggtaggtatgtcccgtcccatcgaaacgtcattcggagttccctccgtgagaggaggatcgccacaagtcttcacccatttatgagggaatgacagggctgtcccccgtgtcaggcggggggggtgcgttgggtcccgctcaaggacggactgctgcttagcttccgggcgaaggcacaggtcgcagtccggtcaaggtagagtgggtccccctctcgtagaagagtaggtagaggcggtgcatgcggtatccccttgaactatagaaggaggaccttgcccaccgagaaaaggagcgactctcagtaagcctgaactctaggagaagagaagtgggagcgctctccggagtttaggaacccttgtaacactcagccataatctcacacacaggagtagggtatcgcgctccatagcagcccgaacctgtataatcttagtgcccacacgcgttttagtagcattgagggcggattcgcgatctccccacgcgagccttttcccccggccgaactcactaaaggggatctcacgatctcccgctagagaggatcactcctcgacagaagccatcttcaacctatgaatgccaataaaaaatgaattggagataagttaattatacataccactaacatatctgcttcaacaacttcttccaaagtagcatgaaatgcttccactagctgcacaagaaaggttactatattattactgtcaccacagtagttgaaaaaggctttcatgcatcattaaggttcccctggaggcctagaccaaagtggcatgatagtgctgtgattggcagcaacaccacaagggcagggagagatagagtaaggaatttcaggtcactcttgcttagcacttcatgagctaagacctcatgttaaaaagagcattcctaagataattcaatctaagagataagataatagagaaactaggaagtaatgaatatgtgaacttcaaaccacatacttgcaactaacttgcagtgccagctcttttctctcttttactatcaactctgcacagttctaacctagtagcacaatgtaatacaagcctctctgcagcattttcttaaaaaaatgtattaaccaaatctttatagtaaggtgaatgttggggtttagcagaggtcggcataacagatggtttcgctttaaatcgtgccagcagtgctgttggcagagtacaaaactatgcaaaataaactaataacttgtatgcaaaatggtagacgctaaatccacgattgtgtcaaaacaatctgcaaggtcaaaattaaatcaagaaagctacctgcacaggcaagtctgagatgaagccaacagtatcgctaagaagtgcttttctcctgaatagcatttgacaaaaaaaaaagattatatactgaacatgcactaatcacaaatcaaatctactgacatacaatagatgaatgaaaaatctattaaggtaccctgatgggaggatcacactgcgtaagcggggatccactgtagcaaatagcctgcatggaaacagtaaaatgatttggctacacagtgcacatttaaaatagtaagctatacagggaaaagttctcatcatacctgtcatcactgtatagatcagtttcagaaagtgcactcactagagtggattttccctgtaaaagatagcatcaaaggaaggagtttgtagaaagctcagatatatttcgctgtatttctggaagagcatagaaaatggttgtccaatattaagggagagaactgcaatggcagatcaacgtactgcattagtgtagccaacaacagcaacggggtgcaggaa

SEQ ID NO: 92100 - DNA, 1750 bp, Oryza sativa
cggccggtcggtgaagacgtagacgcccaacaacggcagcataaaggccagccgtgcaggcggaaacaccagtcggcagcggacgaggcggccggtcggtgaagacgtagacgcccaacaacggcagcataaaggccagccgtgcaggcggaaacaccagtcggcggcggtcgaggcggccggtcggtgaagacgtagacacccaacaacggcggcataaaggccagccgtgcaggcggaaacaccagtcggcagcggacgaggcggccggtcggtgaagacgtagacgcccaacaacggcagcataataggccagccgtgcaggcggaaacaccagtcggcggcggtcgaggcgagccggtggtgacgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcataaccatcaagcaccgggagtcggcctaggcacttcccaaacatgcatatgagtgacatgagttcgtcattaatggaacaaagtttcacggatcagaattttctactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaaatatgatataacatctgtagcccccgactcactactcaatggaagaccaattggtgtagtgaggcagaggaaaaggaaaaatatcatataaagaataaaataaatgatgacttagctttataatattccccttggtgatggcagaagtggccaatgtgggaacaaagtcgtccatcaataacaatgaagacaccagtcggcggcgacgaaggcggtcgacggtgaaagcgaagacgtccaacaacggcggcataataggccagccgtgtaggcggaggcaccactcggcggcgacggaggcaggccggcggtgaggacgtagacgtccaacaacggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcacgccggcggtgaagtcgtagacgcccaacagcggcggcataataggccagccgtgtaggcggaggcaccaatcggcggtgacggaggcaggccggcggtgaagtcgtagacgcccaacagcggcggcataataggccagccgtgtaggcggaggcaccactcggcggcgacggaggcaggccggcggtgaagtcgtaaacgcccaaca

SEQ ID NO: 92101 - DNA, 1067 bp, Oryza sativa
  unsure (1)..(1067): unsure at all n locations
cccatgaacggtggtgtgaccaaccgaccgtataggcggggacaccagtcggcggcgacggaggcaggccggcggtgtagatgacgatgcccatcaacggtggtgtgaccaaccgaccgtataggcggggacaccagtcggcggcgacggaggtaggccggcggtgtagatgacgatgcccatcaacggtggtgtgaccaaccgaccgtataggcgaggacaccagtcggcggcgacggaggcaggccggcgccacannnnnnnnnnnnnnnngcaacggcagcggcgcacaccaaccgtggaggcgatgaaaccaatcggcagcgacgaaggcggccggcggtacatgtataaaataatagatcaaataataattagtgatctgtgaattaattctaatttatataagaaaatttagaacgataaacctggtttgtgatccaactttgattcgaggcctgtcaatggatgaaccgtagcatgcagccgtgtcatgcagccgtgtagacatgtaatcgtcggtagcacatgcacggattagtttggagaccactttgtgcatgtaatagctgatttgtgtatggattaatttccttgaccacagatttgaccaggtatatttaatttgtatcctggactttgtgtcttgccgtacgtatccgagtagtattgacttggtgatgtacaggctcaaccaacggtgatcttcgcatgattttggcggcggctgcttgctgattgcttcaaatcatgccctggtgacgaaaccgacggaccaacagatatggcagcattgtagcgacggatttgatctcactgacggaggtaaaattgacggtaacaagctggttgtagatcgattcgatcggtgataatctcctggttgattgaccagatccagatagaatttttggcgacgaagaccctgcccttttgttgagaggatcacggccaaagacaagagtagcaccgatgatgccggcacaaagttccatcgcacttctcgacggaaaactcgacgcagcccctacctggcgcgccaactgtcgaaacatgaattcggcaat

SEQ ID NO: 92102 - DNA, 1041 bp, Oryza sativa
agcggcggcataataggccagccgtgtaggcggaggcaccaatcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggtggaggcaccaatcggcggcgacggaggcaggccggcggtgaagatgacgatgcccatcaacggtggtgtgaccaaccgaccgtataggcggggacaccagtcggcggcgacggaggcaggccggcggtgaagtcgtagacgcccaacagcggcggcataataggctagccgtgtaggcagaaacaccagtcggcggcggcgaaggccagccggtcggcgaagacgtggacgcccatgaacggtggtatgaccaaccaaccgtataggcgaggacaccagtcggcggcgacggaggcaggccggtggtgaagtcgtagacgcccaacagcggcggcataataggccagccgtgcaggcggaaacaccagtcggcgaaggccagccggtcggtgaagacgtggacgcccatgaacggtggtgtgaccaaccgaccgtataggcggggacaccagtcggcggcgacggaggcaggccggcggtgtagatgacgatgcccatcaacggtggtgtgaccaaccgaccgtataggcggggacaccagtcggcggcgacggaggtaggccggcggtgtagatgacgatgcccatcaacggtggtgtgaccaaccgaccgtataggcgaggacaccagtcggcggcgacggaggcaggccgg

SEQ ID NO: 92103 - DNA, 1277 bp, Oryza sativa
tgttccgttgcagttgggtgaatatccgcaatggtgtcaaagtcgacaaggaaggattcacattaatggacctggccaaggttggatacgcagacgaaccattcatactagcaaagcaggtcgaacagattttgtacataaaagaccccgcaaacaagaagatgcacgtcgttagggatggcaagcaaagaattgtgggtgtggacaacgttgtcgatgaagaataatacaacaagaatcttcatgtgagacctcagatcgaccctgacgatgatcccgaagacgatgtggcttacgttcgttcagaccattcggaaggcatatcactgtaaatgatgtatttaatttgtattggagccttaatgaatgaattgcatatgtttcatgccattccagttaaaactcattgaagaaatggatttgttaattatgtggttttaaaaaattatacttgttattttaaactatatgtgagaaagccaattgttaattgtatgaatttaaaaaagtaatatgaactttaaaatatatgtgagaaaggcaattgtcaattatatgattttaaaaaattaataggaattttaaactatgtaaataagacatttgttaattatatgagataaatcaaatgtaatagcaattttaaatcaggtagaagttaattataaatgatttttataacttaaaaatattttaataagtcatctatgacgggctttagtactatgcccgatagagattatttcatctctatcgggcttagtgctaatgctcgtcacggataggtatcatccgtatcgggaagagtactaacgcccgtcacggatgagtgtcatccgcatcgggcatagtagtctgcctgatagagatgaggattgactagggtttacttagtcaatcctcatccacgggtacttatccaccgccgatgccgcctctcactttctcacactctcactctctcagatccactgccgccgccgcctcctcctcctccgctgccgccgctgacgccgcctcctcctcctccaagccgtcgcctcccgaccactgccgcctccctccacgccccccggttcaagatcccccgccgcctccctccacgcccctggttcaagatccaacgccaccgcctccctccacgcctcccggttcaagatccaccgccgcctcctgctctgagcgccgccaccgcctcccggttcaagatccaccgctgcctcctccctcatcgtccacgagccctcgtggatccggccttcctgaccgccgcagcc

SEQ ID NO: 92104 - DNA, 3238 bp, Oryza sativa
ctccaaattctcttgaaaggagtaggtgtctgctgaatacaaagagcattgtaaaaagttttgacagaaaaggtcccttacttagtcaggttccagcggagcctatctttgcaacctggctgaaagtgtcatcagcaaatttttgtttaatgaggttccaatctgtcaacttttcatcaaccaaggtccttctaaacttgaccacactccaacctttttcttttatcttagctaaggagataagttttgtcaaggtaatattataaagagcagagaactgagaggatagtggccagccacccatccagctatcctcctaaaacattacagatctcccgtctcccactttgtttgaacacagactataaaatttgtcctttagttcaagaagcccctaccaaaagtaagaatctccagattttgctttcaggacagatatgggtttcttcttcaagtatttgtttctcagaaaatcttgccaccatccctcttcattttcaagttgccagatccatttccctagcagagctttgttcataagatcaaggtctaacactcccaacccccctggtccataggagtgcagataactggccattgaacaaagtggtacttcctaatgccagagaagccttcttcttaaaaaaaatccattctctctcttcaccctgaggaattctataaaaggacaacatgtagagagggatattacttaagctggagttaatcaaaatcagcctcccaccaattgattgaaatctcccttgccagcaacccaacttgtgttccattttgtttttagctgttttccgatcctttttcaggatccttcttttatctataggtacccccaaatatctcataggcaaatcacctatgttacaagtaaagagttggctatagttttttttttgtctttcttctgtcaatcctatacaaaaaatttcactcttgttgaagttaattttgagacctgataattgctcaaaaagacacataatatatttcatttgtggcatattctaaactatcaggaaataagagaatagtgtcatcagcatattgcaaaacggcagctttgttttcatcattgacacctgatccttctagcaaggaattattttctgccctatgaatcaacaaagtaagggctttagctgctaaattaaaaagcagaggagatggagggtctccctgtctgagacctttgtaagtttgaaagtaagggccaacttcatcatttactttgactactactttccctgctctaatgactttcatcatctaggcgcaccattgaggtgggaaattctttgcaactagcattctatgaataaaatcccaatctactttatcataagctttttcgaaatcaatcttaaaaagaatgccactttgtttcttttagtgaatagaattcagaatttcatgtagaattaccaccccctccaatgtaaacttattcttaagaaaggcagtttggtttctggagataatataagctattacacattcaatcctattcatcaaaacttttgtcaagattttgaagctcacattcagagacaaataggtctaaacttttgaatttgcacagcatccttagttttaggaaccaaagtgataatgccaaagttgagcctctctacatccaaaattcctttatgaaagtcattcaataaatctaagagatcaagttttatcaagtcccagaatttggcataaaactccccaggggctttattgtgtttaaggtcaaataccacagtcttaatttcttccaaactaaaaggctgaatgagccttgctttgtcttcctcagagactgtagaagctccacccatgtcaaaattcatggtgttttctttagaatggccaaaaagttccttataaaatagtgttatataatttactaattccctttgtcccactatcttaccctcctcctgagagagggagtgtatctggtttttcctcctcccatttgcttttgcatggtaatattttgtgttacaatcccgctctaatatttctttaactttgcttctttggtaccatttcagcttttcttccataatcataaaactcagctgttgctctaacacccttctctcctttctatcactattagtcatgccagctgattcaattttgatgtcaatagcatcaatttttttgaaaatctcttcttttcctttcttatacagcccttcccagtttttgttccagccattcaactttcttctcagggctaagtttcttttgccatctctcaatactactaccagagatctggctattccacacttctgtcactactttagtgaggtgtaacagttactaggtaattgttgctacctagtaactctattttgaaagcttgaaagaaatgtttttttaagttctctctttcttttccacggtgttggaaatcacttgcttgaaaatgggttgtccgttagatttattaaatgtgtgttttgttcatggtcgtcgatggatgggatatgtccatccataatttattcgatatatcaatcaaattttttgtttgattttaatggatgggagcatccaatttatagttcggttgaaacaataaaacatagatgggataagcccatggtttgcttttatatatacatacaataaaatataatcacccggcatcttgtttaataattaatataacagtgtaagactcacaaattgggtaagtggtttaggagaaaaaaaatcatttgcaacatgcaaacatgaaatcgtacccaccacagctaatctgaacatgccacgtccaagtcctccattggaggattgatcatattaagactctctttgtttagacttataagtaaacaaatgtctacctaagtaaacaaatagctttcccgattagaccttttaaagacattcttattcttaaggaaaacaaaactatagaatttttttatatatgtgaagtggaggtatgactttgtattaaacttaaagccttgaaacaacttgcttataatacatttgaacaaaaggtttgcttaaaaaataagtttaagaacaaacaagttctatgtgtttttgcacaaattttgacaatttgacgctttgcggaaactaattttacaaatgaaccgcggccaaaacttattttagaaatgacccttttgttcagcgccaaatcgtatggcgctgaacttaaacacctcatcgccacgtcaacagacgctgaatgccgtgc

SEQ ID NO: 92105 - DNA, 664 bp, Oryza sativa
  unsure (1)..(664): unsure at all n locations
gccccattgtactttgcttcaattcactgcaaatggagcttacttcataggcacatgcagcattcttttcagcaaaactgaatgcttgttgatttctannnnnnnnnnnnnnnnnnnnnnnnnnggttcactgaaattgtaggcagtccatattacatggctccagaggttttaaagcgacactatggccctgaagttgatgtctggagtgcaggagtgatactttacatacttctttgcggtgtaccaccattttgggcaggtgtgttctttctcttgactagactgcatgtgttgcggggaagttatagaacaccattcttatcatattattgtggtgccatgcagaaaccgagcagggagtagcgcaggcaattatacgctctgtggtagatttcaaaagagaaccatggcccagggtatctgagccagctaaagatcttgttaagcggatgttggacccaaatcccatgacaaggcttactgcagaacaagtacttggtaagcatcgccaatcacctgtcctaacgcgtagcagcatacataatgctatctcactcctactttagtggaatatatgaaggatatgtctgtactatatattatctatgatgtgattgatgagtaatgaactcacattattataagaagatataaaattagc

SEQ ID NO: 92106 - DNA, 612 bp, Oryza sativa
ttggtactgggtaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcactcccaggctaacacagtcagaaatcgaaacgtactctcaacagttcgcttaggcatggaagttttgcggcattctggctacacaataacaagggaaga

SEQ ID NO: 92107 - DNA, 4763 bp, Oryza sativa
aagaatattcgggatgcaaaaacttgtatagaaatataccgtcggtgtcgcacaaccattgcgcgaaaatgacgcaggaatgacgtcgcgggtggtctcccgcggcaataccgcgagcccgcgcggtttcgcggactgaaagagcgagaccgttcaagcaatcagcgacactgtccaatgggctccttttgattagtaattaattatttgattaacaattaattaataattagtaattagttatcctgattagggattaattaattattaaaatccttaatcaggataattaaattgggaaggaacggtttcgctgtttgcttgagcgatagcgctgattgtttgagcgagaccgcgtgatctcgcacttgtgcgataccggttgcgacgtcattttcacgtgcgtaatggttgtgcgagaccgatggtatatttgtgcaaaagattttgaatcccgaatattttttaaaaaaattgaatgaacaataaattttcaaatttaattccctgagagacgggcatgcacctgcaccgtggtcaaggtcggcaataataccgcagggaagcatggacggcgcactcggatggttaggctcgcagctgcagtggaaaccatcagatcacaggacattactctcgcacagttgcacgtttggtactcaaaataatgtttgaccgttcgtcttatttaaaaaaaattatgaaaaaaataaaaaaaaattagtcacacataaagtgctatttatgttttatcatctaatagcaataaaaatactaatcataaaaatttttaaataagacgaacaatcaaacgttgaacgtgaatagtttaaaactgcacttattttgagacggagggagtagctcatatccgatatccgaggggagaggatggatggatggagacagacacagacccagaaagcaaaaattactggctggacaaccaccacgccgcttcccgtggtaaaacaatcatgataccctctttttggaacgctcaaattccaccaaagtgatgaggagatagcacaaatgtggtgggtatttatagttgcaacctgcaaatgacaactagatagatacggccgcaagtattgacagcatcgtaagacggcaacaataggatcgcggtggaatctcagcaagtctgcatactgcaaggaaacggtaatggtttgcacaattgaatctaacaatagcatcagttataaccaggcaaactgacgtggttgcaccttgcaaatgaagcctgcataccgcacaacttattactgtcaaaatgaacaagcacgaactagacaatagcaaacaatagcaaaagagagcattttttctttctacgaaagttgttttccttaaaatgtagtagtaggcttttaagtcggcagacacttccatctcaacgtcatcactacacaatataccttctagctagcgtactcagtcagtacaacagcctctaccacaggccagcaaccgagaacatagttcaacgaacaaagttgatcaaacttagtgcagatatataaggatagcagaatcaagactcaggggggctggatctggaagatatatcacaccatacatcggttaagactacgttcgtaccatctatcaaaaaacacagaccgagaacattcaggattgcggacatagtagctcccagtcaccatgtcaaggcagcaagcctgcgaggtggagtccgagatcgccgatgtaatggcctgtcagggagacaaactagtcagcaggttaaacagagtaagagtataaaatttctagccagaagtggtcagcaccatatctgaattcctgttacacaatacaaatctgcactcaattaatccagaggattattaagacagaagttccacgtctagagaatggggcattgcactagctgcagtttagatcaggctcagataacgcttcctcaacgctactgtctaatactgtacgtagtaggagttcacaagaaataggtcagagtttggactcactttgtttcttctcagatatcattacctcagactggttattgaaacagtgaattatcatttgcggtttactcataatcacggaactaagagaacaaaaacacttctgctcccacaaatataaactacttgtttccaccatcaatttatcgaagtagttggaatttggaaatacagcaatagagctagaggtgatggactatttagtactccctccgtatttaaatatatgatattgttgactttattcggtcaaacttttgaaactttgaccatcatctctaaaaatatatagtttgaaagcgtagaaaacatataggtatactttactactttataagtacttttacaatattataattttattagatattatcattatattataatagaaaaatagtggttgaagttgcacaccaaagatcgaataaagttaacactcaacctagatcagatgtgatagtctgagttcacaaacactggaccttctgcagaaaaaaacttactacctccgtcccaaaatagttgtcattttgagtttttgcttgtaacttttgaccattcgtcttattcaaaagattatgaaattattatttattttgtttttgacttgctttattatcaaaagtactttaaatatgacttatccttttttatatttacaataatttttaaaataaaacgaatggtcaaacgttgcaagcaaaaagtcaaaacgacatctaatttaggacggagggagtatgaaacataggtaatgtcttccaggttaacaggtttacacgagtctaattatgtcaaaattccacaagtctggatgaactgcttatgcaaatcccagatcaaaccaaaccaaataaacaggccactaggatagggaaaaaatagccactgaatatgaaacaatatgttacagttacagatcttgcatgcaagatttcacgaaagggcaattgccaggaaatttagatttagaattttagattcagaacaaacagaaaaaagaacaagacattgtttggtgatgagattgtggagtaaatgaaaccctatgccagtgtaacacaacaaatcacctatcccagcaaatgcaaaagataaaagcatggttaataacacaccttgtactggtgagtttctgtataggacctctgctgaatgcccagtcaacatagacagtccttgttaacagctgagtcccattcattgctttgattgcagtttgtgcttcctcaaaactttcatattcaactaatgcatatccctgttagacagaagaacagatgtgaacagaaatcagatagctctgtgagaaagaaacatagatatttccatatacaactaatccaaaaacagtgtttttcacttagatctataaatgtgctaggcatacactaaatagtcttggatccacgaaattttggagataaaaacgttgataagttggatcgtgtatcaggagatggacaccagttggatgcaaagtatttgggaaatgaaactagtatcagggcatcatgaaagccatcaaatcatttcaaacagtaaacaatacgaaataattggaagtcccaacacccctcttaacccttaccatgtaaacacaccgtggtgcataaaccatttattttctgtaagaatgttaaatgatgtgtactctggggtaaactagccatattgtaccagaatatagcattctggcagaaccaaactagtgcatattcttgacttaatatgaaaatagacatttctctaaattatcacagtagaaggaaaatctaatttcacatcaggtacatgacttctaacaccatgtgctccaagattgcccccattattagattctcttatataagtcatccagagaccttagattagtatgggtgcagttttatcagaataaactaatatcttcttgatgtaatcaagtaaaatgacttgagcaatacactcatgttggtcaattacaaaatgtgtaatccaacttttaccatgctaaatcaaagttgagaattatatcacataaaaaataggagaaacaagatgaataatcaatccaaacaagctaagcaatgtggttgaagaaagtgagtggccatttatgaaactcagagaacatcatttgatatgatttcgattaagaaggtttctaaacagcataaatcaaattttcaactattctcatagcagtccctcaagaaatattcctgcaaataaaaaaggaaaatgatgatgcagagacaggatataaatagtcacccaaactccaaggaatactgacagagtcgttagcgaaagagaatatggttgaaagtaaatttaaggtggttgtgctaagttgaattaacacagaagctttattattcaaggaattacattcagcatatcaaacacaccatgcccttcagattaattaactgaatatgggaagccctcactgccagaagctgcatggaaaagaaactacaatgcacataggtcccaaacagaccttaagaagcctatataggccagtagtaaatactcctataatgttatgtataaccacagtggttgctgcgcattagcagtttgtattgaattgctgcctgttggaataaatatcaattttaccttggcatatccagtgcggcgttccagatttaaatgtaggtccttaacatgaccaaaatcactgaaagtgttgtacagatcatcttcttccgcgtcttctttgactccagagaccagtagtatccatccttcaatagctacaattcagca

SEQ ID NO: 92108 - DNA, 3556 bp, Oryza sativa
attactgatgtgttgtccttggttcgcaatttcctagcttcacttaacacatgatgtgctactttatctgctgaagttttctgctcgctgtacttctgcttaccctgaaaaatgagataaaagatcagcacaccacgacttaataaccatgaggttgaagccgatcgatgagttacctcaaggacaagctgcgctgccctgttagcgctaataacatcccatagcccgtcgctgcaaaggagcaaacaagcgcacgttatgaaatgtatgagtaatgcattacattagcaagcatgaccatcatagatggggagttttgatacctagcaataagggcagaggctaagcatgcttttgtcatgcgaactgcctggctcacatatggttcagagctgaaccgtgaatcttgttcctttaaaaacttgtccccaagcatcctgccaagatttagtcctgtggaaataaacagcgagatcgtgtcatcattattgttcaagtctgcagctgatgtaagatagcaatatagcatataccacatatacggctttcaccgtctttcaggggttgtcctgaatttgccatccgggctcgttctgttgtactgactactcgatgatcctcggtcattgtaattatttccccgttgacactggcaacaatttataaattattgctgtattacaaagcttgatgaaagaggaccttataaatcattttttattgctattgtatagcagtttaatatacaatagggtggcaatatttaaatttcaattatggtgtatttcacattatactagcaagtgactgctagtgggtttttttttctttgcgaggaagcaagtgctacagaaaaccaaatagtacagtgtcttcgagaacagaaaagatgctaattacctcataatacaagctgagtcaccaagattagcacattgggcgaagcaatcttcgttctggtcgaaccaaatcagaaggatagttgctgtgcagccctggaaaagatagaaaaacatggtaagcctactgaaaaggtggcaattcaagaaacagaggattccaaggacccactagacttcatgtacagcatatagccttagaaagactatctggagtctaggagttttaatgggagactcaactcataatttcggtaaatatttcctggcaatcatgggaaccttaaattgcaagagacttcgcttcatgtatacatttcagaaaccaaattaagaatcagagctaaacttttaaatctagaaaaccagcaagtgatgaattttacacatccaggggcaagtaaaggacaagaaattgcagtagcacatcatttgatcaaaaaagttaacaaacatacaatgtagcaacattcgtccaacaaattctataccaaccaaatgtatagataaaccttgtaacaaacatatgatatttatttaatcaagttattaaactaccagacaagaaattaagcaacatagttcaaaaaatatagtacacgagaaatccagataaaaggaaaacctcatactgatgatggagtgcagcttcagtcaatgcaaaggcatgtctaagaacatctgaagcactatggcatgaaagaactctttcttttgtttcctgttgagacaaaatgtttgcaatgttctgtggaagaatcctaggcaacaaagggggtcatcagttcaacacgtatataatcatatcaaactcaaaatcaagaacggttatagtaattaatacacgaatgtccaaattctaggataacattatgatttgcacttgatcaaacaaataggcagaaatagcttacctgctggcagctattgcagcaccatcccctccatggccatcgaatatgccaaatagcccaaactgtgtaaaaatcaatatcagaaaccactcaagtatttgcacaaaaactaatcattcacataccttttccacaccgataagaggatactggcagcagctgacatcctccatgtgaagtttcttcccagttcgacgggctgtcattggatcagatgctataccaactcctacaggttgttggttttgtagctcaatttggacctagcacggtagcgctatcagggaattgctttcttcaaagatagatacaaccaaatttcaaacatatgttgaagagtttttttttcttttttatatatgctccagtttctatggcatggcagacatgtggaaccaaataggccagcatatgaactgaaatgtcaacagctagcaagaaaacagaaaagccgagtgtggtaacatgtttgccaatttgaattaggtatagttggattatatgaaaaaaaaatgcataggggtttcatttcaagcagaatgatatgtgaacataaaagcattaaccatcagatgaataataatgctggaccataagcaataaaagaccaattctactataaattagttataaaaatcttcagtacacttgaaaggacacactgaaaaacaaaagcggttataacttacagatacttttgatgaactcccaagtgttataatatcaccatctgcaagttcagcaggctcaccccaacgcctagatccaacatcaggatgattaactgaccgggaattcaaaaatgttccatttagactacccatatccacaatttcccatttgagtttctgcaataaaagagtaataataattttattggatgggaatgtaagaaggcttaagatatttgcaggtatgtacataggtcatatgaattttttttttagatacagcttagatcttcacaacttacatttgcattccagtcaatctgtgcatgctttcctgacacctctgagtcctttaacaccaaatgacttggaggaacccttccaagagtcacgggtagcatggacttgttacctgactgcatatagtggtttattccatgagatgggccagctatgacctccaaagctaggttgcttcctgcacttctagcaaatgattataaacatgagcatatgcatgttaacaacaatatttgcagcataaggaccactcgaatatttaaatattttcagggattttttaccaactataatgtcaggaatggtgccattgtgattactctctccagaatcccttcttatgtgcttcacatcaggtgttggcccatttgccacagctggacgcttaagcgtatttcccaaatagagctcttccgttttactgtttgtaacatcaattacatgagtttctcctacacaaaccaaagaattgattatttttgtaattttatgacgattgttagtaaataagatgaatattactaaaagaggaaatgaaaacaagactgatgctgtataacataatgatgaaagtttgggtgtaaatgtatacgcaccttcaataacatgagattcagtgggataggttgccccttttccaacaatgccatgagtcttaggtgaagtgataatcctatcaatccgaattcctgattcatcgacagtactactattgctcgagactgaatagtcatccaaattgtcagatatgagaggcatgggctgcaggaat

SEQ ID NO: 92109 - DNA, 5278 bp, Oryza sativa
tgctaactccaggagtcagcaggccgggtccggctagggacgagtgcctagaggctctcatcattccgacgggacggggcgaggcgtgcgaaaggccgcctgttgccacctaacccgcgatctgaccggtctgtgaccggtcacacactgtgacctgtcacggaccgaacgagtgtgttgcgctgcattaaatgcggcgtggggcgctcgtccaacccgcaataaacgcggttaggtgagcgccgctgtgctcacctaacccacacacgtggcgccaaacccacagggggtcggggcgccccagccctcggggccgaaacgggagcggcccgacccctcggggagacagagggaggggcggccacatcaccctcgggcccgacccccccgagggggtcaggccacgtgggtgactgcagctgccccaaacctatagtcaagatacccccggtcccatgtcaccgacagtagcccccggcgttatgccagggcgatcgccctcctcgaggaaagcgctcgggcgtgacgccactccttaggcctggtgacaggtggggccggtctctacaggcgggcaggaatccagtggtcgcaaatcgcgcgcatcggcaagggaaaaaccgaccgataataatgagcggctttcttcaagaccgctacattacttgagtagcgcgcgaattgggacgagccggttcgtttcgcctggagatgtgatgatggtgcatcggtcggcgagcgtagttaacgcgcgcacgatatgtgccatctcgactaccacggccgcacatccgcctcgtgcgccgcaaacgggcgagcgggattagtggaggagtgggcgcgagaaacgagggggcgagatagtgggcgagggaagcgaggagccgggcatagcgttggtaagggtataaagacgccgaggaagagattcgtttccttcctctcgccattattccccttgccttcgccgcttgcgttctaacttctcgtttcctgtgccctaccttcgccgcactcactcgctctcaagcccctcctccgccggcgtcatggcacggggctccgcaccgctcgatggtagcgtgctgccgccttctcgcatcgtgagcgagaggcaggccgggctgccgcgccgattcatgccggaatctgccactggccgggaggtggtcgcgctgggtgagggacgcccggcaccacactacccggggcggtccgtattcttcctttccttcgcaatggcagggctggtcccgccattctcttctttcttcatggatgttctggagctttataatctccagatggcgcacctcacccctaacgcggtaatgacgttggccatcttcgcgcacctatgcgagatgttcatcggggtacgcccatctctccggctgttccggtggttcttcaccgtacagccggtgtcgccaccgtcggtagtcggtggctgctacttccagccgcgggggccggtgctgaaccgctacattccctgcgtccttcgcaagaagtgggacgactggaagagcgactggttctacacccctctcgccgacgaagcgcgcctccgacttccgagccagcccccggcgcaggcctccagctggcgggcgccggtagatctgggagacggctacgacgccgttcttgaccgcctggctggtttgcgatcccaggggctcacgggggccatggtgtacggcgattaccttcgtcgccggatcgcgccgctccagcggcgcgcccggggcgcctgggagtacaccgggtccgaggactacatgaggatccaccagggggtcaaatgggattgggtccctgaagacttcaagatggtgatccaacgggtgctgaatctcagctccttggaggcatccctcatcccccaaggtgtcctccccctctgcagcgatccagagcgcgccaacatcctgaccatcatgcaggcggtcggggcgtcaggggagcgggctcctcgaggccacgatggcgcgggcgggagccgcaggggggaacaatctaccccgggagggggtcgtgcttctgggccccgtgacgggggcccggggggcagccgccctgccgacgcccgggggaagaggaaacaggaggataccccctccccatctcctccccgagggggcggggcggtgcgtgccagcagcaggcgcccggagggtgctgtgccgacgtcgcagcccgagggggagcgaaaaaagaagcggctccgcaagatgggggggaccgaaccatgccggggaaacctcatctcccccccaaggtggtcgtttagccgacctcctcgcaggttcgtccccgcgcccactgcggccgtattcattctcccatctcccaaggcaagttttcactcacccgtttttcgtcttctggtttttcttctgcctcagcgagatcccgtcgcgcccttcccgccattccaagtctggccggtctgaggccgaggagacggcgaccgcggaggcccggaggcggggagctgaccggcgagaagccgcagaccgcctccgggaagccgaagaagctgcccaggaggccgtccgggctcgccaggctgaggaagccgcttgggaggaggccagactccgccgggccgaggagtccgtccgggagacggaggcggcgcgtgtacgccgggcggcctgccgagcccccgacccgactccgcccgaggcgacgacgacttctgaggccgcccacgacgaggccgcgggcgcgccgctcgggcccgacccctcgggcaatgcttggggcgagccagcttcggggaacgcccccgagtcggcatgtccatcggcgggccgagccgcgcggcgcccacaccgaggcggctctcccctctgccttccgctgccccactgagcgcagaacccctcctgcaggccttggccgctgcgaacaccacggtgttggacgggttaagcgcccagatggaggtcctgcaggcagagcgggcggaggtcgatgcggcgtgggcgcgcgtcgaagaggggcggcgctcggtggaagccatggtggaggcgggccgcaaggcacaccgccggcatgcctcagagctcgaggcccgtcgtagggacctggcggagatcgccagggaggtggaggaggagcgggagactgcctcatcgcacccgccgtgttcaacgcggcgcgggacgacctctgcctcccatacgggagccgggcggcggagctagagaagaagctcgacgcgtcccggcagcgcgaagaggcccttgaggctcgcgccacggtgctggaggagcgcgcccgcgccttggacacgaaggagagggaactggcgggtcgcgaggccgccatcgccatccgggaggcaacgctggcggcgcacgaggccgcctgcgccgaagaggagtccgcactccgcctccgcgaggacgagctcactgagcgggagcgagctctcgaggaggccgaggccgcggcgcagcggcgggaggagcaggcgcgcctcaatctggaaggcgcccgcgccgagagggccgcactggatcagcgggccgctgaattcgaggcacgggcgaaggagctggacgcgagagcgcgcagcggcggggcgaccgcgggcgacggcgacctagccgcccgccttgcagccgccgaacacaccatcaccgagctgcagggcgcgctggactcgtccgccggggaggtcgaagccctccgcttggcgggcgaggtagggcctggcatgcttcgggacgccgtctcccgtctagaccgtgccgggcggcaggtgggcctctggggcgggcggtccgcgaaatacgccgccaaccaggggggcctcgcccagcgcctctcagagatggccgggaccctccagcggctccccgaggagcttgaggaggcgatcaagtcatcctcgagggacctcgcccggggggcggcggagctcgtactggcaagctaccaggccagggaccctgacttctccccgtgggcagcgctggaagagttccctcccagaaccgaggatggcgcacgtgcgagggtccgggacgccgccgaccacatcgtccacagcttcgagggtacggcccctcgactcgcgttcgcgctcgactccgacgaggagggcggtgacgacggcgcggacgacagcgacgacgaggccgacggcccgggggcgtcggagtgagcccccaggcccccgccaatcttaataacttttccttcttcttccgaggccttcgggcccccttcttgtatagactgatttaatctgtaatcaagtaaagaggaaatttctgcgtcagttaagtttgttgtgtgtatgagacgaggatggtccgtgccgcggtccttctgtgtcttggcttaaacgagggctcgtgcccaggtcccaacctcaagtggcgcgggtcggggctagtgcctggggagatccgcgtgtcgagactggccaggccgggagcgtggtgaccgagggttatggatgacccgattgtgggcctatgccgattcccccccggagttcaccacgccccggggcacggctcggttctgggccccgtttggcgattttagccggcccgggccaccgagggcagggtcgggcacgagcgtgctaattcaagccaagattcttcaaaaggaaacgatggcacagacacaatcctcaggaaatcgaaaatgcttttactgaaatacggaagagaaaaaagataaggatatgcatgtggtagcccccggccaaccctgcacgcccgggggggcgcggggttggcccgagcccgagacctgacacccgacccccactaggggtagaagcgacgaaggtgttcgatgttccacggattaggcagctctgtgccgtcgcccgtggccagccgaacggagcccggccgggggacgccgatcactcgatacggaccctcccacattggtgagagcttgctcagtccagcacgcgtttagacgcggcgtaggacgaggtcgtcgacgcagagtgacgggcccggacgtgacgctgatggtagcgccgcaggctctgctggtagcgcgcggctcgaagggccgcgcgccgccttcgttcttccaagtagtcgaggtcatctctgcgaagctgatcttgatcagcctcgcagtacatggtggcccgaggggacctcagggtgagctcggatgggagaaccgcctccgcgccgtagacgaggaagaaaggcgtttccccggttgctcagcttggcgtggttcggttcgcccaaagcaccgctggcaacttctcgatcca

SEQ ID NO: 92110 - DNA, 1161 bp, Oryza sativa
acaactgaacaagctgctactgaaaattagttagacatttggataaaataaagagccacaccttttggagaacccgaactttaccgcatgcaagtgattgcagcgttcttcgcaattctttatcctcaataccagtcgattccttgatatcgaggaagcttagtttttgtgcatcattgaacaacatcaaaaccacactctgaaaaacagaataaatcagtgattttctaattattgatcagacagttacagctacaataaaccaccaaagaaattgggaaaaataaccctacctgaaatagtgacaccgcaagttcctttttaccttttgggaactctgcttttaatacacagtgacccaatgagttttgccacatcaaacgccttccactatacttgctcaaatagaattctttaaatatatcctatcagaaaaatagaaaactaaattaatttccaggcagttaatataaatatttactgccaacaaacatagttttgagaacatggcctgacctgatagacattaagttcatgggggagtttcacatccattggtggatatgttggccaatagctgcaatgcaacatatttaatcggaaatgcacatttatgatagaaaatatcaagttgcatgttaacatgctcagcaaacgcctattataaagttatataatccattgcccatattccagctacatgtcatggactaagaagcctatctatcagtattaggtttagacaagtgttgtgtaaacagaacatgctactcagtaaaccagcacacatgtaaaaatggcaaggcacatgttacctaccctgttgtaagcacgtgaacactcatttcaatgccagatggaagctttgtccttgcttgagatgattgcttgaaagactcatttatttctttggataattcaatgtcctgagaacagcaccaaagtcattttattttacaagagtattaaatccaaataaaagaaattgatgatatcgtgtacgccaccaatggatagaggcatagagcatatataagttagcaacatttgagctaaatatacatagggcaagagttcgcaaaaaggctagtatactagcaaaagtcatttcttctatagcaaattgctaccttgaacattccctccagcttgttggtaaat

SEQ ID NO: 92111 - DNA, 1102 bp, Oryza sativa
tccatcgtaccctttgtaacctgtgttttccatcatataatctcatatcaactggattagggctattacctatcaaggggcctgaaccagtataatcctcgttctctgtttgcttgatgtcgtattacatagatccttgtaccaacgtaccccaataccctctatatccggtctacgggtatcactcgtcgacagtggcgcgccaggtagggggacttggtgctcaaggttctactactatgtcatccagtttcgttgacaacggcgtcaacaccaacctccaccagggatttcctacttcaacaatgctggtgtggactcaagtcggcgaaatcgtcttcccggtttataccacgatgccgatctcagctggtccatcaatgaccggaaatgagaacgcagtggatacaacccaggacgactccctgtcgaaggatcctcccgccgaagcggagaacagaacattgacgacatccgagctcgagaaggattctaatgcggccaaaccttgtcgttcagacaagagccacgagccgacgagaataacttccgaagcgacaaggtcctggtgtcctatccacaaaaccaggaaacacactttgcacgcctgttgggtttttctcaacgtccgcgccgaaattcgcgcctgcaaagagcgtggaattcagcgtatttctccaacctgtgatgtctattgtcctattcacaagacaaagaatcacgacctctcaagctgcaaggtctttctcagcgccacgatgacgtcatcccctaaggtccagcagttaggcatatcccttagagatgaagacaaggaacaaggaacgacgctggtttcagatcgattcgttggcataatcgacatcagttcacccgaaccatcagtcctgcatctactcgaggactatggctcatcaaagcgagtacgccgcgcgaggtattagctatcgacgggaccagcacgtcagcacacgctaatgcggaagcacaaaatcaagtggctacaccggcctagcacatcaggaccatcaacgcaatactgagggagaccccttacgatcccgttctaaacgatgatctcgcacagtggacagaacagcta

SEQ ID NO: 92112 - DNA, 2615 bp, Oryza sativa
gcagttgtacataattaattatggaaataaagaaccttatacactggcccgaatccaccttcgcctagaatattttgagaactgaaattgtctgtggctagctttagctcagcataactaaaaacgtcaggtcgtccaaccaggttgtatagttctgcatgttatttttagcacagatgagaagagtaaaccagataattttgatgtttgaattatatatgtcctgatatataataccttctttctgttgtgccaatgctctccgcttctttactagtgtaaacactccaaataatgctgctaatactaaaactattgcaccaatcaatattccggaaattgcacctgctttacttttcctttttggtatgccgtttcgaacggtaggagtaaaatctgcaaaggaaaaatattatttatcggcagcgaatataacacttcctgctgttgttttagtgtggtgcttacttggagtgacgctcaatgctgagatcattggcccatagtaattatctttagtaggtatgtcaacagtgcccttgccagcccagaatagatggatctcaaggaagtttttagacacagttaccatgaaactcctattaactacggtaaaagattttccacctgctgttttccttatatcgaaatccttttgttttagagcaccctatgtaaatatcagtaatacttttagataaatattggtaagattcagtagaaaaacattatataaaatgcacaaaatttctacctggatatatatgtcaaaaactcttctccctaagcttagccaagtctgtgagtctggaaaagctaattctgcgaattggagcaaaacagtgtaatttccattctcaagtccaagtccatagtacctcagagatgatgatgacatccttgcagtttcaaacaactctgaatcaactacattttgaaaaggttgggagctatatataatattctttgcatctatggcgttccctacactactgacaccccatcttgtttgaccggtaacataatatgttgcagctccaagatttgtaggatctgcttcataaatagtgtcatctgagcctcttatggatgcattactgccacagtcaactgcgaaggaataatctgcaattaagattaaaaaaattgtagccatcattcaaattcgtaagttcatgttactgtttagttttatgaagaatgagaaatatacattctggagatccacggaaacaaggggtgtcttgttggaggcagtttattccccaaggtagcgtactgtgcacaatttgaattgaaaatttaaagttaccagcaagattttcatatagttcactcgccaaattagaactaaatgtcacaagtacctttcactggtggtatcgagtaagaagttgtttgccaccaaattcctttcaaaaaacagaatattagtatttatattttttctcagcgacacaaatatcacacttttacacttacaactgtaaattgttttgtctagcccaagaaggaatgctcccagtgagttggttgtacgaaaaatctctgtcaacattccagaattatgttatacaaaattagtgcgtactattatgaatgtagtttgtgctatactgccatgtcaattgtatttgacatacatcacttttaatgaagagcttataccatccggcaactttcctgtaaggctattgttcccaagaaacctgaattgggcacagttcaagattataaaatatactcatctgcttaatacaggctcgtatgaacaaattgatgtaaagaaagaatttcttacaaagaattgagatttcccaaattcaagatggattgaggaacttctcctgtgatattgttaaaactcaagtccctgtgccacatgactatcatattacttgaacatatggtacacaacatgaggaaatgagtaataacgtcatcagttggcaccatggcctgtaattgaaaacttacagcaattttaactgtttaaacatggaaaattctactgctccgagatcactagatatcttgcagttcctcaatattctgtaacgaggaaatacaaccttggtaacttgcaactagacaatactgtaagctttatagctaaaagcatcacatacagtgtgctcagggatgccatattactgataaatgccaacggagagaccccatttataatatctccaatccatctgctcatttgagtttttcataaattagttatcagccttgacattgtcaaccttcaagagttcatgccacaaaaagagtatacttacaatcttgttaatttggtcagattagacagactttctgggactggtccttcaaaggagtttccgtggaaagcactacaagctcattattttagaaaaaaagttagggacattcaacctttataaagtaagaaaaaaaatctctgtgtgagcattcttaataagatctctaggtatgaacatgccatgtggaccgcttactgtgatgcagatatctgcatttatattgagtgaggactgaaatgtgaaaaaatgcttttgtttaagtctgaatggagataatgtgatatacagacagtaatttatcttgcacagattcatctatctctg

SEQ ID NO: 92113 - DNA, 3874 bp, Oryza sativa
cttatcaccattactacctttactactattgatgagggttatttttgtcatttttactcctcactaaatttgttttgggatgctaggaatctcactaaatttattttgggatgctaggaatcctcttttagcaagcaagtgttttggtcaaattaaagatgacattaacaagagcatgaggatgaccaactagtgtatgcccggtgagttcttaattaaagattagttatttttcatatatatctaaattcaagaaaacagcttgaaaaattctttttagtttttgcactttgcgtccttttattcagttttacttcgttaaagttttgtcccatatgagtacttgtttaatgctatcttaggttacgttcagcgacaatacacagagagaaaaattaccttctctttcaaaagcatacgcttaccgaaatactagacaatatttttttacaaaagaaattacaaaaagttgtatttttaatttttaagtttaaaataattaatattaattatcttattttgtgagtatgttttaatttttttttctttcgtcaactctcaatcataatgttaaaaaaaactctcaactagtatgttttaaagttttatggtgttagtcgtgtcaaaaacattgacttgtccacccgccgttgttttgactgcctgccgcgggaagggaaaaacttgccgtggaaatctgatgctgccacggcatcctttgcgtcaggacggcgttccccgttcttcaattttttgtcgatcagctctgttgaatcgtatgattcatatgctagctgtgtctataggatttggtgcttgcagaatgtattcttttcaccaaagtgcatatacacacacctagttgcatacatgcaatctagatagctatataaaatttttaaaattttcacaaaacgagtcctcctggtagatatgtgagcgtttgcacgattgtgttgtgtgtgcgttagacttgtactgacaaaaaaaaagaaatattaaattgataagatagatcatgaagatgtaaattactaaacaaatagatctaaacttagtctatactcactactgcagaaaaacccatagaggtgcacccttttttatttttataggtgctaaaaaaacatgaaaaaatatttggtatttttattacttccctataacgtcacacttcgcttcccacatatcacatgatttttgcaacccatattcatagacatgcttctaaagattcttaccatgctattgttttgtgattattgttatccaaatttataatgctcaactgaaaattttagcgactacaaaattgtagacgtcatctatacctacaacgttcatatatgttttgtctccatccgagatcatttagaaattttaaatattcacttatgtaaatagatctgaaacattataacacattttcggacatcagaaaaacattaaataaaaaattcatcacctacaaagttatatgtctcgtcaactacaaatttgatataaagtttatcttcatccaactttatatgaaaatgttagatagaaaatattgtgtcattattggtgccgattttagttgtaaaccaacatctatgagctcataagtactagtttttattaagaatcaacacatatatgatgcctataagtatagtttttattaagaaccaacacatatatgatgcctataagtaacggttcatgataaaaaccagtacatatgcttatagaggtgccattttattataagaatcatcgacacctatgtgttgtttataggtatgtaccagtttgttatagcctgatagaaaccgacacctatgatttgatagattattggtgctgacttttgttacaaaccaataccaataagtgattataagtaccggttcttaattttatactggaaaaaggtggagaaagcttcataggcgccagttttaggcaaaccgtcatatgtaagtccagtctttatgtgctgttttataatagtggctggataaatataaatagctagcaaactgtattgatgtgcacttattcatagttgtagcattttattattttagaatgttcaggcatatggctgtgttcgttgggtaggttgggaactcattccctccacacggaaaacggagcggtccactagcgtgtgattaattaagtattagctatttttttaaaataaatagatcaatatgattttttaaacaacattcatatagaagcttttttcaaaaaaaacacaccgtttagcagtttgaaaaatgtgcacgtggaacacaaggaagaggggttaggaaccctgaggaaataacacagcctatagaatacatgagaaagtccagagcaagtaaccagctaaactattaaaaacaattaactttactccctaatggcatttgtatgtttttttctccttaggcactaaaatttaggactatcatatatgtattacaacttatatcttaatattctcaatatttttttagatttttttatagttatttacataggttagaagcatttaagactgaatcaaatatcaagatctcaaagttaagcaaacacttctgaaaatattgaaaatattttcgaactttgataatggtgtatctatggctataaaaagtgcaacttaaaatatagagcttatataaagaagaaaaaaaaggtgaaatgtcacccgagtaccattttcaatatgctttatggagtcaaatgagtaaagaaaaggtttaggggttgatctaatgaaatagtttgagagattaaaaatttagtcttgaatgtttctatatataattaatctaaacttattattataccacaatcagtattactattttgcaaactttacgcaacttatttgttaggtgcacgcctgggtggagcacctatgctgtgatgtcacgcccataaattcacaagtaatttccaaactaatttgtgcattaaaaccctcgtccaggaatcagccgaggtacacaaactgacaatttaatatacaaattcatcaaaataactaaaacgataaatacttacataagaggcacttagtcctcaccatgaagaaaactgcagcggaaagtaaaatctagcgaagcttcagctccactcccacaggcagctcaactgggatctaagccaaaggtcttctcattctggatccttttcttcaactgaggtttgatgattattgcaagaatgagcatatgacatactcaacaagccacacagcaaatatgcaagtgcacaaggataccaaaggatggcataatatagggttcatttacgaaagcagcatttagcaaagagttgagaatttgtaaaacagtagagtaattaatcatcaatattaatcaacactgaatagcacacccatactgctcaggcccaaccaaacctgaacaaccaaccccggtcgtacagatcaaacctccaaaccaggaattatccattccaaaccataagtcaaattaattatcacattattatcattaatgagtagtgtgggactaatcacgaaaaacattgttagacccgcccataaccacgggcacggctattcgaatagttttactctggccagagatgtaccactgtacccacaagacacgattccacacatgctgccatgccccgaagtaccaccacggcactgctaagggggaaatcgtgacagtacccttcacacaacacaactcaccacagtgtactatttctggatcataatcaccccctcaataaccaaggcatggactccccagcgaccccccacggacttctcgccgcttcacagtctggcacaccataatgaatcatgctatacaaaagataaagtcgttgcccacgctggcttgtggttggc

SEQ ID NO: 92114 - DNA, 2817 bp, Oryza sativa
ataaaagtgggattcaaatcattaggacgttgcctttttgcattaatgttatagactgaacatccatcaagattcacaatgtataagccattcatcatgggtgcatggaaatagaaaatgtcattataatagactgaacaaccattgtccacaaatctaaaaccataaccctctgcttgcaaacaagaagcagagataacgttcttacacaaagctggaatgcaataacaattatttaactccaaaactaatcctgacggtaaagataatggcatagtgccgaccgcaacagcagcaactcttgctctattgcccacgcgaatgtccacttcgcctcttgctaagctcctacttcttttcagcccctgcaacgatttgcatatgtgagcaactgaaccggtatcaaatacccaagaatcagtagaggaagtagcaagattaatttctataacattaatacctgagatggaactctttccatcctgctgcttctacttgagctgctctaggtatttcttacagtttctcttccaatgacctgtctcgttgcaaaagaagcactctgcatccttagcgggccctgtcttttgaaccttggtcttagagttgctagtactcgtgatctcatcagagtttagctttctcttttgaccactcttcttgttgttgggcttgcgcttatgcataaccatcatatggttggagtttttcttaatgctttcctcggcagtcttgtcgcgaccgagaaaatttgcattttcccgaacgctagtgtattaatccccgtcccagaaaaagccggcgtacaccacacaaacatgatacaaatggcacatctttattatatcgataatatttacattattacaaaggcacttcaagcctgacaatcaaaaataaacagcagtggactagcgggcctacggctccatcttcacaggcgctcaactggggtataagccagggctccacctaagacttcttctccaaagcttctcttactaggggagggaagatagagcaagaatgagtacaaccacaatactcagcaagtcacaccgggagatgcatgattaatgcaagggaaacaaggggtaataatataggggattaggttttgcagtaaacagcatttaaaagacacttagttgcccaaagctattttataaagacgatcctagagctacacagcattattaatcaaggccgtggacccacacgaacctgccttaacccaaggcctacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgcaaccacgtgccacataccaccacggtatacagacgaaagacgtgacatagtttccaacccatcctagccatagacaagagtaccgacccaatcccaacctacggccggaacccccgggacaggtaggcaggattgagcccctagcagcaggacaccagccctgtgccatgacatctcgactaccgggccgcagctcgtgtagccttcatttgtcctagagatgtccatcgacccccgacttcgtccatctccatccgtgtacttctgtttataaccagactgggccacaaactaagccttacccactagacatgtggaagtacggtagtgctttgcaacagaggcccgagcttaatccttatagtggccggggtgctacttcccacaactggcatgcacccaaaccccaccggaaaacaggttttaggggttttgaaagaggaagagaggtgtatgtccaattccaccataagccaaccattccatagtgtccaaatgatatgagaattcccaaagtctaaagttataaaaccacctaatgttgcctaattaaacagcgaagcatctacctaaattcatactagtggaaccatgaatagagtgtccagtagttggggttttgtttattctagggtgaacaaggtaataataacaatagcaataataatgtcttaacaaaggtaaataggcatggctaaataaaacagtgataacgcgggaatttaaataaagcgataatgcattaatttaaatcaaaataattttataaactgggattcaatatgctcaaggatgatgtgacttgccttgctcagagagaacggccttccgaacctttggcgacgaccgcgaaccacgcttctggaacctccggaacgacagaagctacgcgaagcacacaagcaaagctacaagcttataaagaaacaataacaatacataaaaagaaagcatacggtactttaggttataacaaacattaagagacttgaacgggtcgattcggagctcgtatgaccaagatatgatcatccgaagtttaatgctgttatatggagatttgcggattattataattaagctttgcaactataaaacatgtgtaagcgctagcctggaaaagacaggaaggctgcgctgttgacatgcggacctcacatgtcaacaaaaaggaccgcggtagaccgagtacacagagacggtccacgggtcgacggaagcggatcccgtgtgtcaaccgaggcgagtggccgacaaacggactccactagacaccacacgggctgcacacgtggaaaccacgtggctaccgagcgggcacactaacacggtcaccacacgcacaa

SEQ ID NO: 92115 - DNA, 783 bp, Oryza sativa
atggcataccaaaaagggaaagtaaggcaggtgcaatttccggaatattgattggtgcaatagttttagtattagcagcattatttggagtatttacactgataaagaagcggagagcattggcacaacagaaagaaggtatgatttatcagtacataattcaaacatcaaaattgtcaactggtttattcttctcatctatactaaaaataacatgcagaactatacaacctggttggacgacctgatgttttcagttacgctgagctcaagctagccacagacaatttcaattctcaaaatattctaggggaaggaggattcgggccagtgtataaggttcttaatttatttccataattaatcatgtacaactgcaactggttataaatttgtgtgattttggcatttaagtgttgtgttttagccacatttgtctatgctcaaaatatacatgtaaaaactttatcagggtaagctacctgatgaaagagttatagctgtgaagcaactttctcagtcatctcatcaggggacaagccaatttgtgacagaggttgcgacaatttcagctgttcaacatcggaatcttgtgatattgcatggatgctgcattgacagtaaaacacccttgttggtttatgagtaccttgagaatggaagcctggatcgagcaatctttggtgagttcacttctgcaaaattgccaccctcggcacttatagaattgtattttcttagttcacaaataaaactcacactacaacaaatataccttgtaga

SEQ ID NO: 92116 - DNA, 2209 bp, Oryza sativa
aaaatgccattacatatgaggcaaattttaaagtgccgaaaagatgtctctataagataaatttaacaaagtatgctaaaaatatctctaaagtgtctctagaataaaaatattttaagcgattttaaaagtgactctaaaaagtgtctttagactatagagcttcaaaacttagaggcgttttgaaaattgtctctacaaaagagcctctacataaggtttggtttttgttgtagtgtcattgcttcatgactaataattatggatttttcttttctgcatttttgtaataatttgcgttccttatgataactgagctatttatgcttgtaaaggtgacagcaacttaaacctagactgggtaatgcgcttcgagatcattttaggaatagcaagaggcctaatttatcttcatgaagagtcaagtatacgcattgtgcatagagacatcaaagctagtaatgttctacttgacactaatctcgttccaaagatctctgactttggacttgccaaactctatgatgaaaatcaaactcatgtgagcactagaattgcgggcacattgtaagaatattttaccacttatcatcttatgattataacatcaatatgaatgctactattaacctgtcttatcttttttaaggggttatctagctcctgagtatgcaatgagaggccatttgtcagaaaaggctgatatttttgcattcggagtggtcatgctggagactgtcgctgggcgaccaaacaccgacaactccctcgaggaaagcaagatctgtctccttgaatgggtatgctggtctatgatcttcccatacaagaaaacttcaattcactgtgtattgtcttttgcttactgaaactatatacaataaaacttcaatttaaggcatggggcctgtatgaaaaggatcaagcacttggaattgttgacccaagtctcaaggaatttggcaaggatgaagcttttagagccatatgtgttgcacttgtctgcactcagggctcaccgcaccagcgaccgccaatgtcgaaggttgtggcaatgctgactggagatgtcgatgtggctaaggtggtcaccaagccgagctacatcactgagtggcagcttaggggtggtgggaacagcagcaacaccactagcagctaagcagaagtttgtctccaggttaagtgaatttaaagtagaaaatgcatgggtcatcaagattggtttgcgacaatattgtatgtctttttctaaaaaataattatgtgttgactaaattacagcaaataatggaattacttatccttaactcggtcctggtaataaaagtttgctcctaataatttgtaaatggtgaataaccgtggtgtattcaatactcaataaatgttaatagataaccctcaatctgtaatggccagtgcaatgcagaggtaaaattctgtcccattgttaatttcatgaagagctgtctctcccatacttttttcagatttttatttaatttctaaaagttgtagtacaaactagtaccaaaacatttattaatcattacaaaccagtactaacgtgttttgaaaggttttaaaatccatttgcgaaaggttttaaaatccatttgcgaactcctcctacgtactagtacgaatttgtgaaattccgggttagaacccgctaacatgtatgttttgaaaatgggttgataaaatttaaaatttgatagatatgagaggttgaacacttcatcattatatttctgtaccataaataatattggtggcgttttgaactcctctatcatgatatttcaaaattgtaccgatatggtatagaacgggtagatttgggacaggttagtaattgttgtgcgtaaaccctggatttattgcttagatcaatcatataaaattcgtatggcctctggatcactttaacttcacaacattaaaagatgatgaaagtaggaaacttaaaacgtactctaagatttatgttgcgttggttgtgggggacacagagaaaccaggctacatctcttcttcacctgcccgttcagtgtaagatgttggtaacatctgggaatcacatggaatcaacacatgagttctttcaaatgaatgtcttagtaaggctgaattttgccagaaagggtttcttggaaattttctttattgcctcttggcacatctggaagcagagaaatgggtt

SEQ ID NO: 92117 - DNA, 6823 bp, Oryza sativa
ttagttatgaattttgtaagattaatatgctttaacctaatacagaaaactattatgatttacgacgcaataaagatttattttgaagaaggaaaagggcttttcttacgtcagcatgacgtcatcgtcggcactgcacgggaccacgagatcaccggtgctacagggctcggccgggctatccaagggcaccatcgtggagaggacgacgaggtgaactcaccggtgctcagaacaacgacggacgacgacgaacggcggccggcggtgagctccaacggcggcgcggctctgggcggcgtcgacggcgggattccggcgggtctcgacggcaacggaggagcggacggggtgcggctccactcggcgaacccgatggcgacaatagtgagcggcggcggcgaccacaacggtggcgtggggcggctaggcttgcggcgaccactaggacggacgcggcggctgtgctatggaccacggcggaggacgtggcttcagggcaatggtagaggacgacaaggggatcatttacataggcacggaagctcgagatcgatcccacaccgagaggaatcaaagccgtaaaactatagggttaggtggagagataaactcgaattcgaattcgatttggataaactacacgaaattcggctccgattcttaggggaaaaggaagaggacgatgaggggataaatttccctcatccaatcgaactcgggagcgacgaccagcggcggatttggtggggaggtggtggtggtcgggctcggcttgactggccggaggtaggggatggccccgacatgtgggccccagatgtcggcggcttagagagagggggaggggcggcttggcctgggccggcagggccgcgtggctcgcgcgcgcgaggggaagagttgggccggaaaagggcccaacagattaggataggattttaaaaattttcctaattaaaataattcgtgaaatgctatttcatttaataaaaatacttcccttgctcaaataattcacataaaaatccaggaaatagataaacaagcaaagtatttaataaaattgtatctatctcaattttatgtgcgattttgctagtttttattagggtttatcttgtaggtttttaaaataatttctaaaaaatgcattaaagaatgaattattaaattaagcgattctgagagtgtgacatgtagggagaatacttccataaaagatgcccgtggtgccttaggccctctttttgcatgtgtatagtattatgtacacattggatgacatggcgttggacctgttcgaaatagtgctgggacagtatgtcaacatcttcattctggtagccatgccctacaatttactcacccaacattgctgcggaattctagaggcactcttaagtttcagtagtcagtatggactgcaaatctctgcccctatacagccaatatcaaattgcctttttcagtacaatgagctccatatcttgaggtatgtatagagattatggataccccatacccacacggcatatatagtctgactgggtatggggtgccatctgtagatagaatatcttttaaagggactcggattaaatttcaaacttgtatgtcaaggaaatatccgggatcctagtcggttacgattgtaacttatctgtaactacctattccgttagggatatggattgtactttgtaatacggacccctcccctatataaggaggggtccgggtgcctctaagggcacgattttctcccagatcatacggtcaataacatactcggcggatcaatccccggacaggagtagggtattacttcttattaagaaggcatgaacctgtataaaattccttgtctctcaacccatccacttttccagcttgatagccacccccttttagtattgccgaaatctcgtttcgacagttggcgtgccaggtaggggtagcgtcaagttcttcgccgactagtgcgatgggtttcatctccggcatcgacgacttcgtcttccctcccgggcaggcgttccggtttggcagcctcgactttgtcaccaacgacttcggcaagatttctctcctcggctcagatccgaaacagtcggggagaggccaggtctccgccccgttcggtatcccgaagtcggccgagatctactccaggatcatcacaaccgagccggccccaaaccactcggacgagatccaatctactccaacatgacccgatcaagacgatggcgcctatcctccaatcctgatgaaactccccgatgacttggctgccatcttcaccataagggcgtcttctccccgtaggcctaggcgggacccgacctcggccccgatccagtctagctctagggaagtcggcatcatactccagcctctcggcacggtttcgacggaacaattggacggctaccttagctcccccggtgtcgactctcgaccgacagagatcgtagagtacgacgacttcggctaccgctacgaccaccgcaacctcgacgacttcgatgaaggctacgaagataactacacacctctctacttcggcattttcatggccgacaacgagacagaagaacagcgccaagcccaagaagcagaagaacagcgcgtgcgacaagaagccgaacgtcgccgactagaggaggaacgctaagcacaagagcgagaacgattgcagcgtgagcaacaggagcgcgaacgggctgcaaaggaggctgaggaccggcgacagcgtgccttggaggccgagcgacgagcacgagagctcatcgggcaacaagacgttgaggggacggcggtttttcgcaccccctagcagaacgcggctgcaccgatcactcttctcgacaccctcctcaaggaagacgcactcaatcaagccaatcacgtcgtcaacatcttgaaccagaccaagaccatgatcaccgcttcggttccagtaaactgtcacagcctgaattttgtttcaggatttataagttatctaataaattattaatagaatttatattaaatgttctttaattaacaagtgaagttaaatgtgggaaataaaatttcctaaatataaatcatggttggatttaatttttattaaattctccatgattaattatactctctgaaattttctcggatttttcagagctcaattcctaaatgatacaaagaacagttcagtaattatttaatcattaatgatctaattataattatgttaagtgcttttcttgtttaaaaatccttaatttataaattgttgtctaaaagggaattattagaaatgatcttaaaagcctagaagagaagatctaattttaatttgttaaattccaatataaaagtgggctagataaaattttattaaatactttacttgattctatagttcctagatttttctggggtttatttgagccaaggaagtatttttaataaatggaattgcatttcatgaataatttaaatggaaaaaggtttttaaaagtcccttttggttttgggccgaaagccggcccaaaccgctctctctctctctctccctcggcccaagtcagcccaagccgagccgcccgcgcgcgtgcgtgcgaccgccgctgacaggtgggtcccacccgtcagtcgtcgtcttcctctcgccgaaaccctagccgagctgcgccgccgccgccattccaaatccggccatccctttccgtttccggtgaaattgattgaggggaaaggatccccgtgatccactctaccttttcccttttggaaacatcgtctaaatcgctttggaaatcgccggatttgagttcgattcggatcgatttgtctcctccgaaccctaaaccttccttcccgtcaccggtcgccgtgggccttcgccgccgctccctagaccctataaattgaccccccaagctcccctatacctgccgccaccctcgccttagcctctcgtcgccggtagagctctagcgccgtgccgcctcgcgccgccgtcgccgccgccactccagcagtgcgccgccatcgctccagtcgtcgtcgtcgctcggggaggtcaccgccgtggtcgccgtcgcgtcgccgtcctcgtccgccctttcgccgtcgctgtcagccgccggagcaccgtcgccgccgttgacccgatcgtcgccgccgctcttcctcgtcgctgtcgtcgtccgttgatcttccgccgtcgttttggtcaccagtgagttcgccgtgccgtccgctacgcgtaggtgtcctccgtttgcgccgccgcgccgtcgttcgccggcgagcacgcgaggccgagccgtcgccggtgatgacgtcatcgccgacgtcatcgttgcagtccgccatggtccggttgtggaccgatggatcttggccgtccgttttggatggatgaatctcggccgtccgttttcgtgaaccgtcgccatgcactcggtcctccgtcaactgatgaggttgttgtcccgatcttcacgacgtaagattgatcttgataactagccgaagaacgaccgataacttgctgcaagcagcgataattagtgcaacctgacgacacgcacaaggagccaaccaccgtctctatacggcagcctgaaccaaggattcgcccaaccacactctcaaagaaccaacctacgcaacctaaactcgaggatcaggagcacggattgggtgccgatgacgcggccgcttctgtaatctccgcgaaggaaaacacaagagaaaaggggtagagaatctctctctggggtttgttagcacacagctgaacaaagggttccgaattggattatcaaaagtctgagtttgcaatggtcttaggggttatttacactagcaacagccctgctagataggtgtgaattcgagatggaaatgaaaagactaaaaatgtgaaagggcctccacgaaatggcttctgaagtgggttcgcgaggctgttggtcttctggagtggtgttcagtaatttggcaataactccaacttgggaagtccaaatgatgcaccgtcagttgcgttggaaagttaacttcactatgttttgaaccatgtatacatgcaccacgaaacattgtagattggtacagttttgaacatgaacttgtaccaacgtgctgactcagcagactcctggccttcagagcagtcttcacaaacgtacttggttctcattggtgtgaagtccaaagtacttggtattggtggcattggaaagctgacttgataagctttccaaagagtcctcatttacttccatagcttctgtaaattgagagttatgagcagttctttgaactggtccgttttgcactgcagttggtccgttttgcttcactggtccgttctgtactccagtgatagaatccaccgatccactttcatcctcctcatgttgtatgttcctaagcacaactaaagtagaacacttaggtagtataacattctcagaagtactgaaattaaaatcagttaggaatgaattcacctgaacttgtagtttcttggcacgacttcttgtaagtggaccttgaattgtatcctttgtgtttgatgatggttgcttggtacttgaagtagcatgcacggttgggatgtcctcatcatcctccccctcttgaaaaggagtcgacctcgacgactctgaatcttctagtccaaagaatggtgttaagtcagcaacattgaaggttgaactaacaccataatcttcaggtagctcaatcttgtaagcattgtcattgatcttggacagcactctgaatggtccatctcctcgtggcatcaacttggatttgcgcttctgtgggaagcggtctttgcgaagatgtacccaaaccaaatctccaggctcaaatgtcaccttcttgcgattcttgtttgcccatgcagcatagtacttggacctcttctcaattgcttctttggtcttctcatgaatcttcttaacgtaagttgcacgcttggacgcttccatgtcactcctttcctgcaatggtagaggcaacaaatcgatgggagaaagtggtttgaaaccatatacaacttcaaatggacacatgttagttgtagagtgtactgccctgttgtaagcgaattccacgtgtggcaagcactcttcccattccttcaggttcttctttatcaaggctcgcagcagcatagagagtgttctattcacaacttcagtttgcccatccgtttgagggtggcaagtggtggaaaacagcagccttgttccaagctttgcccataaggtcttccaaaaatagctcaaaaacttggtgtcacgatctgaaacaatcgtcttgggcatgccatgcaacctcacaatttcactgaaaaatagagaagctatgtgggaagcatcatcgcttttatgacaaggtataaagtgtgccattttagagaatcgatcaacaacaacaaaaatcgaatccctccccctctttgtcctaggtaatcccaaaacaaaatccatgctaatatcttcccaaggagcactaggaacaggtaagggagtatataatccatgagggttcagttttgacttagctttgtgacaggtgacacatctttgcacaagtcgttgaacatctcttctcatcttaggccaatagaagtgatcagctagcatgtcataagtctttctccatccaaagtggcccatcagtccacctgcatgtgtttcctgtaataacaagagtctaacagagcaatgtggaacacacaatttgttagctctaaacaaaaatccatcatgtatatgatatttttcccatccttttccag

SEQ ID NO: 92118 - DNA, 2468 bp, Oryza sativa
atgcatctcgactcggtttgggttgtgtgttgatgcaagaaggaaaggtggttgcctatgcatctaggcaattacgtcctcatgagaataactacccaacgcatgacctagagttggcagctgtggtgcatgcattgaagatttggcgtcattatcttttcggtaaccgtacagaggtgtatacggatcataaaagtttgaagtacattttcactcaacctgatttgaacatgcgtcagcgaagatggttagagttgattaaagattatgatatggaaatctactatcacccggggaaagcaaatgttgtagccgatgctcttagcaggaaaagctactgtaatatgtcagaaggtcgacgtttaccttgggagttatgccaagaatttgaaaagttgaacttgggaatagtcagcaatggttttgtggccgctttggaagctaaacctactctgtttgatcaagttagagaggctcaagtgaatgatcctgatatccaagaaataaagaagaacatgagaagaggaaaagccatcggttatgtagaagatgagcaaggtactgtgtggttgggagaaagaatttgcgtcccagaaaataaggagttgaaggataccatcatgaaagaagctcatgaaactttgtattccattcaccctggaagcactaagatgtaccaagacctaaagcaacaattctggtgggccagtatgcgacgtgagatagcagaatatgtggctctatgtgatgtatgtcagcgggtcaaggcagaacatcagaagccagccggtctgttacaaccgttgaagattccagagtggaagtgggaagaaataggaatggattttataaccggcctacccagaacgtcggcaggacatgattctatttgggtagtggttgataggttgacaaaagtcgctcacttcataccggtcaaaacaacctacacggggaataagcttgcagagttatacatggccagagtggtatgtttgcatggcgttcctaagaagatagtgtcagatagaggtagctagtttacttcgaagttttggcagaaattacaagtagagatgggtacccgtttgaatttcagtaccgcttatcacccgcaaacagatggtcagacggaaagagtaaaccaaattttagaagatatgttgagagcctgtgttctagattttggtggaagttgggataagaatttgccgtacgcggaattctcatataacaacagttatcaagctagtatgcaaatggctccgtatgaagcattatatggccgaaagtgccgtacgccgctcctttgggatcaaaccggtgaacgtcaagtttttgggacggacatattgcgagaggcagaagaaaaagtgaagattatccaagaaaggttgcgcgttgctcagtcacgtcagaagagctatgccgacaatcgtcgcagagatttggctttcgaagaaggagattatgtataccttcgggttacgccgttacgaggtgttcatcgtttccagaccaaagagaaattggcaccgcgtttcgtgggaccttttaagattgtgagtcgaagaggtgaggtagcttatcagttggaattgcctccgtcaatggcgggaatacatgacgtgttccacgtgtctcagttgaagaaatgtttacgtgtacctacggaggaagcagatcctgatcgtatagagcttcaagaagatttaacttatgttgagaagccagtcagaatcttggaagtaagcgagaggaataccaggaatcgtgttatacggttctgcaaggttcagtggagcaatcattcagaagaagaagccacttgggagcgagaagatgaattgaagtcagctcatcctcatctcttcgccagttcttctgaatctcgaggacgagattccgtttaaggggggtaggtttgtcacgccctaaaaatcgcctaaattaaaaatacattgtttaaatcatttttagaaattaaaattaaaagcctacaagctaaaccctaattgtctaggaaaattttcaacgtaaaattgagctagataaaattttattaaatactttgattgttcctctattttctagaattttctgggaattatttgagcaagggaagtatttttaataaatgaaacaacatttcacaaattatatttaattaaaaagttctgaaacccctccctaaagccgttgggccgtttttggcccaacatccttcccctctcccgcggctgagccggcccaaaaccggtccaacccgtcgccgccgccccctcctctcgggagaccgacatgtgggccccacatgtcggatccttccccttcctctagcagccggccgagccgtgcatgacgagcccgagccgccaccttgcgccctcaaatccgccccaatccggccaccccgagtccggatattagaggggttttaatccccgtatcctcctctatctttaccc

SEQ ID NO: 92119 - DNA, 2763 bp, Oryza sativa
aatgagaaatgcatggagaagcttcatagagatggacttctacactcttttgattttgaatcatttgagacatgcgaatcttgtttacttggcaaaatgacaaaggcacctttcacgggtcaaagtgaaagggcaagtgaactattgggactagtacatactgatgtatgtggaccaatgagctcaactgccagatgtggttttgggtactttattacctttaccgatgactttagtagatatggttatatctacttaatgaggcataagtctgagtcctttgaaaagttcaaggaatttcagaatgaggtacaaaatcatttgggcaagacaatcaagtatctacgatctgatcttagtggagagtacttgagccttgaattctgcaatcatctaaaggagtgtgaaattgttccacaactcactccaccaggaacgcctcagtggaatggggtgtctgaacggaggaatcgtacattgttggacatggtgcgatcaatgatgagccaaactgatctgccgctaagcttttgggattacgctctagggacagctgcgttcacactaaatagggttccatcaaaatcagtggataagacactatatgagatatggactgggaagcgtcccagtttgtctttcctaaagatttggggttgtgaggtctatgtaaaacgtttgcaatcggacaaactcacacctaaatcagataaataattctttgtggggtatcctatggaaacgaaaggatattatttttataattgggaagagggcaaagtgtttgtcgcccgacacagtgttttcttggaaaaagagtttatttcacgaaaggatagtgggagcatggtgcgatttgaagaaattcagataacaccggaaaacgcttcaacgtccacacaaccacaagctaagcaagatgttgttcaataggttgaacaagttgttgttgaaccagttgtggaagcaccggcttcacgaaggtccgtaaggatacggcgtacacttgcgaggtatgcgttgttaactacaggtaacgtgatatattgttgttagacaacgatgaacctactacctatgaggaagcaatggtgggaccagactctgagaaatggcttggagccataaaatctgaaatagaatctatgcatgtcaattaagtttggaacttggttgatccacttgatggtgtaaaagccattgagtgcaaatgggtctttaagaaaaagacagatgaagatggaaatgttcacatctacaaggaacgattggtggcggaaggtttcagacaaattcaaggtgttgattatgataaaactttctcgccagtcgccatgctagaatctattcggattgttttagcgattcctgcctatttcgattatgagatatttcaaatggatgtcaaaacagctttcctcaatggaaatctcgatgaggatgtgtacatggcacaacccaagggatttgttgatccacaatcagctaaaaatatatgcaaattgcagaaatccatttatgggttgaagcaagcatctcggagttggaatattcgttttgacgaagtagtcaagacgttgggctttgtcaaaaatgaagaagagccttgtgtatacaagaagattagtgggagtgcactggtgtttctaatcctatatgtagatgacatattattgattgggaatgatattcctatgcttgaatccgttaagacatcgttgaaaaatagtttttcaatgaaagacttaggggaagcagcatatattctgggcataaggatctattgagatagatcaaagaggctaattggattaagccagagtacatacattgacaaagtgttgaagaggttcaacatgcaagattctaagaaaggtttcttaccgatgtcacatggcattaatcttggcaagaatcagtgtcctcaaacgactgatgagcgaaacaagatgagtgtgattccatatgcctcggcaatcggatccattatgtatgctatgctatgtacacgtccagatgtttcatatgcacttagtgcaacaagctgataccaattagatccaggtgagagtcactggatagctgtaaagaatatcctgaagtacttgagaagaactaaggatttgttcctagtctatggaggacaggaagagctcgttctaaatggttacactgacgcaagcttccaaaccgacaaagatgcgtgcgcacgtcttctgaattggtaagcaatgcgtttttttttcagaaaaaaaacattctacaagaaagttgctttaaaaattatattaatttatttttcaagttttttagctaatattgagggcatggtagagctccaactccttaatttagctccaggagatgggattggagttgtgttgtggagaagtttaaacctagctccacctctctagttcattttatgagaacgctctacccagctccgttcctattttaggtgaagttgaaactgtttggctagactctagctctaagagaggtagagttggagctgtgccaaacagatcttgatttaatcatgagctaatgaattgctccgtttcatgtgcaagggggagaagtacccaaccggaacattcaagcttagcctaaggctgagtttaggaggtggacttagaaactccacatccccgcacagaaaatggtattgcccattaacgcttaattaattaagtatgagtctaaaatacttcaaacatagattaatatgatttttaaagtaactttctatagaaaact

SEQ ID NO: 92120 - DNA, 1345 bp, Oryza sativa
tcgtcctttctctccgccgtcgccgccgagctccggttcgccgccgtcgtcgccccggacctcctcccgcttcggcatcgcctccttcggcttcgccgcgtcctcgccgacctcgtccgctcctccgtttcgcccgccgaccgtcggagcgccgccgtcctcgtcgatccgaaccgcgccgccgccttcctccgctccggtcgtcgtttccgccgtcttcgtcgtcccggggtgagccgaggaccgccgcttcgcttccctcttctctcctctctctcgggcgccgctccgccgcgccggtggtcgccggcggtgaccatcggggcgcgggcgcgccgcctcccatcggccgtgccggcgaggccgccttcgggcgcgccccgcggctgccaggtggggcccggccgtcagccgcccgcgcccgcgggtgcggctgacgcgtgggacccacggcgccggtcggcgccagcagcgtgcaccaggtccaccgtggaccgtgaggctgccgcgtgggccccactcccgtggacccggtccgcgcacccctcccctcggctgacgcaataaatccgatttttaattaaaatttaaatgaagaaattcgcaaatatccatttaaagagcatataaacttcaaatggctataacttggccatttgaactcggaattggaccgttcaagtctctaatttttccttaagaagtcaagaacccatttttgtgctttgttcctgcttgttgtatggagtttattagagtaaaagccttttcttttccgttggtcgtgtagacgctgcagcttcggaagatccgctcttcgtggaagttgaagccggcgtttgggaaagcgagcaaggcaagtcacatcatccttgaacatattgaatcccagtttataaaattattttaatttaaattaatgcattatcgctttatttaaattcccgcgttatcactgttttatttagccatgcctatttacctttgttatgaccttattattattgctattgttattattaccttgttcaccctaggataaacaaaaccccaactagtgggtattctattcatggttccactagtatgaatttaggtagatgcttcgctgattaattaggcaatattaggtggttttataactttagactttgggaattctcatatcatttggacactatggaattgttggattatggtggaattggacatacacctctcttcctctttcaaaacccctaaaacctgttttcggtggggtttgggtgcatgccagttgtgggaagtagcacctcggccactataaagattaagctcgggcctctgttggaaagcactaccgtac

SEQ ID NO: 92121 - DNA, 1400 bp, Oryza sativa
aacaaagttgatcctctcatcaagatctacaacttttgtttcggtcatttgtaataaaacaaaattagccatattaatgactacacatatgaagtctttgcaataaaacaataaaacaaaatacttcattcattacaatagataagtacaaatgcatcggtcacaaggttatgccttccatatgatctgaacgagcatatgccacaggctcttggggatcatcgtcaaggtcgatgtgaggtcttacatgaagattacggttgtattcttcttcatcgacgatgttgtcaactcctacaattcggcgctttccatccctcacgatgtgcatcttcttgtttgaagggtcttttatgtagaatatctgctcgatctgtttagcaagaacaaatggttcatcggcgtatcccacctttgataggtctactaaagtcaaaccttccttgtcggctttgacaccagtgcgtatattcacccaacggcagtggaacaaaggaaccttgaacttgacgtagtatagctcccagatctcctcaatgcggccgtagtatgtgtttgacccaatttgatcctggaacgcatctatacggacgccgctgctttgcactctgcttttgtcatcttgtttgacggtgtaaaatgtgtatccatttatatcgtatccttgccatgtgtctacggtccaagtcggtcccatccccaacaactgtactgtctcatttgggatatccgtggacattgtcacacaattcttgaaccattcgttgaaccgagaattatgtaattgacaaccttccctcgtgacaagacggaggaactccgataggatcggcatcggacatgtaattgacacagaactcaatagcctcctcggtcgtgtaaccttcaatgatgctctcctcgggtttggctctgttacgaacgtacgacttcagaactcccatgtacctttcaaacggccacatttcccttagaaaagccaggccacatagttttgtttgcttcaccagatgaacagggagatgaaccattatatcaaagaaagacagtgggaaaaacatctccaggtgacagagggtattcacaatatcggtctgcaacccatctagatcttctggatctataaccttctgtccaattgcattgaagaaagcgcatagacgttggatcgtgtgatgcactttcggtggtagaaagcctctgatagcaactggcaagatttgtgtgattagcacgtggcaatcgtgagacttcattccaacaagttttagatcgtccaatttaacatacttacttatcctcgctgaatagcccgatggaactttaatatccttcaagcatgataacattgcgatcttctcatccttcgacaatgtgtggcaagctggagggaggtacac

SEQ ID NO: 92122 - DNA, 1118 bp, Oryza sativa
tttccttcgatgtgctcttctcttttcgctttccaactttcctcttttttccaaactcgttggttattcccatcactaagttgtgcacctctgtccctgttagctctgtcgggggtccggctgtatctctgtgtccattgaaattctttctcatattcctatacggatgataccttgggagaaatctcctgtgacccatgtagaccgtcttgtgtgaatgcttcaaccatttgcttcttgtttcctccatacactccgaacacgcccatttccctttcacagtttggccagaaaggttgccaagggccggataatcgttgatggtacaaaacagcatggcatggaggttgaaatactcttgtgcatatgcgtcccatgttcgtgtgccctcattccatagcctttcgaagtcatcgattatcggttcaaggaacacatcgatatcgttgccaggttgtctcggtccttgaatgagcatggcaagcataatgtactttcttttgaaacacaaccagggaggaaggttatagttaacaagcagaactggtcatgtactgtgacgactgctcaaatcaccaaaaggattaatgccgtccgtacacattgcgaaacgcatgtttcttgggtcatttgagaattcctggtaaatcctatcgattgtcctccactgtactgaatctgctgggtgcctcagcatagtatcgactttccgttcttcggcatgccagcgcacaagcttagcttgttccttgtttgcaaacattctcttcatgcgctccgcaattgggagataccacaccacctttgctgggcctcccctctttgacttacttccttcaccttcactctttgctcgtttgtatcttgatgccccacagatagggcagacatccaagtcagcgtattccttgtaatacaaaatgcagtcgttcggacatgcatgaattcttctgacctccaggcccaacggacataatacttgcttcgcttcatatgtcgtctgaggtaaattgttcccctctggcaacagatcctttaacagctcaaggagttctgtaaaactcttgtccgaccagccattactagccttaagcttcatgagttccaacacgcatgac

SEQ ID NO: 92123 - DNA, 1693 bp, Oryza sativa
tattgagggtaagaaatatttccctatattcaggtttaataaataatagggtagcaatgaaatgctcatcactgccttcctcagcaccagcattaacaattaactccatgatctcagaaataccgcatcctacttcactgattctcacggatgtttctgaatttgtttgcttctcattctcaatgggatgaccaaaagctgaaaccacataatttttctgaggatcgatcaagttattcgggatatcattagaagatttttgtaattttgcctcctcatttcgcctattaacatccttatgaatgatcccagcatcatttgaagcaatggaacatttctcgataccaataatagcattgacaactttattagcttcagttcctggtaaaaccgaatccagcacgccgtcaaagattatatttagcaaatcaacattctcaagtggttcaaagtgaaaattttcacaatccgtcactgcctgaagaagagttgaaaggataacatgtcagagtaaaagtagaaaaaaatctagctatagatgaaaaggaagttatgcctagttgcatctaatagagcaagagagtggactatatttatccatagtcagctaccaacacaagaaaatatcactacaaaaataatactcacaagctccaacaccattagttttttttcatacagtagatatagctaaagtaattcggcgcagtccatataactttttacatttgttggagaaaataattatgaacctaaccatataccaaggagggtcagaactgaaatggtatatattaagagagtgcatgtcatggacattgagctaatcttgaaattatggaattaaggaagtactagaattgaaaactaaacacgagtaaaacttggtatttattatttccaatgtttaaaattattgaatcatagaagagctataataattgaatccaaaattaactctttacaatttcgtatttattaatcctagctaccatacttatttaatgaagaaaaacatgaaattattaattttaactctcagaactattaaatgataaaatacaaaggaacagaataaaagtataacatcagacattatatacagaatataatctataagatgtgcatttctttagttattactaatcataattttaaaatcattaataaattgaattgttttattttgtatgaacttaacattggtggttaatttgtagtctagagagaaattaaccagaactgcggaattctgatcaaacatacccagataaaatatttgttaaatctttagttcagatattttatttgttttcttttgatagcagctgctaatcgatgacataattgtgatacattttgtactctactgtcaccatgtcatcttataaactgctacataatagtattaaccacaaaaaaaaaattctagccatcattaacagcaaaacagtttggtgatggatggtcccagtgttaattgcatgattacctgagcaatgtgatgtactatcttatctgggaccattttttgcttgagcagatcacgaataagacgaatctttccaagtatttgatgtttcactagcctttctttatcccgtcgctccatctcttgctctcgtccagtcaatttgtagatgtcggctcgaacattgcgagcaatttcaaatgcttgttgacatttgtccga

SEQ ID NO: 92124 - DNA, 3906 bp, Oryza sativa
gcacactccccacatcgcgttccaagtccaagaaaacacaccccacgcacagaatgcctagagctcggccatcctccccggctccggcgacttagccgtcgtcgccgtgcatccccggtgagtccctctctcttcccatctatggaacgtgacctacgcttcacgccgagctcacccgtacccattttgccctaggaccaacctgtcgagcacgtggtgggcgtcaccgtccttgccgccggccacccgaaccgccgacgccgctccggccgccgttcctcaccaccgaagcaacaccaagctccggtgagtttccgctggatttctcgcgcatgcaccctctgtggctcatccctaacacccccgtactctaaaagttacagttcgcgccttgagtcgacccggcgacgtcgacgccggagttttgccgccgttggccatcaaccaccgtctccgccgctccctggaccttgctgcctccgtttctctgcttggtgagcaccctggtaccatatgagagcacatgcactaacccttttgcactaaccaagcctctgcatgcacatatatgggcataccgagacacaccaccgctgtagctcatgttctatgggctacagaccaccatttccctcaccaccaccactcatggatgcgcaagaacgttctatatattttctcttttgtgctcaaaccgattcgatccaccgatcaccgccggtgagccgtagaccgagctcagccatggctgctcctgatgtgagctagctggggacttcatttcttgaatttgatctagggtccaatctgaaaactgccatgactcatattactatagcaggatcttgatggaaataaacaaaagaatagggactcttaataaagtttgctgtccaggtggcagaaggagtgcgggatgattcccccaacttctgagggcctctctacaaatctcctttcactgacctgtcgacccggctggaattcaatttcgaaaattgatttctattttggtttaaagcagagaataagcagaacttctaaaatttgtagaacattcattttaacttcaaaaattgtgaaaccagttttgttagatccataaagctgtgaaatattttacgaaaatataaaactgggtactttctctacaaacttttcctttatttttgttttgccataaatgttgcctagaacttgttaaatccataacaaatttaatatagctctaaaaattgtgaaatcacttcttttaactttctaaaatcattctctgtaactttgtaaaaggaattttgttcacttctgtacaaaaatgctgcttaataaaacatagccctttttaaacctttttaattgtaaaatgcatatctctgtaaataaaaagtgataaaataaaaattccttcaccagagaccacctgagaccagcacacactcactgcataaatttcatgcattttcttgcattttggtttttatgcatttttgtatttatcgtatacgcgtattttgtatagaggaagaatacgtcgaagaagaagagggtgagtttgttgacgaccaggttcaggagtttgcagacgaaggcaagtttgcccctcctttgatcacattgatcctatgctttattgggctaaataattctattgcaaacatgcatacgttagctagtattaattttggtaaaaaaaattatataaatgtgggaatggtagatatgacctaattgctgcataattcaccttgaaatattgaatccttgctggttgtaaccataaagtgcttttgaatacaattattgtgttctttgggattatactatgcttatattgccgctatatgcttatattcggttaccgccttgcaaattactcgttttgataaatgttatatgtgaaaatggttattttgatgttgctggacagaaatttaaatgtgtgagtattgtgaactgaaaatggagataacttgtttttaaacttgggcggcgagtggtgtacatatggtggtagttgtacaccgatagggagagcgttcgcccgggtcgattaaggaccccactctatgtcaccaactaatgaaaacagtacaaaccacatgtgctaagtatgggctggtctcgacctattaagttgtttagagtttagccttgcatcttggtagtccaaagggtatgggttaccgggttttggtaacttatcggaacttcctatggtttgtgatatgatgaaattgattaatgacatgtggtatgtgatgatttgagcgggtagtctgtccaatacaacggtgtcgtgcctcgtgagggattccgggctgggatccttacggcgctaggttaaagcgtgggccccctacctagtggcgctagcttgctagtagcgtgggtaaaacacacatcgtgctggtgcaaggctagacaataaacaatgtaaccgtttcgttatgacctctacatcacactcaatgtgtagagtgtggtgataccgaccggtatcggacaaactagagcgattcatatcatgtgggcttaaaagttgtacaaactttgcagagtctaaaactaatcgattagccgtgctcacggtcatgagcggcatggtgaagtgtcatgagtatagtcggtgattttgataaactcttgtgaacttggaaaatggttggaatgttttgctgtgaacttgggtaaagttcggtgaatggtgatgagatgacggtgagtggtgatgatctaccttgaggggtagatgtgtgttatttattcattgacattacaagttttacttactctatactattgttataaaattccgttgcggaaaatgttgtgaactaaaattggcatttatgcaaattaacctatacactgcttatccttgaatatggccaacatgtagtatgctaggattgtttccgaatgccagtacattaatttgattaatgtactgatttcttgccttcttttacttgtttttgctcagaccccgctgcaggtaatgactgtttggatgaggagtttgatgcagcttgtgatgttgcagattttcaggatggttctaactagggatttaccctagtcggtttgcccatgggcttttgggtagcacgcttaccgcatgaaccaatatttatggcttgtcgccaagtactacttagaaccttattaagactatttatgcttattgcttagaaccacttattatttggatatcatgcttgagatgatttatgtgagactatgttgcattcctgggcaactagtcccacatgaggatgggtttgaaatggttgagataaccggggaatatgcctttgttgagatcgagtctctggagtacgcttttggtcgccaacatcgagtggttgacgggcgtatgacgtagatggctggtgtggctattccaacggttgtgtcttctatttcatatccgatggcttagagcctatgtagtgcactcttcaagacatgtcggggtctgcaatgaggttggatggttaccgtatttatttgggctttatttgagaccccatccatccagatatttcgcgccgacatgccttggagcgttgcaccacctaggctttgggacgtcctgacaacgacgagctcatatttaaggatttctgtcacgtcctgataaattcatcccgaattaaaaatcattcgctaaaaggaataatagaattaattaaaattcgaaaagaaattggcaaacactaaaatacgaacaagaaaaattcaaatgtgacccggagaatttttgttaaattctccttggtctaaaaggagccctcaaattttagtggaattttcagagcacaaataataattattaagaaataaacaaagttaaaatgattttataaaaagaaaaaccctaaaaagtctttttttccccccccc

SEQ ID NO: 92125 - DNA, 920 bp, Oryza sativa
cagcattcatgacgcagatgtatccttgcgaaaggtacctggggatccttaagggttatgtacggaaccgttcacaccccgaggggagtatcatcgagagttacaccaccgaagaggccatcgaattttgtgtggactacatgtcagaaacatcttcaattggattaccacgatctcatcacgaagggaggcttgacggtgttggtactgttggaagaaagactattaggttggatcggaaggtgtacgataaagctcatttcacggtactacagcatatgactgaggtggtgccgtacgttgacgaacaccttgcagttatccgacaagagaacccaggccgatcagagagttgggtcaggaataagcacatgtcttctttcaacgagtggctgaagaaccgaattgccaggttgcagaacttgtctagtgaaacacttcagtggttgtcacagggtcctgaatggagtgccaccacctggcaaggatatgacataaatggatacacctttcacacggtaaagcaagacagcaaatgcacagtgcagaacagtgggttacgcatcgagactgctagtgacggtggtcgtcgtgatcaatactatggtaaagttgagcaaatattggagctagattacttgaagttcaaagtcccgttgtttcgttgtcgatgggtcgatcttcgcaatgtaaaagttgacaatgaaggtttcgccactgtcaacttagctaacaacgcgtacaaggatgaaccgttcgttctcgccaaacaagttgttcaagtgttttacatagttgacccgtgtaacaagaaactacatgttgttcgtgaagggaaaaggagaattgttggattggacaacattgcagacgaggatgattacaaccagcacgtccacggcataggtcaagaaatacct

SEQ ID NO: 92126 - DNA, 4713 bp, Oryza sativa
tccttttatatttgtagttttgaaaaataacactcttgttccagtttctatctccatttggatctgacatgtttggttctgaaacttgggcggtgaaacctgaccattagcgactaactttgcacattgagctctttacctgcgctgcattttgaaattgcttttgtacccgtttattattatcattttatttttctgcattctgaggcacttgccagtttgctacgcaacgagacggcgccagcattttttttaacacgggaaatcatgttgtccaaacgagacctaagcttgagtaaatgtttgccttttactccatctgttttatatgttttgactctttttttaaaaaccttttatactaaaaacataacaatatttttaatataaaataaatatactattaaaatatattggatgtttggtttatgaaactggtttgctattataaatgttgctaagagtctgtttggttggagggactaaaactttagtcccttttagtccctaaagtcccaaataggagggactaaaaaggacttaagtgtattagtccattagtccctatgggaggaggttattgggactatagctcctttttacccactgcccccacgcatgggtatggtgcatctctctttgcatggttttagaggtaacatagtcattgtacagtgcaattaatgacatttagtccctatattcaaacagccatggactaaagtgtttagtcccactaagtttttctataaatttagtcaaacttaaaagaagtttcatattatatgaaacagaatacttttttctaaaaccaataccatttttttcacaaacttacatgaaaaatttgtgaagtttgcatattataagattgataaagtttgcatctcttgacgtcagatttttgtttgctaccctcctgtcatgcgatggttgtcgagtgtcttatttagaaacaaattggatgaaacttcgcgcgttggatgatgttggattggaaatctacaatgttaacaatgttagtgataccaatttgaaacgccgagaagaactattggagttatatgtaatgttggagttatatgtaatgttgtgttgttgttgcagatttggaattggcattccgaccaatatggacaacccgttaaaaacagatgatattattgagttcacaactcgcagaaacatgttttcatcacgtcgtcctcattaaattgatctcatcgatctctattttgatgagcatcggcaatagaattttgaatgtgtcgacgagtgatactcgttgactggataatttgggtattggggtacgttggaacgaggatctacgtaatacgacatcaagcaaatagaagacaaatattatactggttcaggccccttgtcaggtaatagcactagtccagtttatatgagattgatgacagaaaaccacataatacaatggaagtagacgaaactaatgataccgacgagatcatagtcgatgtattcgacgagatctcccggcgacttggcttcgcgtactccgacttcggaaactatggtgggtgtgttggagatgagattcgatgccttgcacccctcctcgggggtcccttttataccgcggatcatcttgatccccaagtaagactcggagacatcggatcttgtacgatataacagaaactctatttcttccgagtaggactttggaaatcacttggctcgtggagatattttccataattcgtaacaaattccaccaatgtatatgggaatagtctgtatacgtgatgatataccatatctgcgtattccgtaagtcataggatatgaggtattccttatccgtaaccttgacagtagcccccgacttcaacttaaatgaattcacgttgtcgcccgcgacttctcctgttagcgccttgtcgtgctcacctggtcgatctcggtgcagaaccgtggagatgtggagccatcgagaacgctaaagggagtcaaacgttcgaatatgaatttaaattgaagtctgaacaaccgcccgcaacgggcctcaagatttttcggcggcaatatctctccttggaatgcgaaccgctaggtagtgcgcctatttaaaggggttttgggatccatttcaagtccgtttgccaaaaaatcctccatcttcttagaagcctcggacccttcgtctcccacaaagccctagatttctttgtcttccttcgacgattccttactaatggcagacctcaacaagtcttcatccgacgcggccagcctgaagaacctttacacagaaggagctctccctcccaatcaaaccatggtgagagaacaaggaggtattgatccttctcctgccctaggccgtatggcagtggtagaggattttgtccgctgtggttttttgcctcccccttcggaattcctcttgttgatcctaaatttttatggcctttcactcttgcacctcaaccctaattccatcacttccctgagcatctacgctcacctttgtgaggcctacattggggtagtgcatttcttggatctttttcgattcttcacgaacttcgttggatggaagccggcaggatctcggggtgttgtgggttccgcttacatgatggcatgaaagcgaggtacataccctttcaatgccatacgtcctggaccaaatgtcgatcaaagtggttctaccttgagcttgaggaacttgactcggttcttgtcgtgcccgaggtccaaccggatcgccaagagagctagacttccaaacctccattgaccccttcgcttgaggccttcgtgaatattgtcggcgacctgcgagaacaagggttgaccgggtataaagtccacggatctcgtcacggggtacttgttctcatgtcgtagtttctgtctttccttaaccgctattccgtgttctcggttttacctgacttcggctttttctcatgtttcagatcttcttgctgatgtcgtgacgcagcgggtgagggatgtgctaatcagccccgcctcaaccgccgatgagctacccaccccccttcgtgacaagccagcggccgacaaggcggctgttatcaacgtgagtgaaccgaacgcctttcgtcttttcattttttagggagacgaagtgacctcaattcccgcaggttctacctttgacggatgtcatcggcccccttgtcgatcatcagacttcctcttctctcagggagaaagtcgtggaggaggttgccgccatcgccgctggacctgctgccgctagaggcagcgggctcaagaggaaaaggttgggctcgtaagagcggcgcccctggatctcgtcagaagtccagtggctccgaggtaggctattccatccctattttgctaccccatttatccttgcaggacaatagggatgagatcttgattctctatcttactcaggatacgggcagtctttctcctcatccgaagaggaggataataaagaaagccgctgacaagtaagtagaatcctggacctccatctgttttcatgttgatgggtcttttgagtgtatttctgatgtcagcaggacggtctcagcgatctctacgcagagtggggatgaggtcgcgaccagcgcgattcccgccgcagcttctcctcgcgcgggtgctgcgcctgtcatcgccgagtccgccccatccgccgccgtgcccgtggctgcgccgccgcctcccactccgatggggccattaacctggtcacaaaagatgaccgagagccgccgctgtcgacgagagatactcgctgaccggatgagtagagtattggggtacgttggaacgagggtttacgtagtacatcaagcagacaaaagacaaggattatactagttcaggccccttatcaggtaataggcctagtccagtttatatgggatttatgatgatgagaacaaattacaaagagagtagtcgaaacaggtagtgatgtgcactagggttcccgatcttttgaaaggttctgataaacaacgatttgggcggagttgcaacacaaattgatccggcttcttgaacacgcacgctcttgagccccgcaatcgcaacaccacgtctcctctggttatcacccgtgtcgaaacgcggatgatgtcgcgtccgggaaaattgcattttcccgaacgctagtgtattaatccccgtcccaggaaaagccggggtacaccatacaaacatgatataaaagacacatctttattaaatcgataatatttacattattacaaaggcacttaaggcctgacaatcaaaaataaacagcagcggactagcgggcctacggctccatcttcacaggcgctcaactggggtataagccaagactccacctaagacttcttctccaaagcttttcttactgaaggggggagaaagatagagcaagaatgagtacaaccacagtactcagcaagccacaccggcggatgcacgattaatgcaagggggtacaaggggtaatgatataggggttaagttttacagaaaacagcatttaaaagtcacttagttgcccaaagccattttaaaaagacgatcctaaagctacacagtattattaatcaaggccgtgaaccctcacgaacctgccttaacccaaggcctacgatgattcagaccgaactggcaacccgaccctgggtcccagctcgtcccaagccaacccaggccaaccattcc

SEQ ID NO: 92127 - DNA, 527 bp, Oryza sativa
actgtgcattgtgcagatggcgagaaggtcgatgcatctgccaagaaaagtaagaaaaagaagtctaaagctgaagctgacggcgaagcaatggacctggacaagccttccaatgtggctgatgaagctgagcctggaactgagaagaagaaaaagaagaagaagcacaagctggaggaggagccacaggagcaggagaagagcgtggcgcatgccaatggcgacgccgaggagaacggtactcccaagaagaagaagaagaagaaccgtgaagtctcggaggacgctgagcctaagacggccactgaagggaagaagaaaaagaagaagtccaagacggaggacagcgactgagtgatcggtttgcctacttgcatggctgatctttctgattagtgttgttggaagcagagttaaaaaaaacacctagattcctagttcctgaagacaagagcagtcctgaactatgaaattgccctcccatcctctttccctcattcgatgttatcaattttgtgtgtgataga

SEQ ID NO: 92128 - DNA, 1100 bp, Oryza sativa
tcataagcatgttaatttcttcacttctattgagattaatcaaattggtctatgtctgaacaaggaaaagcaatccgtgcaggttgaacttggaagatccagattaacacataaagaagatctgcttgatgataagcctgtagaggaggttacgctttttgatgtgcaaaaggtgaagtttgtccggcgctctggtgggtcaaatgacagtgcagtctgcgccctcataaatgtaacagaagtagcagtttggtgggaacctgatccctatctggagttacttgaagtagccactcgacttaaatccattatgcacaggatcaagcaccagaattctgctaatgagataaaagatgatacagtgtacacggatactttggcaaaaaaggattcactcacagaacatggccaacaagaaaaaccacagaagaaacaagaattggttattgccgttgatgtggaatctttgaaaatttcaggtgaacttgctgatggagttgaagcaatgattcatgttggatccattttttctgagaatgcaaagatcggtgttttaattgaaggactagtagttagtttttgcggtgcacggattttcaaatgcagtcgcacgcagctatcacgcatcccagtttccatttcagacagccttcccgataagaagttgcagtctgcagctacatgtgattgggttattcaatgccgaaatgcttatgtctgcctgccttttaggttgcaactacgagctatagatgatgcagttgaagacacattgcgggccattaaacttatttctgcagcaaaaatgtctgtattatttcctgagaagaaatctagcggtagcagtagcagcagcaaaaagagcaaatcaaaatcaacagaatttcggtatgtgagggtcattgtacgtgacctcgtagcagaaattgaagaagagcctatccaaggctggcttgatgagcatatcgatttaatgaagagtgtatttaatgagtcgacagtaaggttggatctgcttgatgagcttgcttcagtcaaacataaagactctcccaaggcaaaattggatggatcttcttctgaaaagaacaatggatgcc

SEQ ID NO: 92129 - DNA, 697 bp, Oryza sativa
tttcactgaagtggagcttttcacttaaaccttctacaactgaacctgtgaagcatcagcagaatattcaggcagtttcgaataattcaccgactgtgaatgttggagctcatgattttgtctggctaatgaagtgggttaacatattttttcttcctccccataaacttagactgttttccaggtttccacgctttggggttcctagatttatacggtctggaaacctgccacttgatagagttatgaccgaacagtttattcgttttgatgcttcactattgcagatcaacaatatgccgctacaggttgatgatcccgctaatggattgacactgcactttacaaaatttaggcttgaaattgctttcagtcgtgggaagcagatatttacttttgactgcaagcgtgaacctcttgatcttgtctaccaaggcatagacctgcacttgctgaaggtatctatcaagaaaactcctgaaccatcaatttctaaggatgctcaggtagaaaataagagcctgcatatgaaagctacagatagtcctggcaaaaacaaaactagttcaactgagaaaagccgagatgatggattttttctgtattctgattatttcacaatacgaaaacaaactcccaaagccgatgctgctagattatctgcatggcaggaggatggtaggaaaaaatcagaaat

SEQ ID NO: 92130 - DNA, 1033 bp, Oryza sativa
aagaggaaggaacaaggcatttcatggttaatgttgtccaacctcaattcaatctgcattcagaagaggcaaatgtgagtatactctgccagcatgtttctcagattataatttccaagcagcacttagcagttcaacaaatatcaggttgtttgttcaatgtatattcttctattacttcagtcataagcttgccatgcaatgaattaatctttatctccattcctctagcaattgccaacttatagcatataacaagattccaaaactaaccaataggagaaaatgacaggctttctaaagcaaaatccatatgtaaatttgaatttcaaatgattatgtggtggttttcatcagctggataatgaaaattcacattcaaattattctagatccaatatgttttcaagaaaaaatattgccaatagactctgctcgtaagctaatggatttaattgcaactttccaagctcatcttttgttattccttagtagtatcgtggtgttacctgtgggagattttttttttcagtatttgttatttacacctaaattttagtagcacttgtgaatgctgaagtgacttaattgcctgttcactaacatcagggtaggtttctacttgctgctggtagcgggcgggtcctggttcgttcatttcactcaattgtacatgttggtcaagaaatgtttgagaaagcacttggttccagcaatgtagccattggagagaccaggcctgaaatgtcttggtcacgttatgaagtttctgtaatgttggagcacgttcaggctcatgtcgctcccaccgacgttgatcctggtgctggtattcagtggctacccaaaatccatcgtagatcatctgaagttaaacgaactggtgctttgcttgagagggtatttatgccatgccaaatgtacttccgctacacaaggcacaaaggaggaaaccctgaactaaaggttcttaatgatttcattttggtttgcaccttccactgaccatcttttggcaggtcagttaaagtag

SEQ ID NO: 92131 - DNA, 3535 bp, Oryza sativa
caagaaatgtcatcgacaagtgcgaattctatgaaatgtcatcatacaagcgactttgtcctagaaatgccatcgccgttagggttccgtttaggggtggtaatgggtcaaggcccgtgggttctttcacaacccatctcaacccttaaatatttttagcacaaaaaactactaaatttcagccgtaccctttttggacccaaccctcacattttctaggctaaaatgttgggcccattaccacccctagttccgttagcagccctccattaagtgctataacatgaataatgcatttaacgggacaggatggatgaaaccctaatagcgatggcatttctgggacaaaatcgcttgtacaatgacattttatggaactcgcactcattgatggcatctcttggacttagctgtttgtcaatagcatttcttggatttttttttcgtattttagtttctgtaaattggattcaactgtagacttcattggataattgatatgttaggtactaactatagtctatttttcagaactaagaagagcaacctatcctatcccctggataatgacgatgatgatgacactggtgaagagtctgatgcagttgtaccagatggagtggaagaggtagaattagcaaagattgatgttgaaataaaagaaagagaatggaagatactgctcgatgatatcagaactttgtctgttggtagtgaaatatctgctgatgagacccaaaccccaaagtctgatgatgctacatggattgttactggatcaagagcaagtctggtacgctgcagagcaaccttagttacttatgtttaaatcctaatttgcataaagttactttttgttgcaatgaattttattctcctgtaaactgtaatggatagttaatgtcttagttcatatttgctttagtcatgaaacagaatttaggatcccattatcataatataaataaaataatttccttttatgtcgctgaatctattgtgatgtcttacataacatctgccaggtaaaatgtctgaagaaggaacttgttaatgttcgcaatggtaggaaagaggtatcttctatgctgagagttgctatgcacaaagctgcacaagcaaggttaatggaaaaggaaaagaacaaaagcccttcatttgctatgcgagtttcactgaagataaacaaggttgtctggagcatgttagccgatggaaaatcatttgctgaagctgagataaatgatatggtaatttaattcatctccagtgaagcataatcttgattttatcttctgatgatacattggagtatttagtttaatttaatatggagaataattatcgttattttcttcatcaagtagacaaatgtacatgccgtcctgctcttgcactaacttccctctttttttatccctaaatctgcagatttatgatttcgaccgggactataaagacattggcattgctcatttgacaaccaagttgtttgttctcaaaaatggacttgctaatgcaaaatcagatactgttctggcaccatggaatccaccttccgaatggggcaagtaaggacactaatatttttccgttacatggtgtatttggatgttcaacatatgatacttgtgatcacaactttgtttttacaaaattgaaatgctgcaataagtactctctctgttccatataacaagtcattttgggtttgtcctaagccaaacgtctttaagtttgaccaagtatatagggaaatgtagcaacagttccaacacaaaacaaatatactataaaaatatattcggtggtggatttaatgaaactaatttggtgttgtagatgttaatatgtttttccataaacttggttaaacttgaagaattttgacttacgacaccaaagtgacttataatatggaaaggagggagcagacaccagacagtatctaattttggcaacctaatttttttagtttctgtacattagatgcttctttcatactatagcaaacattattaagatgctagtattacattttctcttcaagtggtattcagggtttgcatttttaacaataatacgaaatagatgccatttcacagagctatcttaagatactgtaaaaaatatataagactcagttaccaatctgtgacagttcatgggcaatatttgccaactctaccttctctttaattaagctggctagaagtacaatccaataagaaacttctgcttcatgaaaaggaaagtgcacgctaattctgtagcccagcttgatagggcatacttacaatacaaggatggtggtaaatagcatgactagggtctgatctttgttttacagtttacatcatttcatattttctccttcatatattcatttaacacatatagtctagcactgaccaaactgctgcttaactattttgaactcagaaatgcaatgctgcgtgttaatgctaggcaaggagctccaactggtggtaactcagtaatagagagtctcctcgtaagttctctctctctctctctctctctctctctctctctctctctctctcttatgactaattcctaatgcatgtaatttttgtaggattttttcttcttagggctgaggctatgattttaagttttatttgcttctataatttttgtatcagattaatattatgaataagcattagtccggtgtaacagtacacttaatgtcacttttggctttatgcttacctgcatggtgaatgactgcggcttccttttacccccattactgtaggtagacatctatccactgaaaatttatttgactgaagcaatgtacagaatgatgtggggatatttcttccctggtgatgaacagcacccacaaaagcggcaggttaaatcatttcatgttctttgtgctatgatttttccagttctagttatgcactaatgcttcctccactgttacttatctagtatatttgtgccattcctttttcatcaataggaacttttcaaagtctccacaacagcagggacacggcgagtaaagaaaagcacatctattgctgaaacgaacagtcccagtaaacaatcatcgaaagactccatgcttttacaaaagcctgaacttcgacgcacatcttcgtttgacaggacgtgggaggaaactgttgctgaatctgtagctaatgaactcgttacacaatttcagagtcagtcaaatgcgccgcctgaatctcaagatgctcctaaggaagccaaattagtacgatctgctcgctctactcgtgaagagaaaaaaaatatggaccctaatgaggtgaaacaaactagacctcagaaaatgatggacttccgcaacataaacataagtcaggtcagcatatactttgctgaatgtttttctgtttatacaaccagctgaaatattgtatacaacctgctgaaacaatagccattttcattttgtttttcgctaactgaatgaaatatcactgtttcatctgtataacatgaatttggttctgggctgcaggaa

SEQ ID NO: 92132 - DNA, 1998 bp, Oryza sativa
tggatttgccacttctgttaagggattattcagttcacaacgaaagaaagcaaaggcatttgtcctgaagactatgaaaggtgacgctgatcatgatttccagggtgaaaggagtgagaatgaaattgagttctctccatttgctcgacaattgactataacaaaaacaaagaagcttatacgacggcacacaaagaagattaaatccaaagttcctaaaggtgcaggtgagataccttttatttgtttcaaggaagtgatactaaattgttgataagctgattctacctgacacccttaaatagatggagataaagataggcaaagaaaaaggactggttgtcactgtcacttaattgcattccttgttcttaccctttcttggaacttgaaagagaagagccgttttttttttaaaaaaaattgcttaataagaacatatatcatgcatttgtttgtgtatgaactatgaagttgggaaaattgcatcgacattcacccacgcacacgcagagagaattgcaaatttaccttttagtctttctacaagcggactcctggaaaatttacttaaggtcccaagatccaagatccaatgtcccttgaaaatattttagattatatatatatccttgaacaaggaaatacctctggtgcaatgtagcgaaaattcattaagccgctgggacgtatctgcccttcttggagcatttcagttattcagtactacttctgagttctaacatacgttcgtcctcttgttcagctacttcgcaagaactcgggtcagagctgccacctcgtggcccttctgggaaccagacggactcctcctcttccgatgataacgattcatcgccaacggaaacgaacccaaaagattaagccagcaccggctcagaacaattggctctgagcctggtgtccattccagcttcgggtcagcacatcttggcgatgggtcgagagctacgaggcatttgaattttgagaagattttgtagtaggtgtttttcagcaattctttttacccctcatggatggagatttgaaataagtggtactagcaagttatctgtcatgtaggcgactggtagacaagcttacggatctcaaatgtgtagatcgagagtttatgggcctaagcaaactaatttgtgaagtttagagacctatatagtgtattttactctagatatatttttattttctcttactacacttttaatcgaagaatgttattaatttcttctgttccaagaagatgaagtaatcctgactttgtgccagatatagccattgtttaccttagtttgccttctaaaacaaactacccgcatgattatatatgttgcatcaattcccagtttgtcacaggctcacagctctcaactactgagagcaactgagcaagcataaactgggttctgacttctgaaccactattccagttaaaacttctcaaaagagtttcagaaatgtctataaaatattatgttggagacaactgtatgaaactttgagattaaactcaacttcgtgtatgatatctgaaactgaaagaaaaacaaaaaaaaaattagaagcttcccttaactgcaaggagggtgcagcctaagagtagcccgggttgggcctgatggactaatgtaatgggcctctcctggaccggcccacgagctggcaacaaccaggtaggtatataaagggatagttcactatgactcccttaactaatgagccaatctgattcatatccttaactattaaaacagtgccacatatcaggtcaaaactatcacgtaaacgtgacggcagcaaaaccattcttcaaattgcactggttttaataattggaggtcgagatattcagttgaaggatactcagattcagtcattaacaaagtaaaatggacttatatggatgcaagtggagcgagcaagcgggttttttagcccgcttatctcacttctagtttattttttcttctaaatttt

SEQ ID NO: 92133 - DNA, 3054 bp, Oryza sativa
gttccacacgatgcgcgggccgtgcgactactccggtactcccaacccaagacgcggactggaccgggcagctcatcggagtatagggcaccatggccgcctcgtcgtacgacggggtggtggcgctgtggctgctctggtactacgacgaggaggcatgggaatgcgtgtgtacccgagtcgccgccgggttcctcgatcggcgacgtggcagggacgatggggttcttcgtcgcccacgtgagcgacgacggcggcggcggggacgcgctcgctgctcctctcatctcaggggcatcggtacggagtttacaacctcaggaggggcgaggtggtggccgccggcagggagctcggcggcggcgacgacgtcatcctcgcgacgcagtatgtttaccaggagagcttcgcttctccagtggcccggagaggcgtcggcgacggcgctccgtcgccgcgaggagaactggccgccggcgccggcgaggcgtcctcttcgagcttgatcagaaattctccaggattttatggagttctaatcttttctttactttctttaaaatatggtaatggttgttcatggtcctccgtatagtggcatgtgtgcttgccagatatgtgtgtaattttcatctagtagtggattaaaaatttaaaatggttacatttcgaccatcctgatgatgcttatcaattggccttgatcagcagtctgagattaaacaaatttgtttgttttttctaagcactacagttttcattgaaaatatatttcttttctaccaagaagatgtgaagtgatcctgactttgtaagagatataagacataaccgtgtactattcaaccttagttttggtgtttctcaaacagacaactaagagcaaacataaaccgggctttaaagtgtagaacatccaggtatagtacctgtaatggtcgtaatccattgtaaatttggcgaacactatggatatcatctaatcatcatgtatatggaagtctttaaaaattttatagaagccttacatatagaaaatatcagtggatttttacgattaaactctcgctctagtcaaatatatttgactttgcatcgaatatatttcactggagggagtatgtgaaaattgtcaaaaaaaaaaaaacaaaggaattgccatagctgcctctgccgaaatgccgaggaaattccaatggcttggtttgatgctgtttgcggctattaaaaactctaaggcttggtcatatgctccctaccggggaaaaaatgaattacctaaaatgtaaaacttgaagaattcaggtaccgatttgaaatttcattgagctcagggtgcgtttatttctttgggtgtaaagttttcaaaatatacggacgtacatttgaagtattaaatgtagactaataacaaaataaattacagattccaccctgctgtgagacgaatttattaagcctaattaatctgtcaatagtaaatatttattgtagcaacacattgtcaaattatagcgtaattaggctcaaaagattcgtctcgcaatttacatgcaaattgtataattgattttttttatatttaatgccttatgtatgtgtccaaacttttaatgtgatgtttttagctaaaattttttgatctaaacgagccctcaatgcttcagttggcttgaaaaagaaaaagaaccctaaaacgattgaccaaaacagcactacagaagaaattaaaggtggttttgatctaatcagctaattcctttttctaataaatggaaatctaatcagctggagtaataattgtgctggtcgatgaatccccagctgttctctgcaagacatgtacaagccaaagtagaacccatcttgattttttctgcagatgcaagataagagtaggcaggatcgatcgaccagctgatccggaagctgccgcggcgtaggctagctgtacagacagtgcgtgccgtgcagaggagatagccaagcggaccctctacatggtgcaggagtactacctacgtggatctaatgcccagacttcttgtcattcgatcgtgtgatctgcccagacatgcttatgcactcgcagtcttctttgttcgccctgtactactacactactcccatttcagagcatatatttagatcctctagcaaatttttttagcatatcacatcgaatatttggacacatatatagagtattaaatataaattaaaaaactaattaaattatatgtaataaattgcgagacgaatattttaagcctaattgctccatgatttgataatgtaatgctccagtaaatatttgctaatgacggattaattaggcttaataaattcatctcgcaatttgcaggcagaatctgtaatttgttttattattagtctacgtttaatgcgaaagggcatgtagcctagtagttgcaatgacctgagtagcatcccaaggtcctgagttcaaatctccatatgagcgaatttcagattgggttatttgaaggctaagttcctaaaataagccaaaatggctacatatatccggttggatatattatttcagattggattatttgagagctaagttccctatttgatatgctaaattcctaaaatcaaaatggctgcatatatccagttggatatagaggccggacaaaaaaaaatacccttctctaaaaaaatagtctacgtttaatactttaaatgccttacggcgtgcatgtttaattcgatttaccacacatagacacaccgtactccagttcaaacctgtgttagtttttcaaacttcaaagttcaagaatactagtagtggtcacctgttgtagtagtatactagtaccacgcatacatgatcacacatttgaagtattaaatatagactaataacaaaacaaattatagattccgcctgtaaactgcgagacgaatctattaagcctaattaatctgtcattagcaaatgtttaccgtagcaccacattgtcaaatcatggcgtaactaggcttaaaagattcgtctcgcaatttagggctgcaggaatt

SEQ ID NO: 92134 - DNA, 5608 bp, Oryza sativa
cctgcagcccttgaaaccttttcgaaacgtcggtaaggtatgcttgattggtggttatggcttgatatacgatcaaaatgcgtagatgccttgaatgaacatttccctgttgcaatatttctacttccagtttgttccacatttgattccggtgacgtaacagcaagtctgcaagtgtgcttatttctgtactgctctgctcttgctacttacaggaaatacacgagtcgttaatcagaaagagcttgaattctttcgggaggaactccagagtcggctttccaataactataatgtgatactgaaagagcggaagcttccactgtcactactgcaggatcatcaaaaggtacaacttcttttggtcattaggctgtcgaaaatgttgggtcttcaatctattttggacattgaagaattaagtacttttgttaaaatacatggtgccttccattttaactgtggcgaagtgctctatagtctactgtctatatcagtgtaccgtatgttgcacttatgtatgtatgtttgcccctgttgatgatacagcaagctagggcgcatcttcttgacactgaaccttttgagcatgcatttggaccaaagggcaagaggaaacgcccaaaactaatggctcttgattacgaatctctattgaagaaagctgatgattctcaaggtacagtttgtatatatgtacccagtactttaatcgcttaatatttttagttatatgtaattactgatatttatgaagaacacaatttcctttaagtttgaaatcctattttgcaacttggacaaatttatctcatgtacatgttgcactcatattccaaaaagatcttcaaattttaatttgcaggcctcctggccattttgctacttagaatcattaatgattgttgtagactattcttggccttgggtatttcttattttcagaagtcaattacatgagcttgtatgctgttatttatcaagaataccactatcaatgtcctgtactcttagtaaaatgttgagttttataggtgcatttgaggataagcatgctacagcgaagttgctgaaagaggaagaggaagatggcttacgagacctagtccggcacacaatgttcgagaagggacagagcaaaagaatttggggtgaactctataaagttattgactcttcagatgttgtcgtgcaggtaagtgttgtgacattttgtccttgcaaaaaatactctcactctgtcaaaccatccagacatctttggtgctttttttttttaaaaaaaaagaagtgggcattgatttatttgttgatcctattgttttgcacaggtgttggatgccagggatccaatgggtactagatgctaccatctggagaaacatctgaaggagaatgccaagcacaaacacttggtattcttactaaataaggtattgataagttccacaacaatacacagtgcaaaagacggactattttcatccttgtatggtggcacattgatgaatgatggtatacattttttagtgtgatctagtacctgcttgggccacaaaaggatggttgcgcactttatcaaaggactaccccaccctagcattccatgcaagcatcaacagttcatttggcaaagtaagctagcagaatcctgaagaagttcattgtttcaccataaatgaccccttacgcatttgaatcttttccagggatcacttctttcagtgttacggcagtttgcacgcctgaagagtgacaaacaagctatatctgttggttttgttggataccccaatgttgggaagcatcagttatcaacacgttacgctccaagagtgtaattctcttttctttaaccggcttcacagatgacatctttttggtgaactttctgagtattttgtttgtatactatatccataggtttgcaaagtggctccaattcctggagagacgaaggtgtggcagtacattactctgactaaaagaatatttctgattgactgcctggggttgtgtaccaaaacaatgattcagaaactgatattgttcttaagggcgtggtatgtatctgcacttgttcgtttttgtcttcactttttagttagattgcacaaaacaaagcatctagtaaaacacctcactatattttttttcaccttgccggtacttttatgtacgacagatatatataatgcattttcgcaaacattatttcaacataagagttagagatgggcttgctgctgctatcttggtctgaggtggtatagaagtcccatgggtagcttttaccctggacaatctacaagactataactattgcctatctgtccggttgtccattaatgcttaaaaaaaattccagtaacacccaaggcaatccaaggatagtgtggattatattttatagttgtttattgcccttcagatatttttctgtggtcacacgctggagcactgccacttttgaagcatatatttatatttatatggatgtctatcctagttgattaccaggcattttaaagatgctacgtttgtgtacttatctagatgggtaatttcattcatcatgtatttgcatttgttgtcaggtgcgtgtgacaaatttggcggatgcttctgagcacattggtgaagttctgagacgtgtaaaaaaggagcatcttaaaagagcttacaaaattgaagactggtatgcttcttttaacatttagtttatggtttcattttaacaattgttctatatagatatgaacataacgcttattatttccacacaatgcgttccctattggataagtatgttagtatttgggttacttttcttttctcataaatctgaacattaagacttggcattttttatgacactattctgttagtttactcatagcatatttgctctcttttgataaagtatatccatgaagaggatgcgcttgcttgtagttagccttgtgatgctgttgtgcatggaaacaattaaaccattggagacagcacatatcttatgttggatatgttatctttctgcagggttgatgataatgattttcttgtccaactgagcaagaccactggaaagctactcagggtatggctttagcatatatgttgacatgttgtcagtcatgtttctatcaaatatattattcttgtggtgaggctttatgagattggggaattggagaattgtaattgtatactgatttacagtgttttacaaattttaacaatataatgtgtcaataagatgggttaattggatccatgccattctaaatatatgaacagcttaaattaaccatctatagaagattctgagcaaaaaaaaactatctttagaagattaaccaacaatttctgatggtgcttacacttgtggttcacagggtggggagcctgatcttacaacaacggccaagatggtgcttcatgactggcagaggggcaagattcccttttttgtgcctccaccacagcaaggtgaagatagtccatctgaaacagctgaacctgtggagaaatccgatgaggaaggggtgagcagtgacagaactgctgccgccatgaaagcgatagcgggaataatctcatcacagcagcagatgaatgttccttgccaaaaggaatttggtgtaactaatgaagatagtgaagtcgcggagcaatcagagtgatctacaaaaggctaggaaccatgcatgataaagaacagggcacaattttgccaaatacctagagattttatgaagatttggtgtctaacaggaatggtacgatgaatgttacgatcgttcagttcaccggtgcgttctactgcaacgaaagagcgttcactgcaacgaaagactggaatcaagggtgtgggactgggaaacttctgtaacttcatatattgtgtgggcctttgttgtagaccagatagagtgttttggtagcttaatataaccattttgttccaactgtacttgaaacaaatttattccaatacattaattccgcaaagtcgttcgtatttgtatggggtcaaaagtgaaatactcttttgttgacggtttaccttttcgtttcacctgcttggctgctgcctgaactgccccttgcttatgtatgcatccatatgggccacaaaatattggtttgttatcgttgggcggacctaaccattgaaaaagggaggaataagtctattatccatccctcaactttacgtcgagtttaatttccaatcctaaatcataacacaaaaaatcttcacccctatcttgataaaaccgtctgaatcaggtcccataacagtatggatggttgcttacgtcatcctagtcacggaaaataaaatgttacatgtaagtgattgagaggatgagggagaaagggtagttgttcgggctcccacgtaacagtgctgaggctgccaccagagccaccgccacccgaatcaatcctaacgagcgcccttcgaggactgcctcgccaccgttggctgcctgactacagtgaagctcacaactagccggaggagcttatcagtatgaagatgaggtgaagagaagaaaggatgtggaaagtagagggccactttgcaagtgagcccacatgtcttaaatttttttttactgattatgatgacacgtcagtaaaaccaaccatccatactattatgggatgggacctgacttgaatgattttattaagatggggtgaagatttttagtattgcggtttagggataacaattcaacttgaagtaaagatgagaaacaacaagtggacttattcaaaaaaaggatgaagtgttatgaaaatttccaactgacggagtataatttctgtaaatgtagcactattttttttatctattctaattttggtcattgctatgggtttagggttcatagggggtataaaatttggatttctaatttcttttagcatggtgtcgtagtcaacactaaatagttgaattaataaatatgaaaatttctaattaaactggcaatacgactaagaattgtttatgaaaaaataatatcatttatgtaggtttcagacggttttcatccaaagaaaaatgttttgatgctctgaaaggggaaaaaaggaatgtgtttctttaagacacagtacaagcatagacaattataaaacacgcaccctcactcttataaacatacacacaaacaccctacctgtatgagtgcctccagaagactagaccgctatcaacgggtgtgtcgcttaccgctgaaagaaaattagccgtaaatgcgagcacccgtgtcagtcgtaagtctaagacttgaattcggatgagatggttccaccacaaggaacctaaccagctaaactatgtccacttcatggaaatgtgtttttttaagaattaaaaggaacttttaatagttcaaagcgcttggcatgtacaagttcacgatttggaagatcataagtgccacatttcaaattgtgaagtttaatttgcaaatttcagaaccatcctcgttaccttgtcttggtgggttaatcatgacatacatggcgcaaggaaatcttttacaagaactatttgaaacttcatagttatatactgtcggat

SEQ ID NO: 92135 - DNA, 1150 bp, Oryza sativa
  unsure (1)..(1150): unsure at all n locations
ttgtgggtctacgcgcttgggagagtccgcgtattctgttgtgagaacatccgcttgagcttaacttttcctactcttgcaattttacttcttgctcgactcaggtgcgtctttgactggtttcttctctcctccggtcttcggtttgtcgttcttgcgtcttagtgcgtcgtccgcgtagnnnnnnnnnngcgcatcgatcgacaattgctcccatcatatttcactattgctcctggtcagaatctttcaggccatcggacatctcgaagtgaacgaccgaaagctctacacccatcgctgggggcggtgggttgtcggcgatcgtacatccttcgtggatgtctatctgatgttgaggatgaggaagatgacaacgatgacgatgggtcgcttggttccggcgtacgattacgaggacatcggctgggttctcgagaatcctgtcgtcgtctcccgttgttgtttcggcgccgatctccatcatcgtcgtcattatggcgacgtcctcgaccagtatcacccagcacccgccgttcgcgatcgtcgtaatcgtggcggttgtggcggttatcacggtctcggtcttcgctcgaatggcctcctcgttcttcgttatcgtgacgccgtgaagagacgcgatgtcaggaatggttctcattgtctcgtgtgcgtagcgcctctcggcagccattcaggtgatcgcggagatcaccggtgctgcgaggtggaggggtggctcgatgaggcgattcccgctgttcagggttttcaccattagcatcgccagttggtggctgttccgggtgtgctgcagcagcggcctcttcgaacgcgttgctgaggttggtcactgattcccgtaaccgttctgtccatcgtgcgagatcgtcgttcagaacgggatcgtaggtggtttctcccagtattgcattgacaaccctgatgtgctgggccggtggtcacttgattccctgcttccgcattggcgcgcgctgacgtgctggtctcgtcgataaccaatacctcgcgcggcgtattcgttgacgatgagccatagtcttcgagcagctgcaagactgatggttcgtggggatccatgtcgattactccaacaaatcgatctaaaattagcgtcgggctgcaggaa

SEQ ID NO: 92136 - DNA, 902 bp, Oryza sativa
ttttgccctttctccacagagatgctagtttccacattctcattacaaattatcagatacttgtgaatgaagagaagcttttgagacgtgttaagtggcaatacatggttttggatgaggcccaggctattaaaagttcaagcaggtaacaattcatcttgcaagtcctttcattttgttgaaaaccaaaatttcatggctcatgcctgtcttcatttattcatctgatatttttccttcgttgagactcttatctgggaattattgtattttatcttttcctccctctgctgcagccagcgatggaagacattactgagttttaactgtcgaaatcgcttgcttctcactggaacacctatacagaacaacatggctgagttatgggcgcttcttcatttcatcatgcctactttgtttgacagccatgaacagtttaatgagtggttctcaaaagggtacttacctacattacaaattatacattctttgttttagtcattatctttattgcttatatttctttggcctgccagaattgagggtcatgccgaacatggaggtgctctgaatgaacatcagcttagtcgactggtaagatacacagccctacactgaacggaacttttatgcatgttatggtttagttaatcttttgaatagtcttgtttgagactgacgtggaattataatgagggcttgaattctcaaatacagtacatgactaaatgacagatgctcaattctcctgttttggacaaagttctgtatagctttggtatatttttgagattatataacttgttctttttctccacagcatgctattttaaagcccttcatgctccgtcgagttaagattgatgtcattgcagaaatgaccaaaaagaaagaagaaattg

SEQ ID NO: 92137 - DNA, 963 bp, Oryza sativa
aatgtatttattttatctacacaagctatcaatgctcaattggtgctactattgaatgactcattacccttttctttcgtttcagataaatgtctggtgcgcagaccgaaattttgcctacaagttaactgatgagatgcatgatccattggccaagaaactggttctgggatttgctcgaacttctgagttcaatggccctagagaaccaaccagccctcattctctgatagaagaattacatactgatttgccattccccgagccgatgctacaactgccatataggatatttgggtcatctccacctatgagtaactttgacccagctaaaatgcttacagtaagtgttctctaatttcctctgtccatgatgctagggtattgcctatttagatttttcttcatctgcacaattctgtcattcatagttgtatttttttttcccaatgaactgctcaattgctttgaaaagctctaagatttgtgtagaatataactttatcataataagttggttcaaacacctgaataaaggacaaattgtttgtgttttcattaatatgcttttagctgtaccagtgagttctttttactaacatgaaatgctcaatgacaggattctgggaagctccaaaccttagatatactgctgcggcgcctccgagctgagaatcaccgtgtgctcttatttgctcagatgactaaaatgttagacattcttgaggtagtactggtcacttcatgcttgtccactttacacttaaaagtataataccaccataaggtaattgagttttttcttaaaaaaaaaactaaaacaagtgacttttgcttgcgccttttactcataagtgatatagagattctctaagtgcctggagataagttgttttattgcatacaactttagatatgtttttggcattctgcaagtcaacaatctttggtcaattatcagat

SEQ ID NO: 92138 - DNA, 4391 bp, Oryza sativa
taagattaggatgcgttatatctagtactagataataccccgcgtattgctgcggaatgttgtcgataaatatatgtgagatagggagctaaggcaactgtgagctgaaaacacttggaaggaaatataaagatgtttagcaagtgcttatcaggttttatttgctgaaacatgcggaatcaccgatatatttctaaaatagttaacttaggtctcggtacatcagccaaagataacttggtcaatgtagcaataacgtaggctgtagcaagctggtgtatagatgatgtgacattgctaaatgccctagaaacaaaaacaaatagctgcaaactgtaaaaatgaggcaacataaactttatttttatatcaaacatagagcaatcgtatatgtttaatttttttttgggcaaaaggaagcgacattcaacgaatgaaacaatcacgaaacattgattttgcctcgatctgtactgctgcacactttttttcaggtgaacagatgaaattatctccccgcaaagttactttttgatgaactaaagaaattatgcaccttttgattgatgcatggaatcggtaaccaaggaaaatgctgatccaaaaagcataaaaaagtttatacacatatatttgtacactaaactcaagaacagtatggctcgctcattaaggtggtctttttgactgcctctgcttcggtttccttgattttgtggcacgctaattagggtggaggcgagaacgaagctgttcaactatcagggtgctaggaggttgcattattttcatcggttacagggggcggtggagtggagcgatcagaatggaagaccgcgagagagaggccagggagctgcatgtcatccgttgtgtcttccaccaatgcaggaatcagaaacgatctaatctcctgccgtgcaattttaatctaacaatccaaagcaatcagtgatgtggagcaaccacatcacagaaaaatcaaattaattgcacgtagtgaggatcaactgtatagatatatatagatatataggataggattcctcaaagggacgatttcaaaactcgatgacaagacgaggaagctgaagtaaactcttctccctacaaattacgcagttccagctgggtaaagctaatgggcgatcgatcgctccaggcaatcgacccccatccccctatgcggctcctctccccttcttctcttcctactacaccataaattaaaaaaaacagttagaaaaatttatatatagaaatactatatatatatatatatatatataatatttgaattcaaatccaaatttgaatcgggcatataaaattttgacttataaactttgggcctataaactttaaatgtatagaaaatacaatatataaaaaatatttgaattaaaattcaaatttgaattagatatataaacttttgacttataaactttgggtctctaaactttaggtgtatagaaatactatatataaaaaaattgaattgaaattcaaatttgaatcgggtatataaactttttacttataaactttgggtctataaactttagatatatagaaaatactatatataaaaaatatttgaattcaaattcaaatttgaatcggatatataaacttttgacttataaaatttgtgtctctaaactttaggtgtataaactttagatgtataaacttaaggttgtacaaattttagatgcataaatttactaaaataaaaaagtaatgcggtgcaaaaaaaaaaaagaaaccacgtgaggaggagggccgattgccctgatcgcgatcaatcgcccattagcttttccggttccagctacatgggccgtatcagaaaattctctgataaaatgaaggcccacaaggcccaattctacctaaagggcctaaaacccctcgagctctcctctcttctcctcactccgccgccgcagcgaactcctccctcctctctcgccgccgccgatccccacccggaagcagcgagccgcctcctcctccccaattcctctccagaatggccggggcgaggagcctgctcctgaggcacctccgcgtggcggtggccccttcctcctcctccccggtggcgtccctcagtcccgcggtggtgctgcgcgaggccctgtgtggccggcagtggatgtcgtcggaggaggccaaggggtcgttcctggacaaggccgaggtcaccgagcgcatcgtcaaggtcgtcaggaaatctgcggcgcacaatgttgatcggacggactagaattagccaccgtactttggccgcacccctcgccggagagagaacaccggcgcttcgatcgccgtgaacttgccggatgaagaacaccggcgccggcagcgcaagagttggtgctagccgccgacatgatcttccacgctggagaaaagtgaaatgcagatttcctcaacagcatgagcaatctgatgagattgctctgcaactcgtacagtgaagtgccacaggactttacacggttgacagttccacatcacaaattcacaattcacaagacggtaaacaacagttgttagtagttatgttaattgttaattaagcaaaaaaaatttaaatatttcttcctcaattcaaggctccaaaataattaatagtagtataatatttttgacagttgagttcatacattatataattatacaagtgccagaccaatcttgaatggtggtctggtaagctaaaccatcacagcctatacaaaatttgtaagagcccacaatacatgtttgttcagatagatacatgtaattacatttcataaactctcaacacatcagtaggagaaaatgaacgacatagacagacattgacacatgcataacaaatcaatacacaccatgatcaacaaatctacacgtatagtttagagtttaactttagacccatgtagaagcttgacaggtcagtggagaaccagaacgtcctttttgcaccaggtacaaatgtacaattgcacccgagtatatgcatgtcacttagtagtataaaaatctagccgcagtcaaataatttcccggtttgtctagcatcatgatcaacaaatatacatgtacactacagttgtttagcatctaagaaaaataattcacttttatgttgatcaaattttccggtaaaagcaaagcacaaacaacatgctcatctcatcaagatactgtatcttcttttactgctatcaagatttgtaattgttcaattatgcagactcaaagagagcatcattcacaattcgctcacttagcatacatcatttgaccagctagacaaattgaagaaaagagcgcagcctaacctctctgacagtagtacagcagcgcagaacaacaacctggagtagccttcttcaacctggagtagccttcttcaagtaactcaacttagaataatggacacaaaacaaataagaccaatctaggaatgactagattaattttgaattaaggagagggtgaggctcgaacccggaccggctagctcgcagcttgcgttgctatccaggaagacccccggcctttctcaaacgtagaataacggacacatgtcgatctctgacagcatgatttggagtggtcattctgaaatgttcgagagcccgccatagctggttagagatgtagtccgtatagctgccttgtgggtgtagcattttgaacattgtcccggctcgagcttcgtcgaggatggctttgcccagagcaagttcatacttgccccctctgaaagctgtaagatatatccacctcaggtgatggctgaaacaaccaaggtcacggaagaaattgttcccttgatagatgtgttcatcatccgctttgaggagcccttcttctggtgcaacctcatcgtatctctgcagcaaaggcacacacgcgcaccttaatcagaattcacacatgataattctgcaagtcacgcacaattcaaacagaactcagacatattatatattactagtaccattgaactacagagacagttggtagtaattctgcagcaaaggcacgcacgcacaacccaatcagaaatcagaattcagacatagtctaatactactgatgcagagcaattaacagcaaatttcaggacaataaaatgattgattgattgattggattggctgtttattaccatgatctccagtttctctaagcatgggaaacacttcagaatctgctctatctcacggggcaccctgtgacccatctctgtgtagttcacccgtaagccgagaatcctgacagaacgcatctttggaggatgcagcaccatcccagcctgcgcatgatcagagtatagtattgttaattagccaatttggatttggatttgagttaatcgg

SEQ ID NO: 92139 - DNA, 883 bp, Oryza sativa
  unsure (1)..(883): unsure at all n locations
gttgattgagttgctgccgtcaatcagaactcgtgcgaccttgatattccgaatagtgggttcgaccacgatcggatatcgccctgggatgacagcagtcttgaggtggtcctcttcagagaattctatcttctgctcagactacttcatcttgggcgcagctccctgccacgtcgaacagacttcacgttccaccttcttatattctcgctttgaggagtatgtcgtggaacctccaaagatgtgcgagacatggagatcagagtctgggtatgctgagtccgattctagagtagccgcttcagcgtccttctcgaccacatgcactcgcttgcctttttccaatgccatgtgtattgcgagcgacttttttgaagacgaggcaatcttatagagagtgtctatctgacttgtgtatagggcaccatgttttcttcgtgtcgctgtcttgtgggtctacgcgcttgggagagtccgcgtattctgttgtgagaacatccgcttgagcttaacttttcctactcttgcaattttacttcttgctcgactcaggtgcgtctttgactggtttcttctctcctccggtcttcggtttgtcgttcttgcgtctnnnnnnnnnnnnnnnnnnnnnnnntcgatcgacaattgctcccatcatatttcactattgctcctggtcagaatctttcaggccatcggacatctcgaagtgaacgaccgaaagctctacacccatcgctgggggcggtgggttgtcggcgatcgtacatccttcgtggatgtctatctgatgttgaggatgaggaagatgacaacgatgacgatgggtcgcttggttccggcgtacgattacgaggacatcggctgggttctcgagaatcct

SEQ ID NO: 92140 - DNA, 7809 bp, Oryza sativa
taatatttaccattgaattgtcatgtgtttcaggttatcaaccctttcaccaagtatccttttgaatatcaaaacttgtagtgttctggcttctaggattacattgtgattatttatgtgcctgcctaattattcataggaattgcttcatccttttttttaaaaaaaaatatggcttgatccttaaccacaacagatatgccctgttgttaaacccattggctcggagtttagaggagttgcgccctgaaggatttttgaacgaaacaatctgctctattatactgaggactgcccttgttgcatcaaccgtgtgcattgcgtttcttatgccatttttcggtacgtatacacaattttctggcatatgtacctaattctgcttcatttttcctgaaactctcttagctgcattctctcagaaagaattttttttagtaaattgctcatttaaccacctatattctacttgagttctcaaaacatcatgtacttataagtaccttttgtgcatgacactaaagatgtaagtgactaacctgcgaacccacttataggccaaaataaaccgttggatttgtgggttagccgcttacacctccagacactccctctataattaaaatgttccacaaaactgggttttgatcatttgaagagttagctcgaagaaataccaactttatgcaatttgagatgcgatattttttttcttctaaaccttttttcccatcaaatggtcaaaaactggtgttctgtggagtgtggagtcagtttaggtggttctatgctcaaagattgctaattcctttgtattacgcaacccagtcaaaatatgttgtctaatgtgcaatttactatacttgtttgtcatgttaaatccagttattaaatcaaaaccttcgtttgtgttttcctatgcttttttatctagattttaaaccctttttttaacggaatctagattttaaacttgtcatagcagtaagcttggtaatgtggagtgggcatatcaaatctgtcttgctgcaaacctgcgtatgctctgtatttctgagttgtgccttgcatatttcaggtctcgtgatggctcttattggatctctgttgagtatacttgtggtaactttcttctgctagaatcttgttttcagataaacccttgaacaaggagcaacaaacatactcatttcaacatttttttttatgattacaggccgtcataatgcctgcactgtgcttcttgaagattaggcaaaataaagcaacgactgcccaggtaaaatgcacatcgcgtggtagaccaacaccaaaaatcgctctctttcttttttgtttcttttgtttgtcaactacatccgtggttgacatttttgtttcaatctcaggtcgttgcaagtattggtataataatattgggcaccataagcgctgctcttggaacatattcgtcggtactcagaattgtggagaactactaattacgaaacctagctcgcgtgcagtgcagttcccagcaggtgaggccacaggcatgtcatatctattactcaccccgcttacggttacggcgctcaaaaatggtcaaatatcgtgtgtttatcagaattttgctagaattaccgagttcactgtaattattcgacccaaccatgtaatgcatgtacctgcatagctgcttgcttctcagttccttgaagtggaatatcttcatcacttgcttataccgtgtttctgtcaatcactgttgttaggtctatccagcatgttacttaaaccgcctttagcaattatatgtactcaattaattatagatcgagattgctggatattgagtgttgcaacttgcaacccttgtttccaaggcaccttctgtgtgttttctgatccctctgttgcacagtacgaaattaatgccttgtttggataggacgaaatcccagcccatcacatgtgaatgggcctggattaaggcacaaaatcccagcccatcacatgtggatgggcctggattaaggcccttccaaatgaggcctaaatggtctgggcctttatcttgtttctgcctcttatgttgggctgttcattagtagtagcaaacacaatccaatagcaaggggttatctacaaagtcattaacttatgatggaccgtattgtttttcgtttatcagaaatgggacacaaatcgttgctgaaagaagcttttgcacatgtcacttcagttcagagccccttcttttgtaattggagaatcttttcgttatcatgcaatgcatgcaagtccttgagtggaaaaaaaggcacctaatgcttatgaacacatggaacagtagagaggcagtacagtcataaaattcttttggtactagtacaaagaatgagcaaatgtgttggcagtagaaagcaagggattgttatgcttgactaataaaaagaaaaagggggaagccactgcgaaaaatgctttgaggaacttttcatacaaagccggagtttgccccttttatggggctccaactttcccttggcacctcacatttgtttttaaggaatcctaagtggccaaaaaacccctccctagcaaacagaaagaaggggtgctccctttatgcaaagaggggcatctttgctgcagagtgcatcccacttcgcaattagcccatcttaaaagacaggagctcttttctccttctccccatgacttttagtagtgcaatctttctgccttcaaaagtgactaatcctttctcttcctttcattggtgtctcaaactccctgaccttttcttctttttcacccaaaaaggttatgccttcttttttgctacacgccctcaccatccatactgtgggcctagttgggcatcatgcatgatgctctttgtcaagctctctcctctcaggtgccttcacaccttactttgcttcccatggagagagagattataaaggggatgagatgaggctctcaaagcacaattataaagcttgccaactttgttgttgctaaccattttcaattggttttgtgtgtgtgtgtatttattcctgagctggactgtttcactcatgccacccatggttaaacactgcttcactaaaatatataaaaaaagtactgcctgattaaaggcttgatagagctaatcatgctggttaaaaggtgcaactttaggtgggtgggtggactatgatgcgatttacgcttttactttgcaccaactttgtttcttcaagctaaggattgatacatacacgagcaggggaggcaggcacacaaatcattcctcatgatggtctactttgagttgtgggagatgcatggtaacttaagcaagcgaaaagtgacatgctagccgctttccctcttcctttctccctatgggctaaagaggagggatggggagaagctaaggggaaagctatagcaccaaactttgcttgcatctcatgacatgaatgaattgaatcggtatgatgatttctcaccaccaaagtgccatccaccgaggagtgaagaagaggggaagaaaagaagagcaaaaaaaagcttactacgccccttaaaaagacatgaaaagcctagtgaattatgcgtgtataaaccacgctactagcctcctttgaattattgatgcttacaaggaagaaatcatgcttgcttggttcgattcacttttcacctttctccaataattacgcacgccctctagttcgtctaaaagaaaagataaaggcaaaaaaaaaaaggattactggcattacatgacaagaacactcagctcctgagctccatgatcagtaccttttaaagcaagattaatagtaacgcccacagttggctgcaattttcaccatatcatcaaaagttggtttagtagcttaccagcacaataaacagtctctaacctgtttgtccatcctttcatgacaatagtattttattctttattcatcttattctctctctggagattatttcaccgctgctgatctatggcaccgacggggcccacttttctcgaaaaacgcatgcagccgggcgacagtttagtcgccgactcgccctctctctcctgccttttttctgccaaatcatcgctccagtctacgtggccagtatgtcgctggcataccagctgctattatacctgctcttaaaaatcgatgccattcctaagtttaccttacggtatatatggtaaagatatagaccagatctagggtctgcaatgcatgctctctgaaattaacctcacgcggaatctccacgatactttgtttttaagaattgatctgtgtgcatgcttcatgctttagtagattccttaatcattcatgcatggtttagtgctaatcatatactactactaaactagaggtatagtactacacggtagtttcgtatttacctagttccgtacaaaatttctacaatgcaagacgacgtagaatactgttgtagccttcaacccaacttgaagcccacggacatgcctgcccatccagcttgctattgagtatgggtcccaatgcataaagctgaatgcatgcatggcatggcaacttccttggattttccctcaaaactgtacaataatatagcatatgcagtccccaaaaagaaaaatcagccacatatacatgcacatccaccagatatgcaactattcaagctaaggatgagtcctccatgcatatcatgcatgcatgcatgcatgcatcttcttccaagaactaaagctaaggtagagatcgagaagaaaaaagccaacgcaatcgatgagcttatgtgcgtggacgcgtacccccatcgatcgatcagctgccatagcgcaacccccctcttttctcacccagctagtatttgtggggaaaaagacgtgtcatcatactaacatgatgccgttgcgtgcatatcattcgccgcagatggacaagcagatgcgctcccgctgatcgatcgcagcgtacgcccggaccagcgtgtggggcgcgggcgcgcgatcgacgtgcgtcgcgtcgcgtcgcgatgaggcgtacgtaacgtgatcggtgcgggggccgatgtgcgcaacgtgcgtacgcaaaaaatttggtggagaccgggtgtaatcggtctcacctgcagccccgctccggatggatgccacatggatgacctagggatcgaacggttagctcggcccggctcccggcgctgcgtgacgaggatgcaaatggcttggctccaggcgcagacgcggctttcagcctcgccgacggctcgattcaacgcagatcgcgtctcctcgcctggatatcggctgcatcgacgaccgtctttctgttcccgttccaggcggccgccgccggcgagccgcagcgccaggcaattgatcccgcggcgcgtttggatgctggctgcgactgtacccgtcttccaatttctggcggccgccacggacgaaacgcaatacttcatcgattacggcttcgatcgacgatgaccctacctccagttcttctccctgatatgaatattgtatattgttttctggttcctaatcctacggcacttcaattttgcatgttaattttcttctcatgccatggagaagcggccggcgacagcacctgaccctcgactctaaacggttcaagctctagcctttagaagccgatctccaaaaaacacaagcacgaagagcacatcagaagcgatgtcggtggtggagctcggcacatcggccatggtgctcccatagtcccatatatgtcagtctcagggacgtctgcggcgccggaggaggaaaaggacgacccctgcagtgccggaggaagacgcgggtcgctgctcaccaggcaaaaggagatgcgatatgatgttcgtcgaattgagccgacggagagcttgaaagacacggctgctcgtggagccaagccgcgtgtgtcctcatcacgcaacgccgggagccggaccgagctaaccgttcgatccctatgtcatccacgtggcatccatccgaagcggggctgtataagaggccggttacatccggtctccactgaatttttttccgtgatgttgtggtgtggacggtgtggtgggtttggttaaaatggagggggcttttgcggggattttgttgggttgcggcttgtgcgggtagcgggtgcccgcatgctgttctccccgtgcctcgcgaacaaaaccggggccgtggccgtggtggcttgtgcgcggcgtctacctggtgtgacgcacgcacgcatgcatggccagccaaaccacctactgcggcatgtgcccatgcatcactgttcggtgaatgagtgaatacatatgaatcgcgatcgccaccgttgggggggcacgtacgtactatacgtaactatactattgtagtgcatgcctttttgtgtagtggaccaggatgtggtaggggcctggtctggtagttgatcgagcttatggtgagtcgtcaattttgaaatgtgagattggtcaacagtatgtatgtatgtaggtatgtcttgattaacagtttaaacttttgggcgagctggttgcaagcggttgttcttacctgcatgcatgtctgcgaagctgtagccaattttgaatttcatttgaattaatttagatgttcctcttatcgctttctatttctatcgttaatgatatagttctcgtccttgtacatcactactccgaataaacatataactagaataaataaaaatatttttggacagcatcaaggatataaatatgaatcttagttcaaaaatatttctatttattctggttatatcaaaccatcaaggatataaatatgattatatgaatattagttcaaaaatatttttatttattctagctatatgtttattaggcatacagggtagtgatgtataaggacggatctaacatagaaaattgggacagacgatgctgacgactttttttaaaacctatagctagtcttgtttataaatgaatataatatcatagtttaaccatgaccggcatgttataacaccgatatatacattatatattgatctatcaaatttctagatccgtctctggtgatatatgttgggaagtaacatctaggcaaatgcaatggtaaaaagtcattgccttatgggtaggctgatttcaaaaaccttatcagttatcacaaattcacaatgtgcactcacgggtttatttctcccaaaatgaaagactttttcaatgaatatgcacccccaccattcacaaaatttgaagttgaaattccagcgatgagaatttagaaaaaaaaaatgaagttgcaccatgcccaccattcttctgctataccccatgagacctcaatagcatgcagttcttctaccgattccctccaaaatcctggcatttctctctttccaagcctttctagtaattaagattacggactcgtgcgtcaaaaatttccgttgaaacttttgcatggaaacccaagaagagtatcaccaagtttccataacaattgacagatctggtttcaggtttaaccgtctgcggaccattttttttctaaacttttcgtaatcatttgaccaacaagtggggaggtactacacgcacgatcgagaaaacacacccaacataggaattcaaacgactcgcaagaacaatgttcatagtacgataatagtacagatgccaaatatgagatttcggaagggtcaaatccaaatagtgccctttgcctggcccgtccggtcccaccctgccagtagcacatacccacacacatgcttcaacgtcaaataatctctctccgtctcc

SEQ ID NO: 92141 - DNA, 1382 bp, Oryza sativa
ccgcctccttttttgtgaatgttctcggatgaacatgttaatacatatggttgtgttaaaggaccaaatctaatattgtgcaggagaatggcactgagttacctgagaaagcttcttgctataaaggagtattctacaactaccttagcattggtaatccttaatcaaccttttttatttgttccttctgtttttttcccatgaactttacatggtgattacatttggtagaagcattaattctcatgaaataaatcctatctctatcctgcctatgctagagatctttaatattcagaccatctggttaataaattggtggttaggtgactaggttctaagtttttgctttagttcccatgtgattagactttcaataaaatgacaaattagtatttcagctggtcgtttgaaattctgagtgacataaataaactaaaacttaagatggtgttcctaattgctgtaatgacataaagttgtaggacatgtagatgtaatgatcgtttaagtttcatcaagaaattaatacttgtttaatgatttttctcttgtgaatcttatggcttcttgcaattatttggaatcttggtcatcgctgagtgctccttattttatattgaacagggatggatgcccaagttgcttatggcttccaccatcttcgtgatgaaaagccatatcttgctcaagggcctgttgcaaataaggtgctgagttgctgacagattttctttatttctgtattgttaattagcttaaaagtccttgcattcagagtgttctagttaaatgtcattatgtcacttgcatattttataagtagcagataagtatgacagctgatagatcacatattcccacacatgcacaaaacttgtgtttatgtaccctcattttacagtaagttccggatgttctattatcctacgaaacctactgtgcatacctgatacatgggttagatgagacaccgcttatataacatatttgaaattggaaaaaagaaataacccagcttcaatgtcttatttgtatgcttttgtgaataatctcagtttctgtaacatagttgttggtatcacagtcatgtttatcttataaatgattcttgtaatgatctttgtttttattctcgtgcagttgatatatgctggttatagctgcacacaggggtggttctgcacaccttgtacagcaagccctcagttaaggtatataaagacagcctgcctttccatggattctaaaatggctccaaagtccgaactttatggtgtcaggcagttttgttttgatccactcaagaatccggaagctgccatgattttaggttaattataggattttttgatcatttgatatattccctccgtttcagg

SEQ ID NO: 92142 - DNA, 1973 bp, Oryza sativa
tttggttaaagtcaaactactctaagtttgactattttgtttagaaaaaagtagtaatatttttaacccaagacaaatatattatgaaaatttatccaattatagattcaatgaaactatgttggtattgtaaatattactacttttttctataaagttagtcaaatttagagtagtttgactttgaccaaagtcaaaacgtcttataacctgaaacggagggagtaccaaacttctaagatatatcatggatctaaacatcgtgatgaatttgttcttagttaacatctgacgacatgaattcaagtttcatgtgtccatcattatccaaaaaaatttcatgtgcccatggcactaatcatgatgcaatagcaatcaactatgtctttagcttttctctccatgttttgatggtttaataaaattacagctatgctatgatattcttcctttgtttgcacacttctctttatctttgtttgaagctgatagaatggtttgttgttgcagggggcttaagaacattttgcgactttacattaaaaaagtcaattgttctgaatgggagcaagttacaatgccttcaaggcaagttgttggtttcttttatatgaaaaaaaaggcttttaaacaattatgatccttaaaagaatcactcaacaattctgtgagatgctgacattttgttaaatctcgactactttaaatacgcagtcgtcttcctccctcccgtgcaacgcgagaatattccgtaaaaacccgaaccagcccaccctgtaaaaaaccaaaccggcccaccccgtattactccagatcctgttgcaataaacgggtatagtactagtgtaagtaataagctagggataatggatgacacttggtaacggacaacgtatgcatatacatgacctgatgccatgctgacccgtgttcacaaatcttcagctgaaaatatgaaaaaaaagtaattaagattaatacaataggttcaaatatgattgtaggattttacatattttcctaaattgtgtgatgccaaaagtttaaagatactactacgttcctatatatgaatgtcttagtggcccttcatccttctgccccaaacattctagtagtgaaaaactctctaaaaataccagaagcatgaaattctgatcctgtattcctgtacatactggctggtgacctggtgtgtcaggcattcagaatgtaatgtgtgctatgatactgttatgaagctcggaagaaatgtcagcatataataaattctggacatacaagttgaattgattatcttcccatttgggagaagtttggaacttaagtagctattgttctcatctttcttttgaatgtgctgtatgaatccggttctgtatttcacagcttgcattcttttcccaactgcagtgttagatccctggtggtcttaaatttatacaactacggcagtggaaggcatccatggggtgatcttaaacctgattaccttgaaaaggttagtagttaatatacatttatcatgttcattgcatatgttctctcaattttagtttgtttatgtagggctttctatgactataaagttgcatcatggatgattgctcagtattctttcaaataattatgtattatttaagaaatcgttctgtcagtttagttgatgcagtagctagaatcagctgcatttaatgggaatgcgcatgcggtatttgcatttatatgcaaattatgtgttcatctttttctttttttggaaacaaaatgatgctttattctattccaaatcccagaaaggttttgtcgaagctcattccgatgatggattgcttgaaatattcggtctgaaagaaggttggcatgcttcattcgttatggctgagctaattaaagcaaagcacattgctcaggtacttacatttgtttggcacactatatttctattgagtattggcaaggcattgctgggc

SEQ ID NO: 92143 - DNA, 557 bp, Oryza sativa
gccctcaggcagatcgaagctgccagggagatctctcatacgatgtcatcttcagctgacaaggtgttcctggactccaatgatctcttgctcaatctccagcagctcaccgtggcaaacaagtcgaagaaatgaagtcttctcgcaccatgttctaggttattagcagatgtcagtctaccagacaatgtgaggaacacttggtcctctctgtagttgcactagtgatcatctgtgatacagaactcgacgagtgactcaacttttggcaaccggcaatctttttgcaaattgcagctaaactttgcaggctacattttgactctgctagtccttgaggaagttcaataaggaataccattctgttttaaggttctcaatctgtgattgcgatgatggattaagaaactgttagatctattgatcaatctggtaggtcccctactggtatgtttatctgatatcatgctgaatgtgtaattttcagcaacattacaggaaatatgccgttgaagaatctaaattagtacactgattaacagatcgtcgatatgtcc

SEQ ID NO: 92144 - DNA, 666 bp, Oryza sativa
cagttgttgaagaaagaagagaaatttgtgtggagcccgcaatgcgagaaggcgtttcaaactctcaaggaaatgctggtttcctcgccagtgttagtcttgccagatactcgtaaggatttcatggtgtactgtgacgcttcgcgccaaggactggggtgcgtgctcatgcaggaaggtcatgtggtagcctatgcctcacgccagttacggccccatgaaggcaactaccctacccatgatttggagttatccgctgtggttcatgctctaaagatctggcggcactatctcattgtgaatcgctgtgaaatatatattgatcataagagtttgaaatacatcctcactcagtcggatctgaatcttcggtagagaagatggttagaactcatcaaggattatgatgtgggaatccactatcatcctagtaaggccaacgtggtcgccgacgctctaagtcgaaaaagccattgcaacactcttggcgtccgtggcattccaccgaaacttaatcaacagatggaagccctgaacctaagcatagttggtcgtggattcttggctacactggaagccaagcctaccttgctcgatcaaatccacgaggctcagaagaatgatccggatatgcgtggactcctcaagaatatgaaacaaggtaaa

SEQ ID NO: 92145 - DNA, 3020 bp, Oryza sativa
  unsure (1)..(3020): unsure at all n locations
aagtgtcttccaaaaatttgaagtaaattgactacctcgatcagacactatcttcttaggaacgccatgcaaacacacaatccttgccatatacaattccgctaagcgacttccggaataagttgtctttaccggaatgaagtgtgccactttagtaagtctatcgactatcacccaaatagagtcctggcctaatgacgttttgggcaaaccagtgataaaatccataccgatttcttcccatttccattcaggaatctttgaaggctgcaacaaaccggcgggtttctgatgttctgccttgactcgctgacaaacatcacatactgctacgtattctgcgatttcacgcttcatacttgcccaccaaaacctttccttgagatcctagtacatcttagtactaccagggtgtatggagtataaagtatcatgagcttctttcagaattgcatcttttaaatctttgttgtcggggacacagattctttcacccaaccatacagttccgtgctcatcctccaagaaaccaatagcttttcctcttctcatattcttcttaatttcttggatatcaggatcattagtttgagcttctctaacttgatcaattagagtgggcttcgcttctaaggctgcaacgaaacctatactgacaattcccaaattcaatctttcaaattccttgcataattccaatggcaactgtcgtccttccgtagcattgcaatagcctttcctgctaagagcgtctgctactacattagcctttcccgggtgataatgaattcccatgtcataatccttaattaattccaaccatctcctttgtctcatgttcagatccgactgagtaaagatatactttaagctcttgtgatcgatatatacctctgtacgagtaccgaaaagataatgacgccaaatcttcaacgcatgaactactgcagctaactcaagatcatgagtagggtagtttttctcatgcggacgtaactgacgagatgcataggcaaccaccttcccatcttgcatcagaacacaactaacccaagtttggatgcatcgcaatacacctggaaacccttctttggatcaggcaaaatcaaaataggagctgatatcaagcgacttttcaactcttgaaaactctgctcacattcttctgaccacttgtacttcacatctttctgaagcagtcgtgtcatgggcttagcaatcttggaaaaattctctataaacctccgataatatcctgcgaggcctaggaaactgcggatctctgaaactgtctttggttgtttccagttggttacggattccacattactaggatcaacggcaactcctcctgctgagatgacgtgaccaaggaacttcacttcagacaaccaaaattcacacttgctaaacttagcatacagttgatgttctcataacttttccaatgcaaggcgaagatgttcttcatgctcttctttggtcttagagtagataagaatgtcatcaataaagaccaccacaaacttgtctaggtattccataaacactttattcatcaagttcatgaagaaagcgggggcattggtaagtccaaaagacataacagtacattcgaacaacctgtacctagtggtaaaagctgtcttaggtatatcttcctctttgatcctcaactggtgataccctgatcgaagatctatcttggagaaaacggtggcacctttaagctgatcaaacaaatcatcaattctgggtagcgggtacttattcttaatagtcacatcatttaatgcacgatagtccacacacatcctctgggtatgatctttcttttccacaaaaaataaccggagctccccatggagatgaactcggtctgatgtatcctttctgaagcaaatcatctacttgcctcttgacttctgccaactcattggctaccattctataaggtctcttatggatcggagttgttccaggtaccaaatctattctgaactctatatcccttttaggcggcataccaggtaaatcatctgggaacacatcaggatactcccggactataggaatctcttccaaagttatctggttcagtcttgaccttaaaaactcagaagacaatgcatgaacagttacaactcgaccatcattgctggtgagagttacttttctgttagcacagtctatcacacctttatgtctagctaaccagtccatccctagaatgacatcaaggtctttggattctaacaatataagattggccagaaatggtaccccttgaatttctattctgacataggggctacgttgcaaagagagtgcttgattgcttggggtactaaccatcaaaggacgtctaagatcttctacttccatcccatgatttcccgcaaaactcatagatagaaatgaatgtgtagcaccagaatcgaaaagtactgttgcaggaactgagttaacaaggaacgtacccaaaatcacatctggagcatcttgagcttctgcagctgcaacatgattgacacgggcctttgatgctggtacagcagagttgctctgggcagggacaaccttcacgcgtcggggcttcggacacttgtcagcataatgtcctgggtctccacagttgaagcataccataggcttgctgccttgctccctcttggcaggttgttgctgtgtcgaagctgcaacaggacgtggagcttgattgcggatgttattgccagcattgttgttgaagaactaacgctgcggacgaacaacagacgaagaacctccttgtggcatggactggggtcctaaannnnnnnnnnnnnnnnnnnnactcccctgttgtgccttgaagtgagcaatccggcgtttcttctgctccatgcggttatacttgtcctcctgacgaatagccttatccactaacttctggaaatcatgataatctccagtcatgagtgggtaagaaagctcatcattaagtccttcccaagaacttctcttgacgctcttcatca

SEQ ID NO: 92146 - DNA, 4599 bp, Oryza sativa
cgtggcaggagttcacggctgcttttaagaagacgcatataccgtcaggtgttgtagctctaaagaagagagaatttagagcactcaaccagggatctcgttcggttactgagtatctccatgatttcaaccgtttagctcgctatgctccagaagatgttcgcactgatgaagaacgtcaggagaagtttttggagggactgaatgatgagttgtcttatgctttgatgtctacggatttccgggatttccagcagttggtggacaaagcgattcgtcaggaagacaagtataaccgcatggagcagaagaagcgcagggctgcccaatttaaggcacaacagggcagtaaccagaggccgcgtctcgttactggacctcaagctccatcgtaccctcaaggaggatcttcatcagttgtccgtccccaacgccagttctacaacaacaatactggtaatcgtggcaatgacaaccgcaacgtggttgctcgtcctgcagcaactccagctcagaaccagcccgtcaggaaggaacagggaagcaagccagtggtgtgctttaattgtggtgatccaggacattatgctgataagtgtcctaagcctcggcgcgtgaagaacgctccagccccgaacaactccaatgttccagcaccgaaggcacgtgtaaatcatgttgcagcagcagaagctcagaatgcgccagatgttgttttgggtacgtttcctgttaactctatacccgcaactgtgctttttgattccggtgctacacattcctttttgtctaaaagttttgcaagcaatcatgggatggaagttgttagtcttgggagacctttactagttaataccccaggcaatcaagtattttcgacacagtattgtccttctgttactatagaaatagaagaagttcctttcccatcctcgcttatcttgctagaatccaaagatctagatgttatcttagggatggactggttatctcgtcacagaggagttatagattgtgccaaccgtaaggtgaccttaaccagtagcaatggggaaaccgtttctttctttgtgtcctctcctaaatctcatggtgtgatcttaaaccaagttgctctacaagagatacccatagtacaagactacccagacgtgtttcccgaggatttgccaggtatgccacctaagagagacatagagtttcggatagacttggtacctggaaccaaccctatccataagagaccatacagaatggcagctaatgagttagctgaagtgaagaaacaggtggatgatttgcttcagaaaggatatattcgacccagtacttcgccatggggagcaccagtcatctttgtggagaagaaagatcatactcagagaatgtgcgtggattatcgagcgttgattgaggttactatcaagaataagtatccgctacccagaattgatgacctgtttgatcaactggaaggtgctacagttttctccaagatagatctccgttctggatatcatcaacttcgaatccgtgaggaagatataccaaagaccgccttcacaattcggtatggtttgtttgagtgtaccgttatgtcatttggactcactaatgccccagcctttttcatgaatctgatgaacaaggtgtttatggaatatctggataagtttgtcgtggtgtttattgatgacattcttatttactccaagacgaaggaagaacatgaagaacatcttcgtctagctttagagaaactacgtgagcatcagctttatgccaagttcagtaaatgtgaattttggttgtctgaagtgaagtttcttggtcatgtcatctcgtctggaggtgtggcagtagatccaagcaatgtggagttagtgttaagttggaagccacccaagacgggttcagaaattcgtagtttccttggacttgctgggtattaccgcaaggttattgagaactctttaaagatagccacaaccagagacttgtgtgttacagagagaagtgattccagtgaacggaggattgtgaacaaagtttccaagaactgaagaaaaggctagtgactgcacctgtattaattttgcctgattcgagaaaaggtttccaagtgtattgtgatgcatcccgactcggtttgggttgtgtgttgatgcaagaaggaaaggtggttgcttatgcatctaggcaattacgacctcatgagaataactacccaacgcatgacctagagttggcagctgtggtgcatgcattgaagatttggcgtcattatcttttcggtaatcgtacagagatatatacggatcataaaagtttgaagtacattttcactcaacctgatttgaacatgcgtcagcgaagatggttagagttgattaaagactacgatatggaaatccactatcacccgggaaaagcaaatgttgtagccgatgctcttagcaggaaaagctactgtaatatgtcagaaggtcgacgtttaccttgggagttatgccaagaatttgaaaagttgaacttgggaatagtcagcaaaggttttgtggccgcattagaagctaaacctactctgtttgatcaagtcagagaagctcaagtgaatgatcctgacatacaagaaattaaaaagaacatgcgaagaggtaaagccatcggttttgtagaagatgagcaaggtactgtgtggttaggagaaagaatttgcgtcccagaaaataaggagttgaaggatactatcatgaaagaagctcatgaaactttgtattccattcaccctggaagcactaagatgtatcaagacttaaagcaacaattctggtgggccagtatgcgacatgagatagcagaatatgtggctctatgtgatgtatgtcagcgggtcaaagcagaacatcagaagccagccggtctgttacaaccgttgaagattccagagtggaagtgggaagaaataggaatggattttataaccggtctacccagaacgtcggcaggacatgattctatttgggtagtggttgataggttgacaaaagtcgcccacttcataccggtcaaaacaacctacacggggaataagcttgcagagttatacatggccagagtggtatgtttgcatggtgttcctaagaagatagtgtcagatagaggtagccagtttacttcgaagttttggcagaaattacaattagaattgggtacccgtttgaatttcagtactgcttatcaccctcaaatagatggtcagacggaaagagtaaaccaaattttagaagatatgttgagagcctgtgttctagactttggtggaagttgggataataatttgccgtatgcggaattctcatataacaatagttatcaagctagtttgcaaatgtctccgaatgaagcattatatgatcgaaagtgccgtacgccgctcctttgggatcaaaccggtgaacgtcaagtttttgggacagacatattgcgagaggcagaagaaaaagtaaagattgtccaagaaaggttgcgcattgctcagtcgcgtcaaaagagctatgctgacaatcgttgcagagatttagcttttgaagaaggagattgtgtatatctacgggttacgccgttacgaggagttcatcgtttccaaaccaaagggaaattggcaccgcgttttgtgggaccttttaagatagtgagtcgaagaggtgaagtagcttatcagttagagttgcctccgtcaatggcgggaatacacgacgtgttccatgtgtctcaattgaagaaatgtttacgtgtacctacggaggagacagatcctgatcgtatagagcttcaggaagatttaacttatgttgagaagccagtcagaatcttggaagtaagcgagaggaaaaccaggaatcgcgttatacggttctgtaaggttcagtggagtaatcattcagaagaagaagccacttgggagcgagaagatgaattgaagtcagctcatcctcatctgttcgccagttcttctgaatctcgaggacgagattccgtttaaggggggtaggtttgtcacgccctaaaaatcgactaaaattaaaaatgcatattttaaatcatttttagaaattaaattaaaagcctacaagctaaaccctaattttctaggaaaattttcaacataaaaatgagctagataaaattttattaaatactatgcttgctcctctattttctagaattttctgggaattatttgagcaagggaagtatttttaataattgaaacaacatttcacaaattgttttttttgaaaaagttcaaaaaaccccttctttggtcattgggccgaattcggcccaatactccctctctctccgcgcggccgaaccggcccatgccggcccaagccaagccgcccgccccctcctcctccagccgctgacatgtggggcccacatgtcagggccatcttcaacctccggccgccgccgccaagctgagcccgagccgccgtcttccacctccgatcctcctcaatccgagcccgaatcctccgggtttttgaggggttttgttcctctcgttctcctctttcttttcccccaaga

SEQ ID NO: 92147 - DNA, 1252 bp, Oryza sativa
actatcaagaacaagtatccactaccatggattgatgatctttttgatcaactcaaaggagctaaggtgttctctaagattgaccttcgatcaggataccaccaattgaaaattaggaccggggatatacccaagaccgcgttttcaacacgctatggattgtatgagttcacagtaatgtcgtttgggttaaccaacgccccggcatactttatgaatcttatgaacaaagtgttcatggattacttggacaaatttgtggtagtattcattgatgatattctaatctactccaaagatgaggacgaacatgcggaacacttgcgattggtactcgagaaacttcggaagcataaattatatgcaaagtttagtaaatgtgagttctggttaaaagaagtcgcttttctaggccacgtaatctcagccggtggagtagcaatggatcctgctaaagttgaggccgttacggaatggaaagcacccaaatttgtgactgaaattcggagttttataggcttagccggatactaccgaaggtttattgaaggattctctaagatagcccgaccaatgacacaactactcaagaaggaaaagaagtttgtgtggttagaacagtgtcaggaaagctttgagcagctcaaagaaaagctgacctcgtcgcctattttagttcttccggacatctggaaagactttgttatatattgtgatgcatcaaggcagggactaggaggagtactgatgcaggacggaaaggttgtggcctatgcatcacgacaattgcgaccacatgaggaaaactaccctacccatgacctagaactcgcagctgtggttcatgcgctaaatatttggagacactatttgattggaaaccattgcgatatctacactgaccacaagagtctgaagtatattttcacccagtcagatctcaacttgaggcaaaggcgatggctggaattaatcaaggactatgatctagaggttcactatcaccccggcaaggccaacgttgtggccgacgctttgagtcggaagagccattgcaatcatctgaggacggaagggatggctcctgagcttaaggaggaaatagcccaactaaacctacatatggtacctcatggacagataaacaacctggacattcaacctcttttgagaacccaaatagaagaggcccagaaggacaacgaggaaatccgagaggtgaaggaacgtctagttgcaggatttgcaaagg

SEQ ID NO: 92148 - DNA, 1193 bp, Oryza sativa
cagggtacgattccatctgggtgattgtggatcgactcaccaagacggcaagattcatccccgtcaagacaaactataacagtgctaaactcaccgagttgtacatgaccaggatagtgtgtcttcatggtgtacctaagaggattatatctgatcgaggcacacagtttacctcgtatttctgggagaaagtacatgaagccctaggaagttaccttgcgtttagcacagcttatcatccacagacagatggccagacggagagaaccaaccaggttttggaggacatgctgagagtttgtgcaatggattttagcaaagactgggagagatgtttgccctacgccgaattctcctacaacaacagtttccaagcgagcctaaagatgtcgccaaatgaggcattatttggtcgacgatgtcgtaccccactaatgtggaccgagacaggtgaacgggcgatatttggacttgacattatcaaagaagccgaagaaaaggttcgcctgattcgagaccatctaaaagtggcacaatcacgacagaagagttacgccgacacccgaagaagaaacctggaattgaaggaaggagactacgtttatctaaaggtttctccgatgaggggaacgaaaaggtttaaggtcaaaggaaaactagcgccaagatatgtgagaccttttcaaatcacggctagacgaggagaagttgcataccagttacagctaccagaaaatatcgccgatgtgcacccagtctttcatgtgtctcagttaaagaagtgcttgcgagtgccggaagaacaagctacgttggaagaaattcatatcagcaatgatctcacgtatccagaacacctagtccggatattggatgaagctaaaaagaagactagaaccaaagtgtggcgtatgtacaaagtacaatggagtaatcacactgaggatgaagccacttgggaaagcgaagaattcttgaagacagaatacccccacctattcgaaaacctgtaagaaatctcgggacgagatttatttaagggggtaggtttgtaacaccctgaaaatttgaccaataaaaacaaaactctaaaaatacgggccttcgaaaacttttaaattaattgcatcatgccgatcttattcgcctattttatttggatttgatttcgaagttcattaatcgtgagtaaa

SEQ ID NO: 92149 - DNA, 2279 bp, Oryza sativa
tggttgtccgaagtaaaattcttggggcacgtgatatctgctaaaggagttgccgtggaccccgaaacagtgaccgccgtcactgaatggaagcaacccaagacagtcactcaaattcgcagtttcctgggtttggcaggatattaccggagattcatcgagaacttctccaaaatcgctcgacccatgacacagttgttgaagaaagaagagaaatttgtgtggagcccgcaatgcgagaaggcattccaaactctcaaagaaaagctggtctcctcgccagtgttaatcctgccagatactcgcaaggatttcatggtgtactgtgatgcttcgcgccaaggattggggtgcgtactcatgcaggacggtcatgtggtagcctatgcctcacgccagctacgacctcatgaaggcaactaccctacacatgacttggaattagcagcggtggttcatgctctaaaaatctggcggcactatctcattgggaatcgctgtgaaatatatacagatcataagagtctgaaatacatcttcacccagtcggatctgaaccttcggcaaaggagatggttagaactcatcaaggattacgatgtgggaattcactatcatcctggtaaggccaacgtggtcgccgacgctctaagtcgaaaaagccattgcaacactctcaacgtccgtggcattccacccgagcttaaccaacagatggaagccctgaacctaagcatagttggtcgtgggttcttggccgcgttggaagccaagcctaccttgctcgaccaaatccgcgaggctcagaagaatgatccggacatgcatggactcctcaagaatatgagacagggtaaagccgctggtttcacggaggatgaacacggaaccctatggaacggaaagcgggtatgcgttccagatagcagagaacttaaacagttgatacttcaggaagctcacgaaagtccttattccattcacccgggcagtacgaagatgtacctagacttgaaggagaaatactggtgggttagcatgaagcgggaaattgcagagttcgtggctctatgtgatgtgtgccagcgtgtcaaggcagaacaccaacgaccggccggacttctccaacctctccaagtaccagaatggaaatgggatgaaattgggatggatttcatcaccggacttccaaaaacccaaggtggatatgattctatatgggtaattgtggatcgactaacaaaggtagctcgatttattcctgtgaagaccacctatggagggaacaaactagcggaactctacttcgctaggatcgtgagtctccatggtatccccaagaaaatcgtatctgataggggaagccaattcacctctcacttttggaagaagctccaagaagagctgggtacccgtttaaatttcagcaccgcctatcacccgcagacagatggacagaccgagcgtctaaatcagatcctagaagatatgcttcgcgcgtgtgtcctagattttgggaagacttgggataagagtctcccctatgccgagttctcctacaacaacagctatcaagccagcatacaaatggcaccttatgaagcgttgtacgggcgcaaatgccggacaccgctattgtgggaccaagtcggagaaagccaagtgttcggaactgatatcctgagggaagctgaagctaaagtcagaatcattcgggataatctaaaggtggcacagtcccggcagaaaagttatgcagataaccgacgccgtgacctggaattcgcagtggacgattttgtgtaccttcgggtcacgccattgcgaggggtacacaggtttcagacaaaagggaagctcgcacctcggtatgtgggtcccttccgtatcatcgctcgacgcggagaagtcgcttatcagctagagttgcccgcctccttgggtaacgtgcacgatgtgttccatgtgtcgcaactcaagagatgtcttcgagtgccatccgagcaggccgactcagagcaaattgaagttcgcgaagatttgacctacgtggagaggccagtgaaaatcctggacaccagggagcgcaggaccaggaaccgggtaatccgtttttgcaaggtccagtggagcaaccatgccgaagaagaagctacttgggagcgtgaagacgagctgaaggcagcccatcccgacctcttcgccagttcttccgaatctcggggtcgagattccgtttaaggggggtagggttgtcgcgtcccaaaacgaccctaaaa

SEQ ID NO: 92150 - DNA, 661 bp, Oryza sativa
agtacttcatcatctcagaaaacattgcatgaacagtcacaactcggcgatcattgctggtgagagttacttttctgttagcacatcctatcacacctttatgtctggctaaccagtccatccctacaatgacatcacgtctttgcattctaacaatataacattggccataaatggtaccccttgaattcctattctgacagaggggctccgtcgcaaagagagtgcttgattacttggggtactaaccatcaaaggacatctaacatcttctacttccatcccatgatttcccgcaaaactcatagataagaatgaatgtgtagcaccaaaatcgaaaagcactgttgccggaactgatttaacaaggaacgtccccaaaatcacatctggagcatcttgagcttctgctactgcaacatgattgacaacgggcctttgatgctggtacaacacacttgatctgggcagggacaaccttcacgtgtcggcgctttggacacttgtcagcctaatgtcctgggtctccacagttgaaacataccacacgcttgccgccttgctccctcttggcaggatgttgctgtgtccaaactgcaacatgacgtgagattccattaccgatgtcgttgcccaccattggttgttgaaaaactgatgc

SEQ ID NO: 92151 - DNA, 761 bp, Oryza sativa
gaatgatgctaccacaaggcatttggttgagatgctgtgggccatggatgaaagtcgtgcagagactgtgttagcagctcaagatcgtgaagatcggaatcgtggtaagatttgcaagttagaagacaaggtggatcgtttggagaaggaattagccgcattgaagggagaagcaccacctcagaaggccaggattcgtcttaccgcaaggaagagagctttatttgtccctcgctatcaattggcgccaaaggttcgtgtggtggagaaagaagttgccccagcagatcctccggtcatcatcataagtagtgatgaagaagaagaatccaagcgcaactgttccaagattgagtgggtagcaacccaagatgatgaagacgagccgaacgagccttcaatcgacctccgatgctcggaagaactagagtgacttgttaagccgttgtcttagatcgttgtgttagtttgcttgttttaagtttggttgtgtgtgtgtgggtcttgcatgtgatttacatcagtggtgggatgtaagtacatgtgtttgtttgctttttgagtgttaggaagttggtgagtttagtggtgtgtgagttttcagtttgtaataatgaaacttagttaagatcaataaaagttaaagtaattctctgccctaagtagttttcccccggtttctcttcttgtgccctgtgctatgccagatggtgaacactcgcagcaacgggaatggtcccaacctcaacaaccccaataac

SEQ ID NO: 92152 - DNA, 929 bp, Oryza sativa
atctggatgcgtcggattccgacttcgggatggcctgaagtcgcgttacatccccttcagtgccccacttctcgcagcaagtggcaaacgagatggttctacctccagatagagaacttggaccccgtccttgttattcctgaggaccagccagaaaagatcccagagtggactgctaaacccgccttgactccctccctccaatcctttatcgacatcattgatgatctccgaaaacgggggttgtcgggatatgaagtcgctgccgacttcgtaggtcggcggattcaaccgctacaggcccgtgcccatccggccttcgattactctgggccagatgacgtgacccgggtctctcctcggggtatttatcctcgtatttctaaatttgtttcaagtgcatctgtttcctctaacttatcgagttctcgttctcgatttacaggtctggacagtgacactgtggggcgccgcatcggccagataatgatcagctgtcacgcccagaaattcccgaatagaattccaagcagaatgtgcaataaaatccccgtccaggaccagccagggtacacaaacgacaatgttgacatacagatccacgtcttacaaacatcataaagttttacataaatgcagcggaaggaaagaaagacaacaggagctaagccttgactaaactgcagcgggaacaccactccacaggcatcctcgacggcaaggacgaagcctactcctcggagaacccttcatctggtccgaactcaaactctggggttgggaaaagtagagcaagactgagtactacccactgtactcagcaagtcataccggaatagaggtatgatgcagggaatcatcaaagaaaagctaaagtggttcctttgcataaagcgagcatttataaacagagatttcaagatttaaac

SEQ ID NO: 92153 - DNA, 549 bp, Oryza sativa
acctttggccccaaacccaaagaggcttttttaaacccttttcaatttaaaatatttcctaaatgccattcccattattaaaaaatcttccctaggcccaaaaaattcccaaaaaattttaggattattggaattaaccaaggtgttcaatgaaatttaattggcccccctttagaatgggaattaataaatcaaaattaattttcttttttagggcttgtacaattaattttaaaaattcccctttcgccacaatttatatattttggattttcaagggtgtgccaaacgtaccccccgtaaacagaatctcgtctcgagattcggaagacctgtcgaacaaatacgcatgacctgacttcaattcatcttctcgttccaagtgattcttcttccgagtgatctatccattggactttgcaaaagcggataactcgatgtatggttcttctctcatccatttccaaactacggattggtttctcaacataggtcagatcctcttgcacttctatctgttcatgataagcttccttgatgtactgtacc

SEQ ID NO: 92154 - DNA, 862 bp, Oryza sativa
aatttaaaggatatattttagggtcgttttgggacatgacaaacctaccccccttaaacggaatctcaaccccgagattcagaagaaccggcgaagagatcgggatggactgccttcagctcgtcttcacgctcccaagtagcttcttcctcagcgtggttgctccattggaccttgcaaaaacggattacccggttcctggtcctgcgctccatggtgtccaggattttcactagcctctccacgtaggtcaagtcttcgcgaacttcaatttactctgaatcggcctgctcggatggcactcgaaggcatttcttgagttgcgacacatggaacacatcttgcacgttgcccaaggatgcgggcagctccaactggtaagcgacttctccgcgtcgagcaatgatacggaaaggacccacgaaccgagttgcgagcttcccttttatctgaaacctgtgtacgcctcgcaatggcgtgacccgaaggtacacaaaatcatccactgcgaattccaggttacgacgtcggttgtctgcataactcttctgccgagactgtgccacctttagattatcccgaatggttctgactttagcttcagcttctctcagtatatcggtcccgaacacttggctttccccaacttggtcccacaatagcggtgtccggcatttgcggccatacaacgcgcttcatagggtgccatttgtatgctggcttggtagctgttattgtagagaactcggcataagggagactcttaccccaggtcttcccaaaatctaggacacatgcgtgaagcatatcttcgaggatctggttcagacgctcggtctgtccatctgtctgcgggtgatac

SEQ ID NO: 92155 - DNA, 661 bp, Oryza sativa
ccacctccccaacagtcaaaactgggtgagttcctcggcatcggcccacgtacgttgtccagctccaacaaccccggggatgggttggtgtggtggcatgcggtggggaaaaagctagacgctgtgcagtgcagcgatgaggagaaagtggtcttcgcggcccaccagctgcaggggccggcatctctatggtgggaccatttgcaggctacgcagccagagaggcagcctattacttgggccggtttcaccgccgatttcgggagggacccatgtgcccgccggagtggtggcccttaagaaaagagaattcggagagttgaagcaaggcaaccgctcggtgatggagtatttgcatgagttcaacaaccggggcccgttacgccccggaggatgtgggggaagatgaggagaaggcaagagaagttcttggcaggaatggaccctgagctgtcggtccggtctagtctccggggactatcgggatttccaaggtctggtggacaagagcatccgcttggaagccaagcacaaggactggagtggcacaagggccgcttggcgaatttccgcaatcaacagggtgctaaccaaagggtccggtacaccaatccctatccagggggatcctcctggcagcagcaacaacagcagcagcaac

SEQ ID NO: 92156 - DNA, 3611 bp, Oryza sativa
ttcgtcatcatcgtcgcgtgttgcacagccagccatcgtcgtcgacgacgcggaccaagagtcctgcgcatcaggtagcaaggacgaggagaggaacaggttcttggtgccgcagccaatctcgatggcagcccccatgatggctcagatgacagtgatcgctccgcaagtggtgccacagcacatctcgaccgtgccacgtggcatgttcgagtgcaaggcatgcaagaaggtgtttacatcgcaccaggctcttggcgggcaccgtgccagccacaagaaggtgaaaggatgcttcgccgcgaagctcgagagcagccgcaacgagactagtcagactcagactcagcagcaacacgtctcagccgctcctcatgacaataccagggccaccacctctcatgtcatcaccagcgatatcagcatggatgcaaacacgatcggtgccagtgctgatgctgacggcaaggcagcggcaagcggcgttggcgcaggtgaaattgtcctcgccggagcttcgtcgacggatatggccatgatgatgtcggtcgaggacttcgcgccgacaccgttggcgccatccgccgtctcaccgttcaagaagaaggggaaggtgcacgagtgctccatctgccaccgggtgttcacgtcggggcaagcgctcggcggccacaagcgatgccactggctgacgtcgggcgcaacggacccgctcacgaagctccagcccgtcgcccaagaccacgccatgatggccgccatgtgccaccagctcacgctcgggcgcccaatattcgaccctaccgaccagcggatactagaccttaacgtgccgacgaacccactggcagaagcggtcgcggccaggcagcagcagcagcagcaggtcgccgctctcaacgacggcgcactctgcctcaacgcggcggcgtcggtgtacctgcagtcctggacagggcacagcaacgggagccacgtgaacaagaccaccgcgacgagcagccgcatcaacgacgcggccggcggcgtgaccacggaggacgatgaagcggacagcacgagcgccaagagagccaagatcggcgacctcaaggacatgaaagtggcaggggagtcgttgccctggctgcaggttggcatcggaatttcatcagagagcaaagaaaagaacactcaagagtgacctggtcatgacaaggaggtcatgccgactaatgaactaagaaattaattaattaattaattagtgctaatctaatccatatatatatatacatattgtaggtgtacgtactatatcaatgctttatgtgatcgggatatatgtatgtgtatatacatccaatgtaagtatttacaagtagggtcaattcatgtgttcctaaaggtttgaggcaacatctagggacgtattgcttgggggactgtaaattaataggctagcaagcttgattctaaaaggtttccttactgtacgattctttgaggagccttgctttttatttttatttttttccttttattttttctattttgtaactaaccgattatttaatttgctgcttccaaaatgtatatatgcaagttgattttgtccttgtgttcactgcaattagacaagctatatgtgtgcctatatatgtttttttcttgcatttctacactatatattactctaaatatacgacgttcttaacttttaaacataatatttagctatacgttttatttaaatttattgtaaacataaaaaaatcacgccagatataaaggatctttaataatgcaaattagtaaagataaaaaaataatgtttaaagtaaactgaatgataaaataagttaaagcaaaataaatgaaacttacttcatagctaattttatgcagatatgcaaatgtataagccattcttaacaaatcaaatcacaataaaataaataatacttaacaaatttcatgtcaaaaagatatattcaaaaatggaggtggtactattctgcgggaggtgaggaacgtcaatttttttattcatatcgccacggtggagaagcttgctgatgttcgttaccagtccagttcgatggtgcatgtaaataggtcgggcaggcgcccgatacttataatatgtatataaagtgtatatatacgtatagacaacgtatatgtataatataaattttatgtatatgtattttttatgtataaaaatatatattcgtataaaaactttgtatatgtatatgtatacttgtattggtataatacaaagtttatatacatatgtattatatcaatataaagtttatgtatgtatatataaataattatatgtataaaaaatattggcgtataaaaatatacacgtatacaaagtttatatacgtacgaattaaaaaaaccgaaaaagactgccacccctctctccgtgcaacacatggctgcgacgcgcgggggaggagcatgcctaattagaattggaactagctaataatctgtcgacagtttttaaggctcaaaactttcaaatttttaaccataggatttgtcatcaacagttgaaatgggtactgttaacagtaaaatttggtaatcccaaagttaccatcggtttagagtcagtatcggcttcaaagttcgagaatcagccgatgggagtcaagtcgccacgatgtcgtgttcttggtggagttggatcaatcaaaggaagcttatctagaagagttcgagttcaagaaagatgcgacatgacagttatctattaattaggcatagtttattagtttccttttatctttaggaaagtgtgtttagtgtccgataaggactttatcttttcctttttagtttctttcttgtccgacaaggactagtatctccctatgggtataaatatgtacacccggggtcattgtaatctatcaatctatcgatcaataatactctcggcgcatcgccaccctcttccctaaggtttttacttatcttccggcggaactttggcacctgacgcagggctgcatcggctttcgatctccagcgaaggggtaagtcctacgttctgtcgggccctggtgaatctgtcggctacgttggtattgttcaaggctgcatcgattcgatctcttggatcgctctggtttggttgatatatttgtctacctgatatctcaattctatctctaattgcattgtgtttagagacgcatcggtttagttgggactgtctcggttaggtatgatctcctgtcttagccgatatatctctacaatcataatgctgttctaaatagatttgttatatctatcacattagatagatctatcggctcatcgagtattagattatcatatacaatctcgtgctgcatcggttaggttcgatctactagattgttgttgataatataagtcttgttaagtcgataggttcatgctaatgttttatcggggtactagccgataagttatctggacgttgcatcggcttgtagggattgcatatacatataagttggattagccgatggcaacaaaggtttcactatttaatctaatcttgtggatcttatgacatcggacctccagctgatgtgtgctttaaccttcggatc

SEQ ID NO: 92157 - DNA, 926 bp, Oryza sativa
cgctatcggctggtatcggtatcggctattatcagctatcggctggaactactccatcggcttgtcagccgatcggctgtttagatctactatttgcatatcttgtcagttgcaggagcaaactgactggcacgcccgcatctcatcaatctttggtcctgcacaggagctaagcagatctcctaggccggtgtgttcgatttttttcgtcaacacagattggcacgcctagtgggaccacgaattttatatccacatgtctgaagaagaagtcaatgccaagatcatggtcacggtggagaatttaatggaggaacaacaatattagctcggggggcaagtgcatcagtttcagcatggtggagcacatcagtatcagcatggttgatttttcattacattttaacactgttgttgtcttacttaacttggggaatttctgcaatttgcaagtgtgttaccttgcaaactatacctttttcttctatttgaactgtttcatccaagttcattgacgtgatgatcgattgtaattcataaacagcgtgggtctactcagctgtatccaacataattcgttcaccaagaagcaatcacccatagctactttattattatttaaatattcttatgttggttactgaatccttttttattaaggatcctgccaaacgtgccattttttactttattcatgtatcccgcaacaatgcgcggggtaccatctagtatacatattgtaggtgtacttgctttatgtgatcgggatatatgtttgtgtatatgcatccaatgtaagtatttatagtagttttacaagtagggtcattcatgtgttcctaaaggtttgaggcaacatctaggaacatattattgtaaaaagccagatgtaaaggatctttaataatataaattagtaaagataa

SEQ ID NO: 92158 - DNA, 1660 bp, Oryza sativa
  unsure (1)..(1660): unsure at all n locations
ccgccgcctccagcacaaacctgagcccccgcaaacgcgtaagatcatccgcgattggatggagagtgcgagaggtttttttgcgagatgatctgatccggagttcgtgtttctgcgtgcagtattccaggtgcaggagcgccatctccgcgcaccagcacacgatcgggaggtggttccaccacagggacgggagcagcagcagcagcagcagcagggtcgacaaggcccgcgccgagcgggcgcgcgtgcacgccgcggtcaccgtggcgagcgtggcggccgccgtcgcgccgtggcctccggcgcggcgaacgacccggacgacctcgacgacgccaagatggacgccgcgctggcgtccgccacacagctgctggcctcgcactgcatcgagatcgcgnagctcgccggcgccgaccacgacaggttcgcctccgcggtggaggccgccgtcgacgtgcggagccccggcgatctcatgaccctgaccgcctccgcagccacaggtgagcaaccatgcatcacgacaggccttctctagctcctgccacgcatgccaaccccgaagcaactaaatcatcttcgagttctctcgcaacatggcagctctgagaggagcgacggcgctgaggctgagagcgcagcgggaggcgaggagcaaggtggcgcggtggcgccctacgagaagaccggcagctgccgcggcgacatatggtgcaaggaagggacgctcctgaaacgcagccggaaaggtaaagctcaaaaaaagcctctccttgacacggacgcacgtcacaacgtcgtcacgtcgccgcgcgcccaaactgagctcgatcttgggatggtgattttttcaattttctcatcaggcgcttgcaccggaagcgcgtggccgtctacatcaacaagaagtcgcaggtgatcgtgaaactgaagagcaagcacatcggcggcgccttctccaagaagaagaagagcgtcgtgtacggcgtcgacgacgacgtgcaggcgtggccggcgccgcacgcgtgcggcggcggcgccgtgcctcctgctccggagacggcgtcgtcggagaagtgccagttcgggctgaggacggcgcagggcgtggtcgagttccagtgcgagagcagggcgcagaagcaggactgggtggagtcggtgaagaatctgctccggcaggcggccggcgggacggctcagctcgagcactccttcgaatctctccggcttagcgcctcgtaaaacgtaaaaacccagtgaattcgttttcgtttgctgtaaaatttacctgtcgagaccccgactgcccgttcattttatcgcaaagggagcagccgagacgtttcagtgttggagctgaagaataaatgtgcatacttgtaataacatgaataatttgtataaggatcagtagataaatgtcggtgttaagattttgatgtatctgctctctttacacacgccactcattacctgtttaggtagcaattccgctcaaaaatgcaaacacgcagtgataagtagtactcatatgaattctgaaggcgttgtttgacctttcagtcagggtctcgggggagagcccattagttattgaccctcttcatttacaggtatcgggggaaagcaacaatttttgcacgctaccaat

SEQ ID NO: 92159 - DNA, 1064 bp, Oryza sativa
gctttaatgaacagattcgatgaaaaacaattcacaaacaagtgcgttttccagatgtcccatattgatgacaaacccgcacacccatgaattgagtcccaagagttcatcgcagacttgcaatgaaacctgccactaacatcgaggcagttcaatcgcaaaaaaacaacgcggctgcagaggtcctcaaaacccgtggtgattctcacccagtcgctctcacccattcgcattctccccgcactattccccgccttgtttccctctttccacgtcgcgagaggcctctgcgccccatccgctcatcataaaaacccaccactcccactgctttccctcccacctcaccacacaccacgccactcgcctcgcctcgcacagtcgctcgctcgcccgctctagctagctcacagctcgctcactcgctctcctcttccaaccaactccaccaccaccaccagtccaccacagcgcgcggcgccatggacgactcgtcgttcggttccgagccgaccacgtcctcctcgggcggggaggcgccggcctccccgccgtccaccgcgtcgtcgtcctcagacggcgccggcggcaagaagaagcggccgcgcaaggacgggcaccacccgacgtaccgcggggtgcgcatgcggagctggggcaagtgggtgtcggagatcagggagccgcggaagaagtcgcgcatctggctgggcaccttcgccaccgccgagatggccgcgcgcgcgcacgacgtcgccgcgctcgccatcaagggccgcgccgcgcacctcaacttcccggacctcgcccacgagctgccgcgcccggccaccgcggcgcccaaggacgtccaggccgcagccgcgctcgccgccgccgccgacttcccggcctcctccgccaatgcgggcgccagcaataaccccgacggatcggacgacgcgagcgccgggtccgcctcgccgccccgcgcgtcggacgccgctgacgacgcgctgttcgacctccccgacctcctcctcgacctcagatacggcccgcccagctcgggcctttcgtgcgcg

SEQ ID NO: 92160 - DNA, 1386 bp, Oryza sativa
cagccacgggggccggtgctgaaccgctacatcccctgcgccctccgcaagaagtgggacgactggaagagcgactggttctacaccccccttgccgacgaagtgcgcctccgacttccgagccagcccccggctcaggcctccagctggcgggcgccggtagatctgggggatggctatgacgccgtcctcgaccgcctggcgggcctgcgatcccaggggctcacaagagccatggtgtacggcgactacctccgtcgtcggattgcgccgctccagcggcgcgctcggggcgcctgggagtacaccgggtccgaagacttcatgaggactcaccagggagtgagatgggactgggctcctgaggacttcaagatattggtccaacgggtgctgaatctcaactccgtggaggcggccctcattcctcaaggaatcctccccctctgcagcgatccagaccgcgcctccatcctgaccattatgatggcggtcggggcctcagaggagcgagctccaaagggccacgacggcacaggcgggagccgccggggggaacaatctatcccgagagggggtcgtgcttctgggtcccgcgacaggggcccggggagcagccgccctgccgatgcccgggggaagaggaagcagggaggaacacctcccccatctcctccccgagggggcggggcggcgcgtgccagcagcaggcgcccggagggggccgcgccaacatcgcagcccgagggggagcgcaagaagaagtggccccgcaagatgggggagacagaaccatctcggggaaacctcatttcccctccaaagtggtcgtttaaccgaccccctcgcaggttcgtctctcgcccatcgtggttgtattcattctctcaacgcgagtttttactcacccatctcgttcgtcttctggtcttttcttttgtttcagcgagatcccgtcgcgtccctcccgccattccaagtccggccagtctgaggctgaggatccggcggccgcagaggcccgcaggcgggaatctgaccggcgagaggccgcggatcgcctacgggaagccgaggaggccgcccaggaggctgcccgggctcgccaggccgaggaaatcgctcgggaggaggccgcccgggcccgccaggccgaggaagccgtttgggaggaggccgcccgagcccgccaggacgagatgttggcgacttccgaggcagctcgcgacgaggccgcggacgcgtcgcttgggcccactccctcgggcgacgctcaggcgacaacttccggggcagctggcgacgaggctgcgggcgcgtcgcttgggcccatccctcgggcgacgcttagaaccaaccgggtccgctcagacatccccgagtccg

SEQ ID NO: 92161 - DNA, 2466 bp, Oryza sativa
tgagctcgaggcgcgggcgaaggagctggacgcaagggcgcgcagcggcggggcggccgcgggcgaaagcgacgtagccgcccgcctcgcagctgccgaacacaccatcgccgatctgcaaggcgcgctggactcgtccgccggggaggtcgaagccctccgcttggcaggcgaggttgggcccggcatgctttgggacgccgtctcccgcctagattgcgccggtcggcaagtgggcctctggagagggcggaccgtaaagtacgccgacaaccagggaggcctcgcccagcgcctctcgaagatggccggggctctccaacggctccccgaggagctcgagaagacaattaagtcatcctcgagggacctcgcccaaggagcggtggagctcgtcctggcgagttaccaggccagggaccccaatttctctccatggatggcgctggatgagttccctcctgggaccgaggtccgggatgccgccgaccatatcgtcgacagcttcgagggctcggcccctcggcttgcgtttgcccccaactccgacgaggagggcaatgccggtggtgcagacgacagtgacgtcgaggccggcggtccgggcgcatcggatgagcccccagacccccgccattcttcagttttttcttcttttcttttttctaaggccttcgggcctcttttttgtatagatcaacttaatctgtaatcaaaaatgaagaaatttttgtgttaatttcatcttgctgtgagtatgagatgaggatgatctgtgccgtggtccttttgtgtcttagcttgattaagggttcgtgcccaggtcccagtcctcaaaaggcgcgggtcggggctagtgcctggggagatccacatgtcgagactggccaggccgggaacgtggtgaccgagggttatgggtaacccgattgtgggtttttgccgattcccccccggagttcaccacgccccggggcacggctcggttctgggccccgtttggcgattttagccgacccgagcccccgagggcaggattgagcacgagtgacctatttcaagtcaagattcttcaaaaggaaaaaacagcacagacacagcctttaggaaattgaaactgtctttattgaaatattgaaataagagaaataagaaagtgcatgtgtggcagcccccggccaaccctgcacgcccgagggggtgcggggttggcccgagcccgaaacctgacacccgaccccccctcaggggtagaagcgacgaaggtgttcgatgttccacgggttaggcagctcagtgccgtcgcccgtggccagccgtatggagcccggccgggggacgccgaccactcgatacggaccctcccacattggtgagagcttgctcaatccagcacgcgtttggacgcggcgtaggacgaggtcgtcgacgcagagtgatcgggcccggacgtgacgctgatggtagcgccgcaggctctgctggtagcgcgcggctcggagggccgcgcgccgccttcgctcttccaagtagtcgaggtcatctctacgaagctgatcttgatcagcctcgcagtacatggtggcccgaggagacctcagggtgagctcggatgggagaaccgcttccgcgccgtagacgaggaagaaaggcgtttccccggttgctcggcttggtgtagttcggtttgcccagagcactgctggcaactcctcgatccatgaatcgccgtgcttcttgagtatgttgaaggtcttggttttaaggcctttgaggatttccgcattggcgcgctccacttggccattgcttttggggtgggcaggtgaggcgaagcagagcttgatgcccatgtcttcgcagtagtcgccgaagagttcactagtgaattgggtgccattatccgtaataatacggttaggcactccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatattgagtccccagacagcaaatggccacgaaagtggtatggtctgcagggcctgggccggctgatggatttgcttggcgtggaattgacacgctttacatcgccggaccaggtcgaccgcatcattgagagctgtcggccaataaaaaccctggcggaaagctttaccaaccaaggtgcgcgaggcggagtgggctccgcattcgccttcatggatatcggcaagaagcacaacgccttgttcccgaggaatgcacttcaggaggattccattagccgcgcgccgatagagggtcccttctaccagcacgtagcgtttggagatgcgatggacgcgttcactcccttcgcggtcctcgggtagagtcttatctgtgaggtatgcttgg

SEQ ID NO: 92162 - DNA, 533 bp, Oryza sativa
tgcagaatcacgaatcaatggcgccggcaagctgtagtataattagctaaccttggtgcttaattccgttaatctctcgtagggtgccatgcaagtacagcggcgtgaacatcgcgttcagggttgaccagggggcaaacccgttctacttcgaggtgctcatcgagttcgaggacggcgacggcgacctcaacgccgtcgacctgatggaggccggctgcggctggacgccgatggtgcagaactggggcgcgctctggcggtacaactccaacaccggcaaggccctgaaggcgccattctcgctccgcctcacctccgactccggcaaggtgctcgtcgcaaacaacgtcatcccggcgagctggaagcccggcgtgacgtaccgctccctggtgaactactcctaaattaattacagctctctccacatctcctgcaagaagctgcagtgcagagttgcggtaaattggtaattacagatttataattagcctcgggttaattatatggcgggaaatgtgcgtccgggt

SEQ ID NO: 92163 - DNA, 774 bp, Oryza sativa
ctatttaagtcaacaaatctgctattcaagtccacaaattaacaacctgtcatgcaaatgatcaccaaatccgtaattatgtccaaaaacacacctcgtatcacggaaatcaccaaatatatgctactagtactattcaagtcccagctgtagattttgaacagtaacttaaattccacattcgtctttgcctctcgcgggtaccgagcccgacaaataaaagcagaaggaatttaatctttcctttgtaccactgtgccgtcgacctgccagccacaggttgcagctgcctataaaatagacagacggcaagttgtacacacatatccaggggcgcgcacagtgaaggccgcggccgcgctgctgttcgatacacacaatcggcggcgacatggcattggcagccaagctcctcccgtccatcgtcgcgttcgtggctctcgcctgctgcgtcctccgctcatccgtcgcgtccgtcgaccaccaccggaagctctccggctggtccatcggcggcgcgacgtggtatggccctgccaacggctctggaaccgatggtacatctacctcacggactcgatcgatcatcaccagaggatggaccatatatgcgagcggcctgcaggcttaattagtactgacgaggcgtgctgcatgttgatgtaggtggcgcgtgtgggtaccagggagacgtcgggcagccgcctttccactccatgatcgccgccggcagcccgtccatctatgagtccggcaagggctgcggctcttgtt

SEQ ID NO: 92164 - DNA, 2498 bp, Oryza sativa
gatcggacacgatcgactggggtattccatggaggcgcacgatgtcggtgaagaaggctgcgccacggactcggcggtgtacgggtgcgccaaggggatgaagtggcaatacttgctgaagcggtccacgacggagaggatgatcatcttgccgtgcacccgaggaagcgcctccacaaagtcgaggccgatgtctgcccacacaatggacggaactggaaggggctgtagcaggccggccgggtggagatgttccgacttgtagcgctggcaggtcgcacacgccttcacaaagtcctgcaccaaacgatgcatgtggggaaaatggaagtcgcggcggaggcggtggagtgtgcggtggacgccctcgtggccgtcgtcatggaccgcggccacgatctcctgtagtagcggcgaggccggcgggatgtgaagccgcccgtcgtaggtgaccatgtccgtgatcacggcccacggcgccgcgcgcgtgcctgcacggacctcgtcgtggatggcgaccaggctcagatccgtggcctgggcgtggagcagccgctcgatgaaattgaaacggggcgcggagatggccaggagctcgccctcctcgacgtcgcggcgggagagggcgtcggcgacggtgttcatggcacctgatctgtactccaccgagaaatcgaagcccaagagcttcccgacccagtggtgttgcggaatcgtcgctaggcgctggtcgaggaggtacttgaggctgtagtggtccgtcttgacggcgaaacggcgtccccataagtacggccgccagtgccgcacagcctggacgaggccgatgagctcgcgctcgtacgcggcgagggcgcggtgacgaggggcgacgggtcggttgaagaaggcgaccggatggccctcctgagtgagcaccgcgccgaaaccatgggacgacgcgtcgcactcgacgatgaagagcttggcgaagtccggcattgcgagtactagggctgtagtgaccgcggtcttgagggccgcaaacgccgccgccgccgcatcatcccaagagaagccgtctttcttgaggagggcagtgagcagcgcggcgaccgtgccgtagttgtggacgaacctgcggtagtagcctgccaagccgaggaagccgcgcactgcccgaggcgaacggggagccggccagtcacggatggcctgcactttggacgggtccatggcgacgcccgccgccgatatcacgtggccgaggtaggcgaccgaggaggcgccgaaggagcacttagtgtgcttgacgaagaggtggtgtcagcggagctcggtgaggacggcacgaaggtgacggagatggttcgcccatgtcttgctgtagatcaaaatgtcgtcaaaaaagacaaggacgaactggcgcaggaaggggcggaggacgtcgttcatgagggcctggaacgtggccggggcgttgcagagtccgaacgccatcaccaagaactcatataggccatcgtgggtgcggaacgcggtcttgtggacatcctctgggcgcatacgcacctggtggtacccagaccgaaggtcgagcttggagaaaaaccgcgccccgtggagctcgtcgaggagctcgtcgaccacggggatgggaaagcatccttgacggtgagcgcgttcagggcgcggtagtcgacgcagaagcgccaagacccgtcgggcttcttgacgaggaggaccggcgacgagaacggggagtcgctgcggcggacgatgcctccctcgatcatggcggcacattgccgctctagctcgtccttgtgggccgccggatatctatacgggcagacagccaccggctgcgcgtccggcttgaggatgatgcggtgatcgtgcgcgcgctggggaggcagacgcgtgggctcggcgaagaggtccccagatgtcgccaagagcccatccaggaggagctcgctgtcggtggtggcggtgagggccggggcgccgggggtgggcatgccggaccagcagacggtccgcccttggtgctggaacgacatccggcggctggccaagtcccagacgatgggccccagggcgcccagccaatgggtgcccagcacgacgtcgaagcccgccagcggcatcacgaagaggtcggccgggaacaggacgccgtcgatggtgagcggcgcggccttgaggacgcccgcgcaggtgacgcgctcgccgttggcgaccatggccgttagccgggggcgtatgtgcaggggcatgccggagcgccgcgccgccacctccgagatgaagttgtgcgtgctgccggagtccaggagggcgacgagcgacgccggcccagcgcgaccgcgatctgcatggtgtcggcggcgggtaccccggccagggcctatagggagaagacaggcgcctcggcgtcctggtccgcggcaccctctgcgtcgtcggcgtcgtcgagttccaccccatcgatgaagaagacgcggcggcagacg

SEQ ID NO: 92165 - DNA, 587 bp, Oryza sativa
gggcctgcaggccgtgatccgcgagcagcacagggcgctgggcagcgtgtttacgctcaggtcacttgggcttgcggtgacgttcctcgtcgggccggagtgctccgaccacttcttccacgcgccagagttggagatagctatcgatggcttgtacgaggtcaccgtgcccatctttggcaaagaagttggctacgacatcgacttggacacaaggaacgagcagcatcgcttcttcgccaagatgctgaggcctgccaaactgaggggccatgttcttcccatggtctgtgagatcgaggcaagtacattttttttttgtccattacctgatcctataaattcaaagctcagatcatgtctgttatcatctccgtaaactaatcttgtttgtataggaatattttgggaaatggggagagtgtggcgtggttgatctgatgcaagaggtggatcacgtgctgatgctgatcgcgagccggtgcctgctcgggaaggaggtccgggagaacatgttcgacgaggttgcctcactgtttcacgagctcatgggaggtatgcacctgatcagcatgttcttcccttac

SEQ ID NO: 92166 - DNA, 711 bp, Oryza sativa
atgattcttgtgtcagatatggagcttcaccagaaatcaccatgctgcaaacaagaaatagttatacaaacagacccaaagaatactgagtacgtcataattagtggagctcaacgaaagactgaagattatgatgtggaggatgcagagacactactgctacctgcagatgaaggttcaaatacttgcagaaattaatctggcactcctatttatgaagccattgttttaaaatgattacttgtctgttgtggatttttcttcagaaagagacaagcttgcggatcctatgtataagcttgaacaccaggaagaggatcttaaaaagaagaaagaagctgaaccagttttagttcgccttcaacgactctccgatagccggcattctgatgactacgctcttaacagagcccttcgtgatcgtcttagggtcatccaatgaaatcctttatcatattttttttccaaaatagttatttaaaagtgtcatgattcttatccacttgtcctatttgtgtagagccaaaagaagagagttgctgaagagaaaagatcagctagaaagatgggacttggagtacggcttttaccaccctctgcagaagatgccactgcagcggcttctgtgaagtttgcatcaaaatttgagaagagcagaagggacaaaagagcagcaattaaggctgcttccatcttcccggagtcatcaag

SEQ ID NO: 92167 - DNA, 939 bp, Oryza sativa
aagagcaagccagggtcagtcgttccttacaccccttgcctttgccccccactctcgccagatggcgagctagatggtgccggcgcccctgctctcctttcctgcccggccatgaggtggggtgcaagattggaagaagggggcgacaacctcgacgacggctgcccacatcagcggtggagcggatctagagtggccacggtgagttcatcgttgcaatcttctcttccttgctgactggcgcccacaatccccccgccgttctatgctctcttcagcccctgaaccgccagaaccctcttcttccttcttgctggatccagtggaaggcgagcgtgggagtaggggcaccacgtccccaacgttggctcgttgccctatgcttcacgcggcttcgatctgaccaattgagtcttcctcaattggttgttgtagtaatctagtggaatccttcttgtatttatcgaatctgtagtaatcgttttggttgtagtaatctctttcgtgttgaacatggtatctcccctctctgtctttgttcgatcgtgatggcgcgagcgataggcgatggactcaaattttgtgcaaactacagccgtactactgcaaccaaatttttttgtctcttacgatgtaatatctgatcacatggtttcctgctttgttttggttgcaatgtgcatgcctgattggtcatctgtttaggaacactcaattctgacatgtaccaatgtagcaccaaaaaaaattcaaattttagtttgctatatgccatgatgcttttatttgatttaaagaaacttttgttttgatatgtgatggatattttttcttacttgcatttgtttccatgatgcagggacagtatagcaatattggaaccaaggactatacatctaaattatcagtgtgctgaggttcgtgatagtgctctgctga

SEQ ID NO: 92168 - DNA, 681 bp, Oryza sativa
gtggacttatgttagtaataaacctgaaacttgggatgaattgaaaaccatgatgagaaaacgctttgtgacatcttattacaaatgtactcttcgggagaaattagaacatctgaaacaaggtgacagaactgttagggagtacattcatgaattaaggtctgtatcatctacagtggtctcaaagagtgcaatgaaaatacaacgcgtagatttttcaatgggcttaattctgaaattcaggttttgcttgataatgtgacatataatcatattgggcacctattcatgcttgctcgtagcattgagagtcagatcatatcaaaggcgaggatgcatgaccaatgtgatttatctcctatttctgaatccctaatatacttatgtaatgatgatgtgcaaacattggaggagcaatcttttgtctcccctgttactaacgttttgcagaaagatcagcacatccaagaaaaggagaatggtatacttgagaagaaagaggatgaagcacctgcgatgtctgaagaaagttcgcaaggtaaattaaatggtgctgagagaaatgaaggtgagtattctcaaggtgagctacacttgtccacttttcatgctaagtagagcaaccattagtggaatcaattgctgagttgcctttgtcacaagttgatttacttgctgttc

SEQ ID NO: 92169 - DNA, 717 bp, Oryza sativa
tctttagccaaacggaatacatctcgaaccatcctaggtccctaaacaaatgaataaaagaacttcatcaagaaaagaactagtatgcccaaaaaccatagaaaatctacaaacgaagtctcaacatccaaaacataaagcaaacttatgcatactattattgagcatgaagcacaaagacttggttaatttggagttgtcattgatggtcaaaaagattgtttccaaagaatattcagacaaaaaataggaattgttcaaatgaatacacagcatgggcaagctagatatttactagcactatcaaagttccccataattcttcagctaaaaatgattagcctatttcgattaacttatccttaacatttgagcagaactaatccttaacacattccttcttagtattcagtagcacagcagttcaaacattatgcagttgaaccttttaagtataaggctagatttgttatttcagcgaacaagatgtaacgagtgagctaagttattaatatatatacataaactggtcctaacatacctcacccaggtacttctgcacaaactctgaaccaacaactctgataaatgcagcagtagtgtggtgtgccacagctttggcgagcatagttttgccagttccaggtggaccatacagaagcacacctcttggaggatcaataccaatctgcttgtacagctcatgatgaactactg

SEQ ID NO: 92170 - DNA, 1550 bp, Oryza sativa
agaaaagactgcaacaaagaacaaccaagcaactcctctgagcatagccttgccacctcttaattatcattgcatagtgatgtaaacacattcatgaaacaaaaaaattatccacaggcagagaaacacgcaacctttgatcacgtgaacacgagaaaggatcagtcattctgtgcaactccatatcctcatatacataatagaatcccacaaaattggaatcatgctgcatcagtaaagattcggggatgagaggagatttcttcccgtaactcaccgagatggccactgagaagagtcatgagggtggggcttggacgccgccagccacctgactcacgactgctacgagcagcggaagcagcagggcgaggaatcgccaccaaggttgagcgcccattgtcgccgattgaattggtaatttttttttctctcttgtgaaagggatgaacaccgcggcaaagacaaggtgaaggaggatctgagacccttcgcgtttctgttgcggtcgattcgtcccctcgttgtcgttgacaacagcaagttactcgaggagagctcgatcctgtgtctgctagatcaaccacaaacaaaagccagtactgcttgagatcacaacacacaatcgtcacagctgcacaaaagacaaagattggcatagattaccttggcccttggggcgacacgggccatgagagcggcggcggcattgacgacattgttctcaatgaaactgattgtggagttgatgatgagtagtgtgatgatgcccacgaagtcctgccagttcggcggcttcccctgaaaaccccaaacaaatcaaccctcatcaattcaatcaaacctctcacaatccctcacatgccatgctctgaaacatcattaaattcattactacttactcctccattggcgagagcgatggccatgattgtcacagcctccatgacctaggacagcgggttccacatgaaccccaagaacttgaagaacttgctttcctgcacacacacacacacaaacaaacaaacatgaaaaaaaaactttgcatcattgaatcgattcctaaacagaacaagaaacttttctctactggatcttgggagagaaactgcggattgggtgggttaccttcttctccacgagcttgttggggccgaagaggttggcaggtaattagcattaaagatgaatccatcctaagcacagtgaaaatgcaatcattccaccatttgttattacctgtcaaatatactacaaagagaattcaggtcccaacagagatataagacaaatttctacagctaatgcaaagattggcaaagtgcagcagaatagcacgctgctagattcaaggaactaagaaataacacgctttgtaagtagaaaactatctattctaagatacttttgtaggtctttctccaaagtaatgataatacacagaaataaatgatgttataattctgaaatgcaggctaaaacattttaggaaggaaagcaaagcatctttaaaattctaagtatcatgctatctttagaaaaggaca

SEQ ID NO: 92171 - DNA, 7320 bp, Oryza sativa
tagaatactcaagctttactatcaagtgactattggaagcacttctctttctagtgtcattggactggatctaaccacttcatataggaactgatgtaacttgaggaggcaaaggcgttttaaccatgttgctgacttgatgagactgacgctttggcgctgaacaaccttttgagagatgataggtcttccaacagttgggaacaatggtggactatctttcttggtctcgagagtagacaattactgaggtgatgtcccggctcaagacaattgagacacgtctcacttgatggatctttgatgtgcactcttcccgctgtgcatgctcccaactgaaactggagcaaagaggggttcataaccttggtgacaatgttattactatcaccgtgggttgccgctgcagatggagcttgtggaagagcggaagtattgctacttttgttactgactgccataagttgacgaactggttgcaaggttgtcctttggtctctcactgccttagctagcaccaaactaagttgattatccttgagtccatggtatattccctcacacaaaaatcgtgcatcctttctctgccaaagactggactgaggtgtaccatagtttttgtaagcaagctaacctggacctttcttctctcctgggcacggtgccctattgtcggtcgttttgacaaataagtccaacgggtgattgaacactttgcaagaaactggccttgaaacccataccttctgtaggtatcacttgttgctcctgggattagtggtggcttggctatgctggtctgctgaagacttggtggcatactgtctgaggttgcaggtgcttgctcttggaaaacaaactgactttcgctctgatcctgattccggcttgcatctgagcttgtacttgttgttggagagattgtcgttgcatctgctgctttggactctgcggttgcggtatcaacatctgacacatccatcattagatcttggctagccaggatctgactagagcgaggtgctccgactcagctggtagcttgttgtcttgaactgatccactgactctgactgcaacacactactgctggagttgcttccgctacacttgaccttgcatcgagctttgcatctcctgcatcaacaccaatcatctgatcttgaacgccaaaagttgatcaacgggggttcctctggcattggggcaccttgcagctttcaactgaaccattgattgtgaccataatacaccgtcgttgttgttgctcttctctctgacactgacccactgctgttgggatagaaaagagaggtggaagagaggggttgctaaagataagactttaaaccacttgcctaccgaactgttgtgagtagacttttatgattcaagttgcttaaacaaacaatctagtatggtcgcatccccaccaatgatgcaaaccaaattgcatgggctctgaattgcactcgaagtcgacttggattgggcctccaccttgacttggacatcctcgatgatcctccatgactctaagtccttctccaagtgtctccttgtcatctccattgttgctaatcacaatataatcattaggtagcaatctattatcaaattcgtacaaaaaagaacataggaacgagctcacctcgaaattcaattgtcgcgcgcgagctcttgttatcggtccatgaaggagtgatgtccgcatcattcaacccctcttgaattgaagtcgtcctcgactcaagctcatcttcttctcccaagtattgtttcaaatctgaaatattaaacgtgggactaaccccaaacccgggaggcaactcaagtttatatgcattatcattaatcttctcagcaattttgaaaggaccatcagcgtgaggcatcaacttagactttctcaattttggaaatctatcctttctcaagtgcgaccaaactaaatcactaggttaaatcttcacttcatgcctacctttactatcaacaattctatactttcatgaaaaaatttctttagtttccaagagcaatacgcattgcttgacaataaaatgccattagtatagagtaccggtgaattgaattccaatctttaattttcatgcagctgtccacctcacttgaattgttcgaaatttccattagagtcaggcttaattttattaaccctcttaaatggcctattttgactcatttagaaacttctactaaattctttattttgttcatcaatcttaattattcttatatggttcgaaaaccatttggatgaacgattattttaatatcttataaaatgaacaagctttatttagtgtttaccactataatccgatctcttaactttatttgattttagcattagtatcttaaatttcttaaaggaaatcggatgtcgcttatgggtaatcatagccataaatggctaatttcttaacttagtgaaattttctaataaagctaaacaacaccattaaaatctaagggaaagaatatctctatctcatgagatgttccaaactcccctagtaatgtggcataagcgacaatgacacaatttcaatgacgtcttacttccatcattatagaataattattcttctcattcttatttaagcttcgttcattaatgatgcagcggaatttaaaacatcatcaaggcttgattaagtccacaaatggatttcttaagtctgcacactatgtgtgacttgtctttccacaacaaaaccgtcaagctatgttatgtatatttaattgtgcaagtcacaaattaagagatgcaaaattttagcatccacataatggagctatgagtcataaatgaggtagagtaatctgatctctcttatttgagctcttgatgagctcgcaatgattttattatttatgtaatggaagcgtaatatcttatgaacttgaatcacttctaagggtgaagtgtctcgaccttaatgagacgtctattctcccctagaaatgtggccgaataataaggccataatttcgacaatgtctcataatgattcaacccaaaataatgccattgatcttcttatttaattactttattgaatcaagacattaagcatgtccctatttcttgcaaagaaacttacacaagaaaatttcaagagtagcatgcataggaaggcaattttatttctccttgcgaggaatatgagctttattattattattaaattttgaatttgaaaatgagcaatggcgcgcggtggtacaacctagtggagcgcgcagcactactcccgtccgtcggctctttccttattttattcttctccctcttcccctttccattttattcttctccccaatcccctttctctccggcgagcccaaatgaatgagcggcggtgatggtggcggcgacggcggttcgacgaggagaagcgcgcatggtggcactgctccatcctccgccggttggggggcgctgcaaaagcggcgccaagccgagccacttcctgtcctgctagttcgccatgtgggtcggtggggttcaagacggtgcacgcatgatgaagctagcgtggccgcgaggaggagttggcaagggtgcgccatggcatacacgggtgaaggagttgcccgtgcggcaacgacggtgatgccttcttcccgacgaagcccgcatgacggcgctaatgtcgtgcagcatctccggtgacttagggcttcaacgatccggtaaatctccaaaacccgaagcttaatttcttgatttttgtttggatttaatgcaggctttggggcttagggttcttccctcccctcccccgaaaaaaattagggttcttagatttggggattttaggccaatttgatccggcttattagggattttgggaaatttcaatcttgtttattcccttttgcttaatagtggggaatttcaatccaatttatcccctgttttttgtttgctgagtgctagccgaaaccttagctttggtctaggaattcttggtgtgagaattgggaatttcagtctcatttatcccgatcctcattcttctcttaaaaaatactgctaaggaacgaaaattaaatcttcaatactatgcttcttctactgttggccgagaccaccagtacaacagggctcaatggcttcacttagggatgatgggatcaagtggctaagataaggctctgacaccacaatgttggaatttaatccaattaattaattgagtcttagcttaaacatgatcaccttcttcttatgcggaaattaattgatctaactgaccagagatgaagccattgttcttcttctttcttcttctttgtttcttctgctgcgagatacctcacgaaccccttccaatgtctaatcgatcgggcaattgatttagggcttaggattagatagagttcgatcatcaatctgcctccctccttctctttctttatatagtaacactggtgggactcgggggtttatctccaattagtttggaattttgttttgcaccgatcacacaaaacaaaatctaatctcttatttttctttcttgattaggaaggaaattggtggttaatctctttcctgatccttatcgatagtgagtcgataaaatcaaccaatggccatttgcacgggagtgccactattgcaaaaatccttattggtgtcggttggaaacaaactataggagctggtttaccagccggaaccaacttgggggtgccaatgactaatagcatagatgtcgatttaataactgttacctatatataattaataatagctactggttttgtctcgtagcaagtacttataatttaaaaggtggctgatatgctatgaaccgacacctttaacctatttagggttctgtagtagtgcgccgacggcattcgtgtaccgttgcgtgtgccattttggttttgtattatactagcaagactttgaattattggagcactattttacgtattatgtattttgttcttttttagcgtgtacggtggcagaccaacgtacatacgacaattgatgggttgttcaatttcatttcttgctctcacttagtgccagacacattgcctagtaaatttcttcactacaagagaattaaagcagaataaattgctctaccaaacatccatccctcttctagttatatacttcgtcccagggctgaatcagctggagggcttcctgagaaacggcgacagaaatagcatgggaaggttcttcatcactcaaacaaataccccaaatttacttaggaagcggcagtgaaaaagaaagcgtacaataggaacgagagaacctaggaaaagaagaaaaagctactggaaatcgaaatgttaccgacaacattggtgctggagtgctcagttcaagtccgtcgctcgtctgactgcatccaggacaacttgctataacgctgctccatgggtggtgtgggatccgatggattcgagctttgcttgtactgctaggatcaatttgtgaaattccatttttgacatgcgtgcagcgatgtgtacttttgcaatttttggtgagtaggtagggcgtaaaatttttctttatttccttcatttttaattatttgatgaaggatatctttctgttaatgcgacctatatgtttctgttaaaggagagtatgttgtttctttgcaaacaaacatacgttagcaatcagcaaattttagtgttcaacaaaaagatcgattgaagcttaatttggattcatccgtctatgtatttcacgtttccaataattaggtgctaaatataaaaaagaattttctaaaaaataatcaataatgatttgtatacatagttcaacattcattaatagttccgtagcaaggtgtatatatcgtttgctccatgcacctaccgtgatggtgttatacatgaaacacattgatctaggaggataagtaaagtcactaaatttaaatgctatgcaaacttccaaatatagttctattaagtatgcactttatggccgagttatgcccaataatgatctgttacaactttagaacatataaaaataaaaacaagatatttttactaccaatagataacactataaaaatgaattttttttacggtggcgctaatacgcgcgctgcacgcgaaatattagttcgagcgccgcacaacgctctctccttccggttttctcttttttaccttcccacctttcctccgtcctttttttttgttttttaccaccccaccttccatgtttattttttctcttttccatctcatatgtgtttcatgacagggccggtaaaaaatgaagtatccatattttttcctttttcgttccttctctccatttttttatttcacgttttagtaaaatatttatcatctagtttttctttccggttttctgtttttctattttctatccacatttcaaaagcaacgaatttacttcatggagttttccatttgcacccagcctcccacacctgcttattcaaaagtaacaaatttactcgtatgaatgtcccttcaaaaataacaagtttattttacatgaatgccctgtgatgatacggcaccattcctagatggccctaaaagaattactaccataattgttttaccactgttatcaatattgtttagactttgtggtccgcaagaaaaacaattaccaccttcctctcattatagaccttgatctcgtagccaccgtatagtaatatgttactgatgtgttcaatacacagcataagagtaaaaactgaattaagagtattgtttatctgtatcacaaaatggtcgtaggaatgtaaagaattacagatcacacacgagtgataaaattactcacttaaaaagaaaaaaatgattcagccaaaaatccatcatgaagttgtgatcctagtggctttgctggatcttactataaggatggagcggctggtctgtgtcttgtgactggtattggagagggcaaccaggtggcgagcagtagtcgatgatggaatcatgaaaggatgtagcagtgtggtatatttatgagctcgaagttgcgcagtagcagccatccattatctagcaagcacgaaaaaaaatgcaaaaatattctcgttcatgtcattgagacaacgagcaaaagaaaaatagcaaacaacttccatcactggcgaactccacaatatcctctgcgagcaaccacatggagcacgatgtggaaatgtagatcatgtgcagcccatcaatttagatcaggtaatattggatattgcacgttaatttgatttgcaaaaagaaatcggggtttcgtgagtg

SEQ ID NO: 92172 - DNA, 10582 bp, Oryza sativa
tcgcagtttacaggcggaatctgtaatttgttttgttattagtctacgtttaatacttcaagtgtgtgtccgtatatctgatgtgacacgctaaaattttacatctctgaatctaaacacagccttactctggcgatctatatatagttgcatacattgtaatattattgctgaattcatattcccatctgagccaaccatgcattggtgttttgcataatggaggtacccattgctgccatgacttttgcccacccagccaatgttatgactctggcttcaaggcagccaaagagtaaaaggtcccatatctcccctgctaccacggctcaccgtaatctacagactcgcctggctcaccaccaccatgcaacaccagcttcattgcctatggcaatctgcaacacagtagacaaagtgatcaataggttcattgacctgccggagcagcgaccaacggtggatccgcggcgtgtgctctctggcaacttcgctcctgttgatgagctgcccccgacaagctgccatgtcatccgcggctccatcccaagctgcctcgccggtggggtctacatccgcaatggtcccaacccacagcaccggcttccccagcgaacacaccacctcttcgatggtgatggcatgctccactcccttctcattccctcggcctcgtcaacactgttgtcggagcctgtgctttgttcacgctatgtgcacacgtacaagtatctcttggagcgtgagaccggaggaccggttttaccaaacttcttcgctggcttccatggagtggccggcttggctcgtgcagtggtcatgatcgcaagagtgcttgctggtcaaattaacctgaacaagggcttcgggctggccaacactagcatcactctttttgcagattgcctatatgcgctatgcgaatctgaccttccctactccatgcacatcaacccagccaacggagaagtcaccacacttggtcgatgtgactttggtggtgatctttcttttaggatgacagcacaccccaagaaggacccggtcaccatggagttgtttgcttttcgctacaatgtcttccaaccattcataacatacttctggttcgatcgagcaggcagcaaggtcgcagatgtgcccatcttgtccttgcagaaaccatcggtgatgcatgactttgcaataacagagagatatgcaatctttccagagtcacaactcatcgttaatcccatggacatggtcatgcgggggagctcgttggtaggattggaccgtaccatggtgccacggattggcgtgcttccaaggtacgccaaggatgagtcagacatgagatggtttgaggtgcctagatttaatatgttgcacacgacgaatggttgggaagaggctgatggagaggagattgtgctcgtggcacccaatatcctatctatcgaacacatgctaggaaacatggagctcatgcgagctcgtgtcgacatggtacgtatcaacctctgcaccggtgacgtgtcgtgcactgcactctcaccggagagccttgagttcggtgtcatccaccaaggttatgttggtcgcaaaaatcgctatggctactttggtgtaagtggtccgttgcccaagatcaaggggataagaaagcttgactttgatctcgtcggctctggtgattgcacggttggacgtcgtgactttggtctagggtgctttgctggggaaccattttttgttccagacaacatcgacgggtatggaaacgaggatagtggttatgtggtgtgctacacccatgaagaggacaccggagagagttggtttgtggtgatggatgcaaagtctccagagctagacattgttgcagaagtgcaacttcctagtcgtatcccctatggctttcatggtatttttgtcaaacaggccgaacttctcgcacaacaataagcatgtttgtgaaaaaccttacccactactctacgtataaagataatacttcataacttcataagcgagatctgctacaaatgtactttccagcatttgatttagaatggtcataagagaagtattatagtctggttgtcatttcacatctatctatatatcttttattatatactaaaagtccattaaacttcctacaaacgctcctaagccgccacgtgttctcctacaaacgctcctaagacgccaagtgccagtctaaaaatctaaccgttgatttttctttaaattggtgggtccaacacttttaaccattagatcaaataaaataaataaaatcctcctctcaacatcggtccccaccacctgtacgttcctcctctcatctccagttggcatattatatggcaccttaaataattctacagatatgtttcgctaaattatatcgatgatatccaatctatctattatatagtaaaagtctgtgaaaatttttataaatgcttctaagctgtcacatgatgcttatataaatgctcctataatgccacgtgacactccaataaattagcaaaaatctaagaaaaaaaacctagcctttgatttcactaaaattaataggcccatcactccaagccgttggatacttggattagattgatttttctatttcttacaaagaggcatcccctcttcccgtgcatacgcatgtacataactcctctccatttctcttttaaggaagtttttttttttttgctatcggatgaaattacatgttctatttgtgtcattattatgactaaaatcacaaattagaatttaatacacctcttaactataatttagcttgtaaaaattatgaaaagaaagtgacattattatattgtttcatgctatataataacttcactggcatgtaactaaaatagttctacaatgtcagaaaaatgtagtttacaccagtataattttacttgtagaaatatattccctaaagaaacatgtagatatatattaggcacatttcgacaacttgtatgccatatctatccattatatgctaaaagttaactaaaattcctacaaaatactctcaaaccaccatgcgggactcctacgaacacacctaagccaccatgtgacactaccactggtggacgaatggtctttcctcccaatttgtaaccccatgttctcctagttttgaaataaccgggacaaaaagaaatcaatttttagtcctggttgatgttactaaccgagactaaaaatgctagagccagaaacggcagttggcagtttttttaattgtttttttttcatattgatttcactaatcattacatcccctaatagagaaatccccaaatcatctccaaatcacagatcaaattcatcataaattctaaaaaaaattacatcacaaattttgaaaaaccatcacaaaaaaattagaacgatagtattaagtaaattaaaacaatatgaattcatccgattataacttaataaagataaaagaatactgaacctcgacaaagaactctactaaggcctggtttagttcccaaaaaattttattttggggtgtcacatcggatatatgaacacacgtttgaaatattaaacattgtctaataacaaaacaaattatagattccgctaggaaactgcgagacaaatttattaatcctaattaccatcattagcaaatgtttactttagtaccatattgtcaaatcatggcacaattaggcttaaaagatttgtctcgcaatttacacgcaaactgtgtaattggtttttttcccacatttaatcacataacatttaatcatcacaaatcctcaaaaaaagaaaatcaattccgaaggccgccgcgtgcgattccccagcccggccagccggccgccgccgccgccgacctcgacaggccgccgctgacccagagaggccgtggtaggaggaggaggcggggagggggaggagaggggaagtgggagaaaggggagaggagaaggggatcggaccgaggaggccgatcgagaaggagaacgcctgagattgagatgggatcgaagaggctggagagtggagatggtttctaatgagagaggaagtgtagatggtttttatcggtcttatcgataagaccgagagagaggactcgacatgcgctcgggaggatttttggtcccggttggtatgaagaaccagaactaagatctaagataattggggcctaactcgacccaataaattctttgaaccgagactaaaaatgatctttagtcccgattgataacatcaactaggactaaagatcaaaaagtttttaaccaggactaaaaataatctttagtcccggtttctattcgaattaggactattgtggttttaggcgaccgaccaaagatggtttctccagtagtgtacaataaatcatagaaattctaaagaaattacataatacacctaaccatcaattattttaacttaaacatggtgtacctattattttctactgctatcttaacaatataaaaatggaaaagacacacttcccaccccttcatacgtcatgtatgtgttcaagtgacatctccatacgtacattatctctgcttctctcccttcacatcctctctttttttcaatggacaacattacgtaaaaatacaataattagaaagattaatgattataattttaaaagttgtatcttatttttagtttgtttcaattgttgttttatttataactaataaataattcaagttccatgttatccatatttttattataaatttaaatacatcatttgaacattggcacctatgttttgcatggaaaccaaataggaatgagacatttcgaaaaggttgactatatgcattatgttatattaaatcagtctacttgataaaatttgattaaacgtcccatattgcacttgtaagtaaccatgtatcatgtctcaaaaaatagaaaacgatccaacttaactcaatggatttcattattttcatcaattagatcaatttttgaaagaaccataagtacacatgtcatctatttttagaaaaaaaaaaacataagacaacacgtgtcatgtcttacaagttataaaaacaataaaagaaatgctgagaaaaaagaaacatctctcatcggttttcactaaaatccttccacctcctcctccatctcacatgtagagaacactgccctcccattccttatttttgtaacatgtagaggacaactacaatttttttataagctatacatgtctgatttctatctaattattctctatttataattaaactaacaatgtaatatttatatatgcatatattttgctgtatagaattatagcacttgggcacagtccacccatgcactttgcaccacatctatataccttaaaattttgacaataaatattatgtcattatgaaaaattctacaaacatgcatagctaaattaaatcaatagtaccagaataaaattttcatatttaatttgccaaaagaaaaagaaataactcaacaacatagagtcgcaccatgctatgttttgaaacatgtatagctaaattaaaggtacacttcgtaaaaaaaataactaactgaaatatgaattgtctgagccactgcataaaacatcgagttcctttaattagagataatagtccaattacttaatgcttttttctgaatgtgctcaaataatccaaataaataaaatgatcttttatacgttcagattaatatttcatcattataagttctcaaacatagtctacgatgcatgcccgtgcgaatgcacgggctaccttcctagtttttttaattgatacaatggctctgtttttttttacaaagtgactttgattgtttacgccacatacagtactagaatatttctcttcaatggccacgtgactagagtagtttttgcgtgtatttccttgagctgtaagtctgtaggctggcttgggtctcatccctctttgaggctatgcactttgttgagttcgtgcggttttagacacgtagccagttgtcagggccaagaaaaagaacaaaaatgattgattatgctgtagcgctaatcgacgcgctgcgcgtggaatattaattcaagcgccgcacaatgctccatccttccggtttttcccttttttaccacctcacctttactccgcctcccacctttccttcactactagaaaaaagatttttccgggtggcccaaaaccattttcgtaggcgggggaaaggaccgccggtaccatctcgcctgcgaaaatagaccattttcgcaatcgggcctgtggcccgcctgtgaaattcatctcagaaaaataaaaaaaaaccacagggcgccgccaccggcctcacgagcgccgccggccaaggctcccctccgtccgctgccgtcggcgccgtcatcatcgtcgtcgcgtcgacgaggatagccggcggccggatgcgagccgtcgtcgtcgcccgtcgtggccggtggaggaggcggcgaggagggaagcatgtggcggaggaggcgagccatcatcgtcattcgttgtggatggtggcggagggggcgaggaggggaagcggccggcagagacggcgaggagggaagccagcagcgaagagggcgaggaggggaagcgggcggcgcaagcggcgaggaggaagccgacggcgcagggatctggagtgccagcgtcgtcgctcgtcgtgggtgacggcgcgtggacataggagaggagcgagcaggcggcgccgtggtcgtcgtcgtcgtcgtggccggcggcgcagatgtgggagaggagggagctgtcggcggagggaaggagtcgccggcgaggagggagacggcggcgtcgcggtcgtcatcgtcgtcatggccggcagcggagggagccagcggcgcgcagacgtgggagaggagggagccatcggcagcgaggagggagcccgccggcgacgaggagggagccggcggcgcgcgcgcggacgttggagaggagggagccggcgattttttctaagtgtgtgtgtgagagagagaggagggggagggaaatgagtggtggagaggagaggataaggatggtggaggagaggataaggatgactagatttttttttgttggtactattttggcaggcggaccacataaggtgcgcctgggaaaatagattttcgctagcgtccgtctgtgaaaataagacccccacgccgggtaaatgcttttttctagtagtgcttaatttgtttttttcgtttttttaccaccccaccttccatgttccttttttctcttttgcatcttacccatggttcatcaaagggcccagtaaaatattaaccatctagatttttcccttttttttccttctctccagtttttctgttttctcatttagtaaaatatttactgtctagtttttctttctgggttttctatttttctagtgtctccccacgtttcaaaagtaacgaatttacccagtgaagttttcgtttaactcccagcctcccacttccgctccttcaaaagtaacaaatttactcgcatgaatacccccttcaaaagtaacaaatttactttcgtgaatgcccccgcatcctatagcactattccttgatggtcataaaagaattactaccagcttacaacgctagtaattctttcaccagtgtatggtctgcgagtaaaacaattaccacattcctctcaatatagcgcatgatcttagccactttgtagtaatatgtttactgagactacgtggtctacacgtaaaaaaattatcaccttcctctcgatatagcccgtgatctcgtagcaaccatgtagtaatatatttaagaatgtgttcaatacatagtataagagtaaaaactgatactaagagtatttttaatctgtatcacaaaatggacatacgaatcaaaaaattacagactcaatcacatagaagtgataaaaattactcacaggtgtatcaaactagaaaagaaaaaaatgattcagccaaaaatccatcgtgaaactaggatcctgatggctttgctggatcttgctataaggatggagaggctggtctgtgtcttatcacacgtagtggagagggaaaccgggtggcgagcagtagtcgacgatgaaatcatgtaagggtgtagtggcgtggtatagagatgggctcgacattgcgcagtagcagccatccatcttctagcaagcacgaaaaaaatgcaaaagcattctcgttcatgtcatagagacgacaagcaaaagaaaaatagcaaacaacctctatcactggaggactccaccctatcctctgaggctagctacatggagcaccatgtgcaaatgtaggacctgtgcatcctatcaattcagataaagtaatatttgagattgcagtaatttgtaaaaagaaataggttcttcatgcgtgaaggtaaaggatgcaaattggagtgccaattccttacttgcttgttctgtcaatgtcgccaacatggagcagccgctagttgttgctcttagcccaggtgaacacctccttgctggctaaggtgccgcccgacgtctcgcagcgaggcccaaagcagcgccttcgcctcaaccgccaccagccaccgctcgccggccaccgccatcaaccaccacggtgtcgtcgtcttcctgcatggtgcgtcaccgatcagtggtctggatggtggatcgattcaaatctaaaaaaaaagggaaaaatgaagttggagcaagagtggttggttgggtaccggaaaaataaaatatatacgtaccggaatcaaggaaagttgttttttatttactccggtaatagtgggagcaggatgacggggcgtggggtgggatcagaagtagggaagttgtttttattatcgaagtaaatcgtttactctaataatgatgggagcgggatgataggacatggggtgaggtgggcctggactaatacatgtttggcgctcagaatactaaggaacacattgcgctcctaacagtagtactattgattatgtacattttgttttgtttgttagatgtaccagtgactagtaaatttttttttgccaactcatgcactcctgctatgtagtaccaataaccacaacactgttatataatgagcgacaaaaagttttatatagatgcgcatgcgaattagtcgatatcttttggaagtatggatcctccaaattaaattaaactaaaacaagttagacagcaatcttctgagcaagttagaaatacatatctactgagctgctttgtttgcacatccaccaatttagtagccacacaaaaccctatgcatgctcatctctcatatattatagtatcattttgcttttttccctcggctactcctaatcaaaatctgatgagaagctttcggtcgtgccccagggtggacagagttgcaaacatgcagttcatgttactgtctcaactgattaggaaaaaactccgaaacgttatgtgatgaatcctatatatatatctatatggtttgatccccacttagtgtagttaatagcaattctcagctttgtggttaagccacatcagcaacaaaatgttggccgtctgatttgatctgaatggctctgtactctacaaggctaaactggttgcatatgaaaaagccccagttcacaccctggcccaccataccatccgacccttcatctccttcccaggacggagcagcccgccgctcaatgcctctgcttcttcctccagcgccagcggcgcctcccctcccctccccggctcccccgccctattgttgcttcctccagcagcacctcttgccgcctcccctccaggatcctctcggttgctttacgccggcagggagcatatccgccgcgctaacggtgtggttgcgcttcccctgcccccaccacacccccgcgggaaagccggaaaccgatgattcccttcataacggtcatcatgtgctaccgacaacccttccctccatggctccattgattcgtctcctgcatcttctttcacctcccgtatgttctctccttcacctgtaaccaccggcctcgtccactttgaagaaatttcaaggacatctaggccttgtttagttcccaactttttcttcaaactttcaacttttccatcacatcaaaactttcttactcacatcagcttccaacttttttcttcaaacttctaatttcagtcaaactttcaattttggtgcggaactaaacacagccctactgaaggaactcctttctttggcttcaacaggcaacagcgcgccaaaaactgatctattcaccggtggccacgttcccgcccataggtatgcttcctcgtgatcttttcctcattttctgttttgacgccttccagtcggaccaaattgattttttttttatctactgaccctcagagtatcgactaacaaaaaaaaaagtccctgctcttctccagcttattgaaaaaggcatttctcccgtctatttagccgggtactgaaattgatttcttttgtaaattttactggtactcttaagatgagaggcagggctgcagga

SEQ ID NO: 92173 - DNA, 646 bp, Oryza sativa
cttccatacaagttctccttctgaaaaatccttggataccactttcttattataatgccgagcaacacgttctttatccttcgtaaccttcgcaagggctcgcaatcgtgactgaaccagatcctccctctcatcggccataaggttataatattcatcggctgttaaatcgttttgtaactccgttcgtctagagccgatttaacctcccatggcaaaacagcctcatgcccataaacaagtttgtaagtaggaacttgaattgatccatgacaaaccatcctataagaccacaacgcttcggccaaccgaatatgccattgccgaggataatcagaaattttctgcttaatcaacttgatcaaacttttattagacgcctcggcttgcccattcgcttgtgcataataaagtgaagaattcaacaacttgatacccacgatatcggcaaattgaacaaactcatcggacacaaagattgaaccctgatccatagtaatagtttgaggaagaccaaatcggtagattatatgctcctaaacgaattgaatagcatccccagaatcaactttcttcaaaggaatcgcctctacacacttggtgaaataatcagttgccaccaatataaatttatgtcctttactcg

SEQ ID NO: 92174 - DNA, 782 bp, Oryza sativa
cgaggcggccggtcggtgaagtcgatgatgcccaacaacagcggcataataggccggccgtgcaagcggaaactccagtcggctgcagacgaagcggccggtcggtgaagacgtagacgcccaacaacggtggcataataggccagccgtgcaggcggagataccagtcggcggcggatgaggcggccggtcggtgaagacgtagacgcccagcaacggcggcataataggccagccgtgcaggcggaaacaccagtcggcggcggacgagggcaagccggtcagtgaagacgtagacacccaacaacagcggcataataggccagccgtgcaggcggtgacaccagtcggcggcggcgaaagcaagccggtggtgatgttctgactgatcccattcctgaagcgtaagagataagcttaaagccatgaatcccttttatgcatatctggatctggatcctgtaaaacaaacatataggatgagtagtatctgatataaatataatactcgagaaaaattcaagtattttaaaatatttataaatatgtatttctcctctactcaattttgatttccccgagcagatgactccgtacgtttaaacactctgtccgactagtcatagcccccgagcatcgggagtcggcctaggcacttcccaaacatgcatatgagtgacatgagttcgtcattaatggaacaaagtttcacgaatcagaatttactactcgggtacttttgcaattgtagagagcagaaaatagcatttatcttatctcta

SEQ ID NO: 92175 - DNA, 637 bp, Oryza sativa
tcgtgcaggataggagaccataccatagcaactaatacattttatagcaatcgactagttagtgtaatgtgagttgatttttacagggttgtaaatggcaatccaaaaaagacgagtataaagcaactatttttttgcttcacaaggggggcaatttacatatcaacaattcagtgttcccattcatctagaaatgcgactaaatgcaacattagagcttcattcagataacaatacaaggacctatgatcagtataagaagctagaatgctagagcaatcccaacaaatggggcaaatgaatcccaattgcacaactactaaccttttcagaggccaaccaatgtctgaaacttttgacttcactaactgtgatccaagttttcatcacccaagtatcacaaaatgtccttgatgaagtcaagattgagcgtgtcgcggacaatcagaaacatgccaaccatgagtaccaccagtatacctgacgacatgatcctctgttgatttcacgggggatcttctgcccaccacgggccgcctcgagaaggatcaacgccaacgtcccaccgtctaatgctggcaatggcaacaagtttattgcagcaaggttgaggtttatcacagccgcaaactgaaac

SEQ ID NO: 92176 - DNA, 3609 bp, Oryza sativa
attcctgcagcccagcactccagacaatccctctgacttggccgttctcgtgctgggggctagacatacttgggccattcccacgaggacagggcggctacagattcctatttgtagcaatcgacaaattcaccaaatggatcgaagcagtacccactggggaaatcaaggccgataacgccatcaagttcatcagaggtatattatgcagatacggactaccgcaccgcatcataactaacaacggccctcaattcatcagcgccgatttccaggattactgcatcggcttgggagtcaaaatatgtttcgcctcggtctctcaccctcaaagcaatggacaagtcgaaagggcaaacggcatagtactacaagggataaaaacccgcgtctacgacagactcatgtcacacgacaaaaaatgggttgaagaactcccatcagtactatgggccatgcacaccacactgacaacatccaataaggaaacacccttcttcctcgtgtacggctctgaagccatgttccccggcgagttacgacatcaaagtacacgagtacagaagcattccgacgagaaccaggagaaacagcgagacatcgatgtaaaccttctcgaggagcatcgtgagcgagttgccgttcgagcagctagctatcaacaagccctccgccgttatcacgagaagcgcatccgagcatgcatactttcgatcggcgactatgtcctcagacgagttcaaacccaagcagggcaaaacaaactctcaccaaaatgggaaggaccctacacgatcacacaagtcttgcggccaggcgcattcaaaatcgcagacggcgacgatcgcgaactagcaaattcgtggaacattgaccaactacgtaaattctatgtatgagtcaataccactgtacctgtaagcacccttacagtatcaataaagcctatttctaagtcacatgtcacgaccaaagtgttttcacccaatgatcccttactctgacgacacctagcgttgaaacctgtccttatgtccctttacgccgtcttgacaaggcctccgaggaacctaagggatcttcgactggggacgcctagagccgataaggccttgtcagatcctttagagacgaaagaccatgtaagatctggtcgtgtaagagttctcgccgtgcgtattaaccaagtcgtgtaatcggaaaccgagctttccaacttcacggctgggtgctaggatcagagcttattcaaccaagacaggtcaagggtccaagagccttgtcctccgagaaaattcctccgacgacaaagctgggggctagggagagtgtacgactcaaacggctaactaaagtcattaactgagaacacactcatacacacgacatccagagtaagaaacatttgttaaagatagatttctttattcacaaaatatttcttacagtttgtacataaatatttcgctgcattacatcttcccctaagatatctggtcgcagggtacaaatactaccaagaaagccaatgccagtccattgactggaaaatcttctcggccaacggcgacatcgacctcgcaaggtggtctatctccgccggattcctccgagaacaagaaaaaccttcacggaggaattcgagatccaggcgtgggcggtgatctcgcaggcaagctaacacatgtcctccgaaatatcggctcgcaagatgacactcttgcttcaaggcttcgtcgattcgcttgccgatgccatcgagttgggcacaggccccgttgagccacgagatgtacccggccgccgattcttcatgatcggcgcggactactcgaagctgcctgcataccctagccatcgaggtgcaacaattcttcaagtatgacccaaaccacacctcgcggcctcagagcgtctccacggcttgctctttcttcacggatagcatgattctctcgagttccaccacttcaaatttcgtcttccagtattggatacgacgatcttgggtcgcaagggcatccttgagatctgctaaacataacgaccactaagacaagctggaaatccccaaaacaacacaaaggtagaactcgaaggtagaatggctactcacttgaggcagttgtagtcacttcgacctccgcatcaagagtttggtcctcgacgtcatgtgggacgtgtggttcaaactcgaataccggaattatcgccagtgactcgggctgcccgcgctgctggacatcctcgtcatcagcatctctacagtcgacaagaaaaaacttccgagatcaacggtgaacaaggatgataatcacacgcacgaaggcaaccagagttcaagatttacaagtcacaaaaaatacaagaagtcctactcttcaaaaagggggaggacagactcccccaggtcatcgacttcttccatcaccttcttacgcgtgtcgcttgccgccccctgatccaagatctcgcgcatatcgagttcaggacgcgacaacctcacacacgcgaggacatgacacgccccggtatagatgccgttggacgtctcctccgcgatcctggccgtatgcttggaggggatttccccatcgccgtcgccagctccgcaagagaagaggtcaacgagaactcgtcggggttcgccgggatcgtggacttgatgccgcactcctcggcaagctggtggagaccggtgtaggtgacccgcagcgaaccacggatctcggagaggttatccccgagttccgacatgcggtcctcgagccccttgcgctggcgctcgttgccggccaccagctccctcatcttcgtgaggtcctcgcgggcctcagcagttcccgcaccaagcgctcggcacgcgcgttggccgccgccgtctccgccctcgcctctgagatctcgcggccgatgccgcgagcaccggcttcgagaaggcgccccatttcgacttggagctcctcccaggtgaggacggcctctggcagaccacgacccccagcgggatcgctgacggggccgcttggcgtcgcctcccgactcccgaccacgggcacgacatctgttgacgccgtgacaggggacgcgctagacgttcccccggacttggcccgagcaacgttcgcccgcgcctccctataaaccgccatgaatcaaaattccactcaaacagaagacacgagaatctaaaagtttctttacttacttctcgccgatcgtcacaatgcgcttacgtcgcgcaggcggaggagacacgtcggaagcctacaaaacaaccaacatagagtgagaacaaaccttccttgctacataacctgacgacaaggtgaaaattactgagggagtcgccgccttgcggcggtgtccgagcacagacgagaatttcctcgccttagtcggagctttgccaccactagtggtggcagcgtcagacgccaccttgacgaccttctctttcagagatgccgccacctgatgatccgcgagcggaccgacgacatcagtcaaaggaagggcctacactaaatcatgtcataagctgattttgagcaaagaaggcggacgcttatcgaatgaactcacattgattgcttcgtcgtgctccgt

SEQ ID NO: 92177 - DNA, 695 bp, Oryza sativa
ttcagatttctgaaggaacaatctttttgcagacttcagttgcgacagagacaagatatttgcagacaaggcaggaatggagtaaaaacaccttgcaaattcgatgattttttactgtacacatattacaggactgatgttacattatctctattcgctcatggcggataatctgtatttaattacccttccatatctcaggttcatctctctacatacaagatggcatacatgcactgacaacgaagaactaatatgcatgtacagacttcttgctttcacatatataatcctttcttcgataagctgaactccggacgagtaccagcaccgccattgacgatggagctcatcgtcgtcgtcatcttgtcagccttgtgatgaggaagacaagaacctcaacatcgaggctgcaatcttttcactccccagtcttttccattgtctcgtctttgatgcagtagcagggaatgaagcgaaatgcactcggatttagattaaatgcattcactttgagctcttcttcccccgccatcttttccggcatttctcctcaccaaccttctgaatatttaccttggtctccttcaaccgagacttgtagtctttcttccatgtcgcgaattggtccttgatcttccggagctcgccgtctaggttcatgtttgaaccaacctgtccggacatcatcgtcg

SEQ ID NO: 92178 - DNA, 706 bp, Oryza sativa
ctggttgtgagttcttcagaccatgcgaatttggatttgagtacattaccagtgtcaggaggtatcaggatatttcaagttgtaaattctatggatgacaatagaagatatttttcatccttcttcaaaaataacagaagatgcttctccaagttgttctcacatcacattaaccttacaattgataatgagctatggagcagttttcggcatttgagaactttagacttaagccgcagctcaatgacagcattgcctgattcaattagaggactgaagttgctcaggtatctaagtattttccaaacaagaatctccaagctcccagaatcaatttgtgacctccttaatttgaagatcttagatgcaagaacaaactttcttgaagagctaccacaaggcattcagaagctggtcaagctccagcatctcaatttagtcctttggtctcccctgtgcatgccaaaaggaattggaaatctgaccaaactacaaaccttgacaaggtatagtgttggaagtggcaattggcactgcaatattgctgaactacattacttagtgaatatccatggtgaattgaccattacaggattaggtagagtgaccaaagttgatgatgctcaaacagccaacctgattaataaagagcatgtgcaaactctaagattagattggtctgatggattctactctagtgaatgtg

SEQ ID NO: 92179 - DNA, 1910 bp, Oryza sativa
tcttgacgagtttcaataaatcgccaaatgccttgcactaaccccattttttgccttccattgcaagaactccagagtggtatccaactttttgtgcccctgctcgcaacctgggtacaacgaagttctgtggtcctccaacatcttgtccaatttatgggcctccttttcactttcgcagtcctccctggcgtcctgcaacatctgaccaagatcatccgcaatgtcgttaccatcagcagctatttcctcctcgcccgtttgattttcttcaaatccatcatactgagcaaagtccggaatattgtcgtcttccacttcatcttcttccatttcaacaccttgctctccgtgggatgtccaacaattatagcttggcatgaaccccgactcaaacaagtggaaataaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaaccgtacacaaataattattcttacaataatgacagtcatacaataattataagatatctttattcatacaaaaatcataaaatattacactaaataattcttaaatactatttgtaaagttttaaacaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagaaaaaaaagtgtgcaaaacataggtgcaaatgtagtatgacaaaaaaaacattggacgatgaagttgcaaaccttttaggcacctccgatttgtatgtaatcaccaaaataaattcaataaaaattttggcatgacctcccctcttttttgaagaaattttgaagcttgctcaggcagctggagaaggaagaagacatatctataggggtgggactttagtcccggttggtagcaccaaccggggctaaagatcaccaggatcggatctttagccccggttggtaataccaaccgggactaaagttacgatctttagtcccggttggtaatagatcccgggggggcctgacatgccctgacagcattcgaaccgggactaaagataatctttagccccggtttttattgcatccgggactattgtggaaatcgtccgaccgacgaaagatggtttctccaccagtgagatgtatactagcattaatgcatcattagatctaaacatgtaaactaagcagtaaaacatgaacagatcaaatatgcgcaacatgtcgaacacgtaccgaggtaacggaaagaccggttgctcggcaggaactactcgcggttgcgagcgtcgacgaaggcgcgcagcatgcgagcggagaggaaggcgagccgtcgcggacgaacagggagcagtcgcacgaagcgcttcccaaaaaccttattgccgccttctcccggtgcaggtcgtcgaaggcagaagttccggagacctgctctcccgatcgcaggtgcacgccgacgagcgggatggagtagtctacgagcgacggtgcagcacagaggaggaggcaaaccctagattgatttcgtgtgttttgcgtgaaggcggcggctcggtttatatagagataggtcgcttgatcagggcgctcgcacgatctccactccgcataaccgaaccggataagtcgcgcgtaacttatccggactccacgccgttttcacgcaccggat

SEQ ID NO: 92180 - DNA, 10069 bp, Oryza sativa
cagtgtttgctatgattaaagatcttaaagtagtgttcggaaaggggcctggaagccagcctatagagagcgaagatagtcacgcggcgatgtggaaaaagaactctatattttgggagttaccatatcgggaattcttggacgtacgccacgcaatcgacgtgatgcacctcactaagaacctttgcgtaaaccttcttggcttcctaggtgtatacggaaagtcaaaagatacactggaagcacgtaatgatctgaagcatatggaacaacgcggcgaccttcacccggaaccaaaggagaaaggaagccattacttgagtccagccagctacactctaagcaaggcagagaaggaaagtatatttgaatacttggagagcataaaggtaccgtctggatactccacgaatatcaagcgaataataagcatgaaggagaagaagttcacaaacctaaaatctcatgactgtcacgtgttgatgacacaactgctaccagttgtaataaggggtatccttccagaaaatgtccgggcaacaataacaaagctatgtgcattcatgaacgcaatttcgcagaaggtcatcgatccggatagattagaagcccttcagaatgaagtggtgcaatgtctcggcaagtttgagttgatatttctaccttcatttttcaatataatgacgcatctgctttgtcaccttgtgaaagagatccgtattctcaggcctgtgtacctacacaacatgtttcctttcgagaggtacatgggcgttctgaaaagtatgttcgtaaccgtgctcgtccagaggcaagcatcgccaagggttatggaacagaggaggtcatcgaattttgcgcagaatttatcgaagaccttcgcccaatcggggtacctgaatcacgccatgaagggagactacggggaaagggaactctcggaaggaaaagcaataatgacggtagacaacaatttattccgtaaagcccatttcactgttctgcaacactcttcattggtagctccttacatcgaggagcacttggctctagttcgcgccaggaacatcggtaagtccgatgcatggattacatggcatcacattgatactttccccacgtggctacgacaacatctcatgggtaacgagtcaatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatgcaacaactgccacgtattacggtgccatcgaggatatatgggaacttgactatggtcctctcaaggttcctttgttctggtgccaacgggttaggttgactggtggaggcataatgattgatgacagtggtatgacaactgttgaccttaacaaggttggatactcggacgaaccttttgtccttgccaatgatgtaacgcaagtctttttcgtgaaggacatgtctagcaaaggaaagaagggcagagggcctaatgagcctaagcgtcaagtggttctcccaggcaaaagaaaaatcgtcggagctgaggacaagactgacgaggattacgatcagttggataggcaaccccctttcacggtgacgattgaccctagcatcctcctatcaaatgaagacaccccttactcacgcagcgatcacaaggagggaacaatagtaaggagaaagtacgtgcggtcaatcgtcactgccgatgtaatgccgtaattattgtgtacacgatgtaaactattttggatgtattgattatccatataaatcaattgatgtatggcataatttactatcattcatatgctacatttaattgaatatcattcatatgctaattataattgactagaaaatttttaaaagtattaaatcattcatgtggcatttacagatgttaattagagtttttcacaatttaatttactatctttcatatgctacttatatatgactattcgaatttttaaaagttttaaatcatgcatgtggcatttacatatgttaattagagtttttaacatttaatttaatataattcctacgctaagtatatatgatgattacaatttttattaattttaaatcatgtagtatgtacatataaatcttaattagagtttttaccaatttaataatatcattcatatgctaagtatatatgattattagaatttttattaattttaagtcatatatttgcttattacgatttatccacttaatttattacagacaaaaataatttttcaaagtaattgtcattaatctttgtactttaaataatgttaatgcattaacttctattttagaaacacatatgtaagcaaaaataatatgcagtgctataatctttagtccaggttcttaaccctaaccgggtttaaaaagaatttggaaatagcgggaaaatatatttagtcccagttgatgagaacaacgatctttagtcccggttattctcaacaaccgggagtaaagatatctttacttccggttgttctcatcaaccgggactaaagatcgagggctatatatattcccgaagcgcgccctcgtcttctccaccaacacttaacgttttcggtcgatcgatctctctcggcctctctccttcgccgccactgcctagggcaaatccccgcgccgacgccaccgtatctcaccgtcgtctcgagctcgtcgtcctcgccgccacctccgcctcctccgccgccgccgcatctctggggtgagagccgccgccgcctctcccttcatcgatctccgatctcgatctctctctccgtcgtgccgcccgccacgagacgccgtgccacaacgacaccgcgccacgccgacgccgcgccacgccgccgccttcgccgccgcgcgcgcaaccccgccgcctccacgccacgccgccgcgcaacgccgccgccgcatgcaacgccacgccgccgccgtcgtcgccacgccgacgccgccgccaccgccgccacgccgccgcgccaagcgccggaccgatgccgccacaccgccgttaacgaacacgtgaacgagaacgaacacgtcaatatacgttgccgcgagaacgtgaacgagaacgagaacgatcgaacgaaggagagcgagaacgagaacgatcgaacgaattaacgtgaacgagaacgacaacgaacgtgtacgagaacgaacgtgaatgagaacgagcgaatgaatgtgaacgtgaaatgcaatatatatatatgttacttcgcatttatcctaatacatattttttgtatcttgcagaaaagacgtgttgtcggagtcgtccctcaagccggagtggaagagctagccctagaaggaattcgtgcaggcaagtgacgtaataatataaatgattgttatatttgtaatgcaattaagaatattagacttgtaattagacttagcatataagattgtgtagtgttctaatattatttgagttttaatataagattattttattgcaaattagacttagtatgtaattattgactacggaattggtgcgactcctagcaattgactattgtagtcttaattagacttagcatatacgcacgaaacacttagcatacatgactattttagtcttagcatgtaatattatttgatttttaatataagattattttatttgtaattagacttagtatataattactgactacggaattggtgcgactcctagcaattgacaatttttgtcttaattagacttagcatatacgccagttacacttagcatacatgactctttcagtcttagcatgtaatattatttgagttttaatataatattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaatcagtacttgaacgagaaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataatggaagtggaagaagatggacgtcctagtgccccggccgtagccgccaagaactatgtacgtcacagcggttgggttgtgcgggataacgtgcctgtcagtacggtgtactggcgaagaacaaggacacgcggagatcatgagagctttgtcctagattcggagaaagagatgctgtggaccataatgctcgagacattcacccttcccgcgggtacagaggacaaagtgaaaaggtggactctgaagaaaatggcagaacagtttcagagcttcaagggagagctgtacaagaaatatatcctgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcactacttggggtcaggaggctatagcgtcacgatgccgaagtgggaggagatggaggctatcttgattgagaggggtatcgaaccggcaaccgccaattggccggaacgatcgaagttctggtactatgctcatggtggaacgctcaacccagctgatggctcactggtcttcggcgatcagatacgagaggctgcgcgacgactaacagatgcagtggaagcctcctctcagggcacgttccgatcggacagatatagggacgagctgacactcgccctgtagactccagagcatccaggacgaacacgagggaaaggggtgattccttagaagattggtttcaaggaggacatccacacgtacaggagtcggatgaggagtaagagagataccgaggcgaagattgcagatctagagttccgggtatcgagctacgaactcagcatgcaagaggaggtgacaaggaaggttgatgaacgcatagccgcacatcggtcccatgatccccagccgaccattcctcctgcaatgatgagcccgtcaggaaaccgtagcagctgtgccttaacggggcaggtaggattacagagcatggacgccattcaaacacaggacgaatcgacctgtcccgttgatgacatcactcagcagacaccatctgagctgcatattccttacaagaacttatcaataaaggtaagctcgtagtttatatattttagatttagccattccgctagttgctgcttatatatgttgattactaataaaaaatatctcacaacatgaaggtggcgtcgggcatggccatcccaacggacccttcaggtacttaccactgcaggccgattccagcaggatactcgaaggtcgaagttgagttggtcgaaggcgcatacgaggacctcgagctggattaccctggaggagacggtgagacgcatctacgagacacaagccatgccattattctatggcgcaggcggtacatcatcctccctgggcgacaagcggcgtctcgtgcaccatctcctcctcaggatcttgcaccgtctcctcctcatgatccgccagcaccgtctccaccttaggctccagcaccgactcctcctcaggatcctgcaccgactcctcctcgggctcctacacctactcctccgcaagctcctcttccggcaccttcaaagtcaagggcccccccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccctagtgtcaggaacttcttcaggggtatgtctgcatctgtcaaggaggccatcaagctatcggactatgagcgaacgctgaagaaagcatcttctggaaagtccaaaccagtccctcagcttggagagcgaccaaaccaggagatcgagccgttggtgaccggtaaagaaatgatgatagaacaatttattactgacaccggtctaactacggatcaattgctaggagtcgcaccaatcgaaaagacggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatcaacgaactataccagctggacgccctcgacatctctattatgagttgctaaattttgtaagtatatcgttcagttaatttcttactatacgtctcctttaattaattatgtccttgtatataagtagactatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccctctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatatatatatatacacacacacacacacacacacacacacacacacacacacacacacacacacacacacacacacacatatatatatatagatatatacacatatgcatgagcataagatatatatgtagaaatatatatgtattaggcatgaacatatgtactgaaccaggtatacatagaatatatatatatatatatatatatatatatatatatatatatatatatatatatatatatatatatatatattattagaatagttctatcttacactcttcctttgggattaaataaatacgatacctttataatactttcgggcgaaatgctacaatggtatatccgtgcgcttgtggatcctttctgtaaaccatatatataccaggaccatttctagcgtcattgctagacattcatatttctagtaatattgttaagaaataccaacaggtgttaacagcgaaatttggcaagatagactcggatttcgagttggaattgaaggggaatcaaagaagattggatctttccaaatatggattacgcatcggttgggcattgcatcggttggaaatagagttggagtctgatttagccgatttgacaagtagccgactagcctgacttgggctcggtttgggcctcgattgagatgaccgtcattgtcgtttagagatagagctcatttaaggcaattgtatctattaattaggatatttatatcggtttgagttagagatatggtaagagtccatggtatggacttgtttgtattttatctttaggaaagcttgagtcgtgtccataatggacaagttttgtactcggggtaaaaatataaaccccagaccattgtaataggggagacaatccaatcaatacaactttcagcgtatcgccacccttttcttttacttttcgacgagttcttatttcaagttggggcatcggctacgatctctcgacaacaaaatagttataacacaacaaatttaataaagcgaatgtaataatttaagtcaaaatacatttcgcaaattatgtttcaatatgctcaaggagagcgtgactgaccttagtcaacgaacagttttctgctgccacaaacgatggacctaaattgcgagatgggaacctctaaaatgatagcaactacaccaataacaaaacaagactaaaactctaagaaagaaatgatcacattacataaaaataacatttttgggccctttaagttataaaaaattaagcaatttaaacgggtcaatttggacctcgtatggccaagatacgaccatccaaaatttagctataatttaaatggagacttccaaattatttaatcattattgtactattaaattatgtgtaatacatcagcgctcgaggagagaaaggaccgagcaactgattgtcgagacccatgggtaaaacaggtagttcaccaaggactgggttccccgagatggtccatggtaaaagcagagataagaacattcttcgagtcggtgagggcgacgcaacttcatcgaacgacgtgctcaaaggaggggatggtgttcctgaggtcttgataaaccctgagctgcactcaatacactcacggctatgattggcctgatctttcggggagttgatgataactctaatttgggagaacttactacaaccgtacgagacgctattgtgttgtgccttagcgatcgatacaccactccgtgggttgttgatcttgctggtgcaaatcaaccttatgactgcaagcaaatcaaataaacaagtaagaacaagataaaaaaaaaggtaatctgaattgctcataggaattgaatacacacaataacttgatatggaggcatgctcaaggaagagatcgacgaggcgtaattgacggcgacgacgatgcagcgggacaatgcttcggtgagtcgggaaaggttgccggaggaggaaggcgatggcatcaccactggtcactggcgagaacggttttctagcttgttttgggctcgacgaaggggagcctggggaacaggaggtggctgcaacaccaagggtggcagcgccggggtgctgcgtttcctccggtcgaaggggaggggttgccggagctcgtgtcatggtggagagagag

SEQ ID NO: 92181 - DNA, 1614 bp, Oryza sativa
aaaatctgttaggggctttctgtggcatggatggtgattctatacttcattgatgcacagaacaacacacttatactcttaatgttgatggtggagtcattgtggctatactttctgttgtcgccatattttatacagcattgttctaagtcatgaactcatgaaatcatgatccctagagctgcacattttcctctgaagtattcaggtagcctagccagttgtatataaaggacattaactacatagcacttctatcaagccattgcgctgtatatgtgcttaaaggttcgattaattgggctaactgctgaccactaaactccaagaaactgccatctcgtatttttacaatgcttatctggatgttttctcttggcagctaattcatatttttggaatggtaaacaatatttcagttgataacaattatcacttctccactgcaaaataagagtgtcttattctttttattcggagccacattaacagattgtgtgatatactgataggtgagggatatgcttggcgatggccgcctcataaaacggcgtgtagttgatggaaaaggtatgattgcatgtttatactgatttatggattttttttcccttgggttgaaacttttcacatgttcctggtatgcaccttgatattataacaaaatttatctttcataaaaattaactagaaatcttgtggtctttcccatccattcaactactgactagtgattactgaaacatgttgacttcttatcatttgggtccttgtgatacttgtgtttgctacaagtttacttttagttctttaattatttaccaggaacagattttctaccttttacttttattagcagaaaagatattgagtacataattaaatgataaaaaaaggagcaaataataatagcaaaaagtttctacacagtgaataactaccctgttgttactttaagagcatttttctattgccttctctgcatcgtgtcatcatcatgaaaatggaatgaccttagacttagagtcagatgctctctttatccaacttatagtggtaaaaagagttgcaaaatttagatgaagggaagaactcagaggtgtgaattacacaaaatgattcatcatttattcagctatttttatttcaaaactacaaatcttcaacaagccaacctttcacatggaattgttgtgggcgtgatgaggtacatgttttgattccatcatgtgatgtgcttgatgtttatacctcttttcgttccttgaaaatatcaggtgaatttcctatggactgtcctcttcatgatagcttgctaagagtgcattataaagggatgctccttgatgaaccaaagtcaatattttatgatacccgagttgataatcatggtgaaccattggagttctgttctggagaaggcctggtaaactttcacttaaatctttattgctgcaattattaactgcatcagttcttcatgtcaggtcataagacctgaccaaagtaaagaacggtgccctgcggtttcgtttaatttttcttggggaacctcgcattctcctaaaatctgttcccatttcttataaagttaaagcttcctggtgaatctgc

SEQ ID NO: 92182 - DNA, 4549 bp, Oryza sativa
tgattgcaacaggccagcgaatgttcctgaaggagctcatgttcaatgggaaattgaattacttggatttgaaatgcccaaggtagtgactaaaaaacagtcacaaaccttttgtatttccatgttgcttgtgcagtgttagaaactagaatgtttgtgatgctattcctgctctctattgcggggaacacttgggattacaagtagctgttaatttcaacccgcaatcggatcggtttgaaagttgtcctggttcttgtgagtctgtagctgtgtcccgtgatcctttattgcttctagcttttcagcgaacttgcattatgttttcatgtattgaatagcagaagaaagtaataagcattacatgtcattctgaatatttcactagatgaacaccttgtcttgtgtggttcaacactatttcagctatggcttctttatgattatattatatcttttccctttcgtttttttattaagttctgtctgacaaatcttctgacttctcatataatacaaatgtaggattggactggtttcaccttccaagaaatcatggatgacgcagaaaaaataaaaaccacggtatatcgattgagattgttgagtgaatcattacattttgttttgtttttggtgttttttccacttagtatctccctgaacctatcatgaatgcatttttccagaaatgcagtgcacttcaagaaactgttgagatgtctttaattgaaaaacataaaactacttttatttgtgttctatgtgtgcaagctgtgtttctcaattgtcaagatggccaattgtttagtatgatcatatgaaaatcctggagttcccataatgccatcatctaggtctaattttgtggtgatgtccaattccaccttgtggaccactgcaaaattgtgatcataggccccttttgaaacaaaggaaaaaccattggagttttagagaattttatcctatgggaaataatcctatggagccctttgaaacaaaggattgtttcctacccattcctttgaaattcctatggaatgaggtctaacctcatgttttcctcttcatgtgtctagaattcctgcgtttttcaggtgtgctaatcaaatgacagttttaaaactttcatgtgtttcaaaatcctgtaggaatccaataagtatgacattgtattcctatgtttttcctattactgtgttttctcaatcctgcgtttcaaaggggccctaaatatctatacctgttgtccacttggctggttttgatgtgtcttttttcactaataattagctctaaactgaagttctctctcagggtaatcgactgtttaaagaagggaagtttgagctagctaaggcgaagtatgaaaaggtatgcccttcacatgattcagcattcaatattaagggcaatctcggaacattttttttcttctccattgctatgttggtctggatattatctctttcccgctattgttaccactccatatggttaccaatttggcagtctatactatgaatgattttaccttataatttcttgtacatgtaaagggcataaatttacacgtatccatgacttcattctgtcaattttttgggtgcacacgtttttcttttatttatttttgtgcaaggatatgggtgagatgttttcaaaccttctctgcctgcaggtgcttagagagtacaaccatgtgcatcctcaagatgatgatgaggggaaaatctttgctaattcaagagtatgacagcactattttcaatctttttttccctaacaatagcatagatgcctgattagaacatttctttgaaacatgtacctctgattagcactgcaattcaacaattgtttctgctttctgaagcatgtgtttacctttcatttttgtttttcttttacacatgcagagttctctacatctaaatgtagctgcttgctaccagaagatgggtgagtatagaaaatctattgacacatgtaacaaggtatgtttccaaaaagaactttgtactctcaaagaattttcctagggtgtctatatcaaagagggtggtgcatgcttgtatgggggctgtcattggacctcttccgcacatgccactggatgagccttgtaatggatagatctggggatccaatcatccatccaaggggaagatagatgtaaacttttgcttaccactcttggatcaaaatttcgaggagggacatcacatttttagtttctcctagtctgatctgctgaagttcacgcaataacctcgtgaaatcttgatgatagatagtactcacatatgagtttgcacaaggcaaccatataaccatgaatgtgctggctggcttgttttgtacacattatggtacttggcattgatatcattgtgaagtgagcaattattccatttactctttgagcaggtgctagaagcaaaccctgtgcatgtgaaggctctttatcgccgaggtatgtcctacatgttattgggggactttgatgatgcaaagaaggattttgagaaggtgtgtttcccccatactttagtacctgcttattttctttttttatgtgtcatggatgattgtttgacctctacctaaagcactatgtcactacatcttttttagatgatagctgtcgacaagtcctcagagcctgatgctacagctgcccttaataaacttaaacaaacaattcaggtatgcaacattacatcataaggtgagacccttcagaactgttgaactaacaggagttgtatatatatatataatttctaaaacaggaaactgaaaagaaagcgaggaagcagttcaaagggctgttcgacaagaagccaggcgagatttccgaagtaggtgtaggagagccagagggcaacaagactgacacgacaggctcaggcgaggcagcgtcaactgctgacagagacacggatgcaaaggaggctattccccgtgcagattcagggttggccttcgaggaagagaggcccggacttctcgcccgcatctggccttcagcgagtcggatcttctcctcgcttgggctcaacaggtgcacaatcctctgatgcaccaccagtattcaaaccactacaaacagcagccagaaaagtcgcccagcaaagccctggaacgcattacacacgcaaaattatcaccttggatatatatctctaaaaattatactccattacatggtgtaggctgatgacctataaatgaggtaggcgtagtagtaacgagttagttaaggacatacggagtattactgtggaaatgcatttgtgcctgccatgataagaatcactaccactgccacctgatagagtgttgatgatgtggtgtgggccccctgatcctgagcgtgcgtagtgtaggtgtagtaggtaagaatgagactggcttaaccgggtgtctcttccatggctgtggctgccgctggttcttctggtcttctagaacggtgccacccgtttgtcggccaacgcgtagcagaggccatacttatgtgacatgattgaattgccattacctaacacctctgataatgatgtttcccataaaaattaaacctagaaccggatattacacatcctaatataacgaatctaaataaactcggactagatgtaatatattatagtataattaatgtggacaattacatctagttctaaatttattttctatgagacggagagagtcacatctgattttagattttttttttttttttggaacggagggtgtacatagattcaaggtggtaggcgtgtctacagtggacgtgcaggtaaaagcatatgctaatgcggcttggcctgctgctgctgggattccggtagatttgcttgtttcatcgccatattcagcccatatctccttgttggtgttggtgatggctattagtaacaacgtgaccttttaacaaaatatttcttgttctcatatcaatctctctactatttgaggaacttgcttggggcctttgagaccatgttcaattaatccctgtgagggggcctttgagaccatgttcatgttcgattaatccctatgaggaaggattaaagggaatttagtccagagttattgtggtgtgaaattatttctctctcaatcccctcaaatctttttcaatcactctttataccgaatatgaggcataaacaaggacttagggttatgtatccctcatcccttctagaaactccaggccgatatgatgaagcactgcaaacagatactttttcttttagggactggctatatgtctgttgatagaaaatcccacctcccatctttcaaatttttgaccgtcagatatgctttaagattcgtgcagatgtattaaccctaactctcctcccgttcccctcccctcgctcattccaccgccgccactccctccgatcgcgcattccaccgctatcgcccgatcctccaccgccactgacccatcgcaccgccgcccgcctcgtcggctggccgaaaggcgtcaacagcgccagcaaggtccccccccccagcc

SEQ ID NO: 92183 - DNA, 2729 bp, Oryza sativa
ttgagcatggcgcgggggcggttggtccgcaaatttctgaagcccatcgacgtggacctcaacctccatgccggggcagcaaaaccgcgcgggggaggacctgggagcaagggatggggaggagggcggcggaagaaggggcttcctcggggatttgcttgacctgtacccgcgtagtgggaggcgatgatcgacgaacggcagcaagtagccggcggccatggccgactaggggcggtttcgttttctttccatgcgtggtttttccccttcgctttgactgcatatgggccgaaccatcgcgcttctggactggtcgaaagagggcggaggctagagaaaaccggcgctgccgtcagatgcgaaataaacggcgctcaagccttctacatccctctgacgtagaatcttgggaaactattctaatccctcgaggggatgttccctcgtttgctcaaaaaccatctaaatggttatgaaaaattctagaaaatttgacaacattcatacaacacatatatacaacttcacaaaatcgtaagtccaaactcaactcacacgttgagatataaaaaagacaaattcagcgtatgaatagtagcatactgtttatatctaaatttgtcttttttgtttctcggtgtgtagatcgaatttgaacatgaattttggtggactagtaggtatcattatgctctacattgtcattttttttagattttttcacaactatttgcatcgaatttaaaagaaaaaggtatacgaggggatatcccctcgagggattagaatccaccccctagaatcttctatgttagaggatctggttccggcattggaggggaagaagagactatttgcattgagattcgtactggatcagcctcgtagccgaagcgcgatgtgattctattcacatccaaattaatttcagaacactataaattaattaatacttctaaaactatttcacccggacacaactaagctaaggaagaacaagaaaactccactcctcattaacaatattgggtgcttggcaatggcatcactggtggagaaaccctttgtagtcccggttcgtaacccccctttagtcccggtttccaaaccgggagtaccaatccgggactaaagatcgctatctttagtcccgggtgaaataaccgggagtaaagatcgatctttagtcccggttggtgttaccaaccgggactaaagatcgagctgaccatttttttttgcatggccctgttgctgcatggtttatatatatatatagtttatatatatatatatatatatatatatatatatatatatatatatatatatatatataaaccatgcatatatatgtttcaatacatatatatgcatacatatatatatatgtatatatatatatattatattatattatatgtatatacatgcataatatatatgtatttatacacatatatatgttatgcaaattaatgcatatgtatatagatatatatatatgaccaaaatatatttacattatagaaaatgtgtacacatgcatatagaaacatatgtagtcatgtattaattacaatccattatatgtcctagctagctagctatcatttcgacgtagtagtactcgctgctagctcagaagctaaggaccggtgaattgtgtttccgtcgtagtagaattcacccttgggattaaggatttcttcgttgatgaatcccatgagttgttcttgaaccgccgtgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtttgcaaggcagtggcaatactcgcacacgtaatagccgcacaagttatttccctgcttttgctttgcgcactacaaataaatgacaaacaacgagagatctaattaatatacacttgtatgtatttgaatcggagaaatataaatatagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcaatgcgacgtttactctccgagggtcgatgaatccagtatcgaaaaccctccgccgtcgggccctttgaatctccattctacaacgataaaagggagtatattattttctatagtctacttatatacaaggacctaatttattaaaggagacgtatagtaagaaatctaaccgaacgatatacttacaaaatccagcaact

SEQ ID NO: 92184 - DNA, 784 bp, Oryza sativa
tttcactccggcttttcgattggtgcgactctagcaattgatccgtagttagaccggtgtcagtaataaattgttctatcgtcatttctttaccggtaaccaacggctcgatctcctgttttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttgtcggcgtcaactttcgccttcttcgttgcccttgtgtgggcaggcggtgcagctgggggggcccttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcatgaggaggagatggcggagccggaggagatggtgcacgagacgccgcttgtcgcccagggaggatgatgtacgcctgcgccatagaataatggcatggcttgtgtctcgtagatgcgtctcaccgtctcctccagggtaatccagctcgaggtcctcgtacgcgccttcgaccaactcaacttcaaccttcgagtat

SEQ ID NO: 92185 - DNA, 2680 bp, Oryza sativa
actccggggagcttgatgaaggggcttattcggtctggtgggggtgacgcgacccctgcggagggagatcaggtcagagcattgtgtctcttgttttccgttgctaggctgtggctgtgcgattgccaattgtgcttacaagttgcaaaccgaacaaggattgtttcatctcacaaaattaggatcgttcatcagtgaataaacggaggcagtatatgttgtgcacatgatgttatggtattgcctggcattggacatatagtatgtaattggaaacaagaaaagctaagcaaattcaattaaagagcgagcatctagtaggcgatttcgtagtaatcaacaaatcgtacaatgacttaaggctgttcttgtaggctgcaagttttgattaccaccagtgttctgcattgggtttttaaatgaattttccagtgagaactgtttcaagttttacattaaccatagaaagtttttttccttgatggaattctatatgttggaattctaagtggctctatttgcctgcaatcaaaacttgcacctgttcaacacaaacgggtcaatttgaactgaccatgtatggataagcttctcatctcagagtatgtcagttgactattgtagcgactacactgcaaatgtgttattgtttctggaagcgactcaccaagctctgcttggatcattgttttgcttatgatttttctaaaatgaggatcacatttctggtttcaagttttaatggggatcacatttctggtttcaagttttgagatgtggaacaatcaatctactgcaaaagaaatataaccttcttgatactgcactgctgtctaaccctcataatagctatgttgacctttcattgggtgatatctgacttcatctgtagcctgtagggaactgaggggcctctgggtggtcatgtttttgctcattcaaatcgttttgcaggttatagttcattgcacgactcggacaatagatggcatcattgtcaattctacaagaagggagcatggaggtgattatcaacttcttttcacttttcagctcttttgactgtcaagtgcttacgtggtgtgtattttgtttctgaacaccaatatgtcatgaggatatttctgacttgataaattcgtatctgctttatgtgtatatataatgtgtcatgtgtggatagtggttccgtgttcacaagttctaaatagctgcgaatatattgtttcttaaattgaacatctttatatgctggtatcctatttagtggttttaatcagggatggggcatagattaaggtaactgggctatggttccccctagtctttgaactatttgcattagtactaaactactaatgaatatgtaaagttgaacatgcccatccacccggtttactctagactcactgtctgcatgttctttggaattgaccaaattaactagtggttagtactgcctactagcaaggctgagccttgttcatggacggttcattctgtgtgtgcaatagaaaagctgaacaatatttattttttgtttgctaatcatcccaaaaagttttcaggaatattcttatctttcaattaactgttacatgaatttgtcattactcattatgagcaatattattgtttcatttgtatcagtaatcagctcgtctcctggagttctgaagttctaaaccatcttctgttttactgttacaataggtaaaggggtcccgctcaggtttgtcttggggaagagcaaaatgatccttggctttgctgaaggctttccaacaatgctgatgggtgaaattgcgatggtatttctatacagctagtttaaaccagtgggtcaaaagaacaacaacattctaacaatgagccattactcttcttttgggtgtaacaattaaaaatgtacaggtcgtactacgcaaatatttatcattctctcatagtatcttttcgcagttcaaaatgaagcctcagatacactatgcagaggaggattgtccagttacagctcctgacggctttccaaaagatgatgaacttcaatttgagattgagatgttggatttcttcaaagccaaagttagtcttgttgaataatggcttcagtgtgacttaaatccttaaattgctgtatatttgagagctattctgtgcaagctgttaggacaaattctcatgagctttgatttcatttttaataatttctttctggtacagtatggattctagaatattagccaaatgtttgactagaaccttgtgtccaagatagcagacgcttactacatctttttttttttcggacacgcaggagatcacttactacatctatcaccatgtgttataaagtgtttcatatttcacttcataacccaaacaatacttgtggtttctgattctttagcatctatgctgttgttcaggaatatatctcctcaagtacagcaccactataatgcatatatcataagaaaatgtttgacaacaatattgatttatttcatctttatgttcgtgaataatattcatctggcatcgtgcctgcttgttgtgatgtatctcagattataccataagtttgaagcctaaaattcaaaaaagcaaaatgtatctttgcataaaaaagtggcagatcaacccaatactgcatatacacatgttcttagaatgcagc

SEQ ID NO: 92186 - DNA, 561 bp, Oryza sativa
attcctgcagcccaaactgacaagtaggaggtgctggttgttatttctggactagcattctcctaaaatctgttcccatttcttataaagttaaagcttcctggtgaatctgcattacaaaaatgaggacttaaataaacttaaagaacgatgaacaagtatgcattcacctttaaatattgtacatgataataatggcaactcccagtagggtttcaggtgacagttctatatacttattgccctctctgtacagacatttttcctctgagaaaagggtggaaaaatgactttgctagcattctacagctatatatgcacctcattacatatatcttggtgttcatgtatacttctcatacttccaattaaataagagtacctttgaacattttcataggtacctgaaggatttgaaatgtgcgttcgactaatgcttcctggtgaaaaatctattgtgacctgccctccagattttgcatacgataaatttccaaggttgtatgtggctttacattagaatcttttttcttgtaatatagcgtgctgaataatctaatg

SEQ ID NO: 92187 - DNA, 1072 bp, Oryza sativa
cggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagttcaaatcatgtatatgctagttatatgtgatacttacaatttttaaaagttttaaatcacacaggtggcaatttcatatgtacgttaattagagtttttaacatttaatttactagcattcatatgctaattataattgactattgtatttttaaaagttttaaatcacgcaagtggcaattttatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatatattggaatttttattaattataagtcatatatttgcttattacgatttatccacttaatttattacagacaaaaataatttttcgaagtaattgtcattaatctttagtactttaaataatgttaatgcattaacttctattttataaacacatatgtaagagaaaatcatatgcagtgctataatctttagtcccggttcttaaccctaaccgggtttaaaaagaatttcgaaatagcgggaaaagatatttactccc

SEQ ID NO: 92188 - DNA, 1394 bp, Oryza sativa
tacacgcctgctgaaatttgcaggttgaatggtgcgttctaatactagaattagaaatgttagcacaaaaaaaaacatatatacttcataatcagaaaccagctgcaacaccttagtcatatgctattataacgatcggtggcttcagatctacaatgattgtccagtgaacaaaaagccaatgcattgcagtggacggaagccaatgagtgaactagtagttagttaattatgtccagagttcaagataaagagggtggcaaacctggaaatgtcgcatatgcaaaatgggctcacacccaacctctgcaaccaattttcccagaggagtcttagcattgaatcggctagcctgataggcaactaatctgttatctctgtcaggaagctgatggcatactttaagcagtgatcttaaagaattcatctgcatggaaaggaagaattagagcaaggtaaacaattaatatcataaaacaaacataatctcagggaacatattgtaatttcttcaactgccataagagaaaaatcacaagaaagtaaaaataaaaatgaaataaagaaaaagacagaaaaactcattagtgtttcatggttaccaagctaaagaatgcaaaagatcaatattttttttacatttcattattatgaaataacaaataatacattatctatacccctttaaaagtatagtggtggtggcagtgagtccgtcaccccacctgctcccattataaattctgcaaattgcccctttaacttaatattcaaaaatcaaatccaaatggatagccacgtggaaaataaaattgatgtgaatattccctgtggcaaaaagatgggtaaagcattttgtgaaaaatatttttttatttaatcaatattataatatatttttattttttccatagcaaagcacgggcattaagctagtaaatgagaaaaggtttttgtgatgtgacatttcttgacatcttgattcatgtcttaaataaaggctctgcttccatggatgtatatagatgtcttgaacaaagcttacatgttcatttcaataacataatcgaaaagcttacgtaaataaacaatatatatttaatcaccaccaaccttcatgtatgggcatgaagcgcagcccccatgtatagagcaaccttcgccagaactcacaccaggaacaacactaacattgtctaaatcagtaactgttgaagaatcaagatggtgggaaccattgacagatgtattagaaacagcatctgaagaaactgggaacacgatttcaacttcaatattggcactttgttgagaagttttataggaatcaaataattcacggacagcagcaacaatagaagtgatcattccggattctgttcctaacacaaact

SEQ ID NO: 92189 - DNA, 3548 bp, Oryza sativa
tcacgtgtgggcctcttaaggttccgcacgtaaaaataggcttatttttgcgtgcggacctcttaaggaacccatgcgaaaatcgattttcgcgtgcaagcattttaaggatccgcacgtaaaaatgggaggacgatttttctagacgctgtcagttatggaccgcctgaaatctaagaagtggtcgtccaggaaaatcattttttatagtgccggtgccatagatatgacttgtagtctcaacagaatgctgaaacatcccctcatccgagatgctttgacaaataattgatacaatccgcgaccaggtgctccatagaacacgatgtctgtgcatcttttcaccaccatgacaagattctcaaaccgcacttgcacattataatggagtacttgcaatgctaatcggacaactcaacttccaaatgccattcgtgttggaaaaattgatctctcggtttgaaaaaccgggaggagatcgcgctacaccattttttccacccgttgtctacgcaaaatcaaagcgattcaatttgttttaattcttgattaactacgcgccattatcagtggcgcccaatttatttccttttgagtcgcccccgattccctacagcgctaaatataaaagaatttgttttaattcttgattaactatgcaccatgatcggtggcgcccaatttatttccttttgagtcgcccctgatttcctacagcgctaaatataaaacgggagaccagcccaagagtggatgacgatctctctcaatctcaatcttcccgacaaccaaaccctaaacccgatcaacatatgcgctggaggagaaacatgtgcagttccgagacaatgtaggtgacgaccagaaggctgccgctaccccacaagtgatcgccggcgaccctttcgagatcaagccgacatcctcaccaacgatacgcgaggtggttcgaggttccgcgtcatctacacccactctagttcaagctagaacaattgcaatggcttcaaacaacagtaatttagacctatcaggtagcacgctacctttaaaggcaaaataaaaactttggtttcttctccgtcgggtggaccaagatgcaaagaaactaatttgatttaacccaaaattatcaaagagaacgcatacctgaatgtcagtattccaggtggagtacctttaacggagctcgtatttcatattttcaaaaatcgacatgagataattccacctgtaaaggtcaaaactaaaatttggtgcaatgcacaaatgccgcgtcatctttaaatgcaacgaaggcatcaattacaatatgacgatacgactgtagtgccctgcgttgcaataactcgaagcacaccaagcagaggccagataaggtgtgcggcggtgcgtttttcgaaggggaaatcacttatttttgttatagagcaacactgaatcaacctatttacatgatcgctgaaccttggacatcttagaagtcactttggtagtacaatctgcatgctgcggacaaggtgcagataaaacaaaattactacattgtcaggcagacactctcacactcctatcttcacacactacactggccggggtaaagacggatccaactgagattttcactgccggtggccctccgggagaggaaccactctatagaacggcacagctctttgtggtagatttccatcctcctcgtcatcatcaaacaagagtagataactgccaaaaggaaataagacaagcatattttcaggaaaagcaaatgttgctattgaaatgttagtcataagaatattaagaagaaagtccgattaaaaccttttacacaaacatgtatgtttattttaaggtccagtttgcttggtaccatccaaaaaaatcatccgagttggagaatccatatcacaccaacttttggggctcactttttgtaagtaattgatttttttagcagacttctgttttttttttcgagccagaagaacttttttttggtccaaaatatggagttttggaaggcccattgttttttgttctaaatattgagtttttgtaggtccattgtttttgtttagccataatgagttacatgctggaaggaggaacaaaaatatctgaacacaaaaaaaaaaagatctcgctggaaacacgtaatgtatgattgtatatgcatagcttattaagttatggtagaaatacaaattttctccagatactgcagtaaggtagaaatacaaattaaacaaatacagaaccatcctaaacacataaaattaaatagcaacacatgagactatacaaagttgtaaaaacataaatacttactcgtcagatttcctctgcattgtttgtagcccagtttcacatcagcatgatgacagagcaaaaatagttaatcacttatcaaacaatagaaatcatagaaatgtaatagttgtaaaaaagatactatagatggctctgcaaaaccaatacatgttagggaatcatttgtggaataaaatcatgtccatgaaacataatgttgaaattcttcgtataaacaagacatgtcacacatgtaaacggagcttgctggtattaacagcatagtattattcgatagtatcatagtagtaatcagattagccactaatcaacaatgaaaccaggttacacgtttctgtttcagcccttctaagttttcagccctattttggcagccaatagttcatcagtcaccactcaagaccaaggtggtaaccaacttctcaagttcagaccgttagaacaacagttagcatgagtttggatacaaacaatcttaatggtttgtttcgaatacatgagttttcctgattccttcaaaaaaggaactactaggattcctgtgagatataggattcctgagctccaaaggagagagccctaagataatcaaattggcatcagagctcaaaatcttggtggttactgattcagagcctgtgaccagtcaccaacaatctggcaggaagagtttaatttcgaaaactaaatttgaattaagaaatcctcgcaaaaaatgaattaagaaaatgtaactggcaggcagttaccagtatttgaattaaaaaaacaaagaactcttaagttatgtattagaaacactagttgcttactcaagactaagaaatcatatttccatgtatatccagtaaaataaggtttcggggatgggtgcccatgatttctttggcaactggtttttgaagccttgattggcatatggtgtgcaaaatagcggtctgtataacagaacttataatttattatcgcaaagcaatgcttatcaaacatacgataactgtattcgaaacgaaccttgattgacttagtggtcccaagataatcaaactacatcccactaagtcagataccatagccaaccttaagacaatcaaactgggatgtagtgttctaaatagtgatatgcaataggaatttgtaatttgttatagcaaaactatgcttattgctatgcaaatcagtgcaatttatactccaaaaaggagtggtggtgg

SEQ ID NO: 92190 - DNA, 6647 bp, Oryza sativa
  unsure (1)..(6647): unsure at all n locations
caggttgttcagcaggggcattctgttcttttgttttgctccagccggaaaggctgtgaatcaactgcaagacatgttgccaagtttttgaaagtggcttctgttggatcaagtgacgttggctcagaatttccagatgctacatttgcagttgaagccttgaagaggagcccttctgggttagatcctgtattagaagagacccttccctctggagttgcataccatcatgctggtttaacggtattgtaattttactataatttctcatatcatgccatgaagagttggtggaccttatttatgccattgtcgttgcccctaagcatttagaatctgcactgcgtagctgaatgaccttttttttactacattttagtagatgctgttttgaatttattactaatttctaaaaccattccattacttcatgacaacctttatctttcagtaggactgtaggaaacatgaatgtatgcattgtacttttcttgatgtctattttgacaactattctcctagctattgatgatcgtgagcttataatatgtagtcatttctgtttcatacaagtacggctttctcttttggcaggttgaggagagggagattgtggaaacatgttaccgtaaaggtcttgtcagagttttggctgccacttcaactttagctgctggtgttaacttgcctgccagacgagtaatatttaggcaacctaggataggtcgtgacttcattgatggaactcggtacaagcaaatgtctggtcgtgctggtagaactggcatagatacaaagggagagagtgtaagatatgaaactttcatttatactagatgtttcccatgaattcatcagcttagtttcaattttttatttatgtatctggttgtgctgatgttttcttgtttatgaatgtctaatactttgatatttgaaatgtagatacttgtatgcaagcctgaagaggtcaagaggattacaggtattcttagaagtaactgtactcccttggagtcttgcctctcagaagataaaaatggaatgactcatgcaatcatggaggttgttgctggtggaattgtgcaaactgcaagtgatatccatcgatatgtgaggtgtacgctgcttaactctactaaaccttttgaggatgttgtgaagtcagctcaggactcccttcgttggttatgccataaaaggtttcttgagtggaataatgaaactaaaatatactctactactccacttgggctagcagcttttggcagttcacttaatcctgaggaatcgttggtaggttactttctttagttattttcaatattttttaaatttaatcttacaattttctatttctctgtgtaggtcgtgctggatgatctttcaagggcaagagaaggctttgttctggcatgtgatttgcatttggtttacctggtaaccccgataaatgtagatgtcgaacctgattgggaattgtactatgagaggttcatgcaacttacttctcttgagcaggtatttctgttgcatcttagaacgttttttctccaacaattagtctgagtacatgtaatattttcatatcctatttgtgtatatcaatagtaaaggaccacagactgattcttgctattgtctatattgtccttatagcctgacaggcaaccatccttttcaagtgaaaaatgtatatatttttctctttacccaagtaaaaaggtgaacactaagatgacatattgagatgatcagataacttaaaatgtatcaagtgatgttgtcaaggaggtggcattaaacagtatgttgttttactcttattgtaaaatggtagtgatactaaatcaaataatattcatgtaatgcatcacaaggccatgaactcatgcacccactttacaagttcatggcactatgctagaacttactctattttatctatagtattgatgcttgttggtaatgtgcagtcagttggcaaccgggttggagtaatagaaccatttttgatgcacatggctcatggggctgcaatgcctgttcgtggaaaacctcagcgtgctggtatccgcaacaggtcaccaacacgaggttctggtggaaatgcacttattaatgagcaggcacttcgagtttctaagcgcttttatgtggccttgatgttgtcaaggcttgctcaggtataattcaactctgcaagattgtatcatcaatttgcttactattcctgaaacctagtagtatgttaacgatctatctctgccatgccagcaaagtgcattactctaattggttttggatctttttttatttgtaaatatagtatgattgaatatttaatgaagctatttaatgtattgtatctttcaggaaattcctgtcacagatgtttgtgaggcattcaaagttgcaagaggtatgattcaagctttacaggaaaatgctggcaggtttgcttcaatggtttctgtgttttgtcagagacttggttggcatgatttagaaggccttgttgctaagttccaaaaccgagtctgttttggagtcagagcagagattgcggaacttacatcaattccatttgtcaaggtttgcttatgtcactttgcatgcatgataaatcctaagttttgtcccatcatatcttcctacttatttttatatgttaatatgttatgggatgcagggttcacgtgcaagggctctttataagtctggtttgcgtactcctgttgccattgctgaagcatctattcctgaaattgcaaaagctctttttgaatcttctacttggtctggccaaggtctaatactctagctatgtttaaactttctattaaaatatttgtgtatgttgtgttagtctgaggttctgagactacagtagtgctgcaatgatggtggtggtggtggtggtagcagtagctttactattagagaaatggtgaaagtaatagctcaaaagccatcaaactcgtaaattagtactcttaacaacctgagaacaagacttctcttcctttggagatggctgtaatgtgtagtccacattggcattcctttctattttctatttttgttttcctctctttttgttcaacattttggatcagtttagtatcaaggggtcagattcatcctattggcttatttcttgtgattttcctgccttgtgtaataatatctgttcaatggactaggtgattctggtttacgccgaatgcaattgggtattgccaagaagataaaaaatggagctcgaaaaattgttcttgaggaggcagaagcagctagagtagcagcattctcagctttcaagtcacttggtgtacaagttcctcagtttactacacctctactcccaactatcgatgaacccccaactcgagatagcatggtttctgttggcagaggtcaagctagtgatgatacaaataactgcttcagttatggttctcaaagggcttctacagagagaactttagggaacgatatgcaccctggttcttccatacaaataacagagagtgcaagaatagtgaataatgccaacatcgttgtccaagtagcatcacctttctccatagaaactaaattaagcagcagaaatgtggctgacaaaggccctgttaatgcatataatttcccaggagggtttgacagttttcttgatcaatggtctactgttagtgagttttcttttgatcttcattatgtcaagaagtcaattaaatcatcttcaacctatttcgatattcttggtttggctgtctgttgggaaaattcacctgtttactactgcaactttccgaaagacctaatgatggctggtagcaatgactccattgaaatgtgggacgaactaacgagaagatggaacagagtaatcgaaattatgcgacaaaacagtgtcaaaaaaatgacctggaatttaaagttccagattcaagcattgaagtatccctgtgtttcttgtcaacggctctctagacttcatcttgactacaaaatgttgaagaatgttgaagtcctcgacaacttgtatgttttcctacaaccagtttctgtccacagtggattggacatatgcttggtggcatgggttctctggcctgatgaggaaagtaaaacagtgccaaatcttgagaaggtataatatcttatgctgtgatatagaactcatgcttggtttcctctttaaatgttttcatggcaatctctttcaaccttaacatttcccaatgatttgttaattttttgacagaaaagatttcttaattttgatgctgagatatttcagaaaatgtactttatttgtaatttttacctgatattaattaatagttagtgaagagacgactacacaatgaagctgcagcagctgcaaatcgagatggcagatggagaaatcagatgcacaaagcagctcataatggttgctgtcggcgtgctgcacagacacgggcattgtgttctgttttgaggaaattacttgtttctcaaaatctcaatgatttactcgaaacaattgagggcccattggtacgttctacccttgccaaaatgcaatattgtcatcaaatgctttgacattcacattatatttgttgggcaggtaaatgttcttgctgatatggaactttggggaattggtgctgacatggatgcatgtctccgtgcgaggcatatcataataagaaagctgaaagaactagagaaagaagcttataaattagctggcaagagcttctcactaannnnnnnnnnnnnnnnnnnnnnngttctttatacacacttaaaactgccagttccaaaaggttgtgggaaaggaaaattgcatcctacactgacaagcagtccttggaccatctaaggtataaatttgatctatttgttgtgtgtgtcatttctaggcattgcaaatttattatattagcaagtgtttttttttcctttcaatgtgccagtcacaaacttttcatgattcaagcatttttgaaatttaaaatgtatttccttgtatatctagtctcaacaatggttcactgacataatgtcttcatgttgtattatgtctggattgaagtatccttgtgtccattctagtttctgcatgttgaagatgtcattacggtgttgtcttgatctaagctggaattattggggtgccatcacattttattattatgtctgattacagtatgtttcaagagttgcatgtcatgtttggcttggtgcttcaaagaattatagtaaagtgagggtcagggaaggaagaaaataattcttacgcctttcagaatgtcatggcaatgctggctcagaatttgttgaacatgccaatgagttggccagggaaactttattacaagtagtgctgtaatctgtatattcttttgatgcttcactcaaccctcacgtaattttttgcaagtttcccaaggaaagtgtttgcactggtaacaataagatttcagtaaatgtggagaattgctcttgttgaacttctaacttagatcatcactccgtctaatagtcttttgctctgtttattcagggattgacatgtatttagagatgctttggttttgttcatttttaatacagtgtcatattattatgctctttttattcagggatcaacatccaattatatctgtaattaaggaacatagaacattggcaaaactgttaaatggcaccttggggtccatttgctcacgggctcagttgtgcagcaaatcacaaagatacatcatacaaggaaattggctccagacatcaactgccactggccgtctatcaatggaagaaccaaatctgcaggttatgttacattattgctagtgttttgtataatatgattatattcataggtcatagcaatgattgactgcattttttccttagaaaaaaaactgactgaactataatttgtagtgtgttgagcacttggtggatttcacaacattgaagaatgatcatgattccacaagcatgtcaatggttgatcatcatgaaatcaatcctcgtgattttttcattcccacccaagtattgctcactcaacaattgtttcatgctgtatatattttcctatcgcaagtaaggtaattttgtggtctcctttttgctaggagaattggttgctggtaacagctgattactcacagatcgagctgcgtttaatggctcatttttctaaagatactgcattgattgaacttctaagtaaaccagatggtgatgtatttactatgattgcttcaagatggactggtaaagcggagtccttgatctgttcaaaggaaagagagaccaccaaaagatttatttatggcatcctctatggaatgggtgccaactctctagcagaacaacttgaatgcagcccagaagatgctgcacagaaaatccaaagttttaagaggttctttcctggtgtctcttcatggctacacgaagctgtggcatcatgtcgtcataaagggttagtttgctttgtcatagccatttctgccttttatgctctgatatgttttccctttgatttttttatcttttcttttgaggtgaaacattaggggtagaccctactgaagtatagagtaaattgcattggtggtacatgaacatttttt

SEQ ID NO: 92191 - DNA, 3573 bp, Oryza sativa
gctagggcgcttccgacggcgaaagacgaaggcgagggtggcgacgggaagcggaggacctggggatccttttataggggttgaaaggtggcggcgaaggcccacggcgaccggcgacgagaaggaaaggttagggttcggaggagagagaccgatctgaatcgacctcgaatccacggatttccaaacgaaattagccgatgattccaaaagagaaaaggtagaggagatcccgaagaacatttcccctctattgatttcaccggagaaggaaagacgcggccgaatttggaaggagacgacggcggcgcggcgctagggttcgggcggcggcgactggaggaagacgacgggtccgacaggtggggcccacctgtcagcggctgagagagaggaggaaggggcgcggcggactgggccgactgggccggggagggagagagaaaaagagaggttttgggtcggctttcggcccaaagccaaaagagacttttaaaaacctttttcaatttaaattattcatgaaatgcaattccatttattaaaaatacttccttggctcaaataaatcccagaaaaaaatctaggaaccatagaatcaagtaaagtatttaacaaaattttatctagcccaattttatattgagatttagcaaattaaaattagatcttctcttttagtcttttaagatcatttctaataattccttttaaacaacaatttataatttaaggatttttaaacaagaaaagctctcaacaattataattagatcattattgatcaaataattactgaactgttctttgtatcatttaggaattgagctctgaaaaatctgagaaaatttcagagagttgacttaatcatggagaatttaataaaaattaaatccatccatgctttatatttaggaaattttatttcccacatttaacttcacttgtaaattaatgaacatttaatataaattctaataataatttattaaataatttataaatcctgaaacaaaaatcaggatgtgacagttcacggcggcgccggtgttcgcctcagccaggatctggttcgtcgtgttcggcgtcgctcgccgctgcgtacttaatttctcctgtcacctcgccgccggtgagtaaactaaccgccgcgccattgttgcaacgtggggtgcggcgtgctgtacgataggcaggggcagttcgacgggagcacgacggcgacggtggagtacatgacgggtaggggcggcgagcgaggtgaatatcttggcgatggagcacttcttaccgttgtcccctcctcctcctcgcttttgcttccagccaacgttggtcatagcggtggcgacggcgtcgtcgaggctgagcggtggtcctcgcttgtgacggcgacgaggtggtggaggtcggagagaaataacgcccggaagggtattttggtcagcctgggtgtgtaattaggtaaaaatagagagaattggcccaaatggcaaaacaaatgtttgacatcggttggaagtggcattttaacgacgcggaatggcattgtggcgaaacccactctttgcagtggcttaatgtccaatttctccgctggggtggtgttgtgttttgctcttggctttggatccggaggagtacttttgggcggaaatcgggatcgcacggcaggtctccgaccgggaggcgtgcgagcgccgagtggatgcgccatgttggattgcttcagagtgcgatggtgtgcgtccagttcctgcttgttcgtccggctcttgatatttcgatgacatcagcgcaaatgaacgatactagggcaagggggactagggaagtagggaggggatagacggtccatgagagagaggatgcccagacttgcacgcggggccaactaaataacttttttttactttaacttaagtgtgtttagttcacgccaagattagaagtttcattgaaattggaacgatgtgatggaaaaattagaagtttgtgcgtatgaaagttttgatgtgatgaaaaatttagaagtttgaagaaaaagttaggaattaaaccaggccttattctaaaactagcacgagcctcgtggtcataattttttttcacataatcttaacttaacttttctgtcgtcactgcgatttcatccgtcaattttgtgctaatttatcattcatatacgagcgcatacgattacgccatagactcgtccccgatcccctagcacgtatataagaaaacttaatccccatacgtttgtgacgacctaaaccccaagtcctaccgattctaaaagtgagttaagaaattattaggaggagactcatatcagtataagagtaagaaaatccccaaaattcaaaacctttattttgatttttccaaaaattctgaaaccctaaactcagaaattccccaaaaattaagaatccaaatcctgatttcagttaaccccaaaccagcgaatccccaactcaatgagaaaccctacgacactgagtttagggttagttcgtcggatttcgcggcgcacggcacgagctccgccgtgtgcgtgctcctccaaactctcagttgcctttgtgcgactggtgcatggcttcacgcgccgccgtgcatcccttagccgccgtcttggaccggcctcgcacccacatcagttagtcgcgcgaggtcgaggctcaccacattatagtcttgatacgtgtcgtggaggagaactaaggtaggaagaggaatcgacgcatggcatcagctcgcagcgtgccgttaccaccattaccgccatttcgctcggtgccagtggcctcggctcgcacgaattgtcaacttggccatgacatcccattgcatgtcgccgccctaggctcgctggggccatgcgcggcatcaagttcgccgtgcatgggtgcctcaatgttgtcgctgcgtagtcgccgctgctccatcagcgttcccgtgaccgcgacccctcacctagtgttggaaaaatcgggtcggggagaaatgggaatagggttagtgacggagcgtggggctcctcaccgggagaccgctcaggcccccctttgccggttcggccgggggccctgggtgagattctaagctcctagtctatgtgtggaaggttcgcgagaatggaaacacacaagacacgggcgatgtatacaggttcgggccgctgagaagcgtaataccctactcctgtgtttttgtggatctatgtatgaagaagctacaaaagagctggagaaccagagagctcttactctctccctctctgatcgttctggatcccaaaaaaaattcatctcccttctaagtgggcaaggtcctccttttatacctcaaggggataccacatgcaccatctctctcttttttgtggggacttatcctatcttttcataaacagacggagacttgtatggttgccgtccgaatgaccttctgatgggacggcccatacctacctccacttccgccggaagcaggcgcgacgtgggaacatggctgtctgctgacgacatgaccagtgtcagaccggtcacaaatcggtcattcttg

SEQ ID NO: 92192 - DNA, 1655 bp, Oryza sativa
tctaacagagctgaatcaacatgaagaggaggagcagcgctgcaaagagaaatattgtgagcagaaacaagctaaacattatatagtaatcatgcaagcaacgatgcagaactgcaaataagaataagaagcacaacttaaaatatgattaaaaaaggatacaggttaaattctctatcgcgcagtagtttacattttacacaccaataaaagcatttaatttgtgttaccattaagttttgtctttagtctatatggaaatgtaacctcagttaacctctaaattatagcagcaaaatacaggttagctcatttgatatatcaccaatttaagcttcaaatatttttgtggcatagaaaattacgatatgattgcgacatgagcaatagtgtttaagacacaacaggttgcgagatattgaatatgtattatacagcacacataactcacacatgagcaatagtgtttaagacacagatgcaaacataactcacacatgagcaatagtgtttaagacacaacaggttgcgaggtattgaatatgtagtatacagcagctgaagatacctgactctatcctggagtttgcaccaccgaaactgaaaagagagaagaaaatcaaacattaaaaaaaggccctatcaacaattttactacttgcatcatttttctcgtgcagtttaatagacaagaatgaattgacactgtgcagtatgtgccatattatcttgttcctaaattcatggtacataaaatttgcatacaatggtgctagcaaaataccggtgtattgcaacaatcaacaaatatacatatatttcatgaaaaaaaacatatacatttgcaatccacatcaatcagaaaataaatccacaaattagaagatcccaccaaacaaaagaggaggtggtgggatggcagacccaccaatcaccaccaccactactaagttcttagatgtgggtatgctgcatagtctaaaatgaaaatttacgtctcagaaaacgagactatgactaatctacaggaagcttcactccataaccatgcaagtatagactttggaacctagccccaccagcttgtataagctgcttacaagtagcaatagtggtcgatggccactagcccgttacttacgatgcaacaatatttatgatttgtaagttagcataatagcatcacgtacttcattactccaataacctagaatttctacaaaataggtctctgggtaatactccattacagaactcagcacgaattagatgtagaaaataaaaagcagcaacattgatttgacacatacttcaatattgagaagagcattcaaaccatcctctagtgagttcaatatagatgaatcctgtaaaagggatggaaatacaatcattgatttggaataagaaaaattgccatattttagaataaaaatctcggcatgatcgcttcaacttacatgggtgcaatgtgctccacagataagaagctttaagtgcacatcttcatcgtatatctttatgtctggaaagtattcagaggtatcttcttcctcagccattttgtttccaggaggggtgatatatatccttggagcatccccaagaagatgaggcccaagcataagacgttgcacgtcattatttcttacaca

SEQ ID NO: 92193 - DNA, 8539 bp, Oryza sativa
gcgcgcggttcttctccgccgggtatgaggccacctccggccgcatgaacgagacggcggaggtcaggtcgccgctcgacaccgatgggcacgggacccacacggcctccatcgccgccggccgctacgtgttcccggcgtccaccctcggctacgcccggggcgtggctgccgggatggcgcccaaggcacgcctcgccgcgtacaaggtgtgctgggtgggcggctgcttcgactccgacatccttgcggctttcgatgccgccgtcgccgacggcgtcgatgtcgtgtccctcagcgtcggtggcgtcgtcgtgccgtactaccttgacgccattgccattggggcattcggggcgacggaggctgggattgttgtttcggcttcggccggcaatggcggccctggtgggctcactgtgaccaatgtggctccctggatggccaccgttggcgctgggtccatggaccgcgccttcccggccaacgtgcagctcggcaatggtcaagtgctcgacggtgtcagcgtgtacggcgggccagcgctccaatccggcaagatgtatgagcttgtatatgctggagcaagcagcggcgctgcctcgtctgcggctgacggctactcggcgtccatgtgcctcgacggctcgctcgaccccgccgcggtgcggggcaagatcgtggtgtgcgaccgcggcgtgaactcgcgcgccgccaagggcgacgtggttcaccgcgcgggcggcatcgggatggtgctcgccaacggggtgttcgacggggagggcctcgtcgccgactgccacgttctgccagccacagccgtcggcgcggccgctggcgacaagctccgtaagtacattgggtcgtcgacgcggcaggcgccggccaccggcaccatcttgttcgaaggcacccacctcggcgtgcatccggcgcctgtggtggccgcgttctccgcgcgtggccccaatccccaatccccggaaatactcaagccagacctgattgcccccggcctaaacatcctcgccgcatggcccagcggcgtcgggccggccggcatcccctccgacggccgccgcacggaattcaacatcctctcgggcacgtccatggcttgcccgcacatctccggcctcgccgcattgctcaaggcggcgcatcctacctggagccccgcggcgatcaagtcagcgctcatgaccaccgcctacatcaaggacaacagcaacggcaccatggtggacgagtccacgggcgtcgtggccgacgtgttcgacttcggcgcagggcacgttgacccgatgcgcgccatggaccctggtctcgtctaccacatcacccccgtggactacgtcaacttcctctgcaacctgaactacgccgagcagaacatccgggcggtcacgcggcgccccgcggactgccgcggcgcgcggcgcgcggggcacgccgggaacctcaactacccgtccatgtccgccacgttcgccgcggacggcaccagggcgacgatgaagacccacttcatccggacggtgaccaacgtcggcggcgggcgcgcggtgtaccgcgcgacggtgaggtcgcccgaggggtgcgcggtgaccgtgcagccgcggcagctggcgttccggcgcgacgggcagaagctgagcttcacggtgcgggtggaggccgcggcgccagccaagaagatggagcccgggagctcgcaggtgaggagcggcgcggtgacgtggagcgacgggaggcacgccgtgaacaccccggtcgtcgtgacagtgcaagcgccgctgcagtaaagacgacaaatccgacgcgatcatctcagtgttgttcagtgagtgagacattgctccttggaccataattgcattagtatctagtagtgttagtattattattattatacatatgtataagcttaagctatactgggactctagctcagggttctgtaatcttcttcttctacctccctttcagtctcctcatcttgatcatctcttcttttcttctctgaagcatatgccattattatgtggttttgcagtggtgctactactaccaccacagtaccactacaatgtgagggttttcaagaggttttatgatgtgtgtaaagaggcaaggaattaatccaatcatctgtgctatcaacacccatggtcctcacctgagctcacatggacgtgtgagactcgattgagagatttggcccaacgtgtacttgctagtgtaccacctggatcaagcttaactgccttcaattcaacctacctcatcctcctcctcctgcctcttgaattttttgggaggagatggagggaaagccaaaggcggctgcctgccgctgctgctgggaggaggagcatcagcaaagcaaggcaaaaaatcatcatcatcatacgcggcgtggcttttccgaaaggggccttgcactgtgagagcaattacgtggcatcaatggcagcgaaagggggtggcaaaagctggtgcggtccggagaccaaaaatgaagcttgtgcctgggcggaacatgctgcaagttattgctgcaatgccgtgctcgggacaaggatttacttacagaagccgtcccttgacggtgctagtggccatacagagacttttgtgtgtaagggtggtgtggtttacctgtgctggtgggtgggtgactgttttgtgttcccccatgatgctaaacaactgatgataataaccgcttttagtagtactgctgctggatattgtatcgaataatgtttgttgagttgttgacttgatttgaccacatgtaagtagtgctacgtactccctccgtccataatacgagggattccctccgtcccataatataagagattttgagtgtactccctccgccccataatataaaggattttaagtttttcttgtactgtttaaccactcgtcttattaaaaattttttgaaattattatttatttattttgaattactttattatctaaagcatttaagcacaacttttcgtttttatatttgcataatttttttaataaaataagtggtcaaacaatataaacaaaaatttaaaatcacttatattataggacagagggagtacagaccatggctagtggattaatgtactatagtactctactactaggagattgtgaccagggaggcgatttttttttaattttcttttactgttgggatcacacgcacttgtggagctgtcgtgagtggaacacagaactacagaagaaatagtgcaccgagatctttttttttttactaccagaaatttatttcaactagaaacatagaacatgttcgatcatacaggtttccgatctgaagaggtttttcagagagcttcctttgcaccgtgcaagtgtaaccacgcggcattttcttgttggttcgttttattccatccggccagctctactaaacacaaacacaagtgcttatcaaagcacaggcatgtgttagctatgcccgtgatgctcacggctcacggctctaccatgttcacttaattctaccatctgctacacgcagttacatgcaaatgcaatgcgagacaagacttgtaattcttgcattgagcctcatgagtacacactattgaaactaaccccactcgtaacacatggatgcacgcgttaccaactaactcagggaggtaacaagactttgaacatgcacgtaaacttgcacgcgaatatgtatgcacggttacatcattagtacatgatagtgatactcaaaagtcaaaacgtgcactcggcagatatatcaacatgtagctatatattgcaaagacagtaactgtggcttctatctttcaaaaagaaaaggaaagaaaagaaaagaaaagaaaaagaaatgcggcatgcgaatctctaatagtcagcactcctaatggaaaaacaactgctctgactaacttgtttctaggcttacgtcttctttgtactttaacctttttcctcactgtcatcgccggatatcgaaattcaataggccaaatttaggggaaaataagcaatcacaaacgtggtgaaaacttgaaaactaccgttggatcgagaaatgaacatccgagattcgttcacgtcatcatgagtaaaaattttactcccaacaaaattttttactcatgagtaaatctgcgagtgaaatttttaatcgtgatgatgtggaagaatttcggacgtctatttttcgattcaacggtagttttcaagtttccatcacatatacagcttccaccatatattttctccaaattcagggggaataagtccacattgactcccttaaaagtgacccgaatctaatccgtgaccctcaaccgcaaaatggataggacgactcttcgaactattgaaactagtgcaatttgactccctcagcggttttgtagggcggttttactgatgtggcgttgacgtggcaatgttgacctagtcttcatctcatgtggcgcttctgtggcatttgaattaaaaaatatacgtggacccatctgtcattcataaaaaaaaatatattgtgggacccactgacatgcgggacccacgtgtcatcccctctctctccccttcaccggtctgcaggggcgggacttgacgggcggcgacagcaggcaggcgatagtagggaggcggcggcggcgagcaaccaatagtagcgcggcggcggtcgagggactagtcggcggcgggccagagcggcaacggtcgttgcgaggtccgtgcctttccccacacatggatctcgccgaagccgaggtgacgcagatgtttccctccatctcgccgatctcctagaacggtcgggcctccacctcgggcgacgcggggaactcgtgggggtagcctttctccgagtagtattagaggtcgaagccgatggaggtgtgccagaaggcgcggccgcggtcgccgaggaggaggactcgacctgctcgacgattgagatcccggaagagacgctccactcccatgtcctagaggaggaggaatccatgaagcccccgtcctcggcctcggcagtgctcgccgccgaccggctccagatcgacgccgccgacgcatctccccgccgaccgcccagccgtcgctcgtccttgggcaggccgcttcctcccacggcgacggcgagctgcgatcagggagcggggtagggagcagcgcgagggacgtcgctgcccgccgcagccttcgcttcgtcgcccgaacgcggacggctcagccatcgctcctcggggcgcgctgccgccgatctgcatgggacacctctgggagatcggcgagatggagggcaagagagaaagagaagagaaagggggagagaaagagagaagggagagggaggaggaagaagagaaagaggatgacgtgtggatcctatatgtcagtggggccgtggcctatatgtcagtggggcctatatgtgggtcctatatttttgtaatttaatgccacgtaagcgccacgtgggataaagattaggtcaatatcaccacgtcagcaccatatcagcaaaaccaccctccaaaaccgctgagggagttaaattgcaccggtttcaatagttcgaggagtcatcttatccggttttgctgttgatcagggtcatgtattagattagggtcacttttaagacagttaaagtggacttattccaattcagggcaagagcgggaccgattgctgatttgctgtctcatagatcgacacaatctaggggcccattatgctagccctgaaaaggtttcgtgaggacatgcttaagtgcagcccaattgtctctggacagccatggctccgcgacttaaagtgcagccctagtgaagtgatcagggcggaaggtctacgtgcaggggaataagttcactttaggtccctaaattagacaccgagtttgaaattcaaatataacgggtgcctcaacttacagaaccagtatgcccaaaattccaagcaatatagtgcttgattttaactaacgtggtgagtgagacctatatggagccccatatgtcaggcctatttctctttctctattatccctagtgagagtggattttaaactcttgagagtcgagagaacgtccccacgttgcttgcatgctatttaaatagttatgaacttttttaaaaaaataataagaagactatgaatacacgttttctagctgtaatttaatttgatttttcgttgcgactgttgaacttgaatgtttgtagagtgatatatcacatattaataaacattctcagtttttttaatttttcttaactatttaagtgacacgtaaataacgagggattgtttctcctctctgtatcttccataccccatctctcatatctctctccctcgccgcccccttctcatcggccccctgccacagtcgtagccggtcggaagcaggcccctcgtggcccccgcgtgacagctgcccagcactcgtagccgtgttcctccctttgcagggaaggcatcttcttgccggcccacactactggagaaatcatctttggtcgatcggccaaatttcacaatagtcccggttttattaaaaaccgagactaaaaaacatctttagtcccggttggtcacaccaaccgggaaaaaagatcggcatacgtggagatcgaggcatgcgtgcggatcggatcgagatagctatctcctccctcctcccggttctatctcctcctcctctcctttaactcctctcctcctctcctcacttaccatatctgttcctctccttctcattctcctcccctctcctccccacttctctgcacacccctcctccccacttctatgcacgcggcggccggctgcacggagggcggcgcccggtggccggcggaaggcggcaacctgcgtggcggcgtggccgtgcggcaggtggcggcctgcgcgggcggcgggcggcgaggcggcggccggattttttttttttttgagaatttgtgatttggatctgagatgtatttgatttgtgtgtaatatgaatatgtgatgtatttgtgatgaattttgtagaacttgtgatgtaattttttaaagattttgtgatgtatttggagatgatctatttgaggatttggaggtgataatcgatttgggattttacgatttggggatgggggatggagtgaaatcaatatattaaaaacaatgaagaaaagaagaaaaataaaagagcaaccgaacctagcccggctccatttcactaaccgggactaaagatagatttttactcccaattatttcacacgggaaacaggggttatccaccgggagtaaaaaacattttgctaaattggagtaacaacaaacaaagaagcgagcttcttgctgctgctagctaaccccgtatcctaccggcgctgcagccatcgagacgaccggttgtcgccgtccaaacccaacagacaagcgctccctttctcattcattgattcatttgtcaattaattagtgcgcatgcgcgaagatgaacgatcggctgctgctaagcttggtacgtaattctgcgcgcggcgtgtccgtatgatcaggtgagagattcattcaatttattttcagagatcgatccgacaatccatcagttcccaatatactgcaggatttttattttgcaatttgcatgccatgaggcacgcatgagcttactatacctatcttatacgcagcctgaggccatgccgacgccttcggagtcgatgtagccactggggaatcggggatgcctgagccagcctcgccttcgcggccatcggcgcgagctgtgttggcacaggagtgggtcgacgcggcgatggaggtaggccgcattcgaggtcgacctcgttgatctcacgagggtaggagcagctggcagccaccgcagcgctccttcccctccagctgctagccacgcctaccacgctggctccccgccggccatcgtcgcaagaaggtgaggactgaagaatagaggaagagaggtgcagggcctcatctttccgcttatacttatccttatctgccaaaatttaaatttgcaaccttaaatttgaaacggattttaaggtttttttatcgaagtttatttttcagccttttcttttggatcgataagaacacatatataaaagttttatttgcaaattacttttcgtttgtaaatatgccgatagctcctcaagagaggataggaacttgggaagaactagtagctgactcatcttaccacatcaattaaaatagtgcataatactaccaagaaccttaggtaatcggttttgtaaattaagagactgttatatctgatatttcggtttagagatgaatcttatactgggcgataattttagggacctaaagagaactatttaatgtgcaggctagaccgccatagtagttgggtcgtgacagagttgcgacttacgtgcgggtcataaactttgggccagaagcggagatgcgacttaggaggaaaaagtacaccgaaggtccctcaacttg

SEQ ID NO: 92194 - DNA, 5594 bp, Oryza sativa
gagcgtgtcacgtcgcatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgaatatgcagattgataaactgacacgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacggcaaccatacaagtctccgtctgtttatgaaaaggtggggtaagtccccacaaaaaagagagaaatggtgcatgtggtatccccttaagatataaaaggaggaccttgcccactgagatgggggactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcacaggcgaggtgagatcatgctccagtttggagcattggccatggccttaagggcttgtttacctcattaccaattctccccccccccaaaaaaaacacaatatgttgaaaactggactagcacatcttaagattttatttaaatgtgtgcatgcatatccctatgagcacttataaaagctggattggtatatcttaaaatttacaaattcatcgtaaacttaatgagttgagctatgctcactgtgcacctcattgccaattctaaccaactaaattttggtctttttgaacacaccaactctctaagacataggaataggaaaaatgtatgaatagaatatatgtatattttaatccatagaaattttttaagaggtttgagtggatgaaaattttcctatgttttctctctacgaattgtaggaaaggaaattttttttctttgattttcctatacctacatttctatataccaaataacactcataggaactaattctaaggaatctaagtcctttagttttcctcccaaaacgaataggcccttaagaactttaccagaaaaaaggaagggtgcttgggatgaaagagtgcgcttgggactctctttattggattgattctggtttctttccatcaaccataaaactttagatccaatatctcgtgtgtatgagcaaagggtgtggccaagaagctggcagctgaccaagccccttcaaccctacctagctatattcactgtgcgaataaaacccaaaccaagcatatctcaacactaccaaattttagtcgatttgggttgagcaataaatcaaacaagtcttaagtgcattttgtacgcattttattatggttaattcgcttgtttctctgccaccaaagaaaggcacacctcaaaagagggcagggagttcccgctttatgttaagtataaaagcgtcgagtcaacttatgagaaaaactaggtaaaaaaaaaacttacatatgtatggttaattgagcaaagaaaaaacacggagagccaaaaccaaaaatatacatgtgacggcacaactgctaagacccgacacaagttatcgttgacgagcttatcacgagacaagcagatgtaacagggttgcattggcattaattacccaaggcttgattgggcattacccaattttggtagcaatcctaacataaacaaaacgcccatagctgtaccaacattttggatggtgataagatctttcacgtcccaaaatccacataatatgactccatccgatccatcgatattattctccaacataatggctgtcgtagctgatgaccctgtcgatctatgatcaatttgaggatagcatggtgccaaactgccaactatgtatgcatacacttgacatcaatcagatctggaacttaacttgtaggggctcgatccagggccctagctatagcttgctacattaagcaatcccgttgaaaattgcacgtagtacattacaaaaaatcggacatatatgggcgtatgttgctgtcaagccagggtttctctagctagatacttttcatctgacatttgatcttcctctgcaaccgcgactagccagccaccgataactaatctacgattaattagttttctaaatggaagaagtactaattgacgacatgaaagtatgaaacaatatatatgaaatcagtaagacatggcagcatgtagcagcgcatggctttgtcgatcgatcggtttcataattcatacgcttagcaaaatactaattaagtcgaaatgggccgcctctcaaacctctaactgaaacattttataatcaccgataaacgggtttaagatgaaattaactatgtattgtaaacacaacatgttttctttaatactgcatcctttctttttataattaggattttttaggacggatgttgaagcaccaaacttgtgtgtcgtctcccatgattgtgttgatgcgtgtcgaatcaaatcctactagttgacaagcatgggcataatagtattctcgtttgacgaaattgatcaagttatctttaaccactcctagtgtcggaacttattacaatattattagtggcagacctcaagcattttactattagaaggatgagcctgggaggttagagaagaatctaaaagtgcattgttagatgtgtctgtaacaaatcattagtaccaaaagatagatatgcagctaaatatagttaagctagctaggtgaagaagagaaggatacaatatatatacaattaaggccacaaagcaaggcaaatatgatgatgtccttttgttgcttcctctggccactcttgtggttggttcccttaattcttgcaatgggggattactgcatgattagctgattgccttttccattaattaatcaaactgcactggtgcatgcatgtaaggtggcacgttgtattttattttgtgctttggcctgccggctcactactgaattcaattgggtgtcccctctaaaataaaaggaggattgcattggggtgtctcgcactcgcaagtcatcaaagtagagcggttggtccttgaaaagaatacgaaatctatttggactttggactttagaagttaaggcaactaccattacattcagactgggacttttgggacagctgggatgctaaagcgatccctcatccatcgccgtacgtgcctgcaaattaaactccttttgccgtgtacaaaaatgtgtttagcataaactcgtacaatataattaaccagaggccaaaaagattatgtttttgtgtgcagagagcaggacagagtgttgattagcagctggaggacgtgcattactcaaatctgaaaacctcaatttgggttcagtttgttgcgtagctagctttgactgatgactctggacggcagctgatacgtggcatgcaattagctccatcattttggcgctaatttagcgaaatggacgcgtcagtgacagattatatcgtagcgcaacgcaatgacggcaccaaactaaagaaaaatttttcagagcaatttcggcgtgatattgatatgtggtgtgcaataaaggcaggaacagtatgagctcttgtaattgcctgcatacttgtttctgaattgtcactgttgcaatgtacaggtatcatggaaatgtcacgtcagtgcatgctggttgattgtttaaatcaagtcctaatccaatcaggataccaaacagttacactattcagtaccaaatctgcatagaaaacggaaattttcacaggatccatgcagatgcagggcggcgtcgcactcttgcatggaattcatgtgtttcagacatgacattatacctgtcaggattaaattggagagagcacattggttaatttcatgttgctcacttaatgcagtagtacctaattgatttagcacttgccaattggagtataattagcgaggaatcatcaaaatcataatgctaatactgtcgaacacaatcttgcgccacaagggcagatatctccgagcgattcccatgctatcctcgcttcgttctgcatcagctacagtacaagcgagaacgcatccggatcaaatctcctagctccggcggatcaaacagtgaacacttaccaacaaaaagaagcgatttgattaatggaaacctaagtagcagagcatcatatatctagatgaattaacaagagcaggggcggaattagccatggatggggaccctgtcccaacttccaggcacatgtctgtcactttcagcaatcttaatttcgtatttgctgatctatctatctatcagaaatggaatatagatttattatatatttttcttggaattttttggagacctggctgctctgtttgtgtgtctggtacgcacacgatgcaatatagaattgactaaagacgtcctgaatagttgatattcacgtttttcgctttggtagtttgatgtagacttttgtctgcatctgcagaagccacaattcaacttgaaagtgttgcgccgcatgcagctatattaagtttttcatatatattttttaattattgtcctcaatgtgtcgtcgatcagaaccactcgttagaaactacaaacactgtttatagattctttacggtttttatttttttcgtagagtgtagtttattgattggaactactattattatatactccattcagtattaaaaacatactactactgttttagatattcacaatattttaaaacaaatttaaacagtagtatatgcatattgcagcatatttataaaaggtgtacttctacaatgctctctactcgtggcataaacgatttaacacaactatctgtatataccaactgtggaaatgatctatgagaaaaggaaaatgagaagattgagaagatacgcaaaaaagataatggaaatgacaagattgagaagatacgtaaaaaaatgagccattagcgtatgattaattgactattaattatttaaaacttgataaatgaattgatatgattttttaaatgcaacttttctatataatatttttaaaggaaaaagtatgaattatccccccgaactatcacggtcgatcgaattacccccctgaaccacaaaaccagacatccttcacccgaactatgcaaactggacaaataacccatctagctcaatccacggtggttttggtactacatggtagtccagttagcaatttcttttttaaaaaaatcaacaggccccacatgttagtttcaccctctac

SEQ ID NO: 92195 - DNA, 1724 bp, Oryza sativa
tcgtgcagtaccgccgcacgccggcgttccgggtgatggggtactgcctcccgacggcgaagggcgccgccgagacgctcaagctcaacatggcgctcgtcctcctccccgtctgccgcaacacgctgacgtggctccgctcctcctgggcccgcttcttcgtccccttcgacgacagcatcaccttccacaaggtaggtactcctcctcctctcgagctcaccgccggtggttgggaggtcgccgtcgccggagttcggggagacgactcgtcgcccaatgattggcggccggtgcgtctctgccttgtgggcccgggtgggccggctcgggatcttctgcggctcggcccatgtggggcggtgcgacttttgggccgtgtaggtggagagtagctcgggctttaagtgggccccaccggggcggtccaatcagtgtagcgtggccggggaacccgcgggtacagaagatccccggcccggtcggctcagggtcaaagcgccggtcattcaaaagtctccccgaccgacagggctcccactgtcatgtggggccactgtaagctactccaaccggcagggccacgtgttcattaagctaagctccaggcataaaacgtttgtaaatgtacttataggatcaaggtggtcaagatcgcaataatcgtttcttctgacattagcaattataaatttaccaccctcttaactcgttatcataaaactagaatatgaatagtgtaaagcattttattgtaacatataaaaaccattgataaatttacaaatacccctgcttatacctatgtaggatcagtcgtcatacgtcaaatttaaattttaaaagttaatttttatttttttaatattttgtttttaacattttctttggaatttaaaacacgtatataaaaattttacttacgctccgttcgttttttctcttaaatggcaagaaaaccggagcaaagaaattaacaaataattaattaattattactccattacaaacttaaaaaatagattcatttgaatttttaaataaaattttatataaaaacattttataaaaaatacaccgtttaatagtttgggaaacgtataaaaaacaacaaagttgaagtttagactttttttaggtaacttttttttagggaacgaagtttagagttggagtttagaacgggcctttataaattaattttgattgtttcatctactttttcacaactaattagttgtagagcaaagagagcgaggctaaaattagcacattgttgaggttgctagtaattgcaaaagctaaaaaactttggctacacctgcagatcatcgcgacggcaatcgcgctgggcatctgcacgcacgcggggacgcacctggcgtgcgacttcccgcggctgatcgggtcgagccgggaggagtacgagctgctgctgtccggcttcttcggcgcgtcgcggccgacgtaccggggcctcctcgccggcgtcgagggggtcaccgggatcgtcatggtggtgctcatggtggtctccttcacgctggcgacgcggccgctgcggaagcgggaggcgccgcgcctcccgttcccgctcggccacctcgccggcttcaacgccttctggtactcgcaccacctcctcatcgtcgtctacctccttctgctcgttcatggctggttcatgttcctcgtcaccaagtggcaccagaggacggtaagta

SEQ ID NO: 92196 - DNA, 3323 bp, Oryza sativa
tatcatatactactatgatcctaccctctcaagtcttatctcttctccaaatgcctgaccaaatatgttcctacacatcctcttgcctaagatcatcctacaacattgcagttttgcagaacacagcattcgttacaaagcgaacagcggcgtccctgcattgctgttctgaagatcatcctcaagcgatgccgttgcgaagatctgctccgtgttgcgcgcccccatgtcactggagatcctctcacagagctgcaaaaacatttcaagaagaaattggtaatcttgctccagtttcagtcatagtcagtggcaactgcaaatctgcaattgtttagctgctgttacctgtctatacagtgcagggtctccgttggacttcctaagttctacaacatttacagaagggccaagctcaaaaacctgacataaaaaaaatggcaccccgcttcttttagctgaccagcagttgcatcgtgtttttgcattaaattttttttcgttctttgtgttttacctcggcggacaccataaatgactcagggttctttgatcccttgcaattgcgcattaatttgagctgaaaaataatgttcaaaccatttttagtttcttgaaacgtttaaggtagtgttagtatgtcctgtaaggctgtaatatgacgaagacgatgaaaggcttgtacagaccttgctgtgccccctctgaacttggaatcccaactccgtcgctgagctttcaatcttgtcgaaggcatccttgggtggatgcgttgatgtgaatctaatcctcctttgggacacttcctgcaacaagtcaggcaatgaattattcattccattttcccgtgaaaatgtaatcacaagtggcttaagacaagttcatccagggtgattatcaacagtttcctgggaaataagttatttcacttcaactgcatatgatattttgagaagatagaaacattctattttcaggttatttcatccttggtaaggagatggaagtgctggaaggaaatttctgaaaaggcactgtacaaacctcatcctcgaaaaaccctgaaagatcaagggatgatgccattccaatcaactggaaagcgttgatctgatgagaattcttatctccaggctcatcattgatttgcttcagaaaagaaaagaaaccaaaacttaccagtcagtagttgcaaacaccaaaattaaatttactgttcaggacatagataatccccaatggagtcatgaagtctactaatctctccctacctctttggcaggaagacgtgccccaaactgtacatcttcatcgtcatcatcatatggaagaacaggaatatagtccttctgaaaccattcgtgtgatttgatccctgccatgtcgatcctcttcatcggattgggttcaagaatcctccgaagaagattttgtgcactgtgtgaaagccactttgggatctgagtgtcacccttgaaaatctaatcaaaccgaataaacatagtaactaaaaatgatcagagaatacaataacagaataatattacttcggtttgatataaatcagtaccttctgatacagaacaacaatatttcggtcatcgaacggaagatatcctataagcattacataaaggattactccgcaagaccagatatctgacaaggatccatcatatcctttattctgcagaacctgcaagcatttagcacaaggttgagcaagctttacaagataataattcagttgaactgaaaggaactttcacttacctcaggagcaatatagttggggctaccacaggtagtatgcagcaatccatcattctgaaaagtaccaaactttacaattcagtgaaaaaaaatatttaagaaaaacattttgtacagctgaagtcgacaaatcataccccgaggtgttgaggtaaagcactaagaccaaaatcagagatcttgatgttgcctttttggtccacaagaacgttctcaggctgtaccaatggaataattttaacaagaattatgttacagattcatgaagccacaccgaccgatattgctaactaagtgcatcacagatgataattcataaaatttttagcagtttgccctaaaacaaatcttccattaccttgaggtctctgtggtagactcccctatcatggcaatagctaacaccatcaattaactgctgaaaaagcctccttccttctttctctgatagttttccctttactgcctatattatttttaatcgcaaagaattaacagcttcaaatgttagaacacaccatagtagctggcatgaaaatttttgcagcgaggaaatagcgtaaaagatcattgaaacaagggcttacaattctctcaaacagttcacctccattgacaaactcaagcaccatgtaaatcttagttttgctagcagcaacctgaatcaagagtcgaagaacaagattaagacgtgatcatgtgatgtgacattactctcttaagttagttgcttacatgaaactgaaccatagaattttctctcgttttcgtagtgaaagaaaaaaaaaacgtgacataaattcgacaacgacggtgctacccactagtcggcaatggccatgcgtgggcacatttgggatcacgagcacccgccggagatggagaagacggtgacgttgacggcgaacaattccggcgagaggcatccggttctcaccagacaaagtctccgtggtccagcaaaaataattgggggacccaccagacgacggtgcgccgcgtgggcccacactgccaggtggaccaacgccacgtggcacgagcctagtctacgtgcggctgcgggatcggctgctccacgtggcatttcacacggcggcgccgtcgacggcgagaaaccggcggccgcggcggcggaggcgaaccacgcaatttgcaagctaaataaatcactaataaataaataaaaaaaaagaaaactcgtgttttcgatcgaatctccggtgcgaactcaaactaatttcgacgaatccattatctaaataaactaatttggacgaattaggcggtttattaaggaagcgaagcgagagaaggatgaaatggaattttgacctcgtggaggcggacgacgtgggggtgcctgagcagcttgagcgtggcgatctcgcggcgaatctggtcgccggcgcggagggagacgacgcggccgcggtcgaggatcttgacggcgaagtggccgccggtggcgaggtggcgcgcgtacttcaccttgccgaagttgccctccccgagcgtcctccccatctcgtacccgcccagcagcgcct

SEQ ID NO: 92197 - DNA, 3626 bp, Oryza sativa
  unsure (1)..(3626): unsure at all n locations
caggaaaacagtcatgattctgaggatgcaaattaccagaacaagtcaggcaagaagagtgattctgggattcgctcgggcaaacaatcgttttcgtaccagtcgactcctcagagatcatctagggacaacagtaacaatcactcattctcagtatctgctactcctctagaaattgatgtccagggtggttcaccaaagaagatagctgaagaaacaccacaggaagtgcctctcagtcgcctcgcagcgcttaacaaaccagagatcccagtgcttctgcttggttctgttgcttctgctgtcagtggagttatcttcccaatctttgcgatacttttatccaatgtgatcaaagcattttatgagcccccacaagtgctaaagaaggatgctgagttttggtcatcgatgttcttagtgtttggggcagtgtacttcttgtcacttcctattggctcataccttttttcagtggctgggtgtaggttgatcagaaggatcagactgatgacttttgagaaggttgtaaatatggagattgaatggtttgatcatccagaaaactcaagtggatcaatcggagcaaggctatcggccgatgcagcaaaaattagggggcttgtgggtgatgcacttcaactggttgtgcagaatttagcaacattagttgctggtttgttgattgcttttatatcaaactgggagctatctctgatcatcttggcgttgataccactcatcggcgtcaacggatggatccagatgaagtttattcagggattcagtgcagatgcaaaggtaatcataaaaatgttgaaacaccaaattcttttgtttcagtcaatcttttagcaaatcttgtatcttcaaattcttttgccttggatactcaaatttagatagtttgtcaacactgcattgattctcaattattactgcagatgatgtatgaagaggcaagccaagtggcaaatgatgcagtgagcagcataaggacagtagcctcattttcagctgaagagaagtaatggatttgtacaagatgaaatgtgaaggaccactaagaacaggaatcaggacggcgataataagtggtatcggtttcggtgtttctatcttcctgctgtttggagtctatgcagccagcttctatgccggtgctcggcttgtcgaggacaggaaaacaacatttcctaacgttttcagggtatgtgcagtgttcactacaagatatttacagactcaaacttttaaactttttaggcacttgcatgtcaatatgctagttgaagatttgcacgtcaatatgctagttgaatatagatttttcaaaggggcattgagatttaaacttcaaggtggctagtttgttataaatgatgcaatgcttaggcttagttaaatataatttcaaagtgaaagatatcatatcttgggcatcttattgcaggtgtttcttgctctcacaatggcagcaattggggtgtcacacactagcaacctcacatcagattcttccaaggcaaaatcagctgtatcttctatattcgccatcgtagaccgtaaatctaggattgatccaagtgatgatgctggagtgagcttagaaccactaagaggcgatatcgagttccagcatgtgagcttcagatatcctacacgaccagatgttcagatcttttgtaacgactctgtcgctctaacacattcaactnnctgcgaaaggtacccaacacctccctttaatttgcagcactattagagcctattaacaacacactcataacaggtattctgaagactaaatcctaatggtttttattctggcagcactgttgcntcttgttcggagcagaggcggtagtcgggtaaatccgacagccgatatcacttgcttcagaggttctatgactccggatgcaggctcatatacttnctagtatggagtggacattcanaaagtttcagctaaggtggctaaggcaacagatgggtctagtgagtcaagaaccagctctgttcaatgacacgattcgcgcaaacatcgcgtatgggaaggaaggggatgcgacagaatcagacatcgtatcctccgcgcaattggcgaatgcgcacaagttcatcagctcattgcatcaggtgaaattcaaattgcccgtcccaaccagctcaccctcattcattcagacattgtgttcatgtttctgacagaaaatgtgttacctgaaaaaaatgcagggataatgaaaccatggtcggggagcgtggagctcagctatccggagggcagaagcaacgcatcgcgatcgcccgcgccattgtcaaggatcccaagatcctccttctcgatgaagccacgagtgcgctcgacgcagaatcggagcgcgtcgtccaagatgcgctggaccgggtgatgatgaacaggaccacggtgatcgtggcacaccggctgtccacaattcagggcgcagacatgatcgcggtggtgaagaacgggatgatcatcgagaaggggaagcatgatgcattgatcggcatcaaggatggagcttacgcctccctcgtcgccctccatgtttctgctgctgccatttcgtagcagatctagcagacgccatggatgaaaagatcatggtttgttgctgaatctgtgagaggagcaagagactggtgtaactgtagcttgtgcaggctccagctcttgtcatccagcagcagcagcagaagaagaaaaatttgatgaacacaaatatgtcatgtatacatagatagataagatcatacaaagatgtgcaaatgtaaatgcaacgagttgtatgaatgaatgttcatatgatatgaagcagatgatgatgatgatatggatattcattggcatagttgtgatgctttgttcttgttcttgcctccaaagtttccccccatataagaaaagaacctgatgattggatttaatctttttttgaaacctaatgattggatttaatcgagaaacaagaatcagctgagcaaagataatcttaagagggcaagccaatttgctaaagcaaacacaattttgtcaacagtgacttgagagtcactggataattaatcaatgatgaacctcctgtaagaaactgaagatgtaccaatttcattaggatgaagagataatcctaatgctgcagataaactcttccaaagcaatgaaaaaaacaacaggttcaacacttgacagtaatatatctttagttatcttcaattttttttttgtggaaaagaaaatctgaagttctgaattttcttactcccggtgcagggcagacacggtccacggaacgagcgacctcgacgaccagtcaaaccgccgcgtgctgctgacgtggcagtcatctcagccgtccaaactcgtctaccgccaaccaacagccaggatctctcccccccacgaccaccgcctcattggtccacataagccgcagcccaccgcccagccaaccacggcctgccacgtacgaacccaaggggcaaaaccgtaaattcctagcaacccagacgccgacgcgtcgactcgtcgcaacgcaacctgaggagggaaaaaaaagagaaaaagaaaaaaagaaaaggaataaaaataaaaa

SEQ ID NO: 92198 - DNA, 706 bp, Oryza sativa
gctgagattaacaatgcatattttgcttgaactttacttgggttgtaaaaattagacagatgattcgttttgtagtgtgacatttgtgtgagctaggagcttaggactagaattgaattgctgcaaatgttttaatgcaggaagccacagagctactgctggaggagttgaatcgaatgagggatgaggagggcgaactgaagaagaagatgaaggaggacaaggatgcaatgaaagcactcaagaagcagcagaaggaagcaatgaaggctgccacgacgatgaaatgcaatgatgatgactcctctgaatcaagtgaatcaagtgagagtgagtgtgaggagcagatgatgacaatgagctgcgttgccactgttaccatgccgcaaattggggaaggcgttgcgatctcaacgacagttccccaagttgctgcatccgatgtcgcaacagcaccagcaatggagtatgacaaggctgcaatgaaggccatgaagaagagagaaaaggaagagaagaaagccgcaaagatggctatgaagatgaagaagaaggaaaagaagatggccacattgactctctgcaaggatgaagacagcacctcatgctcctcagaatctagcgacagcgagtgcgaggaggttgtcagaatgagctgctgtgctacgataaccacaccacaaacacaaccctcgagcaccgtttt

SEQ ID NO: 92199 - DNA, 575 bp, Oryza sativa
caaaatcagctttaaacactcttccgcagcgagaaatattcaacacagaatcaccacaagaatcaaaaactttacttccagttttcttaaagtgaacctcaaaatcttcatcaacaatttgtgaaactgaaagcaaattgtactttaaatcctcaaccaaagctacattcttcaattcaaatttttcatttaccttaaccgaacctgtagcgagaatggaacttgtagaagcatcacgaaagataatcgattcagtcttggatgcctttttgagggaggagaaccaatttttatcaccggtcatgtgccgcgaacaaccggaatcacattcttcaattcaaatttttcatttatcttaaccaaacctgtagcgagaacggcacttatagaagtatcaccaaagataatcgattcagtcttggatggctttttgagggagaagaaccaatttttatcaccggtcatgtgccgcgaacaaccgaaatccacgatccacacgttcttcttccttgccaccaaagcctacacacaagcagaagttgaagcctcagtacttggattagatgataataaaa

SEQ ID NO: 92200 - DNA, 782 bp, Oryza sativa
ccaaaaatacgaccatcctccccctgaacctgtaacagtgtacctgcaatatcgtgtctagttcctggactagcctcatcaaaagaaacttcgcaagtttcaacgattttgttagtctccaaaataagtacacgatagccacgagtatgtgcggggtaaccaaggaacaatccaacagtagaacgtgcctcaaacttgtccaaatttccagatttcaagacaaagcatttgcaaccaaaaacacacaaatgtgaaactttgggttgatgaccaaatcgaaattcataagaagtttttccaagttttgatctcaagaaaactcgatttgaaatatagcatgcagtgttaatagcctcagcccaaaattttctaggagttttatactcgtccaacatcgttttagccatctcaaccaaaacacggtttttcctttcaacaacaccgttttgttgaggaacacgaggagaagaaaattcatgttcaagacctctttcgttgcaaaattgttcaaaagtatttttaaactcaccaccattatcacttcgaattcttttcaaagaaccagaaaattcaaaatctaatcgaagaaacaaaccatgaaagtgttgaaaagcttcgtccttagttgccataaagaaaacccaagaatatctaaaaaaaatcgtcaacaataacaaacacataccactttctttaacggattgcactctagctggaccaacagtgtccatgtgtaatagctgtcccggtgcattcgtcatcacagaaacaataggagcatg

SEQ ID NO: 92201 - DNA, 592 bp, Oryza sativa
tctttcagaagaagttcttgtatatcccgtgaaacagttttctcaaccaaaataacattaggactacatatttccatcattttactaatagccctctccagatggtctttttcctaccatagagacgcaaaaaggaaactattaaccttcaagccaacaaaaatgggatttaatttaatatctgcatgcatgtatatgtagtggcaaacctgcccattgaattgaatgatgacaaaccaacatcagaatgcccaaggactcctttgagaagcagcagtctaggattgtggcaactggtcggcatgtgcttgtgagcagcatttttcttgaagactaaccccttgatcacctcactgcaatcaacattgcaaaatgaaggggggggggggggtataatttgaaacataaaaaaaaattcaatgttttcaaagaattttcttcagtaaggaacaaattatgtttcacctttgccgacgagtaccagatgctatgcacttgaccttgatgtaagatccagggtccatttcctttcccttgctagcatctggtttgatcagtagtgcagcttcccacgatagggaggtaaggatat

SEQ ID NO: 92202 - DNA, 2341 bp, Oryza sativa
tcctgcacccacattaattttgtatcataaggcgttgatacttgatgcctcgaaattttgtccagatgcgttttgttgcgacatctttgattggagggagcattgacacagcgcaaatgtacattgtgtttgttcatgtcaattcatgtaaatgatccatcaaactgatgatgtaactaataatattcatgcgacatatttgtggcaattagtgcttgcacacatatatttttcgttgatgagatctccatgtcttctagatatgacacctcgatcgacctcttcatgtaaatcatatcgaggatgaacacgagcatatcataaccttgtcagcaacaaaggcggcgtgaggaaggttatctatttgtgagcaactgttttttttttaaaaaaaaaggattataaagcccagttcaaatatcatcctgagtttgagtttgagaaaggctacctatttgccgagcaacacacgggtgcttgtttatcacacacgcttggtgatctgaagatatatagattcaaaatgttaattaatacatgcaaaaatatatagatatacttgccctcataaaaaaaatctatgacattcaaagtgtcatatattactgatcgaagagagtatttatcccctacatatggtgcgtcctgtttcgtacaaccttttgatttttattttcaagtcaaacttactattttttaaaaaaaatagcattatgcgtagcattaaatattttgttccattaaatccaatatgagatatagtttgataatatatttgttttgtcttccaaaacttgataatatatttagtttgaaatagaaaaaaaatcaaaatatccgagaagcttgtagctaccaacgtttataattttggtgaaaaccaaaatttctgatatttcagtagtaaccggaatttcaaatattttgggaatttatttttttaacgaaattatttaaaaatttaataaatttgactaaatgtgaataaattttaaccaaattcttacataaaaatatgaaaaaccaaaaattccgtacaagatatttgcttgccggtgtgagttcgcagggatttccgaaattactgaaattaatttcagatatttcgaactgaaattttaaacctggtagcaacaaactaagggggtgtttgggaactagggacaaaaatttagtccctgtcacaccggatgtttggacgcaaatttagagtattaaacatagattaattataaaatacatttcataaccttggactaattcgcgagacaaatcttttgagcctaattaatacatgattagcctatgtgatgctacagtaaagatttgctaattatggattaattaggcttaaaaaattcgcctcctggattagttctcatttatgaaattagttttttttattagtatatgtttaatactctaaattaatgtctaaacatccgatgtgacatggactaaaaaattttaaccccatctaaacaccccctaataagaaatactttctccgtttcaggttataagacgttttgactttagtcaaagttaaactgttttaagtttgaccaggtttgtagaaaaaagtagcaacattttcaactcaagacaaattcaatatgaaaatatattcaattattaatttggtgaaactaatttagtattataaatattactatatttatctgtaaacttagtcaaatttaaagcagtttgatattgacaaaggtcaaaaacatcctaaaacggagggagtcctaaaactaattaatcaagtctctgctcggcgagctgctacgtcgccgccacctccatcttcccggcgtcgagcaccaccagctccgccgtgcccgccgcctcgtcgtggaccatcaccaccacgtgcccgtcgtcctccctgcctccggtgccggtgccggacgtcgccgacgtcgccggcacgaacgtgggctcgccgctgaaccgtccctcgccgtactcgtgcacggccgcgagctcgccggtgccaaggtccaccttggccacgccgcggcaccgcggccacggctcggcgacggcgaggtaggtgaagcgagtgcggcggccgagcagcgaccggttcaccgtgccggcctcgaggttgagccctggcacgagctcgcgccggctgtaccgccccgtccggaggtcgagccggacctcggacaggacggcgcgcacggaggacaagagcgcgtcgggcggcgtgatacaggagcagacgatgacgacggcgggttcgtcccaggcgttccagatgtggaagcagaagcagcccggcacgtcgaaccacctcattctagagacggcggcgcttggccggaaa

SEQ ID NO: 92203 - DNA, 2515 bp, Oryza sativa
acaggtgggccccacctgtcagcgacaaccaaagaaggagggacacaaaatggactagagggcccgaggcccaatggagagggaggaagcaggccgggaggagacaggatgggacgagcctgagggataggaaacgaacttgggccaaaaatggcccaaagacaaagaaggtgatttttattttttttagatttaattatgattaaatgaactttgtgcttttaaaattatcttttgagctccgaaaattcacgggggattccagagagtatattaaggcatggagaatattacaaaaatatttctagctatgattttttaaaggaaatatttaattcactcattaatttcacttgataaattgcatttaattttaatttaatttctagaaaatatattatttaatgatttttaatcccgaacgaaaatcgaggtgtgacaagaggattggtagtattatgaatctgatgaaaagagaggatgcggaaaacgagaaggatgttggagatgcatcgtctgacgaggatattcccatggtttgcaacaaggatttttcttgcctgattatttcagatggccatcacatgccatgggagtataaggagaatgaggtcgtgcaaggtgctcggtatgctagattggaggatttgaaggaggcggtgaaacattttgttatttctttgcagggagagtttagggtagggaagtcttgcaaaactatgtatgaggttaggtgtgtgacggaggtggactgtccatggcaggttcacgcatacaagggtaaatggaaggattgctggcaattctcgattgttacgaagcatgtgtgccacttataaggagtggagaagtactaccgtaatattacatcagcatccatagcagctgaggtgtatggccatgttatgaagaacctaaactttgaaccaatgtcaatcattatgcacataaaagaaaaaaaaatacaagcacaccatcagctatgcaaaggcatatagggcaaaacagaaggctatagagacaaggtttggcacattcaaagcatcttatgataacttgctgaaattgctagcaataattcagtttaggaatccaggcacctgtatcgaccttcagcactattcatcagctaagaatgatgagggcaatgcaagcattctgcagaaagcattcttctcttttgcagcttgcatcctagcatttgtgcaccgttgcctcatcctttgcattgatggcacattcttaaccggcaaatatagagaccaaattttgacaaccataggtgttgatagcaacaaccaattgttaccagctgcttttgcattcgttgagagtgagaacactgataactagtattggttcctaagacgagtcaaggaacacgttgtgatgggaagaccatatgtttgcttgatacatgactgacacataggcatgacgtgggctattgatgatttgaagcatggtagctctgattacggtgcagccaagtggccagatgttaggaccagatggtgtatgaggcatatgggtgctaacatctacaaacaatttagcaacaagagagtgatggaccttttcaagaggttatgtttacaaaaccagcagaagaagtttaatgagttgtggtacaggttggacgacttgacagctaagcaaacagatgagaacagatcgaagccatagcctgaaggtgatgatgctccagaggcagttggtcatcttacaaatggtccaccacgaatgaagaggaggaaagcatcagaaatttctaaattttcagagtggattgagaaggaaccaaaggagaagtgggctttattgttcgataaggatggttcacgctacaatgtaatgactacaaacttggcagagctatacaactgggtcatgccagacacacgtgcgctcccatttattggcatcgttgagttcattttgcatggcacttgcaagtactttagggattggttgataacagctgggccttccatgttagacaatgggttgatatatgcccacaaagtaaaggagtacattgatgaggatataaagaaggctcggaatcatctaacaatgcctcatggtacgacgaagcatttgtatgatattcaatgtagggataaatcaaggcgtggtatcaactgtaagagagcgttgcaagagtgtgtcctgaaagctgatggaacatgttcgtgctcttgctaaaatccatatttacttcacaagacatgcacacttgtactcgccgctatagcacgcccaaatcaacgctggcggcatcgccagcttgcggcaggctcagtcagtgggacatctaagtaacagggatacaactccaccagattgctatatgctttatagtagtagaattccaattacgatatggacactcaccagcagtgcctgtcgacatcttgaaacaaggaaccacaagaaactaagttcatacagagaatagtaccagtaacaaagttaaaatcacaaactttatgccatgctgggctgcaggaat

SEQ ID NO: 92204 - DNA, 2952 bp, Oryza sativa
tcctgcacccctatgaacgttttgtaatgctgcgccttcaggagatggacgagattgtcctctgtttcttgtggatattggtcgagcattgcgacgtttactctccgagggtcgatgaatccagtatcgaaaaccctccgccgtcgggccctttgaatctccattctacaacgataaaagggagtattttattttatatagtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaatggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaaacgtcaagctcctcttgcgtgcaatcataccccgggtccttgttcttggcggcgtcaactttcgccttcttcgttgcccttgtgtgggcaggcgatggagctgggggggcccttgactttgaaggtgccggaagaggagcttgcggaggagtaggtgtaggagcccgaggaggagtcggtgcaggatcctgaggaggagtcggtgctggagcctgaggtggagacggtgctggcggagcatgaggaggagacggtgcaggatcctgaggaggagatggcggagccggaggagatggtgcacgaacgccgcttgtcgtccagggaggatgatgtaccacctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggataggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggacatgcgttcatcaaccttccttgccacctcttcttgcatgttgagttcgtagctcgatacccggaactctaggtatgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatactaccagaacttcgatcgttccggccaattggctgttgccggttcgatacccctctcaatcaagctagcctccatctcctcccactttggcatcgcgacgctatagcctcctgaccccaagtggtgatggtacttcttcttggcggtattttctttgtttctttccatcatcgcctgcccttgttcacctgtcttatatgcaacgaactcgtcccagtgatcccttagctttgggaatgtgtcgaagttcggtgtatgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccacgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattatatcgtacaatatctgttcctcatcgcggtcagccatctgttgatacaacaaacatctgctaagtcacgagacatttatgttttaagactacaatagtcaattgctacttgtcgcaccaa

SEQ ID NO: 92205 - DNA, 2825 bp, Oryza sativa
tttaaaaatatattaaatttaatacttttaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcattacatcggcggtgatggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtctttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacatgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctactgtcattattgctttccttccgagagttcccttttcccgtagtctcccttcatggcgtgattcaggtaccccgattgggcgaaggtcttcgataaattctacgcaaaattcgatgacctcctctgttccataacccttggcgatgcttgcctctggacaagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaacttaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcgagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgtgatgtttaggcttcgtacggtggtcggccttacgttcgaagtgcttgcctttcttccgtaccgggtggtttgctgcaaggaatcgacgatgacccatgtatacaactttcctacagtgcttaagatacgtactttttgtttcatccatacagtgagtgcaagccttgtaccccttgttggactgtccggataggttgctaagtgcaggccaatcgttgatggttacgaacagcagcgctcgtaggttaaacttctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgc

SEQ ID NO: 92206 - DNA, 2281 bp, Oryza sativa
ctgatgcactggtcgttctttgttgtctgtgcaaagttgaaaaaactcaccggtaggccctccaagtttgattttaccataataccatttttttcttgcgcgaggaaatatcagtttgcctttgaccaaatgaattagtggatccgaagatgttgacatgaactctctctctctctctctcaagtggttaaccatgcatgcaaccatttttttaaatcttttataatttaactgaaaaatcgttcagtaaccaattgttaaaacaaacaatctagccattcactgaaggtaacatggtaagctattgactgtaaatatttatgtaatgtcgaaaataacttgccatgtgacatagcaaaaatataattttcaaaatacaaaaaaaaaatcacatgcgacccaatcaaatactcctatcagtgataattgaccccgcaagccatctagggtcaattctagtacaattccacgtagatttcctcccaccctaagaaaagttgtcactttgttctttaaaaagaccaactcgcgtgactttcttctttctgcgctgtaaagataatagaatgaaacattccggcttttgctcaagagagctacagttaattattacaaggtagtacacttaaaagaaaaaaataacgcaaacacaccaaccaaaaataaaggaaaccaaacatgacaaggataatattattctaacctgttggtgaatctccatccatggttggcaaaaagttgcataaccgtcgtctcaaacttacgacatgcaacaatcaggaattcttcatcttcattacacttttgtagttgtgcccacaaccggagccaatatgttgccctaaaaattacctgcatataggaaatagatgatgatttatcaaaaaccctatcattcctacacaaccacagtgcacaacataaggcagaagcaccaacaaatatcagtttactctttttcatgtcaaccccccgaagccatctatcaaaaatatgagatatggtactaggaaggtataatccaaaagaaaactgaactgctctccaaataaattttgcataatgacaatccataaacaaatgttgaatagtctcatttttcatataaaaacaacatctcaagctgccattccaatttcgtcttgctaggttatccttggttaaaacaactcccttaagcaagtaccacataaagaacttaatctttagcaacatcttaaagcttccaaataaacttatttctatcaatgtaaccattattaattaaagctaagtacattgatttaaccgaaaactgaccattttgatgataatttcatctaaaataatcagaagaattatttaactggaaatgaacaatagaagcacacaactcatgccaaagtgttagattctgaccaactaaagctctcctaaagaaaacattaagcggaatagaggccataacactagcaatagaagcattcctccttctgacaatagcatataaagatgaatacttatctctaaaggccatattacctagccatttatcttcccaaaatcttgtttcttccccattattcacaatccaggaacccatacttaagaaagtgtttttcactttcatgagtcctgacaaaaaatgggagtcaccttgtttcctatcaacttgggttatagacttattataaagatactttctcttcaataaatcttgccaaacaccattcttattaattaacttatataaccacttactcaactgacatttattttgaatctctaaattatgaacccccaaaccaccttgatctttgggttgacaaataatatcccatctagctagcctatacattttcttatgatcatccccttgccaaaagaaacgtgatctataataatcaatcttttgaagaacccctttcggtatctcaaagaaagatatcataaacatagctaaacttgaaaggacagaattgatcaaaaccagtctacctccaacagacatgtgtttacctttccaactactaagttttttctcaattctttgttcaataactttccaatccttattacccagtttcctaaaatgcattggaatgtcaaggtatttaacaggaaaagaccctaacttacaaccaaagatactagaatattgatcatagcactccttagcctgaccaaaacaaaacaactcacttttgtgaaaattaattttcactccagataatttttcaaacacagataagatcaattttagattctttgcttgttgtaaatcatgctccaggggtgcagg

SEQ ID NO: 92207 - DNA, 1984 bp, Oryza sativa
  unsure (1)..(1984): unsure at all n locations
gtgtagcatgtccctttaataaagaagaatctagttagcggctctctactgtgtagagatggttttagacttgtgtttgaatccaataaatgtgtcgtatctaaatatggaacttttattggaaaaggttatgatagcagaggtctgttccgtttttctttggatgacatgtgtaataataataataatgttgtgaaccatattagcgataatgatgagtccaatgtgtggcattcgcgactttgtcatgtgaatttcggttgtatgacgcggttggctaacatgagtttaattccaaaattcactttggtcaaaggttccaagtgccatacttgtgttcaatcgaaataacctcgcaagtctcacaaggcatttgaggcgagaaatttggcaccactagaactagttcattccgatctgtgcgaaatgaatggcgtgttgactaaagggggaaagaaatatttcatgacactgatagatgattgcactagatattgctgtgtacctattgaaaacaaaagatgaggcattgcattactttaagatctataaagctgaggtagaaaaccaacttgaaaggaaaatcaaacggttgaggtctgataagggtggagagtatttttccaatgagtttacgtccttttgcgaagagtttggaattattcatgagagaacgcctccctattcaccccaatcaaatggggtagccgaaagaatgaaccgcactctaactaagatggtgaatgccatgttagacactgcgggactttccaatgaatggtggggtgaggcaatttttactgcttgtcatgtcctgaataaaattccagtgaagcataaggaagtaacaccattcgaagaatgggaaaggaagaaattaaatctctcatacntacgcacatggggctgcttggccaaggtaaatgtacctatagccaaaaagcgtaaacttggaccaaagaccatagactgtgtgttccttggttatgctatccacagtgtgggctataggttcttaatagtaaactctggagtacccgacatgcgtgttggtacaattactgagtccagagatgccatattttttgagaatgaatttcccatgaaaaatacacctagcacgtctagtctagaacctgttttaccccatgagcactttgcaccgataaaacacaatgagcaaacgcttgagggaaatcctgaggaggatagcattgtagatactcgtaagagtaagagacaaagggttgcaaaatcctttggagatgactacattgtatacctcgtggatgacactccaagaaccatagaagaggcatattcatctcctgacgctgactactggaaggaggcagtacgcagtgagatgactcgattatgtctaatgatacttgggaagtcgttgagcgtccatatgggtgcaagcctgtaggatgcaaatgggttttcaagaaaaagcttaggcctgatggtacaattgaaaagtacaaggcaaggcttgtggccaagggttatacccaaaaagaaggcgaggattttttcgacacctactcaccagttgcccgcttgaccacgattcgagtactacttgctctggcagcctctcatggtcttctcgtccatcagatggacgttaagacagttttcctaaacggagagctggaggaggagatctatatggatcaaccagacaggtatgtactaaaaggtcaggagggaatggtgtgtaaactgttgaaatccttgtatggccttaagcaagcacctaagcaatggcatgagaagtttgacaccacacttacatctgctggctttgttgtgaacgaagctgataaatgtgtgtactatcgctatggtaggggagaaggagtgatcttgtgcttatatgtcgatgacatattgatctttgggaccagcttcaatgtgattgaggaggtcaaggactttctgtccaagagttttgaaatgaaggatttttgagagg

SEQ ID NO: 92208 - DNA, 5540 bp, Oryza sativa
tgtgttattatgtgattgttgatgcttattctacattaagcatgctcatgttgattacattcaccattatcactggatcaaatcccattgtaaatatcatgtttattatcttgttattttggattaaaatatgccgaattatgaccaaatttccaacagctatatggtccgcctgcgaaaatatagcatgaccgcctgcaaaaataaaaaaatgccgcctgcgaagataggtacaaatatttgaaatttgttacaataataattttctcataaattatttttcaattaattaattaattgttgcataaataatattagtaaataacaagcttttgatactgagaaatctacatatattgcaaaagggaaaagtatcgtcaaaatattataatattttttacattgtcacttcaaatacgctatctaattacattatggcatagcattgctgcactcccgaagatttttgtatttgtcacttgtagctagggcaccctctttgtcgaagaactttccttccacatgacagcactcacggtggatgaagtggtagagatcgcgctggatatttttaatggctgtattgtcaaagcttgtttgttgctcctcccttggcaactgcatgcatggaaataagcacaatatattagtatcatctatatgtgaagttgtctaatccatatagtctagagacttacatcctctgggttaaccctgacctcccattaacccttaggaattcgcatgcgtaatacccgctgaggacagtgcctctaggttgcttgtgacacttcatgacatatcatagaagaaaatagttaaattttgcaattagtgaaacaattggaatacattaagtgagtggagtattcccggccaatatgtatgtactagcagcttctcccttgatcgaatctgttctccacccttgaacttgtagtacttgtacgcactgtatggattttgtaccgtttcacattaaggaggagatttaattataatatattcatagcagacatgcaagtgtcagaatcacttactattgtaagattgttagaaattgtttgtatgagtcatgagagtaatcgagagggtccaagactgtcacggtgcagtgcttcgggtagatgattaaaccgatgtaatgatcgctacatattaacaacagtgcagttagtcatggatacaataagacacatatgtataagagaaatgtataccggacttacttaaaattataagcggccaggacgaccctcttattttgaaagtgcaagaaggctcgtccaatgtactgtgcgacattaatcagtttctgcttgtgcaatcccttcttgtattcagctatctcttcgggagtcttgtccttcagctgctctaactgtggtgatagctgcacggtatgctgtgtttgacatatcctagttggatctagaaatccgataggttcttttagcttcttagcatccatgtattgcatcctacaaaagaagtttgttagtaataatcacatggttatgtattatatagattccgtcgtgtaattaatgtacactcatactcacaggcactaagcaccgatatagttgacgtccatcttttcccgatgatatatggtgtgcagatcttcgaaatatggttgtgtcttcggctgttgcgtcttatctttcttcttcgagccggtggacttagctgggaccgcgtcttcttgtgccttgtctttctttttcggctgccgttttgatctccgtggccccgttttctacgagtaggtatgaaactttcgaattactactcactactagttatcactcacacaattacgatcttaattgtacctacccctttctcacggggaatgtagtccttatcaccttgttcaccctcatccttttaccaccgtttcgggcttggacaacgatcacttggtgacgagtactcatcgtcctcgttgggtacgtcgctgtcggacccatcggacggcagcaccgttggttgcggagcaaccacaatagcaagggacggctcaactggcggttgtcaagactccacctcccctacagcctgatcttcatttcctttagtactctcggccatcgtttcgtacttcaaacataaaaatgaactcgatagttaatatagaggccataaaaaggagcaaatttaaattatcgaggccacttatcataaaaaaatagattataccacctacttgtcatatgtgcaaaaaaaattgaacatagaccactacgttgccatagtaaaaaaaaaattcacatagaccactatgttgccatagtaaaaaaaatttgaacatatctccccccatatgataggaaaaaaaatttgaacatctcccccacatgttatacacaagaaatttgaacatttctcccccagatgttgtacaaaaaaattttgaacatatctcccccacatgttgtaaaaaaaaattgaacatatctcccccacatgttgtacaaaaaaaatttgaacatatacccacattcacccatatatcattcacatccacccataccacccgtatcacccacaatcaacagataagacccctcattcccattccatccatatatacaaacccctcacagtcaactgttgaatgtttgttgttgcttttataaactctagacgcagttgtgttttctgctttcttttcttctgctgtaaactgtgacatttcttttaatgaaaatggagggttaaggccctttgataaaaaaaaaatacaaacccctcacacatatataaacacccacatgcacatgttcgctcgcggacgacgagcggccgaggacgtcgttcggtcgtggacgaggaagttgttcagccgaggacgacgttcggccgagggggcatgtgcgcggccgaccgggagagaggcagcggcgcggcctggaggaggcgggcagtgaccgacgtgcccaagagagagagagagagagagaggcgccgtggcggccggccaggaggaagcttgccggaggaggagctggccggaggaggagccgaccgaggaggcgtgcgcggccgggggaggcgaggcccggaggtggaggcggcgcgcgcggcggccgaccggggagagagaggccagggaggaggagataggcaccagcggcccacaggtagaggaccaccgcgaccggcggcggccggcgatggacggggtggtggcggccggcgatgcgcctggtcgtggcggaggcggcagccggagtcgacgcggcgggcggacggcgcttgcaggcggacggcgacggaggatggtggtcggcgcggtttcgtcaaaaatttcagcagcctgatggcgacaaaatttctacggttcccgcctggacttagaaatttggcgcccgacgggtgcccttatataggcgatgtatctttctaggcaggcgccccgcctgcgaagatacatcctaactaacttcgcaggcgggccacccgcctgagaagatgtcacccccacttcagtactcatttttcgcatgcggacaccccacttgcaaaaataattagaaaaggtcaaatattaatacttaataaagaaacattttattaatgtaactgactttataaattataaataaagatggtaagcccatataaaaattgtaataaagatggtacgtttcccaaaaattgttacaaaatattaaaagcttaataaaaacattttaaaaaaataattgattttataaaatataataaaaatggtaagtccatataaatattataataaagatgataagtgcacataacaattgcattgtgagtaaaaacataataatgtgcaatatgagtacatatagccccctacataccatcattacagaacaaacaattactctttaacatttttccccacaccgtccttgtgcatgtaaggcttcatggtcttctgagttgatgcctctacaagcttaatcttttgtacaaattacgtataaagtggcatactatcgtactggttgtaatcttcgacatcttcgaccccgtctactcccaagatcttttgttttcctgatagaactatttctttcttcaaatttgcaaggtctgtcacatagaacacatgtgccacgcgattggcgagtacccaagggtcatccttatgacccacattcgcaaggtcaacaatagtaataccaaacttatcaatactgaccctgttcgggtattttacccactggcacttaaatatgaggaattgcattgtgagtccatagtcgatttcccagatttcttcaataaacccaaagtatgattgtttttccccctgaatcaattgcctccatacaaacaccgttgttttgagttacggtcttactatctcaggctcttgtactaaatgtgtatctattaatgtcatatccctcccaagaattgactgtagttgatggaccacaagccaaccgcttcatagttatttgctcggttgtttctccatcaggtaagtctaggtctcgcaaccaatctatgaagacacgcttgtgttctttcattatccattcggttgtgcgtcccttattgttagctcttagtaattcgatatgttgatcgatgtaaggctcaatgatagcaaactgatgaagaatgctgaagtgagcttctcaaaatgatttgtaatcatgggtgacaaatctcttctttcctattgtccccctgccagtcaatctacccacgtgttgaggtacaggtgtcagggttatggataccacatacctaatagtagttgactaaatctcggcagggctcaccacataccatgtcctatacggaagcaaccttcggatataggaggagttccgataaggaaatgaaaccagagttctacacggaaacgacaaggactattcggattgtatccatattagtttccctagttctacttggacaaggggacacctatgggtataaatacaaggccccctatgaggagggggacgactgaccaggagacgatcaacacgatcaacatggtcaccacgatcgagatccacctcaatcaacaaccaccacaatattcggaacaactgaagccacagcatacaagccaacatacgccaagacacgccgccagatatcgacttcagggataggcatggctattcccctacggtgtctccggataccgtcaggagagactaaagcgctatctttgaggagcaaggctaccctgtagtcgactacgagtcagaccttcagaccgccatgtcgacaacagttagataggctattccacatattgtactggtgcgattatggtgaataaaagcaactccggctccggccaacaagatgtagggttattacctgaccgctcaggggcccgaacctacataaaaatccctgtctccgtctcttttacctcagtctcgcgtatatcctagcaccgacgatccccatactgtccaaataccgtagtcgagacatcaaacgtcgacagtggcgcgctaggtagggggattttggtgctctaggatttcgacgagatgggttcaagagatggaggg

SEQ ID NO: 92209 - DNA, 2975 bp, Oryza sativa
tcgaccaaagtacgtctcccgacgagatcggaaccatcgtcgtcaacaactcgttctctcgagatcgaccaaacttcaagacgtcaacaccgcggagaatcaactgcccagacctccgcctacgacatcggctggaccgacaaaatacacccggcatgtatctacaaaggaacaattgagcactcgagtaggatgtggtcgagtacgccgcattatcgagaacgatctcgacaaatgcagagccatcgcgcccaacctgccaacgaagaccgacgacctatctcatagcaccggccatcctgggctactcgagagaaggttgttaacgaataattcctcgtgaacgccgtcggcttgatcacctgacatgattgcgaacggacatccgtatatgctataagttgggtacgtgagtcatgctggccacatgagatacacttgcaacaaaccaactctagcgcttccatcggtgttcgagagataattctgctcgctcactggtcctcgaaccagtacgtagcaatctctcgcaccgcaaacttcattggtgttcaagagataactctacacgtttgctggtcctcgaaccagtacgtagcaatctctcgcaccgcaacctcagatggtcgaggtacgactacgattgatcttcgaacggcagcagagtagcagtcctcgcaccatgactcggacgacttcaaattgatcgagaaacacctgctcactggttctcaaccagtcaatcgtagcgatctctcgtatctttacttctagtggtcgagtttagactacctctggttctcgaccagcggtgtagcgattctcccactacctttacttctagtggtcgagtttagactacccctggttctcaatcagcggtgtagcgattctcccactacccatacttctagtggtcaagtttagactacctctggttctcgaccagcggtgtagcgattcacccactgtttccacttcaagtggtcgagtcacgactactgcctggtcctccaccagtggtgcagcgactctcctactacctctactccaacaaagttggtatcaggtacacaagatcgccaagtgttttacccagagatccctcacccagatgacacctagcgttgacacctatcctactgtccctttacgccatgctgacaaggcctccgaggaacctaagggatcttcggctggggatgcccggagccgataaggccttgtcggattctttagagacgaaagaccatgtcagccgtggtcgtgtaagagttctccccgtgcgtattaaccaagccgcgtaatcggaaattaactttccaacttcacggctgggggctaggatcagtacttgttcaaccgaggcagttcaaaggtccaagagccttgtccctcgagaacgattctccgacgacaaggctagaggctagggagagtgcataactcaacaaactgactagtcgaagtcggtaaaagagaagacgctcatacacaaaacattggtcggtaaatttaattcatttttaatttaccatacatattataacatgtcaccctttgagcattcgctcgggggctctttctatttgatattcttttatgagtattgatttcaggaaaattctattcgacatttgttgaaaactcatgtctctatagttctacaccaagatcgactaaggcgagtacgacaaatgttgacaaggctccgtcgcagactctacgccttctcgatcgctcgagaacggttgctggatctcgacaaggaatacggaatgaagagatggtgtacccgccgagataaaatttcttgacttcaatccaaattttcgattacagcaagatgggagacttagtcgtctgctctatacttccttggttgacatcagagattgactcagacaaaccctttcggtgcccgcacgaggctgataaaggaagtctaacgttatctctaaactcaccgagaacggtcacgtgagctcgataatagttactccatggtcagtggtcgagaataggaatccgttcatgtgcattgaagtcgggggctactgtcagggttatggataccacatacctaatagtagttgactaaatctcgacagggctcaccacataccatgtcctatacggaagcaaccttcggatataggaggagttccaataaggaaaggcaaccagagttctacacggaaacgacaaggactattcggattgtatccatattggtttcccaagttctacttgaacaaggggacacctatgggtataaatacaagaccccctaggaggagggggatgactgaccaggagacgatcaacacgatcaacatggtcaccacgatcgagatccacctcaatcaacaaccaccacaatattcggaacaactgaagccacagcatacaagccaacatacgccaagacacgccgccggatatcgacttcagggataggcatggctattcccctacggtgtctccggataccgtcaggagagatgaaagcgctatctttgatctcgccggacacggattcgaggagcaaggctaccctgttgtcgattacgagtcagaccttcagaccgccatgtcgacaacagttagataggctattccacatattgtactggtgcgattatggtgaataaaagcaactccggctccggccaacaggatgtagggttattacctgaccgctcaggggcccgaacctgtataaaaatcctcgtctccgtctcttttacctcagtctcgcgtatatcctagcaccgacgatccccatactgtccaaataccgtagtcgagacatcaaacgtcgacagcaagtattccaattgtctttccatctttgaggtaatcgatacagcactcgacaacctcttctgtactgtaaccctcaaccattgatccctccggatgggcatgatttcagacgtagcccttcaaaaccgccatgtaacgctcgtatg

SEQ ID NO: 92210 - DNA, 854 bp, Oryza sativa
ttcctgcagccctaaaaaatatgtgggacccatttatcattcaccaaaagtatgggtgggtcccactgacacgtggggctcatataaatcatatcctcccctctctttctctccgcgagtgtgggacgggggccaatggcgacggagacccaggagcggcactggagcggtgacggaggcgtgcgggtgagggccggagcggcggcggcggcggcggagatcgagaccgccgtggaaggttggccgtcggaaggaagaaaacgagccacgagaacggccgtgtcctcgccatcctcggccccgccaccgcactatccatcgctgcgctccacgccctctctgccggccacgacgcaccggcctccgccgttctcccgccgcgcccacgaacgcgtaagggtcgcctgcgtctcgccaccgcgactcgcgtcggcatcccctcgaagatggcggcatccggcggtggcttcttctgcacctgcggcggcaaccactactacaaaaatcgtttttctgtacgagggggtcggtaggttctatgcgggccgcttgtggcggcgcctgcaaaaaccgccccccgggggcgggttgattagccgcatgcgaacatgcggccgtcttaagtggccgcatatattagggcatgcggctccttaagacggccgcatgcgaaaataggcccattatcgcatgcggctgatcttcgcatgcggctgtcctaagcagccgcatgcgataatggatcttcgcatgcggctggcttaagggaccgcatgcgatgatcggccatatatgctcctccaggcccgagcttgaccatttgaaaacgaagctttctctctcctaaagcaagc

SEQ ID NO: 92211 - DNA, 530 bp, Oryza sativa
tcatccagtacgccttgtccctggtgcagagtgtggatagacccaatggcgcacgagcttgggtagccgcggcactgtagggctcccacacgacgtcagtcggcagaaggcggtcgaactccataacaaactcaggatacgaccgcctaacctgaacgtgagcccatcggcgctgcaattcgagacgatcgatgtgatgtacaatgaacttagcaattaacttaacaatacgataagatcgatgcaatgtacctgacgacggcaccacagagtacccatcgtagggtagtcgacctctggtcgctcctcgtacagtgactcgtacgcgtgctggtccacctcagggcggccgatcacaatcctctcagctgcccagatagaaagaaagagagggccccaccaaaggtcgcgctgggatccgtcttcgtgcaagcctcacaaagtgcacggtacagagccgccaacaacgcggaaccccagctccactgaggcacctcgcctaccgtagcgtcggcgatgctcctggcgta

SEQ ID NO: 92212 - DNA, 5077 bp, Oryza sativa
aattcctgcagccctagaggcaaaggcagatgatgcttggtgttcggatcttggtacaagatcaaataatgaactagcattaattccgttggaaccctcaacatcatcgttttcaattgctggaggtcctgcattttcaaatggtttttcatctggatttggttccagtttttcccaagataatagctttagtcctttattaagggacgcagaagatggttatagtttctccaatggcacaaaggatgatatccatggactgagtggtttacataacttgggaaatacatgtttcatgaacagtgctatacaatccttggtgcatacacctccattggtggagtactttttacaggattacagtcgggagataaatacagaaaatccacttgggctacaggtaatgcatgttgtcctattatgtagattgcgaacttatgatcttattggtgatttctgagaacatctccattgagcagggtgaacttgcaacagcatttggagaattactgagaaaactttggtcagctggtcgaacttctatagctccacgtccattcaagacaaaactttctcgttttgctccacagttcagtggatacaatcaacatgattctcaggttgctccgaatgtttctcctaaacacttcttataaatgtctgttaaatggtgctgacactgagttttgcacctttgttctgttttgtaacttccattaattagtcgtacattataaacgtatttcttactttaagataacatgctgttgtgtcccagaactatgaagttaattttcatttcaacacaccggtgcactgttagtgttaaggcacatttcagttccgaagtacatatgcattaatttcttgtgagattttattacaaaaccctaggttttgggtaataaaactcccaggtctaattcttacatgtactaaaaacaataccgcatactattttattgtacaagtgttatgcataaatagtggtataagagtgtggccaaaaatttggggttcttcgaaacaaattataaaagctgggattttgcgttacaatcgttccaaacctgaggttttgtgaaatttgttttttaaccatagtgttggttgtttatttaaattgtgtcaaactatgattatatctatgtttctcaaacttttgttataagtcgttttgacttttttcctagtcaaacttttttaagttagaccaagtttatagaaaaatgtagacacattttcaacataaaacaaacatattatcaaaatatattaaatgttagttttaatgaaactaatttggtgttgtagatgttactaaatttttatataaacttggtcaaacttaaagaagtttgactagaaaaaaagtcaacgacttgtagcataaatcaacatgtcctgtcaaagagataaattgtctctgctttttggcttgttcgctgttctgataaatggtgcatcctttttggccacacattgacacaagttttcagctcttttcctgaatatgttttccatctttagaatctgttttaattgcgtccctgttatcttccttgctgtaatcttctcttttataaccgtcatcgtcttgtatacagtttgttgtcattttgtgaactgatgcatcctatttatcactacttatgcatccctgctttgcttgttttcagaacttgatgtatttctccatacatttttttttcattgtgtaatattacctgttgcaacctttaataaatgtgtctttcggaataagggattgtttattatgctttttgatatattagtgcctccctcatcttgtcgtttagttcttgtttggataagctatatttatttgacaaaatttggcaatttagattgttcacattttgttaaagaagattgatctgttacttattgcccctcttttatgcaggagttacttgcatttctattggatggtctgcatgaagatctcaaccgtgtgaaaaagaaaccatatattgaagcaaaggatgccgatggccgtcctgatgaagaacttgctgaggaatgctggaattaccataaagctcgaaatgattctataattgttgataaattccaggtaatgaaatctttgctacgtgtatatgtttaccatgtggagcaaatattgtttggatctggaattattttaaagatatttctgcatttttttgaataagggttccctatctctggttgttctttaggcatcttcgtattatggaaatgaacttggtaatgctgaaactatttgtaatcagacaacaggtttttattttcttttttaaagaaacaggttattttttgaggcagggatcaggtgaaatttcaacagtggttatatcacaaaaatttaaccgtttttgggatgagaacgggtactattttctgtagagccctcataagtagtggggatattcagtttttggttaattttgttggatgttttctattttttgacaaccggttttgaaatagtggtaaccagaatgattgctgcacaaaaaagagctcctgaaccgaataattcagtttggttcagttagaaaacagtatctgtttctcctcggaacatgccaatgctgacctgtgccgcttgacgttgctcctttgctggcctgctgtgccactgccgctctgtgactgcctgccatgccttgcgctgctctgtcgttgaattgatttggtgaaactgtggaaccgagggaggaaagagatgtaatagaaaatctagtcgggaatgtagggttgtggtttggtaggggcgtgagatgtgcttgagccgttggcatgatgattggttgctggttggcatattttgtaccttaacatggcataatgatctaaagccatttaccgaacaaagagaattaaaatcaaactggaaatgaaaatacaaaaatcctgaatgtggcatggctcattttggtattaggtttatgtatgctcacaactattcaccactcatcagtataccttttccattgcttgctgcttttgcaatgattatcttcttgagactaggcctgaaagattaggccaggtctgtctgcaagcagatgtagcgtaccaagatttacctcacaaactgctcagccttttacttgctgctgagtgcaagatactagctagttctggtgcttggtattattagttagcactgtagaatttgttggatatttctgatcggttagtatatatgttgggacaagtgggtcgacctgtgaacccacttatgtggttggcaccgttgtatcaagctatgtcttgagttgaatctggcttgaaccaattgttggttattacttggtcgatttatgaagcagtgatgggtattttcaatagaagaaaatactaaagaacaatgttatagcgttgattaatgattgctctctgatggtgaaacatgattgatgtttcttgaagctattttaggaagtgggagagatagtatagttattttgctttcattctgtaatatttcctccatacaaaaatagaaggcatatgttatttttggattaggctttaaccaacaattattatgttagaatataatttttgtgatgcaaaatcaatgttaatagattcacattcaaaggaactttcttatgatatgcttttgagtcacataaatgatatgtatgttagtaataaagaaattgttggtcaaagtcttgacgttaataacagtgaatacaccttatatttttataaggagggagtatatacatgttcaaatttcagtagcattttcccctttggcgtattttgtggtgtacgataattgttaattgtcacatctctgcagtaacatcaattcatttggttgatgtttcagggtcagtacaagtccactttggtttgcccagattgtaagaaaatctcagttacatttgacccattcatgtacttgtcactgccattgccctcaacagttactcgcatgattaatgtaactgtatttagtggtactggagatgcccttcccatgccttacactgtgaaggtacaaaagaatggagtttgtggagatcttataaaatctctgagtgttatgtgttgcttacaaagttgcgaaacactgttacttgcagaggtaaaaaatccagtttgttcttatgtagcaatggtgttatttgaagcataactctttttcagtaaatagctaataaacatcatattctttaggtatatgatcatcggatttaccgctattggaacccatcagaaccactttgtcatgtaaaagatgaagacaaacttgttgcttacaggctaccggttggctctgaaaatctcttgagggtagagatcctgcatcgggtggttgataggtgagtctgtaattatgttagcaaggaccacatatgtgtttccatgatgtccgttcatctattgttgctccttagaataggtgaaccctgcccttatttgaattttggttctagtgagaattttgtgcttatgattcgtgagaatagtttagtgtagctgacaaaaaaaatgctacagacattgagatttcttacctcagatacatgccatgtatttgatggtagtgattttcttttttctactattctattccttggaactggtttccatttttgtgcttacacattgatttgttttgttaatttatgcagatatacttcagagtccatgtttaatcttagtcggaagctaattggaagccctcttgtgacttgtattccaagtgactctacaagaaaagctgatatttatgcaactgtctcttcacttctggctccatttgtgcgggcaaaagtacatactctggatgaatctgcaaccaagttaaatagcaatggacctagcctggatggtattgtactgacagacaatggtgtcacctgtgaggaagatgtatctacatcaaatgtggatgaggaagcagctgatgaagaggttttgccatttcagctttggttgactgatgataaagctaataagagagagcatattgatgcagattctaacggtgttcctgggtcgaccatgaggttattaatggactggtctgatagagaacggg

SEQ ID NO: 92213 - DNA, 1586 bp, Oryza sativa
acaaatgaggcttcaagcctgaccctgaactcgatgtgcaatcgagactctgactatttcatgtactagtgcccattgatttgtttctgggcagttgagtaccaccttccgcaccgtgtcatgcgacagttcgggaagaaacaagattggccggttgaggacatctcaactggagttgaattacacaagtaaatatttcttatctttgtttgctttcattgtcaatgttcaattttgtaccatttaacccttgtcgatgctcactattgtttcatcaccttctacttgtctaggtatgacagggtgagaacaaagaaggtgaaagactgggggctagagcataatagatacattgatgaatggaggacagccggaaggaacgacaggtacatcgagactatacaccaaaatcatcttttctcagagtaccttcgttggctgcataggacatatagactgttcctccgccctacttggacggaagccgacatagaggatgaccgcgactccgatgaggggcggaatccctatgatgtccgaactagagttggatatcaaatggagcacgccccacttagagacagagtcgtaagttttcttgcatttgtcaaaattatttccatttgcaccctagaccctaacatatatcttctcacgctttcagtcgagagagctcctcaggagtgtgaatgaaatggggcataccctccaagctccgaggggtggtgaggacacggagaacacactccgcaatgttttagaggtaaaatttatttagcactttgtattacttgagttatgcctaacaaacttctttttttttgaaatgcagaaagttcgtcaaaggtgccggaaacttgcagcaagattaggttgcaggtcggttggattggacgacgtgtaccaaccggggagactaccaccaccactacctcaatccgcgcgtccaagtatcgctcgacactccatcaggatagaagagcgtgaaggagttggtggctcgtcgtcgtcacgcattaagcaagggaggggaaaggggaaggcgccggctccacctagcgacgacgatgacgacgaggacgaggaggatgaggactacgtcgcaccagacgccgaggagatagacatgtcacagcttcccgacgcgcctcaggggacgcaacccacgcaatacaacttgcgatccactcgggcagcgaaaaagaggtaaaatgagcttaccattctcaaatgttatttgatttcccttattttgtttttaaaatgttttaaacattggattttcaaatgtaggtacactccggtctcgcaagcaattcggcgccaacggaagaagtaatttgtatgaagttaatctattggttggtagtatgacatatgtggtgcactatgtgatataaaatgtgatggactatgtgaggactatgtaatggacttttgacattgtttcatgtgtggaatataggatggacttttggcattgtttgatgtgtgggatatgtgatggactttttgcattgtttgatgtgtggaatatgtgatggcctatgtgaggactatgtgatggacttttggcattgtgattt

SEQ ID NO: 92214 - DNA, 2300 bp, Oryza sativa
aatggactggaaattattctgaacaactgtaatggaatatctgtctagttgatgaatagtcttgtgttggcttggcatgtccaccactcaccccatccacgggctcaccaagtcaccaatcagtttgttcaccttgctgctctttttttgcatcttcctttgcatctgcgtttcagcacatgacaaagttagaataaatattcatgtgttttctagtttcattttgaaattatccaaaatattataattttaaaccacccagaggttatcgctgtcaaactgggaatttccagtaaataagccatactggatgaaaataacaaaataaaaagaaagtgcatgggaatatgagaaagcaggcaattgagtgagaaatgataattttcttatagcccacaatcatgatagactcatgtaaattcaaatgaaaccagacacatcgaatgagcaaggctggtacattagacttctagggcaagaacatcatgttatcaccatttgccaacataactgacgagacaaacaacagcagtatatgtagaacatttcagatgaatacactcctaagtacttagaaaccaactccctacatgttacttttctcccccattcttttaattttaattatccctgtttcccttctagtccctattacatcatctaaaatgtcagtagaggacctgctactttcttctccttccgaatccagtcaaggagtgagccctgaagccggacaggtgcatgcacagcccaaaggctgaggaagtcagcgacctcatgtctgtgattgtgtgtccggcgatcatgtcgtcgcaacatctttgctttcctggctcctcgaatggttctccgtgtgctccgcatgttcattgttgccttcacagcctgaagaaatgcaccaccatgtttagacttccaaagcatctgatacgctgttgcttttgcattctgacgaaaacaatctacagcccttggcagcatgaacatttgtgtgcaagcaatgttgctcgttaccattaatcacctcaatcacagtactatcaactgctgggaataggtcttctgaagagccatggggcgtatagacaaggataacattcagatgcggaaattctttaagtgaagatttaccctcaacaattgttccctgttctctgaacccaggaggtgaaacttggcacagtaaactcacttcaatgatgggttctagagaaatatctgttaattctaccttgtgcaagttcccactaccacatactttctgaccatgatgcttgcaacacagtggatttgggcggaaccattcagtagctatactatgaatgttctcccaaccgtatgagtgagaatgtgacaccctggagaagtcttgtgtaggtagttgaataagttctttcctaacagtttcagctgtagactcaaaataaggagtaaacaactgcaagcacttaattgtagtaccaactatgtttgtactctctgaaagttgtagaataatatcaatgtaaaagttgtcctcaggtgcactgccatcattgaaagcaaagaacaacttagcttctattcctcgctctgcagagttattgggccgtacccaaaaccaatgctgcttgtttccctgtattgatttgtactctaacgtttcacctgaaataaggtgcccgataagagggtcaaagaacaagtaacggcgtggtgtgcctccaaattccacagatcttagaaaatcattagctccatctgcaaaccactcgaatctttggacagaagatctacccagctcatcactattgctgtgaaagatggaagataccagtgtcttggtggcatgggcaattcgcctaggaaaggaagaattccttacttgttgttccacctcatcttcttcctggatatgttgcctgcacttccgtagtgtgtcatcacactcttcagtagcacgcttcagcttcttctgccaacgtaacaacgggccactagtgatctgccatttattggatgtctcaagtgcgaactccaacttgatttgtgccatctccagcctctccaggtgatcccgtgcacttgattttcgctcacaccggtcaatcaacccagatatgatcctgtttaccgtctcttgaacgatagcagaaccgactatctcttccatcttcagtaatccttccctgatcaacacagagcaagatatatcaatacatcgatcaaaatatagatagagttaattgcatattggaccggctttctttaccatggtcgcagcttggctaggaacaagctattattttcacttgggctag

SEQ ID NO: 92215 - DNA, 1245 bp, Oryza sativa
cccccccgcctttgctctcttcgtgtttcatgccatacaattcgttggtcttatgtcaatctttacttattggatgctagcatgactatcgtgcgaacaattgataaacacttgggtagaattaagtgctatttttacttacacttcctcttcgtctttccaagatgatagctcgatcgcctgcctttctgggatgatagttcgcctttctttcttcttctttttttttctttcataatagacagataacaagcagctggttttgcagtgaaatagcaatcgacttcaactgtcattgcaccgtatgtagtccagcttcatgccaatttgtcccaaaatatgctatttttcactcacttttttctctccaggaaacatgtttgtcccacatactgatggcatcctcttttagggcctgttcactttggtgccattttcaaccttaccaaattttggtaaagttgccaaaaaaaattagctacatttagtttgctgccaaattttggtaactatataagaaatcctgccaaaattttggcaagttaccaaaattttggcatagttgccaaaattttggcaatgccaaaatttggtaaggttttttttggcagcaaagtgaacaggcccttagttctttcagctagcaaagatccctcataagggtacaagcaagcagcacatggaactgggtatgtttataccgtgcaccttggtgttgttattactgtcatatggagctggaggcatcaagggcggcgcatcaacgcaagatggggacgtcaatggcacggacttggcctcgctcctagatttcaagcgagcgatcacgaacgatcctttcggagccatgagctcgtggaacaccaacacacacttgtgccggtggaagggcgtcacatgcgaccagcgggcgcatcgcgtcgtggcactggacctcgttgggcaaacattgaccgggcagatctcccattcccttggaaacatgtcgtacctcacttctctgagcctccccgacaacttgctctccggccgagtgccacctcagcttggcaacctgcggaagctggtgtttcttgacctgagtggcaactcgttgcagggtattattccggaggcactcataaactgcaccagattgaggacgttggacgtttcaaggaaccatctagttggtgatatcactcccaacatagccctcctctccaacctgcgaaatatgcggcttcactccaacaacctcactgg

SEQ ID NO: 92216 - DNA, 3440 bp, Oryza sativa
aattcctgcagcccttggtaaactccggaagatcgaacagcttggtcttgacatgaacaatcttgaagcaagagacagttggggatgggaattcctagatgcattgagcaactgcacgcgtcttaagatgctctcactgcaccaaaatctactgcaaggtgtcctgccgaattctgttggcaacctctcctctagcatggacaaccttgtgttgagtaacaacatgctttcagggttagtgccctcgagcataggaaatcttcataggttaactaagtttggattggatttcaacagttttactggtccgattgaagggtagattggaagcatggtaaatttacaggctttatacctagacagcaacaacttcactgggaacattccagatgccattggcaacacctcccagatgtcagaattgtttctttcaaacaatcaattccatggtctcataccatccagcctaggaaaacttcgacagctctcaaagttagacctcagttataacaatcttgaaggcaacatacctaaagaggtcttcacagtacccacaattgtccaatgtggattatcccacaataatttgcaaggcctgatcccttctttaagtagccttcaacagcttagctatcttgatctttcatcaaataaccttactggggaaattcctcctactttgggcacatgtcagcaattagaaaccatcaacatggggcaaaacttcctctcaggaagcattcccacatctttgggaaaccttagcatcctaactttgttcaatctttcacataacaatttgacaggatctatcccaattgctctaagcaaactacagtttctcacccagttggatttatcagataatcatcttgaaggtcaagtgccaacagatggggtattcagaaatgctacggccatctcacttgaaggcaaccgacagctttgtggaggagtactggagttacatatgccttcatgccccactgtttataaaagtaaaactggacgacgacattttttggtcaaggtattggtccctacattaggcattttatgtctcatatttctggcctaccttgcaattttcagaaagaagatgttcagaaagcagttaccattgctgccttctagtgatcagtttgctatagtttcttttaaagatctagctcaagctacagagaacttcgcagaaagtaatctgattgggagaggaagctacggttcagtgtacaaaggaacgctaacccaagaaaacatggttgtcgctgtgaaagtttttcatcttgatatgcaaggtgcagatagaagtttcatgacagaatgcaaagctttgaggagcattcggcaccggaatctacttccagttctaacttcatgctcaacaattgataatgtaggcaatgatttcaaggctctagtgtataagttcatgcccaatggcaacttggatacttggctgcaccccgcaagtggtacaaatgcttcaaatcaactgagcctgtcccaaagaataaaaatagctgttgacatagcagatgcattgcaatatttacaccatgactgtgagaatcctataatacactgtgatctaaagccaagtaatgtcctcctagatgatgatatgactgctcatttgggagattttggcatagcacatttctacctcaaatccaagtcacctgccgttggagattcgagctcaatctgttcgatcggtttgaaaggaactatagggtatattgccccaggtatgtttctctagctgtaactttgtcacttatgtgacagacaactgattatttacatgaactcttaccttaccttgcacatttcacatgaactcagaatatgctggaggaggattcctctcaacctctggagatgtatacagctttggcgtagtactattggagttgctaacagggaaaaggcctactgatcctctgttctgcaatggacttagcatcgtcagtttcgtcgagaggaactatccagatgtgatagatcatatcattgatacttacctccgaaaagatctcaaggagcttgctccagcgatgttggacgaagagaaggcagcataccagttgctgttggacatgcttggagtggcactttcctgcacacgccagaatcccagtgaacgaatgaacatgagagaggcagcaacaaagctgcaagtgatcaacatatcgtatatatctggaatgtagagctaagtatactatacacttcattagtgcgcgtaccacagtgtataaaatggcaggtggcatttacaagtaactgtcttttgttatccatacatttgattataagggcaatgcaagtacaaaatttactcatctgtagacgcgggcagtctccccgtagctgctgtagcctgttttggaggagtttggtgtagaatgtaatctctgtagcttgattcaaaaaaaaaatgtaatctctgtagcttgtaactctcttgccgaaaaatcttaataaactttggctggcatacgccagcctgcgaaaaagcaaaatgtactcacctcaccaagctggttgaaaatagtgctctaaacaaactgcaattgtgactggtgaagagggttagagggaggttcagtatcttcacaatgtcaattggacagttactgcaatgtatttctccaaatagtctgtaactaaaccaacttttgagtaatatctatgtttcaggccaacaaattgcttgccagttctcaaaaaataaaaataaaaatgctgtagtagtttaagaaaaaaatggcaagtttttgtctttggaaggatccgtcaaatataaactgaatcaactgagcaaaagaaaagtaaaaaatattacattccgttgataaactgattgattactctctatgacagattaatcggttagttgtgaaagggtatgtaacctagtgattgcaatgacctgagtagcaccacaaggtcctgagtttaaatctttataggagcgaatttcagattaggttatttgagagctaagttccctatttgatagactaagtttctaattttaaaaggttgcatatatctggttggatgtagaggccagataaaaaatatccttctctaaaaaaaataaaaagaaagactaatcagtcagaatactgatataaggtagagtctctctacctttttgagtcaaaaaaaaaaaatcagtcagaagacaaggtcaagcttagcaactggactaagtacaaaaattttggaattcttttgaacagctgtaatggaaaacctgtctgtttgacggattagaattgttccctttcggagtcatctgttggcttggcatgtccacccaccaatcagctttttctcctacttgctgcgttttgtgtgtttcctttgtttctgtgtctcagtacacgatgaagtagaagaaatatagcatgtttttttttgttaca

SEQ ID NO: 92217 - DNA, 3236 bp, Oryza sativa
tcctgctgttgttacacttgctgtgtgaggagaaagcttcgtcaaaagctaaatattgcggtaaattttcctgtcccttcatatctgttgtcaattgattttttttcctgcttctctaaagtagaagtgcttcattctgaccctacaatgtgaaactgagctacctctggaattgttacagctccatgttatacactatgggtcatttcagaactgattaactgaactagactataactggggctatgggtcattttggctaaaggattataaatgaaactaacttaacaaaatgtctgtctgtccattgctaatgcagaggtttgttaaaagattgggtagagttttatctgaaagaattaccatgcacactatggagcgttcgtatatcctaagagccttttatgttacttaaaactctgtttatgttatgccgctgacagggaggttgcattgatgatttcctatcacatttgatgtgttgttgctgtgcgcttgttcaagaatggcgggaagttgagattcgtggagcttatggtgagtttcctacttccatgttatccaattaaccagttgagcacgtggatattatagggaatatacatggatgatggagtatatataacagtccacatttcctccttaacagtatcctaaatactagtatatggcactgttgacttttatttggtcaatcttttgaaactttgaccattaatagctctgaaaacattaaaaaaaacaagtggatatatttttctttataagtacatttacaatattacaattttgttagaaatgatcttaaattctaattgataaacagtgatcagcgttgctcactgaacacggaatgaattcaacagtgttatatatttaaaaacagatgtagtaaatgggaaggaagattgtattatagtgatatggtctcgaatcttctacggttgaaacattgctctgaaacatttcatgtcatcataaccctgccgatctcaaagacaagcacaacatgatttaaattgcacaagcaatattaatcagtatgcctcatttcctgcaggagagaggactaagattagcccaccctcatttcagtacatggaacactaagcagcgatgcaaggcttgagcttctgtgaagataatgacctaaaggctagagcaacccggtatcgtactacaatagtaatgatgacacagctacaacattgttgtatttatgcttaccctgcattgtttgtgttggtactctgtttatagtaacatcagttggtgttgggcacagtatgttgtatgtagtactttgtaagaaaaaacacaagttacatgccctcgttgtgctcgtctctgttgaatcccccatgcataatttaacctttagcttcatttgcactataaaacagtaacaatattaaaaaagtctcaaattgcaaaggcaatggggtccagaaactcggaggaagaaaactgttaacaggtttctcaaaaaaaaaaaaaaactgttactagtagagataaacaatgcgatgctgggccatgcgaacatgatgcaacaattcaaacaaagaccatcaactaaaaaacattagactttcaccatgagcttccgtttaccacgacgtacataagcttccaaggctcaaggcaggatgtatattttggcaatttaagcaggtcgtcactggccgccatcttatttatcagtatcttggcgaaatccatttcataatcgtcatgtgaagaattgttaagcatgtgaacagtttcacgatgacgcgatccacgggacacgcagacatacatcaacgaaggtcgttgagttgagatgaccgtcctaccagagttcctccaggcttcctgtcgaaactcaaacaacaccggcagatcgatggcctcaccgggcgtagcagcctagggtgagtgcaccggatgcaatctggccgcacgctactgctttcagcgaatcgaacggaacaaggagttcggataataaaactccgaaccccttttcaggctgcagtagaaccaaagcaagggttcgggaacaaaactcctaacccgcgtagcgcaggtgaccgtcgtctttgtgcccaactatctctgtagattgccatctcttgctctcgcaggctgcagcagaagctcttgataatgaatcaatgctggatgaatacaaagttcagcacattattggacgggatcgcaatgcaaaatcaccgcgctcggaggcagcgttcagcgtggccgtgagactgcattgggcaaaaagcgaaatccaacaactccagcgtctcatgctctcagccctgtcaaactcaaaaaccggaaaatcgatcgatggcctcaccgagccacgtctccgccttcctccagaccacgcagctgaaacaccgaatacgaggcccgcgaccaatgtaccttaccgaagtgagtattagtgtgggccatagtaactgggtagtagtagttgttcatagcatccacagtgtttatgtaggggatgggaagtaaggtggggcccgctttgaaaaaaaacgcaagttcgctatagacattggcttgatgtgtcagaaggtgcttatacctggtggtagcactactatccggtattagttcttcaccacctccatagtggttattacccgataataaggtaatatttaatgcttactactccctccatttaacaatataagttattttagcattttccacatttatattgaagttaatgaatctagacatatatacctatctagattcattaacatcaatatgaatgtgagaaatgctagaatgaattatattgtgaaacagaggaagtacctgctattttgctacactgtagatgccctggggatcagagaataaaactccgaaccccctgcaggcagcaagagaacctactcagcacaggtcacaggtgatcgttctgtgtgttgcgctgcgcccaactatcggctcgccttcgccgccgtggcgtctctgtagactatcatcccttgctctcgcaggctgcagcacaagttctttagtggaaatggacaattctgggctaataatgcagttatgtgtttggttgacttgtcgatttcttgataatagataggatcttgcttccgaatcgagctcttagtcatcgtcttgaaggcgtcgatcgtcgacggacaagaagtttgtcaagttagaattcctgcctttcaaatttcgaaggagaatagtcattttggtatgaa

SEQ ID NO: 92218 - DNA, 1409 bp, Oryza sativa
acaaatgcaagtacatacctaggctttcacttacatagtaaagtttgtatttttttggatgctattttcaaacttttgcaatacgaccatccacaataggatggcatttgatggcatagccatttgatggcaccaaaccaaacctggtttagccaaaaattggcaaggttagttttggcctttaaccaaacacaatttagcctttccaaatattggccatgccaaattgtgcctttggccaaattttggtaaggcttgttttggcctcgaaccaaacttgctctaaaaataggagatgtcaatggaattataccacgaaattagcttgaaatgtacctgagcagcaatgatgctgaggaagacggtcaacatgctaagaaagaaatgtgcggcagttgctttgaggcctgccatgaagtagacaatcaccataaatatgactggaaggaaaaggtccagtggcagatcacttgtcgttctggccaagaagtatgcactgagcttgtacatgtcagctgcacgctccttgttcaacattgccctttcttgtgggaatgtgaagatggcagtaaacacaggaaagaaaccccaaaacacagctatgaaaaacagtaagccggcctgcatacgcaagataaaattgtgttatgatactaatcttcctgcatacccgagctgacatatcattaataagctctctgagtaaccaactccgccatttcacatgaatcacattttctttggcgtaaaatgaatcgcatgattattgctatctatgtacctgatcttgtagaccttttggtgtcgagggatcagagtgccaccatagtagacctaagataactgatgttgctatgacctgggtgattctcatccagctcaaataatcatgtcgccgttctttgatccctctacagaagaggatggaatattgctgccaccagctagtgccccattctcgctttgatgatgttatagttgtcttcatatcgtcactgattggaagtggatctagaagctgcttcttcgccttgtatgccactcgattctcataggcgtctacaagatactgcatgaaatcacatataaattattcagacatctaaaccaaccctcaactcataacaccagcacattgctttcatgtcgtcacctcatgaacatcttgtgctgatggcttgtagtcattcttggtattagtttgcaggttttgattttccatgtgcaccttgtcatctaactcggaaggaacagaaacatcagtagtgtttccgttggcgagatccagtagaaattctgctgggttcattgcgatgagcggggtgcacccaatggactgaaagtagggcatggcttcagatgccttcccaaaatagagcaaacttcctcttcccaggaggataagcttg

SEQ ID NO: 92219 - DNA, 705 bp, Oryza sativa
attcctgcagcccggaaagcgtacagaaggtactagcgaggaaggtggctctcgtgagaagtatatcagttggagtgatgatgctactcagttcatgcttgagtggtatatagagctccgcaaagacaaacctagtaccttcaagtggaagaaacaacaccaccagcaatgtgctatagctttaaaagacaagtttgggattagagtcaccaaaagccaagtccacaggcacttaaggctatgcaaggaaaaatggagttggatttgtgtagctttagggaaaagtggctatggttttgatgcagcatcatgcaaatttaacattgacccatctgagaaggattcaaacaaacttggtgtaagctatattattgtgcaataatttctgagttataattcatacaagaatgtgctaaatttgtttatttctaactatgtttcttctcatggcagacaactaaatataactacttgactaagcctatcaaattctttcacctctttgaagaattatttgttggttgttcaaaagctgatggttcactagcaattgaccagttcaatgcaaatggtagcagtgatagtgatggcagtggtagcatcaaggagttggaagaatacatatttgcattggaagatggtggccatgattctgacacgatagctcgcaatagtcctactactgatggcacttattcagggcat

SEQ ID NO: 92220 - DNA, 626 bp, Oryza sativa
attcctgcagccctagcgtaggattgggcggaactacgccgagcgaggccggcgacgagcggcgcttccgagctcgggcggcgacggcggcgagcacacggcgagcgacggcaacggtcggggcggcgccggctatcttccaggaggctactcgagctactactgaaagctaagggggggagatggagcgaggaggaagaacggagggaggcactaccgtgcgggacgggcgcggtgacgagaggccgacggcgtgggagtgatctctccggcctcgggccgaggaagaggaagaagagggcgcgcccggagtccccttccgcgtccacgaacgcaccggctctcccggcgcttggcgatggacggcggaggcgagacagagcacgggagcggcggcaatggcgaggaggcgaatgggagaggaaggaagggaggggggggggcttgggtttattggaggcgggaaggtcggtttgggagagaggaaccgacattgggcggtcaagccggcgagctggcgctccggctagcggccaaagcgacgacaggaggtgacgccggcgagaggggaaaaggggggaaaaaggggaaaaggagggagagaaaggggggctcgccccttgctt

SEQ ID NO: 92221 - DNA, 787 bp, Oryza sativa
aggtgactacattatttttcatcagaagcaagggcattatgcttgttttctggtttggttttgtgcatatatgctttggttttttaaaatcgtatttccccatcattattctgatttagtcaacattttgctatatcacaggcttccagagctgctcttttcctattggtggcgcttgttaccggcaccctgcaatctagcattccttatcctgcccatgcatcagtgcaatcaataaccaaaactggtggactatttacatcagagatactaagcagtggttgggctggtttcattgctggatgcttgcataccttgtctgggcctgaccatctcgttgctttggcaccactgtcgattggaagatcaagactggaaagtggactggtcggtgccctttggggttgtggtcatgatgcaggacaagttatttttggcctgctattcttattactcaaggatcgattgcacattgagattctccggacatggggaacaagagtggttggtctgacccttctaatcataggaggtatgggcatccgagaagctacagaggttcaggaatcgtcgctcgccctggaaggcgtggactgcaacataaccagcagtgagcctttacaaacccctgctgctcccaggaagaagaaagttggttttgcaacatttgccactggagttgttcatggtctccaaccagatgctctactgatggtgttgccttcattggcccttccctcacgcttcgctggtgcagcatttcttggcatgtttttgatggggactg

SEQ ID NO: 92222 - DNA, 1090 bp, Oryza sativa
gtagcaaacagaggagatcatggggaacattctcctgcagctgctcgccgttgttgcactctgcattgcaccggcgaggtcggactggctcccgggcaccgccacgttctacggcggcgccgacggctccggcaccatgggtacgtcgtcgtctgctccaccctctggaatagcattgtcaattatgattgacaaatgacaatgttgcatgcatgcatacgtgtactttctctattctaaaataaatcaaactaaggcgaaccttactccccagcacgcaaaataaagtagcgtttagcacatcattaattaagtattagctaaaataaatttaaaaatagattaatatgacttttgaaagtaactttcgtatacaaaatttttgcaaaatctataccgtttagtagcttgaaaaacgtgcgagcggaaaacgagagaggtgagttaggaaagtagagataagaactcagccctaatgtgggatgtaacatctaagctcctagtactaagggtgtgtttagttcacgccaaaattgaaagtttggttaaaattggaatgatgtgatggaaaagttggaagtttacgtgtgtaggaaagttttgatgtgatggaaaagttggaagtttgaagagaaaatttgaaactaaacacgacgtaagatattattcaaatttgtagtattaagatatgtaacattttataataataatagattgatttattttgaaacgaaggaagtacgtcatatgcaacctgaacttgtgacagaatatttgggtgcatctgtacttgcaggtggcgcgtgcgggtacggcaacctgtacgaccagcgctacggcatcaacaacgcagcgctgagcacgccgctgttcaacgacggcgcgtcgtgcgggcagtgctacctcatcatctgcgactacggcaaggcgcccgactggtgcaagctcggcaaggcgatcaccgtgacgggcaccaactacggcggctggtgcaacgcgacccgcccttactcgacatgtcccagcctgcctgggagaacattggcatctacagcgctggcatcgtccccatcctctacgggctgcagga

SEQ ID NO: 92223 - DNA, 2243 bp, Oryza sativa
catatgtccaaaacaatctgaatactataatttctaaccagtcactgtaaccatgtcctgataccattagtaatatattatagcaattattctattcggtgcatgattcatacgtaatccttatagctcgtcgggagtcaggactcaggactagaaatggcaagagtaactaatacggggtcatggcttaattacaggacattggacagaagtgttgatgaattagttgcagactttgagctcggtttgaagactgctgcggtggataactattcaagaagacttgtcgagttctgtatccttcaggcgctgcaagttgttacatctgttgatctaggagacaagatccatgatggatcgcttagtcggttcacatttgatatgatgctggcttgggagacacccactccttcagatcaacaagttaccatggtttgtgatttttttatatttgtgtgaaattgtgtgtttgtgttcttctgaaatctgatctaaactgaccaatatggtgacattacaggagagcatagctaaagaaagagaggataagaaggagccgctcggagcaaatgaagctgtcatgggcgatgagacctcactgttctattcagatatcatgcctcttctcgtatgttaacacatagctgattaaattcctttccgtaaaatttcttcaagctattcatcggtaatgatgtttcaggtgaatgaagaaccaacagttggagaagatgcatatgtgtggtttggatctgtatttcctttggcgtgcgatgttatcaatgctcgattcacctttgaagccctgactgctacaaccgctaataggcttcattatcctgcttacgacaaattcctgaaagaaatggacaagtatgcaaccacttcacagttagatcttttttgcaaacataagcaacattgcatttcctctgttttttaatggataactccattgacttttgatgtgatatttgactattcgtcttattcaaaacagtagtgcaaatatgcaaaaaaatttaagtcaaccttaaaagtttttaatgataaaacaaatcataacaaaataaacgatactgatataatatttttgaataagacaaatagtcaaatggaatgccaaaagtcaacactttcatacctccctgctagatgtcgttcttcttctttttttttaacaaactggtagaactgcaaattatactgataaagcatgagaaaatgatacaaaatatagaacactgaccaccagtccaccacatcctgatggatgccatgtgaaattgacttttttttaggtcttccgaattcttgcagaaggtgtcaactccaaccggaactgaacttgctgaagatgaattcatcttgcacatcgagggaacagcaggaacacaaagggtggtgcggcacattggaaccactagttggccaggtcatcaatctgatcaagagttatattatttctggtttcttcaggtcttagcattttacgttgatgctttggtaacattttcttatgaatgctacattggttgtatactatacaggcaggctgactctgacaaacaaggcattgtattttgaggcttctgggaaaatttcatacgaacctgctttcaaagtcgaacttacaggcagtgaaataggaaaacaagttaaaactacttcaactggtccttttggtgcaccattgtttgacaaaggcatcgaatttgaactgtgagttccctcttgcatttcttatttttgtgttcatatggacaacctacacggatcaattctttttgttattaaaattatcactttgccccttttgcaaagaatatcgacagtaaccattcatctatgcagaccagaacctttggttttggagtttcctgagatgaccagctcaacaaggcgcaatatgtggcttaccctgataagggaagtaatattccttcaccgattcatatcaatgtacagcatagactcccccattcacaaatgggaggtgcattcgagaatcatattgggggtgataaggcttcatgctgcaagagagatgctaaggatgtcgccaccgcctccttctagcttcctagtattctcgctttacgatgagcttcctaaaggtgattttgtgcttgaacaactagcaaataatctgaaagagacgtcaacgataactccgctcagtgcatcccatgtgttcaagggtttgagcaagtcgcatcgggtagctttaagtgcggagatag

SEQ ID NO: 92224 - DNA, 841 bp, Oryza sativa
ttcctgcagccctccaaaagataatctcatgggagaaaccacttgtgactatcagtgtccttgccatgatggtgttaaccatatacaggttagatttatacaccgcatttaatttcaacatacattttactcttggaaacgatcagggaacatgagatgcaaggtccctttttttttcaacatgatgcagagagtgggtcggttttgcgttagcggcatccttgatactggcagcaggattcatggtttgggctagacaaagaaaaatcggtgcactatgctcagaggtgatcatcgacacttcatcggacaagacgacgatggaaagcctagtggaagcacagcaaagcctgaaaagagtgcacgagtacatcaagacagcaaatgtcgtgatcctccgagtatcgtcgatcgcgttagcgaggtcaccaaaggtatcaatatcatcagagttcatcacacacgttctccgatcaccgaatcgttccaccgttgcgattcatttccatgtcatgttaacgcgttccttcatcatcatggtgtggaactctggataattttctgagtttgcagcatacagaaacggtgatatggatgctgacagggttggcgctggcgctggccgtgatcccgttcaaatacgtcctgatcggggtgatggccggcggcttcatgtcgaacacgaggatcgcgagagccatgtcgaacccgcagggaagccggcggtggagggagtggtgggagagcatacctgccgtcccagttcgggcggttgacgggggtggtctgtgaagtgttcgacgaaatgccggcagaaaaatcctcggtattgttcagctat

SEQ ID NO: 92225 - DNA, 6541 bp, Oryza sativa
aagtgaatctatacctccaggctaaaaacaagtaaacaaaccaagagtaagaaccaagagtcattaagagagaaatgaagtcataaccaaggagatgaaggtcacatgagctcctcttcaacaatgacaccagaaaactcaatgcaccagttatatttgataatatccatcaagtaattatgtttctgctttaaatggaaaagtaacgatgtttctatagccgcggatgggaatttaagcctaccaaatcagatttacttgaatcatcatcggtacgcgtacagccttgttacagtctgcagattcttatcttgtcgaattgtcaattctaggaaacatatttggtccaagaaaagctgtaagaatgtaggccacgttgtcttctgcacatacttcagatagcagcaacatgtaggataggcaggatatctccattatccactatatgatgtatacatgccgtgagcccactgtcttgttctagcttaatgatttaattgattaaattgcccttgtgtattgcatctgatgcatcagctgtgaaatctagatgctttactgactctacttttagttctctttctgcttttggtatccattgattgcgaagtgttgctgtatatgatggcaacaggtgaactgatccacaataagccaaatctttgtagcatgtccaacatgaataactcggtactccctctgtcctattttaagtgcagttgtgattttccgtgtcaaatgtttgaccgtctgtcttatttgaaaattttaacaaaaatgaatcatgcataaagtactattcatgttttatcatctaataataataaaaaatttaaaataagacggatggtcaaacgttggacacggaaactcatggctacacttaaaataggacggaggtagtattactttcagagtcattaacagattggagatcaaaccttgcaccaagttattgctgtttgttcagaactatattagaaaaaaatgttgtctgggggtgaggttgaaaagaacttcagagaagcagaaaataaaagaaaactaacatatgactggtggaatcctggaaattaccttgacgctgcagtatccttttcccttgattaaataattaatcatcccttggagtgtattcttgataaagtatgtccttggctagtgaacaaataccagtatctcctgatcacaccaaggaaaatgtgtcaaccttcagagagagttctgtattaaaacaaagtgagcaaaaagaaaaaaaaaatcaagtgttaccaaaagacatatatgaaacccttttttttatcagacataattatgcgccagctaggcactctactgtgacatgaccctaaccaaataggtcttttttttttcagtaaatagctacctttatcaaaaaaagtacaagggtgtcctgtgcacattgcaggcatgcatatagcagaattgtgtaatatctcaacagccaatgcaccaaacataagtacagtacactgaacatcacaagatacactttactcacctatacccaaaaaagtcttcatttcctctagagaaaatgtcctaaaagcatgttgaaaacggtttgcttttctctgattcttaacagttcccattctcctaggtctgttaccaattatcaagctgcacttttcaatcgcatttttagtttgatgatctaacaaataacaaaaggttcttgtctttttatacagacttgtgcactcattgtttaacttttaggtcaagctatttcctgtttccttcttcaaatttctctcttgtatcatagttcttatccttgtcacatcagaccacattccagcatcggcgtagatattagaaagcagaatatgatagccaggatcattgggattttgctcaaatattcttttcccaaccagctcagcaatgtccattctattatgcactctacatgctgccaagagccctccaaggacatcgatttctggctcttctgccatatttgacatgaaacaccaagcctcatcaagcttcccacatctgctgtagagatcaacaatgcatgagtagtgttccttctctggagaaatattgtagtcatgtaacatggaatgatataagtgcaaacccttgtcaatgagaccagcatggctacaacaagatagtagtgccacaaaagtcactttatctggagcaattccatctctcttcattagatcgaaaaatgatagggcttgatcttcatggttatgctttccaaaagaagaaatcagtatgttatatgtaactgtattgcgttctgtcatcagttgaaaaacctctttagctacttctaggaaaccacacttgcaatacatatctagaagtgcattattgactgagcagactgagttaatacaatacttgatcacatatgcatgtagttccttaccctggatgagcatatggtgttgattgcataaaggaagaactgaaacaacagtcacatgatcaggttttaaacccactttctgtaataacctcaatgcgcagaatgcagagtctgaatatccattcacagcatatcctgcaaccattgagttccaaatggctagatctttgtccagcgtaagccaaaatatagtttctgccacccttatcaacccctgtttgctgtacaagtctataagtgcgctcactacaaactcacttctctcaagtccatgtcttatagagaagcaatgaatttcttttccactcctgattaacttcagcacagaaagacaaggaagtatgcttgccagagtactagagttggggtttatccccaaagagatcatttcacagaacaaactgacactcacattatgcattccattttgtgaataccccacaatcaagctactccaggagacaacatctttggaatttgtagaccagaaaagacaatcagccatctctacgcaaccgcatttgcagtacatatctaccaaggcgttggaaacatatatatcaccacttgctccacttttcacagcacatccatgcaatgcagttccaacctgcaattcacctgctctcccacacgctgaaatgacagttgcagcaattagagagtcaaccccaaacccttctgatctcatgtgattgaacaaatccaccacctcaagccagttccctgaatgcacagttcctccaatcatcgcagtccacgcagccaaatccctcacttgcatgctctcaaaaacattccttgcttcatccaagcacccacactttgcaaacatatccacaagcgcgcactgcacaaacacgttgggcctcgcattaccgctggcaatgtcagtctccaccatctcccataccttcctcccctgcgcaacagctccaagcgcagcacacgccttgatgacaggcggatacgtgaaaccatccaccgctaccgagccatcgttcaccatcccccaaaacatctccagcgcctccgagaatctaccagcgtcgacaaggcccttgatcacggcgttccacgcgaaggagttcctcctcggcattccgtcgaacacccgcagcgcgtgcgcgacatccccgagcttcgcgtacgcgcgcaccaactgtgcgacgaggacggtgccgtggccgtggccgccgacgaggaccgccgcgtgaagcctccgtgcctcctggaaatccgggcacgactgcagccggaggaggagcgacgcgtgggagacgacttgagacgcggccgcatgagagccgcggcgagcggtggcggcgggagcgggagcgcatgtggaagtcgtcgccggcgaggcgagaggaggtagccgtggccgcgatttgatcctccccttgacggcggcggcggcggcggcggcggcggcgagcatggtctccgcgagccctccgccgcgcggggtttcatcagttcaacgtaggaaactgcctaaactgacgtggcgcagtggcagttgaaacactctcaagtttgaacaaacgaaatttttcataggcaaggttgaactattgcgctagtttgattttcagacaagcgaatttgaattttattcctgtttgaatcgagaaaagtctcctttcaatttttcatttcatacgtgtcagtcataaaaaaaataaaaaaaattggcaacacagattaatataaaatatatcaaaattcaacttctaccagttgtaaaaaaaaattaacaaatataattgcaaatgtgcgataactattttcagtttaatttgttatttttgttgcatacttgtagaagttgaatttggttttacatgtttgtacagtgatatatttcgtattgatctatactagaaaaatgcctgtgcgttgcaatgggtgaagtttttagtcttattattgttatatggtttagttaaaataaaattcacttaaatatatatatatatatattagaaatcatgagctgcagttaggagttcgatcgtctcaagttagcatgcgagttttttaatcatatttcttatatgattccttctatattaccaaaactgaacgatcttaagaaccgacaaaaatacagatatgtatttctaaaagcaaacgaacttaaaaactgatacacacactaataacgtaccaaaataccggcaaaaacatctttaacttttataatagtagagattgttatttttttaaaaaaatttaataactatttacatggacatgcaaataacgtcctcccgaggggtgacgaatcgcttgtatccacgtcacgcgtggacgcgtgtgacgaccatggggaggccgtgcttggggcggagcgtgatgacgtcggtgggcgcgtggacgtactccggcgagagctccagcctgaaccgcctgagtatcgcggcgacgacggccttcgcctcgaccatggcgaagctctgcccgacgcacgccctcggccccgtggagaaggacagcagcttggccatggcgccgccgccgccgtcgaacctcatcgggtcgaacaccccggcgtcggcgccccacacctcctcgtcgcggtgcatcgtcgcgatcgggaacgtcagcatcgtgcctcccggcaccgtcacgccgcccatctccaccgccgccgccgtccgcctccggatcgccggcaccgggctgtacagccgcagcgtctccagtaagaactgatttagctgccaagggaaaaaaaaaacgaagcatccttccattaatggtcacatcgaaagctcactccaccattaatggtgatagctggagatggattctaattattcaagtccacccgtttgtttcatatcaaataagacatgctttagttttcaaaataaaagcttttcacccatcacatcgaatgtttggatatatgtatagagtattaaatacgaaaaaaaaacaattacacagttcgttaggaaattgcgagacggatcttttaagcctaattatgccgtgatttgacaatgtggtgctacagtaaacatttgctaatgatagattaattaagcttaatagattcgtctcgcagtttactggtggaatctgtaatttattttgttattagactacgttaatacttcaaatgtgtattcgaatatccaatgtgataaccaaacttaaaatttttctccaaccaaataagacctaaatggttatgaaaaaaaataaaaaaatagacaagatagattaatatgtaaatatatcactccacgacatgtaagttcaaatttaacttaacaaattgcattcctaccagcttcagcttgccgagcatgtcgtaggtggggagctggtcgtcgtcgtccccggcgccggcgccggcgcactctctcacggcttcttcccggagcttgtcctgccagtccgggtgcgtgctgagaagaaacatggtccaggagaggaggtgcgaggtggtctcctgcccggcaaagaagaaggtcttgcactcgtcgatgatctcgtccatgctcagcaccggcggctgacgacgcttcgtgcccagctccggtggcgcgctggcctccagcatcagcccgagcaggtcctcgccgtagccaccgccaccgccgccggccttctccttcgcggcggcggcgagtctgttgctgattatctgcatcagcgtactcctcaccttcctgtccagcctccatactttcagattcttcttggttggaaaatacctgcaaacaaattatttcagttcagatgaaatttgacatggtaaagtgtttgtacctacctggagcctgggatttggacgctgagaaggcttgagaaggcgatgaactggagctccttgatcgccatgaaaacctgcttcccctccgcgtagctgctcccgaacgccgtgtgagagatcacgtccgcagtcagctcctcgaactggctgctcagctcgatcaccaccttcccgccatggctcgccaccttctcctcccacctcgacaccatcgaccgtgcgacgccggccattgtcgccgtcatcatcttacaccaaacaatttttcagtttactacaagccatggcgtcctgcgtcagcaagaagaaagcaatatgtgatgtgatgtaat

SEQ ID NO: 92226 - DNA, 6669 bp, Oryza sativa
gctccctctccccctctccttcccgtctcgtcggcttggcgcagcgacggcggggtgcggcggagacggcggcgacggccgtccctccccctctctctctctccccgtcggcctcgacggcgacggcgccctcccaacggctgcgatggggtcggcttcatccgcgtgcggatccggcagcggcggctccctccggcggcggtggtggcgtcggcggccgcccttttttttttttttggcaattttttccatggctattgctaaccgaataggattgtgcatggacaaaagatggacgaaaattagatgttacaaccgcaaaaatacgaatatttatattagttatatagattatagatttttagttttagaaacttgggctcggcctgctttggaaattaagaagtccaaccacgatccgaaccaccaaatttttttaaggaaaacatgcaatttaactcccagttgatcttttgtttataataatatctcaaatagatgtgcacgcctgaagtttctctatgaagaacagaagataattcatgcaaatattttatcaatgcactaataatgctagtcagatttctatatatctgtataatagctagcatcatcgttttcaccttttcctaattgtagcttatgcgtagtgaatttccaatacatgaatctacaatctgcatagcaatatttacgtattcacagtcgttaaattttcgttaaattccaattttcgttaaattccgattaagcgtatgtataccaattaatcatttggtggtaccctctccgtcgaacatgtgcattcgtctcttcacaatactagcttaatttgtatccctctaccctatgtcgacccacaaagtattaaaaccaatgagaaatgactccgctgagagtattgacgccagtgccatcgtcgtccggcgaagtccagcgagaggggattcgattggatcggaagcaatttagcaaagcggcggcggcggcggcaatttttacttttgtttttcgtttcgaggaaggaaccaggaaaaacttgggttcggcctgctagtccaaccacgatctgaaccaacaaaatagggaaaaattctaatttgactcccttaaataggtcggtagaacgtagaggtcgagatgggggacaaggcttcagattttgacattaccaaaacttaataggttaacaaaacaaatattatattgctattcaaaccttaacaaaatttggtactttcagaaacttcctcttatacaaaccctaccgaattttaataaggttacaaactaaacgcatccaacactaccaaaatttggtaacaccaaaatgtgccaacttttggcggtgccaaattttggcaaggttgatattttgacaccaaaccaaacaagcttcaattagatgctatagatgaaatggatcattgggatccggtttgacgtcgaaaacgaggcggcgctcggctccaggcgatgccaaacagagcaaagtggcgtgggcgcagagctcggcgtggttcgggccgcatgatagccagcggagaacttggcggatcttgaagggtggcagaacgacgcccaaggatcgtgttccgccgggtcttgacagcaagattggctttggattgctggcggagtgtatgcacgttaggtgcttgatcgacgctccgccatggctccaggaaggagggagcgaagcaaggcatcaaggtgtggttgtggaggtgggtagtggcatgaaacggcggcggcggcgtgccgtggttggcgcccggctggtaaaggttggatcgaagttgggctatggtgagaggttatggatttgggccgtgcattcaggctcactggccggggcagacattgtgtcgaacaccttgtgggtatgaacagtgtagttttcgcattttccagaaaattttcagataattgattagatagaatggaagggtttttttagaactcatgaatggcagggtttactgcccaagacaatgtctcttggttgttgtcaatcggtacaccacagagcacagagaaatctgatgacaaaaggacgacaccccatataatgctgtttggaatatatttactgagcagcagataacttcaaactgatcaaaggagacactcgtatatgctgatggggataagatgtacggaaagacgatatatatccagcacacataattcaaccaaccaaacagaagatcaaaaaagagaagatttgggaaataccattgcaaagatacgtgagttgtaaaatatcatcgtacgtgagaatgacatatggggcctgtacccacatttcagtgacacatgatgtattttctaactctgtgatttttgtgatggtactaggcaaattagcccatcaaaaaattagctaaagtgtggcacaaaagtatgtcaaatgataacaatgttagtatagcatccaaatttttgaaggcaaacacacggttcagaacttcaaacgagcgagaaaaaggggggacaatttctcacaacaagtgaacttcgaaaacgatcaaaattccatgcactaaaggatagtaaatgatgagaaatttaacgatatgccactcaatagaagtggctttaacaaaatgccatcctctagaatgaccttataaaaataccactcaatagatgtggctctttaacataatgtcactttaggctgtttggaagcttttaatcagaaatgatgtgtgaaatgacaaaattacccctagttcctttctcacatgtccagagtagaggaggggccgatgtctgtggggactccttccccggtggcaacaatggtttgcgtgggcggcaacgctgtagtgggggcgaccacgacgccctctccacaagcgccaaggccacctccgaccacctcgctgcatctggttgcggcgacgtccatggccactccctcttcttcttcgctccaccctcgcttctacctctccgccatcgacgaggaccgtccctggtaccaggccgacaacgatgcggcggggctcgaggagctcctcaccgcatgcccctcctcgctaacgggcccacgctgtggtaccagctcgacgacgacgtggcagggctcagggagctcctcgccgcgtgcccctccctcgccgacgagcccgcgccatggtactccttggctcgcggcacggaaccgctaaccccgctcatggtcgccaccgcgtacggctcagtggcttgcctcgacgtgctcctctcgccgccctacctcgtggaccccaaccgcgcctcggcctcatcgctctccaccccactccacctcgccgccgcgggaggggctacctctacccccacatcggtttcccgcctcctcgccgctggcaccgacaatgacaacgacgaggtcgaagagcgacaaggtgaggaaggtgaggaagaggcatttcggtcatttcacgagcgtagtctggaaaaaaaatataaaaaaaagcatcaaaacagcccaaaagtggcattctattaaagagccacctctatggagtggcatttttataaggtcgttctatatgatggcattttgttaaagccacctctattgagtggcttattgttaaatttcttgtaaatgattagggagagctcgaaatctgcaaaaattatcggataattcgggtgaatttgagaggggcagtgtggatttacaaatgatccgatttgaagagctacttgttttttttttctcctttggatttatgggctatttcagtttgttgctacttaaaccttaccaaattttggtatggcaataaactaaacacacttcaaccattactactttaccaaaatttgataattatagaagctttctctcttaaaactctaccaaattttgataaatgcatcaaagcaaacaaagcttatagtattatactatcaaaatttggtaatgctaaaatgtatataaatttgatattaccaatttagtatggttgatttgggaaataaagcgaacaagccctcgtgtgaccacctgtgtgcgctggagagatctggaccgtccgtttgatgctggccgttggatctgagccgtcggaggcctcgtggattaggatatcatcagtgttgttgtcttgtgggttggacagtagactgctgataagaccgggaatctggagtcagaaaacttttcgtccagaaatcaacactggatttttggctttgctctcactcgttgagcttcgttggatggttagtactacttcggtactaacgggttactttgatcttaaggtcttcttttttggcccaatcaatcactgaaaatagagttataaaaaataactaaaaattgctttcttcaatatcagtcctttaaaccacctcaaatactctttccttaaaagaaaaaactagtacttacaattgcaccacagtgtagtccaatttcaacatttcggggagtttctctcggctgacactatttcgtccgaaatttacatagattttctttattttttaatatagtcaagctattcaaatttgataaatatttgattgcttattgtaatattttgaaccgaatttttttaaagggaaataaaccgaaattttcaactctgaagggaggtgatgggatgcgcgacccttctctcatgcacatgggtggccctcactgcacgagctcaatttcagatgatcatgaggagctaagctcgatttctggcgttttcagcatgcctagctcaagaccatacaacgtccctcccctgcacgcgggggtaagattaacagcctcatttcttcgctaatgcttatgcttatcaactaatttttaaatttttaactttaaatttgatgttaattttgagttttttttatcgaagtttatttttcagtctttaattttaaatcgctaagaacacgtatgtaaaatttctattcacaaattatctttcatttataaatatgccgtttgtcttattccatcaataagccgaacaacgggggcctcaggctcaaagcaggtagctagaacacacgctgtactgtgcatttctgtaaatcatttttttttacgaaagaattttttccatcttttagctgaagtacctaaacaagtagagattccaatttcacccattaattacgacgagataaatacaaccatttatgatttatctacgtagataccatacgccctcttgaagcaaagcaatggcgtgaggcagcagcccgggtttgcttcctgaagcaatcctctctgccgtaaaccaggcgtctcaaatacacctgatcaaagaaaaacaacaagaacaacaaatcaggagagcccaaactccaatccggaagacgctagcgtgcgcggaaacatcgcgtgagacgccaagcttttgcctaattgcctcccaggggaggcatccaacgctgtccgtccattctcccctccgcgtttctgatgacgaactgactagcgacaatgatcgccctctgctacaggctacagcagcttaagcacggtgatcatcgaggacaccctagtaatcaatcagtcagccatacacggctaatcaatcagccaaagacataggacttgttttgtttgctaccatgccaaaatattaataatgccaaaccataggtaaatttgatagtgccaaatattttagcaatttatgtgtcttattggtatattttgatagcaaactaaacactagccaaactactattcaaaataccaacgatttagtgagaatttagactattcaccatcaaattcacgtgcctcaacttttttaccacccaatcggcatacccgctataatatgtcattaggactgttaattagtccatttggtaccactttcatgtttttttttactgtgtttctcatttcttaatttcatttgtatatttttttcaagatttgtggacgtttttgcccctgggcccacctgtcataaccaaagagagatatttctctctggatcgatcgatccctccagtctcatccgttcgccgccaaccccgccgcgccactcacctcagcttgccgcctcaccaccgagcgccgcccccaaacgccgcgccatcaccccgccgccgcatcatcacccaggcctggcgccgctgcccaggccaagcgcctcccccgtgcctggagccgccgccaggccgagcagctcccccgtgcagcgagcgcgtttagtaaatgacattgggcacaaacactatatattgattaaacaaggttagtttctcagttcagaagatttagtgaagcgaccaaggtggcaggtaaagctctcacatggtggaagcagtggtagagccagatgagctgcacgtctggaggcggcccagcatcggcgcctccccttccgcggggtggtggcacggcgctcgggggcggcgacctgggggcggcgctcggtggtggggcggcgggctgaggcgagtggcggcggcggcgagctgcggcggcattgggcggcggagtgggggtgctcggcggcggggttggcggtgcccggcggcgaggttggtgctcacggtgacgagactggagggatcgatcgatctagagagaaatatctctctttggttctgacgggtgggcctaggggcaaaaacgtcctcaaatcttgaaaaaatatgcaaatggaattaagaaatgagaaacacagtaaaaaa

SEQ ID NO: 92227 - DNA, 7414 bp, Oryza sativa
tgaaagatcacactgccgaggttagcaattgcgtggatattcttctgcaaaataacttcacattctttgccattttatgtttttggatattggaattacagattgctggatagctggtattcttcttgcatgcatacagtcatatttcctttctgtggcttctaaatttctgttacagtaaaattgaaaatatttatgaaatttctatctatcaaggatttgtcacaaatatgattataacacattttggcatgttgagctatgatactcaaaactcaagtcatactgcaaatgcagttctttcatcaaattttctttatcatttgtaccgttagctactctggtccattcatgtttcacagttacaaaacatgtgaaaatgccccaccattgtccttaaaggccctcttcacagttacaaaacatgtgaacatgccccatcattgcccttaaggcccttgttctttacagattattctctgcactggattattgaaatggattatttgctatatactttggaaaatacatcttctcaaaaaaatttcttttgctgcatttcttagataacttattttaagctatttattgagtttatttttaaaaatatttaatttatatagataatccatggtaataactcagtaatataaatcaaacagggcaacttttaccatattttatattgtaatatttcaattggtaatataaaatgtttcaattcaaattctattgtttcaaacttatttgttttacaaaaatctgtcaggttgaagctgttacagtccatgcgactcagaagtactttgtgactgcttccaaggataatacttggtgcttctacgatattccatcaggatcttgcctcacacaggtttactccattatctttctcatgtaacctgctcccattcatccatgtacttatacatgctttgtctgttagctcccaagatgtttatgagttaatgaataccttttctttactcaggttggcgagtcttcaggacaagagggatatacatctgcatctttccacccagatggtcttatcctggggacagggaccactgaagctgttgtcaaaatttgggatgtgaagacgcaggtgtgatactccggcaactcattcaagttcttttttcaggtgttcatgcatgtctgctcttgaaataccttgctaacaatcatcttttttctctagtcaaatgttgcaaagtttgaggggcatgttggaccagtgactgctatgtccttctctgaaaatggttacttccttgcggtatgaatctctccatagtgcaatctgcaaaatgttgaatttcttttttattctgatatatgtatcatcactgtacagactgctgctctcgatggagtcaagctttgggatcttcgaaaattaagaaactttaggacgatatcaccttatgactcagacacgccaacaaattctggtaaggaactttgcgcatgctccacactcacagtaaattgtgaatggtgcatgtgcttcgatgtgtgtatagatatagccaacaagcgagattatgttgatcattcaccctagatatatcttgctttctaggattttgattgtagctggaaggacatctcattccatttttgttatttgtactggagttccattaatcatatgatgcatgaatgtttttttgtttatcttacagtggaatttgactttagcggaagttatctagctgttggtggttcagatacaaggtattttctcaaaacctgcaagtctgaccttttggtgcaaatgttataccgtaaacttttatatttgatacctcctctgtttggccttcagggtttaccaagtagcaaatgttaagcttgaatggaatcttgtcaagaccttaccagatttgtcaggcacaggttcgtccctttcttatggcccacattctcggttcgtgattggcatctgtgcttgcacttaactaatttggtttctgtggcgtacacttttctcagggaaagtgacaaacgtcaagtttggcaccgatgcgaagtacattgccgtaggttctatggatcgtaacctacggatatttgggcatccgggagaagatgatcaaatggacgacgcaaagccatcggaagagtgatgaaaccaattgtacttcatttggcctgcgtaaattgctccctgtttgtgtgttttgacggtggatgagctggctgagattggaggcacataacaacgggagacgagaagttccttgcaggagcaatttggtgggctttggtcgatgtaaacaaatttgacattgttattgtatttgtaggccttactacctaatgaggatacggtttgttttggagatgaatacaatgctgaagtgctcgacttgcggacatgccaatgaaatctagaatgtgtttaaatttgtggttacgtaatgtccatgcactaacgctcgtttattcatttctcaaagttgctggcgcgatattaaggaatggtttgatggttaactaattagtcgtctaatctgagaaatctggcagcatccgaattaccttgaacagtacatcaaggcagactaagtatattgaggacctttccgtgccaccgacaagcgtggtcacataagctcactgaaatgtgggcaaagagggtaaatcctcaatttcaaacaaaagaataatgaggactctcccgtgccactaacatgtggggtcataacaagctcaatgaaatgtgggccaggaaggtaaatccttatatgtgatcaaattttaattcaaagatcaaactatggccgttggatataaatcggatggtgatgaaatatgttctggcatgggctgaaattgtcgagtggatcagtaatgggcctcgtgtgggcctcaactaaaaccctaacaaagagagaggcgcagccatcccactcacagacacacaacaagtcgattcgatccatcccggaggatcctccgccgccgccgtcccggagcgccgccgccgccgccgtcgtaccggaggtaccactccctcccctctcacatagcagccccccttcccgtcttcacctaggtcggattagctcgtggtgctctccctctctcctcgttggttctagttactctggtggtttagggcgtagagggtgtggaggggatcgggttggttgattgcgcttttttttctgtgatgtttttccttctgtgctccgtatcaaatagattgaagtgataatatgtgattcttgtggaaatgggtatggttgaaaccgctatgtccttaagagagagattggtaaggaactctgaaaccgctgtgccttaagagaattgatatgaatatataattgaagtgctaaaataaggatagtttgtagctttctttctttcaaacagctcatcattttcagggtttcggtgctgatttacctttctatagtgaagtcccttgtataatgcagcatagaggtgacaggagacgatgaaagtactcctttctgaagttttaactcctgagaggcattagaagctgtgtaaattaatgacaagttttttcattcaataatagagaagttctctaggagaatgccaacaataaactcccttgtataatagaagtctgatgttgcgttcgagttatcaacaaatatttctctgacttctctttcatgttatttcctgctggtttttgttgaacattaatggttttgatggagggtcttgtttcggttcagatcttcataagcctacggcatggcaaccactctgaaagatgcagttgcacggaagcctgtgttggcaacaatccgccttatcgttccagctggtgccgcccgccctgcgccaccagttggtccagcgctaggtttctacaggctgaacctgatggcgttctgcaaggatttcaatgccaggactcagaagtataaggcagaaactcctatgcaggttaccttaactgcctacaaggacagcacattcgagtttgtagtcaagtcaccatctgtctcatggttcctcaagaaggccgccgggattgagacagccagcggccgtccagggcacactgtagtgtcatccctttcacttcgccatgtctacgagatcgcgaaattgaagcaatctgatccctactgcaagcacatgtcactcgaggcgctgtgcaagtcaatcattggcacagccaactccatgggcattgagattgttaaagatctatgagctgcttggccccatctttgtcatgaggggagttggtgagttgcttaatgattttgtgtattactaatttttagttggggaagtaaattgtgtcctggtttattgagcagagatcttgagagttccatgcctctgaaattgccttcagcacagccttttttctctctgcaattctgatctgaaacatgtagttcccacaaatcgttctcaccgatgtcaatttgttcaatgtggtgatggtacaatgaaaataatagatttctctgatgatggactcatcaagtctgggtgaacctttgagtgaacaacctgtaatgcagcatttgctcatataagcaggatagttttccagttaatctgtgattcttccggaaatctggtcataagattcatctagcttgccttccactgcccattatgatgtgcttgcagtttcaactttaatccaaatcttcacgctgttttactacaaagaactcaatgagtaggttgtcgggtttttccaggtttttctttcttttttttttttaaaaaaaatcctccattctacaacctacattcattgttcatcttgctgtccaagtgagtttaagagaaaccgagcaaatttattttttgttcatgtgagttgaagagaaaccgagcaaaaattactttttgttcttctttgaaaagtcatcttgctgtccaagtgagttcaagagaaaccaagcaaatttaatttttgttcatatgagttgaagagaaaccgtgcaaaaattactttttgttcttttttgaaaaggaaatcgaacaaatttactttttgttcacctagtgagttgaagaccgaacaaaattactttctgttattttctaaaaaaaggaaatcgagcaaaaattacttggtagaaaacattcactgggagatcaaacgaatgtattccccagaagttcaaattcgtatacattaatctgactgccctttatctgagataaaaatgaactagaagaacagaatctattcacccagtagcggcttgttttcgggttggctctaattcataaatagacatacattcaattaaggatgcagttctcgtttacaatgaacacatttgtgccagttgaaattgatactcttcgtgcataccaaactagctggaacagtctttttttctgcttctccaaggttatgattgtacatgtttgggtactgggaccaaacagtagaaaatatgatctatccattgctgatatgttcaagcacaagatattgcagtgctattgagtacttggctgctcttccttccctggacccacaatctgaactgctaatgctcttgagtatgtaggatccatgcccatcacctaaggaagccaaattaaatcgtgcaaacataacgggaagaaacaaaaagatttagattgatagccatgaactatcatagactagaaactgacatagcacaaagaaatgaaacaaataaagtgaatcagtcatttacagttttggacaatttagttggtattcatagcagtctcatcaaacaaaactttctaagacggatacaaactaaaatgagaagtatcttgactgtcatgccatctatgtaagtgcagtgaatgaaaccaagagggtatctcatctatatattttgttactacagtgaatgaaccaagagggtacctcatcaaataagatttcaaagatggatataaaatgcaacgagtaaatgtccaaactaaaaagaattatatgcaagcacaagatgttctctgttaatgtgaaacaaagagccgatgaatagcaatagaaacaaaaggtttacttaacaaaatatgggtgaacaataaaatgacaaccggcactgtacatcagatatcttgtaagatttaccttggattgtatatattgaacttatccacctcttgtaaatgaacatggatcttggggtgtcaccttgatgaacatcagagagcaagagattacaagacccagggactccgagctttgtgctaggatagagattgagatgtttattctcaggaacataggaacatgcagaagtttaaagatctggcattgaatttatcactcactttgcatgcgcaacagcattttgacacagagctaatatgcgaaccactgctagatcccgagccctagcatttccatatctttgctgacagctcctatagtttcagtattgtcagaactagtcataccaaaaattgggaatgcacaccatacataattcaagtcaattactatagtgtataaagttctcgctttgatgatgtagatcaaacctagttttctcagaaagatcagaaaatccctaaaataaatttgtgcagcaggtggtctaatgcatcattcagtagaacaactaatagccatatcataatggagcatacagacctaacagaagtctacaccaaacattctgcacgtaaggacttggatcatcattatcacaactacaggtgcccagaattctcagctgagattattgagaccaaaaaaaaaaaaatctagaatgatcaagcaggacgacaagacaaaattaaaaacacacctttctgagaagaaatctgcaaaatcatcaataattactgcagcagggaagctgccaagcagatgaaatgccgcgaagtactttctgatgccctcatcatcttcaatgtatctacaagcacggagtacataaattagagcataaatccccatctttttgtcatgaagtaacacaaataggcatttcaatacgatcacagaccatatgcttagctgacaatagcatgcaaatctcacaaatcatcaatagtaaataaaatgtaactagagagatctcatacttgatatggattctctgaagcacgctgtgtgatagatcaataccctgaaagaaagaaataagagtaagatttagcttcacaaatgaggagcaggtgagattttgtaacccaagattccagagcacgagtagagaacaatcgctcacctgggacaagaacggggggctattctccagtctccccttcctgcagatgaacaccacgcctcgtccactctccgtcgcgcggtttatcgcgaactggaagagaagcgacgtcttcccgctgttctagcaccaggagaggcggcgaaatcggagcaagagcggagtgagccaagccgcagcatcggggatgggacacggaacgcacgggattc

SEQ ID NO: 92228 - DNA, 6227 bp, Oryza sativa
cgaagatgtgggaggtgatcgagggcgtgtgggtagagatgctatgcttctctgcatctagatgcagagggtacctacatgcgaagagtctgggtaatggcggagagttgctcacctttgtatggctcctgttgttacaaatggggatggagcccctagcagagaagctgcagagggcagagattccaaaaagaggaggaaacggagccgctagtgctgcttcattgtcttctgataagagcttggcactacagcgaaagaagactgaggttccaagtggagatgaaggaaatattgccgatgtgccatcgacttccaatgacagtatagtcattgatattggagacaatgcttcttgacacccatatttttaatatcttgttttgtatatttccttttttatgctgcatattgtttagtaattttgtttcatgtgttgttgctaacaaataaatctatgtaatgtcgtgtgatttttgttataattctaccattgcaacaatttaatcttgtgagtgcaatttttacatttgattgattatccttttgtgtcattgcccaaaagattacaactccactggtattttatataataataccaagcccgtttttcgaatgtgctcatatgaatagtgtatgtgcgtacttacagtgatgagtgtgcacacgttatgagcgcatacgtttgtagtattgatttatgtgaaccgtggatcttttgtacggactcgcgtgtcccctacagaagaaaactactactcccactaggagataattacttgataagaagcgcgcctcgtgccgtgagtggcgtagcgcatcgcacgggccatctgtcttgggggcacgcagcgtgaaggcgtggaggcgtgtggggtgggtggtggcggtcgacatggcgagggcacgcgtgtgtagcatattttagctgtgcgccattgtgccatatcccgtatgtgcgttaggcatgcgagagcgaggtttggcatcatgcgagccttgggcctggcaccatgacagaggtggattgcttgctaggccttgcctctatcggctgggctggccttggttgagggctagggggtagttagcgggatggcattgtttggttggggaataagttcattttaggtctctttatttgtctccgaattcgaaatttatatctagaccgtaaaaccggatacaacacatcccctaagttacaaaaccgtgcaaaagagatccctcagcagtattgtcccctactttgactgacgtggcgtctacgtggctcttttgactagtcttcgtcctacatggcattgacgtgacgcttacgtgacaattcgatccggaaaaataatagaacttgtggggtgcaatatcagtttcacacaaaaaataataaaaaatggtgaggtccatgtgagcccacatatcatcctcacaactccttatctctcgacgagaaggtttttccccaaatcggttcaccgtagttcgccattgatgccgccaatgggtctcgtaatagcggaaggtaatggccctatttctcctctcctctcttcctttcatcatgccgctcccaatcactaccaagccgaaccccctccgccgtgccgtgcacctgactcgattccaggacggaggctacgccatcgcagcgaggtgctcgccgacccgctgtctctcgtagactggaatcgcacgcacgcatgcggaatttaattatcagtttttgtgaaacaacatcactctctttttgtctcttctacaagcaatcccgaacaggtggagtgattcgttcagaaaacactcacccgtagatcgaagaacagccacgcaccgtgtaaatgacgtggatctggccactggtcaatcaacagcagcagctgtgatcgtgctccaccctgtcaaaacgagccactaaccatcccaatccagagagccggagagcagacgcgctgcagcaaccggcggcgattcggggagtaagggtcggggatcggggaaaactcgggtggtggtacggtgctggtgagcatgacacatgggcccatggtttttattattttacaaatcaaattactacgtaagcgtcacatcaataccacttgagacgaagtcctaatcaaaattcaaaagagctgcataggtaccacgtcaaccaacactagggataatactgccgtgaaatgagaattgagaggagaggaagtgagaagataaggatgacttgaaattgttttgaagatgatgagagggaaagagaagggcagtcagacttgtaggcaacctttaagaggcaagtttgcgaaaatcaattttctcatgcggtcgcttaagaggctagctgcaaaaatcaacttattttcacatgagggcctgttagtaggcctgcttgcgaaaatatattttttttacacaggtcttctaaggagccgtatgaaaaaatgtaggccgatttttgcatacggctcaaatcgatttttataaaccctaaccctaaaccctaaacccatacggatagacggtcttgcactcaaaagtttgtaaaaatggggatttttgcgtgtggccaatgcaaccgcatgcgaggatccaatttttacatgcgggcgcttaagctgaccgcatacaaaataaaaaaaatcgcaaaaataaaaaattccaagaatcgtaaaatacaccgccgccaccgtcctcgtcctctagtcgctgccggtgtccacgttgtcctccatcgcaagtgtaggcgcaggcggcgacagtggcaactcctgtgctggcgacgcccgacctatcggcggcggcggcggcggtgatgatgccgccgcaatcgccgcctccgaaccccgaggaggagacgctcctggcggattactaccggctcgcgacggtctagctacctgtcgtcagcgggggcggccgggttaatcgtgccggtggtggtgcagcccggctaagggtccgccgcgaagaagtggcggccacggtcgtcggagctggtgcgggtgtcctcgctgagcgtgcaggaccagatctacttccgcaacctggtgcgccaggcgcgcatcacgttcgagttactccgcgggatcctgctgcgggacgacgagcgcgcggaggtgctcggcctcacgggcgtcgccgggttcggcgccgccgcgtccgcgccgacctgcgtgccgcggtactgatgggggaccgagacctgtggctcaaccgcgactgccgaatcgtggggccgttcccgaggatctcggttggggacgccttcttcttccgcatggagctttgcgtgctatagggctacacggccaggtgcaggcttggattgactttgtcaaggctaggcagtcttcctcaggggaacccatagccacatctatcatcgtgtccggtggttatgaagatgatgacgatcgcggcgatgtacttgtatacactggacatggtggccgtggccccaacctccacaagcattgcgttgatcagaagtttgagggtggcaaccttgccctcgagcgtatagcatggcccctatggtattgagattcgcgtgatctgtgctgtcggcaaggtatacttctatgatggcctctataaggttgtttttggccttctttcccgatgcttcttcctttttaagaagaagtaaaattaacgcggtgcaccctgataacatctttgcatgctagtggctgttttgttttagtaaaataaaatgcttgtttttttaaataaaatcggtacatgttcatgtaccatcctaaccaaacacttaaattagcaagattagcctcgtttattcttttggccttggctcgcacgcacgcaggcacgaacattttgtgaatggttccgcacaggctattcctttgcatttaaacaaaagtaaaggattttgatatcatttatatgatgtcatttaaacaaaaataaattgtgcttatgcgcttcgcaaagcttcatgacatggaaaccatcagtttcatgcaatttggcacatgtgcgtgcactggtggagaaaagatttttactcccggttgggaaccttctatagtcccggttttccaaccgggagtaacaatccgggactaaagacgctatctttagtctcggttcaaatacctgggactaaagatcgatttttagtctcggttgatgttacaacctgggactaaagatgtggtcccggttgaaggtttttttttcttttttttcttttctctcttcctttttcactgttcttttcctattttcccaaatcatctcagatcaaacattcacagcacacaacaatatagttcatccaaatcattcacagcaatagttcatcccaaatcattcacataatagttcatccccaaatcattcacaacaacaacacaaatcaaatcacacattcaacacagatcgtatcaatcaacacacagattgaatctcacattaagaaaaaaaggaaaaaaaatccacggcagcgccggcctccaccgcctgccgccgcactggacgccgccgggcgcctcccccttcagatccggcagtggccggccgcctcccctctggatccgccgccgctcggctgccgcggcgcgagggccccgccgccgcctggctggccgccgcggcgcgaggctgcctccgcctccgcccggccgccgccgccgcttggccgctgacggaaaagaggggaggaatagaacagggagaggaggaggaggaagagataaagaatataatttattaactcctcgatctcgcgcacgcctcgtcctctccgccacgcatgccgatattttgttccggtttaggctaccaaccgggactaaaaataatagagatattttttctcggttgtcgttaccaaccggaactaaaaatagatctttagtcccggtaaaaccgggactattgtggattttgactgaccgatcaaagatggtttctccaccagtggtggatgtagcaaaaactgatggtttacatgacaaataaagatgtattatggtaaacctttttgtgaagtttgttttcctctatttgaataaatatgaattgtttctaagattgatgaattttttaaaaaattaactcagaaatgtaattcaagtttgattccctttgtactaagaacttagccatcttatcttttacctcctgaattattggatgtaattatttttctaatacatattataaataatgtgcattgcagttatatggttactgtaattttttttattgtttatttcattctattctgagcaaaacatgtattccgtagcgtttagaacgggcggattacttgtataacccaaggcagaaaagccaaatttgagtcatctgcgtcgacggagatgactcaatgccaggttcgttcttgggcccgtcccctacttcacatcgatgcatgcatcatctctgtttcacactggaccttgacatattggtcttgctagctgctgcctctgatatgatcgacctcttatgccatttccaacccgatgaccagaatggtgtccatagtattaaataagctgccacctaagatgaaaaaaatgatatggtaaagtgaataaatgaggaaagagaaggaaaccatattttgcatgagacatggtttctacacaatatccaagacatgatgtgagataagtagcattaaatttaagtatgaaatagtggtatttgcattggaagagtagtgtctagtactagtttcttgatgatgtggagtctatgaaaaggaaaaagtacgaattacccccccccgaactatcacagtcatccgaattaccaccctaaaccacaaaaccggacatttttcacccccaactatgcaaaccggacgaattacccccctcgacccaatccgcggtggttttggtctacgtggcgtacgcgtggcagcccagtcagcattttatttttttaaaaaatgtgggacccacctgtcatagactcatagtctctcatctctctctcctctcactctctgtctctctcactcatcctctctcgcgcgcacaggacaagcggcagcggcggcgcacacggcgggcagcggcgcgggtcaagcggcagcagcggtgcacacggctggcggcggcgcgggacgagcggtcggcaggggcgcgcgggtcaaacgggagcggcggcgcgcacggcggggggcggcgtgggacggccggtgggcaggggtgggcaggcgtgcggtcggcgcatacggcggcgct

SEQ ID NO: 92229 - DNA, 2408 bp, Oryza sativa
ttgcagtgctacgatccttgagttctgagagcacactactgattttactgcatttaatcttccagggccaggttgctcatcaattgcatatggcgttgcggaagaagtgggaccttttcatgttaatgcagatggacagggtgtacatctgaatccctattcgtggaaccaaggtaatattcaacagaagcaaaattgcctttactaacttaaatcctttatatggtatcgtcttctcttatttttatcattttgatacaccctactactagttgtcaggatgaacttggatacttttcttcataaaaaggaagaagcttggccctccttcgcattctctctctctctctcttaattctagtcaccctggagtgcatatgttatatcagtcttataacttattggactactagattggttgttggtatgatatacttgttaacaattcctgaaattttgcagtggcaaatatcttgttccttgattcaccagttggtgttggttattcgtactcaaacgcctctgatgatatattaaataatggggatgccaggactggtactttcactttgcttttcatgtggttgaaatgaaagttatgtcccccagatgtaacaatattatagtttgctcactgatattcttcttgtttcacagccaatgattctttgacgttcttaacaaagtggattgaacgatttcctcagtataaggggcgtgagttctacgtgacaggagagagttatgctggtcagcgactattttatgagcttctatttctatatcatccattatttcttgtatttactattaaaaaaattaagcccaactaaatcttaattggttaggccactatgttcctcaattagcacaagctataaagaggcaccatgaagccactggagacaaatcgatcaatctaaagggctatatggtatggctttggtgcttttgcttctagttctctaattttgttatgcaatttgattgcttagttcaaaagtagcaaatcatatgttttgattaaggcaccaattacatagctgccatcattttgaaattatgatggaagtgatttcctttgtgtttgtcttcccttaagatgtgtctctttttacaataattttgaacatattagctgataaaatgcaatgcacctcgtaatacatatattctcatttcgaacatgccattttcccaggaactgtattatttaatttattttctttgtatgtaatgacatgtttttgcaggcaggaaatgctctgttcgatgatttccacgatcaccttggcatatttcaattcatgtggaccaatggcttgatttctgatcaaacatacaggctactgaatgttttctgtgactacgagtcctttgtgcatacatcttcacagtgtaataagattcttgacattgctagtgacgaagctgggaatatcgattcgtatagcatcttcacacctacttgccatgcatcttttgcctcctcaaggaacaaagtcatgaaaaggttacatgtaagtattgaagctcctgcaactcaagttgagttttaatattttacatttacatgatactccctccgtttcaggttataagacgttttgactttagttaaagtcgaactgctttaaatttgatcaagtttgtagaaaaaaatagtaacatttttaacccaatacaaatttattttgaaaatatattcaattattgatttgatgaaactaatctagtattataaatattactatatttgtccataaacttagtcaaacttgaaacagtttgactttgattaaagtcaaaacgtcttataacctgaaacggagggagtattattaaaataaatttaatggtcttaatacttagccatgcatgcattgagttggttgctaagtaactctagtggaatcaagaaaatcgtaatgcttttctccagaaaaaaaaagaaaaacagtatagtgaaaagcaccatattttatctacttaaaaaagacgtccaaaagagttctgggcttgggcacaaaaactgattgtatacaagcaggtgaaactttcttgatctgaccatatgcatttgtattgcgtgcaattggtcgcacactgctcataaactcctctatgtatatgtttgtttttatctgattcacagtgatggtttgtatttatctgattcacagtgatggtttctttttatagtctgttgggaaaatgggagagcggtatgatccaggcactgaaaagcattcaactgtatacttcaatctggctaggtgcaaaaggcacttcatgttagtccgatcatcaacaaatctaaatgggaaacctgcaggtaaatcttatgttttttggaaactcggttgatattactgttgctgtggcacgcttgagtactaatgatgatt

SEQ ID NO: 92230 - DNA, 5306 bp, Oryza sativa
ttgccgcggctccagtatctctacctctcgtacaacaacctgtccagccatggcggcaacaccgacctcgcccccttcttccgctccttgacgaattgcacgcgcttgcaggagctcgagctcgccggcaacgacctcggcggcgagctcccggcgttcgtcggcgagctctcgcgcgagttccggcaaatccacctcgaggacaacgccatcacgggcgcgatcccgcccagcatcgccggcctcgtcaacctcacctacctcaacctctccaataacatgctcaatggctcgatcccgccggagatgtcgcggctgcggcggctcgagcggctttacctctccaacaacctcctcgccggcgagatcccgcgatccatcggcgagatgccgcacctcggcctcgtcgacctctccggcaaccggctcgccggcaccatcccggacacgttctccaacctgacgcagctgaggcggctaatgctgcaccacaaccacctctccggcgatgttccagcgagcctcggcgactgcctgaaccttgagatcttggacctctcctacaatggcttgcaggggcggatccctccgcgcgtcgccgccatgagcggcctcaagctgtacctgaacctgtcgaacaaccacctcgaggggcctctccccctcgagctcggcaagatggacatggtcctggcgctcgacctgtcggagaacgcgctcgccggcgcggtcccggcgcagctcggcggttgcgtcgcgctcgagtacctcaacctgtcgggcaacgcgctgcgcggcgcgctcccggcgcccgtcgcggcgctcccgttcctgcaggtgctcgacgtgtcgcgcaaccggctctccggcgagctgcctgtgtcctccctgcaggcgtcgacgtcgctacgggacgcgaacttctcctgcaacaacttctccggcgcggtgccgcgcggcgccggcgtgctcgcgaacctctcggcggcggcgttccgaggcaaccccggcctatgcgggtacgtccccggcattgccgcgtgcggggcggcgacggcgagacgcacgcgccaccgccgcgcggtgctccccgccgtcgtcggcatcgtcgccgccgtgtgcgccatgctgtgcgcggtggtgtgccggtcgatggcggcggcgagagcgaagcggcagtcggtccggctcgtcgacgtcgaggactaccaggcggcggcggagagggagcacccgaggatatcgtaccgggagctcgccgaggccaccggcggcttcgtccagtcgagcctgatcggcgccgggcggttcgggcgcgtctacgaggggacgctccgcggcggcgcgcgcgtcgccgtgaaggtgctcgacccgaagggcggcggcgaggtctccggcagcttcaagcgggagtgcgaggtgctccggcgaacccggcacaagaacctcgtcagggtgatcaccacctgcagcacggccaccttccacgcgctcgtcctcccgctcatgccgcacggcagcctcgagggccacctctacccgccggagcgcggcgccggcggcggcgccggcggcggcgacgggctggacttcgggcggctgatgagcgtcgtgagcgacgtcgcggaggggctcgcgtacctgcaccactacgcgccggtgagggtggtgcactgcgacctcaagcccagcaacgtcctcctcgacgacgacatgcgcgccgtgatctccgacttcggcatcgccaagctcatctccggcgccgccgccgccgtcggagacggcggcgccagcagcacgagcgacgagtccgcaccgtgcaactccatcaccggactcttgcaaggctcggtcggatacatcgcgcctggtacgtgcacgtcgcatgcatccatgcatccattcacacaacttttttgcaattaacttgcacttatctcaccatcttattactaatcggaattgtgcatgtattctgagaaaaaaaaaactttcgaacgttactatagtgtatactatagctgtagtaattataatatgattatactatagttatattataactatattataactataatatagttatattatagtgtaattgtactataactatattgtaatatctatataagttacatataaaattatatatacaaattatattatagttgtagtgaaattatatcacagatacatatatatttagatttgaaagtttttcagttttttaagatagtcccttactaattacgtgtttgattttgtgattagaatatggattaggagggcatccatctcgacagggtgacgtgtacagcttcggcgtgatgatactcgagctgatcaccgggaagaggccgaccgacgtcatcttccacgagggcctcacgctgcacgactgggtcaggcgacactacccgcacgacgtcgccgccgtcgtcgcgcacgcgccgtggcgccgggaggcgccgtcgccgatgtcgacggcggcgtcgccggcggcggccgacgtggccgccgtcgagctcatcgagctcgggctcgtgtgcacgcagcactcgccggcgctgcggccgagcatggtggacgtctgccacgagatcacgttgctcaacgaggctatcaggaggcacgccgccgccgccgccgccatcgccgccgccaccgacgaggacgaggacgacgacgacggcaggtcgttgtcgacgaccaaggacgactcgctgttctccaattaattaacacctaattagccacgagaaacttctcgtcacaatcctcatttcgccattgttaatattattgagacctttgagaaggatcggagaaatcactagtgcttccttctcgtagcgcatttgagttagctctcatgatctctaatcatctctgccttggtagggaatgtgattagtatattggtttattggatggttaggggatcgcctactaactagtgctaaattctttctgttattaattcatcaatggaagctgcactcgattaatctgttcatgttgcaaacatgtcggactccattagcaaccggccatgcatatacttgaataagaacaacgtacagctgaaggaggaagagaaatggatcttgatcagttaggtcattattcaggtgctaatgatcaaacataaacaaatccaaatgctgcaaaagtcgtcactgttcgatgcatctgatgatatcatgctgtcttccaattcaccacccagcaatgtagtttaattttgttcttgatttgacaagaacttccatgctactgccagatttttttaggcttttcaattagcacgcttgctggcttttagtcaggttcaggattagcagaaagcgactgacacacaatatactggttttactcatgaattaaagattgtttttgagagatatgaattgaagattgttacctgaagcattttaggttttaaattgctagtgtttgtggggttttgacctgaatatataaaacctagtggcgactttgcaaagtgttctgcatccatgagcttttggacttttatgttctagtagtcagacttttatatcaggatattgtaagatgtgtaagaaagggtaaggcaatgtagttcaaagtgtgatcttgtgtttatatgttcatacttactctgactagtgaccttacatcatttcattaacttaaactgaaagaacaaagtactgaagatatgtagtcaatggcaggaaatacaagatgatctctgcaaggtaaagagccttaaagaactgaacaatattgtgggcatgcacacatgacagatcatgcataataataagatagtataaattacaattgttgttgcagtcttgcaggcagatcagcaataagcaaagattgatgtgatggtaactaagatctagctagataaaggtgtgagtgacttctcattcatgttgcaattgcgtaccaaactggcagtatgacgcattttggttgatttgtttgctcctctttatcatacaaaagatgctgttccactggcttttctttgcaaaagaaaactgcagacaaaaacaaaacaaaagaaaaggttacaggtcttccatttcagagtgtgatccatctaatgatctgaatcagatgatggtagctttagtgctttccttgcatgtcttatcatgttaccttccaatttggaattacctatatatagttcttcaaggtttaatccttactcttaattattcacaacaacaaaaccttcctagaagtaccaaatattatcactaaagtagtactagctaggacacatgcactcgatgtcgggtgtgttcggaacacctggtttccaacacgaagtacccacacagaaaacggagcggtctattagcgcgtgattaattaagtattagctatttttttaaaatggattaatttgattttttaagaaactttcgtataaaaactttttaaaaaaaacacaccgtttagcagtttgaaaagcgttcacgcggaaaacgagagaaataggttggtaagaaggggcgccgaacacataaactagttttctacaagagatgttttataatggtctttgctggtagtataattaatctaaattatttatgctttctaatccaatgatcatatttttatactattatcttaactactaatagtagaataatttttgaactggtagtaaagctcatacatcaatagttgagttcacttctactagtgataattttgacattagaatattattagttctttaagatttaatgtctactcttaattattcacaacaacaaaagctttagaaccaccaaatttatcactaaagaagtgaatacataggatacatcactcaagagcttaaactagtttcccatgaatactacccaataattagctttcctgttcagtttaagatcgacaaactggtccgaagaatattgacgaagataatccactaaattaaaactaatatcctaaatcgaaatgctaatttaatcatatactaactacgttaaaataatcaactatgtttatgtttcgtaccagttatattagctttgtctatgagaagcattaatggactgtgatttattactataacttcttaaaacgatagtaatcagttttttttaacgaatcaacgagcgccaatttcattgaatagagaaggagaactttacaaagcgaaaggaaaaaagaaaggagctaggacctttggtccgagctaactaaaagaaagccagctattaagacttatcgctcctgctaagacccaagttttggcctcttccttaatcttggctaaa

SEQ ID NO: 92231 - DNA, 863 bp, Oryza sativa
aataattcttattggtatttacagctacacttgatataatctttaattggaaggccaggagaacaatggaatttgcagttaaactgagatatgttctaaagttcacatagcagccttgtgggtagtattactgccggttacatatgcatacacctgggagaatccaacaggaattatcagggccatcaaaggctggtttggaaatggtcaaaaccacccatcactctttgtccttgcagtagttatatatttgtctcccagtttgctagctgctattctttttcttctcccatttctacggcgtatacttgaaagttcagactacaagtttgtgaggttcgtcatgtggtggtcacaggtaaatttacataattacattttagtgaattgcatgatagcttcgttttttatcaacattgcattttaaactcattaaatcatatcatttttacccatcaagaaaatttaggcataaatttgttaatctcttttgcagggaattaacttgatattctcgatttttctttgtaaactacagttaactactgaccaagataatgtggaaaatatagttgtgagctactacctgagaaggagacctgatatgacgaagcaaaatgtatttttgggtcaaaaatataagtaattaactctcgatgaaatattatttatttagtaaacttatttaacaaaataaaaacattatttatttagaaataaagaaataatactgtgtgtaaacaattataatatgaggaaacagtggttttgaaattacaaccttctaacagttctgtttttacatttaatatcatttttattttaaaaatattctattagtattcttggacgcactactattt

SEQ ID NO: 92232 - DNA, 2191 bp, Oryza sativa
tcaatcacgcataaatttagaaactatcaagaggtacaaatttggaaacttttttttagaggaagatcattttttgatgcagactttgtaagaaactaataaaggttaatcagcaatacctgttcgagctaatgtttgccctctgtatgaagcccacagacgaagctcctcattcttgtcttcattctctttaagttcctcatcccattcaaccctttgctgaaagttcttccattcatctacatacatatgcacaacaggatatagtaaaagccagatgtaaatagaagacatagacactcatatgctacatcaggacaatggaaaatagtttcttctcgacctgggtaaattttctgtaggtagaatagggtggaaactccatcctcattttcctcctgcagctcttttatcgaaaaaagaacaggttcattgtaatacggggtcaacgcgctgcagatagaaatagacattatcagtttgacaagggtgccatgagaatactgaacatagaggcactgcaaaagtaatgtcaaaaggaactcacaaaaaataatgagcagcatacaaggacttacgaaaatgaaagcatgtttctgactttgggagcatcaggcatgtccataaacaaagaattggtgaaaaaggtaagacgccttctagcctccagatttgaggggacatccatagcagactctttcacagtgagtaacagttccagcctttttatctgcagcaagaaaaaaacattgttgacactcatttagaattaggaagtttagccaacaacagcaaatggttcagtctaagatatagtaaacctgaagcacacaggcaaacacaccttctctatccaggcatctgtgaattgtacgggaaacttgatagctccagccggttgaaataactgatattcttgatcccatgtcgttgtgccttcaggccttttgggggtattgaaaaaccaccatgacttgactccaaaatactgtcatgttgcaaacaaataaaataatgacaaactgctggaggtttgaacaggagcaatcatgtcatacaaaactcatagcagcagaatttatttcatatctcgtctacaagcctcctgcctctatattttttctttccttcacatccatgagtcttgtttttctaaacctgcacaaatattgcacatggtagtgaaatattcactatcatttcacccacgctatcaacaagcatggttggtccggaaaccttgtactaagacactaagtgatgatggttctgtgcatctccgggtgcagaagccaggccattttattccactatctaaaaatagcaaaatattccataattttattgtccattgaaaaatgctacaacagaagttgctcatataatgatattaaacagtaaatcgtcatggttcagtacttcatcctcatgatatttgcacatgtttaaaacaatagttgtacctagaaagttggtcttccattatatctcttgttacaacctccagcatatcttgaaaaatctttattacagcatccctatcattcttatcattcttctcctgatatatataataaacagacaatgagacaaactagaatctggtatacagacatatggacagactccatgaagtttgcatgtataacaagcattgcgaatatgagcttaccaatcatcatcagtaattgctaaaaaaaggtcatcagtagacagacagtcaatcatgaaaaggcaagcatgtttctttacgcgttgcattcattaagataaaatgcctagcttctcatcaatttacgtgccagaatgccaactgataatcctttgtactaaaatactttccggcaatataactatcttttagatattacaaaatatatttcgattatctaacatttgaggaaataaacagtacattttgcagtaatttgctgataaatggaaaataagctacatttctttagaaagataaataagctacatgttatgatgattggttagacaaaaaagatgttgaccttaccaaatattttaccaattcaacaaacttattgtaaagatctggcaaagcgtgcatattcaaatcagtaataactttgtcatcagcaatatacttttcaacttctgcaaatatagtatttatgaccctgaaaagcatcacaaaatgcaccatggatcgggctgcaggaat

SEQ ID NO: 92233 - DNA, 1812 bp, Oryza sativa
ataaataaacagctactcccattgttcccacaaaattgtcactgtttcaattttgaccatttatatttttaaatggttagtctatcatgatatgaggcttaatacaaatgtttacaatgcaaaacactttgataatatagaatatttttaggtacttataatttctttttgcagaaaatacaaatgatcaaagtttaaatatgaatagtgcttgggataaatatttaagaacttgagggagtattgctgttagcatgaaaatattgggaagcaaaagattttaagcgtactagtgtactacaaatagtaactggtcactgcaacatggacaagctgtcgtacaacaaaagaaaagacaaatataatctgtttgaaagatctattagagagagatatatattatgttctttattttaaaattatgtgaggggttttgttgcatatttgcctgtaccaatacgtgtatatatttgagcccagagccctttgatgaatacaagtgatcttcgcaacaagatccagacatagatatacaaaagtataaaaaggaaaattaacctctccaagtcgttggaaagcaccataaattccaccaagcagtgtcgagaagattgtataccaaatttgtgtatccatgaaatagacctggaaaggcaacaagaatgcagaaaataattgtatacttccctctacagcacaaatctagcttatcacaattatcttgccacaaacaaatggagcttcctaagctaaaacaatgcgagtgcttaaaaactttctaggaaaacaaaggagaaggtcgtaccaaaatgattggagcccaaagcgcaatcacgacaccaatgtttccgttcgctacataacaaaatttaggattgttataaactaatatacagctgaaattgtttgagtgacatagttaccttttgggaaaaactcatgccactgaaaagtgtgtataggtaacttcatgatatccttggtaggttcgacaagaggcttgatctttaagaataaatgcaagattaagttggttcatacagttacttcaacagaattgatttctaacaaggtaagctcacaataattgagaaaaaaaaaaggcattgctcaacatgaactagattcagcataatcccatgatttcaaaatgtaagtccccttaattgaaaggttcttcaatgatcagatcgtcatggttaccagttttattaggtgcatcttgtgtgcgtcaaataaatttatcataacattacactagaggtttctaaacttgtagagaaggtccaagtggtgttaaacttggaagcagaaggtcccaaaacatattgagtgctgctcaagtctgcaaacttaaaaaacgccatttatgtcataaaggattattttatctgacagaagttataaaatggaaatagaacagattattggatatgtgaaactaatgcggatcatttaaattgatgttttctatagccatattgggtattgtgactttcaaattggctgaaagagctgacacagcactagaaaatggaggtaagcagcgcacagtgcagtttcatacattgtgacactacaccaatactattttagctctcgtaatttaggtaaccaagcatgttgtacttgctctatcattgccatctgctaaccatgatgagaacatttagatattacacataaaacatatactatcaaaagcattaaggcagatataatgcaacatgctcttaacagtagctaaaacagtcgaaaaaaatcatatagcaacatcaccgagcacttatattccaaaaatatatatctata

SEQ ID NO: 92234 - DNA, 765 bp, Oryza sativa
ttttaacagaaaatataataaaataagatgcctttacttagaacttcctgggcaattctcatatatactgctcatgtgaacaaagtgctgataatcaacaaatatgtacatttgcccttataatattcttcatgaattttaaatagtcattgcccttttaatattctatatgaatttaaatagtcaatttttggaggtcacatccatgtttcctttactccaggactgtgccgttggactattatttgctctccttccagttctgggtggtgctagtggcatttttggaggcgtgatgtcaatggctaaactgtatggctattatcagaatagctatgttaaaataaaatctaaatttcattatcatattgatgcatgcctatgttttagtgcctgtttggttcatcagtaacctcaaatatctctaatatgcaggctgcttgtattatccgtatttataactgttgcatatatgatgacttggtcatttgttcctcgattcttgaaactgatgattcagctatcatcgcaggttagatgaattagcttgttattttttgtttctgttcctgtttttgcattcatatgtataaattcatgctcatatttcttatgtacttcaccttttatacatgttaatgcatgaatagttcgtctcagtaccatgtaagttgaaaaataacatgggtgtcccacttgcatgtgatcccaagcccctgacagtttcagtcactttggattttttttcaatcattaatctttgca

SEQ ID NO: 92235 - DNA, 580 bp, Oryza sativa
cctgcagcccagctctacatttatcatgaatttgaactattatgttcaactgcaggtggagacttttgcgcaattcggtgtggtgtttcttctattcgctcttggccttgagttttcactgacaaaggtaatcgtgaattcattgccatatcttttatctaatgttttctcttttctcaaatatgattatgaaactatataatgtgtcaaaggtttactgacttgtctttcattcatcagttgaaagcggttggacctgtcgctgtaattggtggtctactgcagattgttctgttcatgttcttgtgtggcctaactgctgcggtattaatatttatttattgtccgttgatttttttcgttgtgtttgcttcatcatattctctcttttattagaaaattacttatccaccttattgcaatttttccagttgtgtggtgctaaatcatcggagggagtatttgttggtgctttcttgtcaatgtcatctactgcagtggtaattaatctgttcaagatgactatcattcaacattcatacttagacaatttactactaccttttgggatgaatatgtg

SEQ ID NO: 92236 - DNA, 2496 bp, Oryza sativa
accttaatcatcattcatgttcatatggatattacttatctaccaagtagtagtatttaccaatcagatcatctgttttactatctttagatcttggaagccgctgataaagttaaagagaagacaaagatatatctccctttcaatatactccctcttgatccagacagtggcaatcaagcagtcatgaaatttcctgaggtttcttttatattacgattctattgagttgacttaatgctatcaaagtgaaggactttctgatactttctcactttcaagatccaagctgccgctgttgctcttcgcaatactagaggtcttccatggcccaaaacttatgaacacaaggttaacgaagacctcttggactggctacaatctatgtttggttttcaggaaaggcaatccacactttgtttgaatatttttcgttgcttatttgttcttcataactatgattctgactcttaacctacccattatctggggttttgatgtctcatcgacttcttgacatacagacagacaatgtttccaatcagcgtgagcatctgattttacttcttgctaacgtacacatacgacgaaatccaaagactgatccacaatcaaaggttctgttcttccctgaaaatattcaaaccctgagcctgaacagattaaaaatcttactttctttccttcatatgtttacataaacattttttatcccttttgatattcccttttattttctctgaagcctgagttatcagcaattttcgttgcagttggatgataacgcgctgaatgaagtgatgaaaaagttgtttaagaactacaaaaagtggtgcaaataccttgatcgcaagagtagcctttggtgactacctcagaatctcttcattgttatcttactgttcttttgtacttggttctttcttcttattgcttttgaaaaatatctgtttggactttggagttagtgctttgtgtttcattaccttacctctgcttgatggactgaatgttcataagaagcaaccaaaataatgtagaaagcccacacaaatctctgtgctctgcagttgcaaaaggtaaaacaatttgaaagatattaaaggtgaaggtggaaatttgtaaatataatttaaaaggggtagtgcaatcagtactccataacatccgacaccggttatatatgtaattcctggtctgtgagcctattagttcaaagcatatgttgtcaccctaccaattgaaggcaatatctctcatcttctcctttccttcgcgtcccttgctggtgtcgtaagtctgcacccatgtttacattaaacacacagagtaaggtgagccttagatggaataaacagaagaatttatggccatgataccatagtatttatacaatcagcatggtttgaactttgtagggttgtagttctcataatttgtaacctataaacagacccagaagggtggtagtgggcaaacttttagatggaaagaagcaggcacctaatgcattagtgttaaaaaaaagaagacaaggattgctatatgttgccgaaggccttccattgtggttcaaggttttagaatgaccttgagtatggctggtttggcatcctctcctagttttagggtaccaggagttttaactattataacatgtgttgagggacatatctagtgcaaactaaaactccaaaagcaataggtgtatggaaatctaagggctctcattaaattgaacggtccattgttgcaatctgcctctatcaactggaaaagttactcatagtgagccaagtcatatctatgtcaaatcaaagcaatcaagttttttaacatcaacttccctcgtgtttcaaaatatgtatgtgcaataattataaaaggtgataaatcatctttgaaaagtttcacgcaaaatggaccaaattcccaagttagggaataagtactgttttttcctcatcaaaaaggagaaaaaaaagctgatgccttacattttctgaacacttacagtctctgagcttccattatctttcttaatgacaggttgccaacaattcagcaggaggtgcaacaacgtaaactgctttatatgggtctgtaccttcttatctggggtgaagctgcaaatttgcgatttatgccggaatgcatttgctacatataccatcatgtatggtgtgaataaaaatctttctgcatcttaaattctccttttacttaaatttatatctctaattctttattttagttgccggattcactttatgaatatatttctcttcagtaggccattgattggatcatgtaggataacgactttatttatagcttttgatgatgcatttgctcgttctcttcatctgccttaaggactgccatggagtactgccctgcaacaaccatatatttcatgatgaataaaacaaacaatgaattattttctgtgaatggatgcgcggagtatgccatgaactgatttggttatgtgca

SEQ ID NO: 92237 - DNA, 1711 bp, Oryza sativa
  unsure (1)..(1711): unsure at all n locations
ataacactaacaataatttaagcaatacattatgctgtaaaatttattatacatggggttattagattaatagtcatcaggtattaatgtgtgatttatgtttcaattgtaaaatgttttccgggtaaactctagtaaaaaagatgttgaccatcttcttattgcctaccctgtttcacattttattgataccattgatcatatgaacatctagaaagaatgtggaagtggctacatgttgatgtacggtaacaattatgaacactgcagttacacaaaccctgtatcataagataactcaattatgatgtttatcttctatatgattcactcctttcaactcagctgttgtgacatctcattttgctaaaatcgaattaaaaatttatgttgtttcagtctaagagatcacacaactcataatttacagttactctctccgcccacaaatataaacatttctaggttgtctagcagaggttaaagttgaggagaaaagactttggtgcccctcactaaatgagggatggatgggaatggaagggtcgttaggggtaatatgggaataattttgaacgagaggcgattgatgggacaagtagtactctagacatccttatatttgtggacaaatttcaacgtnntgnaatgctatattgnntgaatagaggaagtatttttctgtaattgttgtttcatgaatgatcaatcttcacaaggtgttaaggacagtagctaaaattgctaattgtatgcctgagcaacatcagtttaagtaaattcctttatgtaaatgaggatgcaatcattcatattgagcaaaatttatactaatctacagttcaactctacgacctgttctatcaagatactatagttgatcctatggagagtctaattttgcaaccatatcaaccaatattcgtggagttcatttattgtgttagtataagtttttttttccttcgaagaatgttttagctcagaatttttcttctactgtgcccacaacaatgtttgtgttggactttgatagcttattgaggtgctgacaactctagcacttacaactctatagatggcatttgaaatgtatggtatgctagttggaaatgtgagtgccttgacgggtgaatatgtgaagccagcctatgggggtgagaaagaagcctttctgaagaaagttgttactccaatttacctcaccattgcaaaggtatatcttgttctcagctatcattccattattcaatatatgttttacactactttgctaaaattagtattttgctatcattcctcaggaagctgaaaggagcaaaagagaaaaaggaaatcattctgagtggagaaactacgatgatctaaatgaatatttctggtattagtttatcttacacctttgtacccctgttgcctatattttacattctttaaattgcaggtctgctgagtgctttcggttaggttggcctatgcgtgcggatgctgatttcttttgtcaacatttaaattcacctgatcaaagaaatgaagtgagcccactttagttattacttcagtatcatgtcttcttttttcgggtgtttgaaacaatagtagtgtaattgcctttttgcagaccacaagaactgaaaagcagaaaggaaaggtcaactttgttgagctacgctccttttggcacatattcaggagtttcgatagaatgtgg

SEQ ID NO: 92238 - DNA, 643 bp, Oryza sativa
cgacgagtcctcctccttccagccttgcctcggagctgcgatgggtcaggaatattgagtacttcatcgttagtctctgtgaactccccagctatgccgaacccataaatctcgccgctccatgtatgatatattacttgcttactgaagtactgtgacacatatactgcatctggtatgccacactccgctgcggcagcaatgacatgggtgcatggcctgtggagcagcttcggctttgcacaagagcaatgacatgtgccgtcggctttgagaacacactcctgcttcactctcttgcggtagatacccctgcctgccttatcttgacatagtatctcaaacctgtgctgttgggtaccttgcactacagctcgatgtttcatggcctttttacgcaactcctctagctttttctgcatgaaagctccaaacaaaatgctgttgttcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcataattccatatctagcaccacctgtgtcatacgccttggcccatttctctt

SEQ ID NO: 92239 - DNA, 2499 bp, Oryza sativa
caagggaagccaagtgtgaccgaagatgacctagttggcctaacctacttaaagctcgtcatcaaggaaaccctaagactgcaccccgccgcaccaatgcttgtcccaagggagtgtggggagtcgtgcaaggtgctagggtacgacgtgcccaggggcactaacgtgctcatcaacgcgtgggcgattggcagagaccccaattactgggatgacacggagacgttcaaaccagataggtgtgagaataacaagtataactttagaggcaccgatttcgagtacataccgtttggatctagacgaaagatctgccctggtccggcgttcacacatgccatcttggagctcgcgctcgccgctttgctgtaccactttgactgggagctcccctgcggagttgctccaggggaggtggatatggccgaggagacaggcgtcgtcgttcgcccgaagaacgacctctacctgcgtccggtcgtccgtgtgccgccgggagctgcctcgagcggcaatggtggcacctagccgtgcaccgcatctactacctagccttaattatgtgaaaatgtaacctggttggatcgaatggattaagtgctaaataaaatggtttatgtgttcatgtttgtttgtgttcgtcacatgtcacatgcataagagagagaatcagactatcagagaaggcgaggtccagaagcaggatcaatgttatgcaccttgcaatgtcgatagcaattggcattagtcctaaactgctcagtcatcgtgcaggatattggtgcaggtatcccatagagtcatactctggttctgtaatcaccaggcattcagaaatcaaaaccgtgaaaactaaagacaggcatattcatgctccacataattctccaagaagaaatttggataaaaatattgatataaatttttaaaagtacggaacaatggaaactttcatctgataagcattcttttatcggaataaatatatcagtggatacgtacgatacaatgaacagatcctctcatgctttgtataaattgtattacatgctactacaatacagtgaacaggtcctttcatactttgaattacatgctacaatacatctcaccatactttacatacaatcaatggtctgagagaagggtcaagcactcaagcttcctggtgcacacattaatctacacctcaattgatgcttcaccgttgcttgcctttctccattttgaggatcgttgcttgtttatgatttggacgtaagggtgaatagtctaagtgtctaaccacaccatgagcaataggtcaaccccttgcatcatatgatatcttggtatgattgagtataagactatgagagggaatattgccctcaagatctgttaaaagacatcaggagggaaacgcccaggcatagaattgttctgctgagcttgcttcagatgcactctaagtgcataattatttatctgcaatgttaaatatacttatgtaagaacaatcaaaatcaccgggagtagtgttcgggacaaaagaatcaccaggagtaaggagtagtacctcaagagtttttatctgttcctgatactgcaaaaccagttgtttcaggctatgaacctcctgagtcctctcgtcaaactctttttgacgttcatgttggatagcaaccgccctcttcagaacagcgttctctctcagatatattgccagttgctccttcagcatcacattttcctgcaggaaagcaaagcataactgcttaatttgcctaggagtacaagtactatggatgaaacgtgcatatgctgttggttgcaccttgtgcaaattatgcactgcttcagttcctgctcgctccattatggatttctccaatgcctccagggctcttgaggcacgagcccgcgcatcatctatgtctgatgcactcatcatctctctaacaaatagctcaacccactcagaaccatgatgatttgtctgaaagttttctgtagcatgtgggttttcagtgagcacatccaaatgtccattattaacaacacctgtccaagattgcaagctgacatttagcaggcattttttggagaaatttaattcatgaaagaggcatagttcatgaagacatggcaaacataagttggcaatcaagcttggacatatcctagaaggaaccaaatatagtacatgtgtcatgtcataggccaattgaaaatggaaccacccagcttgataacttgctataggagcatgaagtagaagcatgcacagtaacttcaaataaatactgaggctagagaaccgcatatcacaatggaagttcatccttgacactactcagtactcacaattgtggattgtccattaatgaacacaccacaatcaactaaaacatatcatatttaaacgggatataagaacatggcacttcagtttatcacccactctggtgttacacgctaatggcaggttgcccataaaaatgctacagtacattacaa

SEQ ID NO: 92240 - DNA, 879 bp, Oryza sativa
ggaagatttcttaatctttatcccttttcctttgcaggagtagtaggagacccagattctcctgcatcatttggtggatggcttaattattcagccactaaccatccttgggtggtgtcttttgttgtgatggatctctttcttttctttggcgttataactctaactgtagttcaagcatcacaggtatgaaccaagttggtatttgcctcccttttacctgtcattatactatttgaggtctgacacccagattgaatcagtatgtacacaacccatatatgtaactttgtaacttaataacccatatatatacttgcctttagcttgctgttgcattgctcttttggcagtgcatggatgaattattcaatgaaaaccattactcatcaaaagcagtatttggtcatttccattcacactgatgtataattcccttatcatttacatttgcaatctctgatcaaaatccacctaatgacaccatgcttccattttttgttttactcatttctatgtcaatatatttgggtgtgaactgccagccaacctgcatttcttttgtctagtatatgacttcaacacaaatccaatgtgttaacggccctgttaatatgtacacacacttttagagatcgctcttgctacttgtggcatgattcttcatgcaatcattggtcctatctattatattcttaaaacagacttgaaaggagctaccacgttcattgtggatgctagaaattcccacattaatcggagaaaaagaaaagaagagttcgagtagaaatacatttagaaataagtgaaataaaaaattattgaaagaagagtccatgtagaacacaactagagttcgaaatttttaaaaaataaaaa

SEQ ID NO: 92241 - DNA, 639 bp, Oryza sativa
gctacaatttcagatgacttctttgcccagtgattacgcctatgatcgcaattcccttgtgaatgggccggtctccagattttgtcacaccagagcacgagagaatgtactacactcttcacaataaaaggtactgtttacatctagtttcatgttgaaccaatctaccacgattgctcagcaccaccatcacctgtaacgtttcttttttacatgcatgaacagggtagaattgataaacacaatgttgcgagcttgttacggaacaatgaacaatgaggcataattttcctataagttaccttttcttcttggtcttttcaccagaggatgctgggttgctatgccagtttcgtttgcgttggttaatgaaccaattgttgatttgcttcagttgtaaccccgtttcctgcaccaggcgggccttgtcgtcttcctgaatatgtgtagaaagaattgctcgtcatgacccacaattgataccataataataaagttacggaaatggaatgttggtgccacgtacagttgggtatggccacttagaatgagcttgccaccaagcttttagtatagatgcagtatcaccaggaagtttaccagctctccgcttgcgaaggatctcttccctaatatcca

SEQ ID NO: 92242 - DNA, 934 bp, Oryza sativa
tggaactccaagatcttcctgaacgtgacggcggcggcgtgggggttccgctccgtgacgagccagcacgggtcgccccccgcctcgccgtcgtcgtcgtcgtcggcggcggcggcggcggcggcgacggcggcttggccgatctggatgcctgcgttgcggggcctcttgggcctactcggcttgacgcccttgtccttgtcgacgtcgtgggcgggctggctgatctggaggaggtcggcggcgcgtggctttacggtcctgatcggcttgacggcgtcggctgcgaacgtgttagcggcggcggcggcggcgcgtttgcgcttccacgacgacgggccgggacctgcacccgggtcctccgcaaactccggcggcgggcccttcgggaggaactcggcggagcagcggagcaggtctcggcgtgccggaccaaacactttctcgagctgtgcgtacacctgatgagcgtccatccatctcttcttgtgcaagtcggaaagcttgacgacgaccctgtcgtaaagcttctcgtcctccgccttcacccgctccaagaatcgcttggcctcgagcggcgacacgtctcccttgccttggggctttgccgttgccgcagcgggaaggtgatcggcggggagctcgatcttgtactccggacggacgaaggtgttgaactccgcgatgaggtcggggtggtcgccgaggagcaccgccgcgccgtccaccaccagggaggtggacgcgttcgcgtacttgccgtactcggtgaggatggtctcgagccccttgtagacgcacggcttcaaccagaagcggcttctcaccttcctcaggaaggcgagagccgcgcgggtcagctcttctcggttcgccggcgccggcggcgacgccatggccggctttctcggaacagagaagctaggcgcgcggt

SEQ ID NO: 92243 - DNA, 934 bp, Oryza sativa
tttgtgggggcattccagatcttcacttgcctacatgttctcttaagatttccaagagaaggcatagagttccagggttggcgattgttgttccccttgttgctacaacaatatgtatcctttcattgctccttttcttccatgcttggtataagaacagattaacaaaaagtccttcaacaatgtccatgcgagcccatcaacttgtctcctaccagcagttggtacatgcaacagatggcttctcgacgaccaatttgttgggtactgggagctatggatcagtctatagaggtaaattgttcgatgaaactggtgagaatgaaaatcttatcgctgtaaaagtattgaaacttcagacacctggggctcttaagagtttcacggcggaatgtgaagcgatgaagaacttaagacaccggaaccttgttaagatagttacagcatgctcaagcatggacttcaatggaaacgacttcaaagcaattgtgttcgacttcatgcccaatggttgcctagaagagtggctccatcctcagatagataaccaattggaagagaggcacttgaatcttgtccacagagtaggtatactctttgatgtggcttgtgcattggattatcttcatttccatggcactacacctgttgtgcactgcgatcttaaaccaagtaatgtgcttcttgatgctgatatggtagcacatgttggagattttgggctagccaagatactgtcttctcaaccctcaacgagctcgatgggatttagagggacaattggttatgctccacctggttagtttatcattctttttatttgcatctatcgatttatttaacacaagaaaatttacttgaaaacattacgacctttcaatcgtcaaatctctttcaccatagacatagcattatcatttacccagtttactta

SEQ ID NO: 92244 - DNA, 949 bp, Oryza sativa
tgctagttgatgattggaagcttctcgatggcagctttgattaggctaacaacagacctggtgatgctattgttcatatcttgttctggatcataaataccatcagagcaaatgttgccccaaataccgatcttgactttggtaagggcggagaggtgctggatgccgaaatcagaagcaccattcaggcaatccattccatgtaaacggaattccacttggaagttatcaagctttggcattgattctggttcaaactctagcaaggtcccacatctcttgattcgtaatgagaaatatgtcagacttctgaatcctttgttgctacatatgatgatccttccattgatgccacacatagttttaagtttgagaaaacacaagctgggtattgcgccaaggatctcaatatcattcggtcccattctatggatccagagttgtaattcagtgaggcttccaagcgagctcatccagtttgggaccttacggatgtaacagcctatgatatgaagcttccggatgatgcaaggactaggagggtaccacttctccatgatcagtgggccaccggtcaaatatagatgatgaaggttgctagatagcaaagctgacacgtaattttgacactcctcagcatctgaccaccaaaaaagatgaactttcaacgtcctaagctttgatagctgactgaatccttgcagagacttgcctagttcacatgacacgccaaattcctctagttctaccaggctatgcatcttaccaattaatctgtccggaaatctagtccctcttccaacatatagattggccaggcactcaagttttgcaatacttagcggcagttctagaatttcagtataagatatgtccagtgtttctagacagttcacttgtccaatctttcttgggagcttagttattaatgttgaccggagagataaat

SEQ ID NO: 92245 - DNA, 8081 bp, Oryza sativa
agtgggccaaatacaacgaccagaaggaagcgatgccgaaagctgcattccagtttggagtgaagatgcaggatggcaggaagacgaggaagcagaacaaggaccagaagctcacgaatgacctacacaagattaacaagatacttgcgaggaagaaaggtgacaaagatggaggggatgatggtgggcattatgatgatgatctacctagtggcaagaagcagcgcgcctgatgcaagccactaatagtttatcctgcgagaggtgtaaaaatgtatttgtactaggaattacagcgccatgaacaaacgacagttgtaatgttcagcgttttggccggtgcagaagggaataagaatggggagctggaacggtgaaaatatgtagtttgtccatttttataacagaacaatcggtaatttgctttgttctactatgaaaagagaaaacatcaacgaatgcccaattttctgacaatgtacgcgttaagtcatatcctttaaaatggaaaagtgatttcatccctcgaggggatatcccctcatttcgtgcatgccacctaagggtgtgtttagttcgcgaaaaaaaaaatttttgggtgtcacatcggacatttagccagatgtcggaaggggttttcggacacgaatgaaaaaactggttctaggactggtagccatcctccagggcctgcttacctgagcatctccgcgctggcttcgactccctggtgctcctagtctcttggcaactgtggaaggaacataaccatatgtggcttggtcatatgtggctttagctagtattgctgcttttgggaacttgtcaggagtgtagcgtggctcggcccattctcgttgtttggagtttgtgtttagccgccgtagttttctaagcttcagccttttattttgcattttctcccttcctctggcataagccggtctggctgattgtgttgtgtaactataattgttttcttctaatatattgacgtgcaatccttctgcacgttcgcgaaaaaagtatttcacatcaacctgttaactgaacatcttagtgtcagactcggatgaggaacagcgaggatacgatccgtatggtttcatccacaaaatgctcacactgtaatgcagaggcaattagcgcccaattatctttcatgctgcgagtttgcattccacatttggaaaaactttccagggttgctttgcctaaccaccctctgattaacactcacctagtgcctaattcttttgcccttcatgacaacctaaaccccagcttcagagttggcacaaacgagtcttctccctacacgtaccagaatgccatttcccagctagtatatgcacggtaatttggcacgtgcaacctctgcaatataatcatccgaattccatcacgtagatttctgatttatcacatattttcacacgtgcgaagcatgccggaattcattttctacgcacgtttttgatttttttttttcatttttaaatttatttttttaatatttacagaaatattatatcagcggaaagatttacaaaaatggaccttgccgccctccatttgggcggcaagctgacgtggcacacggcgtcatgacttgtgcgcattttacgctaagccccttgcagctctctgtaagggcggcaaggggctaaatgtgattttggccctgccaaaaaagcaattggctagttctttttgcatctgagccccttgttgcccttacgaattttgcacggtggccccttgccgcctagacagagggcggcaagggggccacgtgcaaaattcatagcttcccaaaacgactgtcatgtgtccatgtgccacgtcagcttgccgcgcaaatagagggcggtagggtctatttttgtaaatctttttgccgatataatatttctgtaaatattaaaaaaataaatttaaaaatgaaaaaatccacgttttccaggcttaaaatggccgtgtcgaattaggctcacatttcggtacggcccatttgtccattcggcccatgtccaacacgccccacggccctctaaaactcacgtgctaaaaatagcccaattcgaaaatttccccacggcgtcgtcgcctccgccggcgaggtgggagatgaatctctccgctaccttccgatcggcgaagatccctcgcgctcttcctcccaaatccggcgagcccgccgccgccgccttggcctcggcctcgtgcgcgcccgggaatccgtcggcggaggccgcgaaggggaaggcggcgttgggctggtgcgtctacctcatcgcctcctcccggatctcccgcacctacgtcggcgtcaccaccgatttccctcgccggtgattccccgaatccctttgattcactgtttctagagctgtttcagaagattctgtgggttatggtggctccgccagttagtgattgaaatactgcccccaatttatcgctattgttttgttaacactatgagatgtgatattaggcctgaaagttacatgattcggatgacaattggactgaaatccttgcgattttcatatatttagtacttttttaggacttgggaaaacaaatgaagctcaggttattgttcagtccctttagtgaagataattgaacatggattgattcctttcaaaaaaaaatgagcatggattaaaccttaatttgttctacttttagcaatgtatgttaaacatgcataatattttctactgaataagctgttgcctgctcttgtttctacctatcttcaatttatgacgctgtgatttacaagcagaactgtgttactcgttgggcataccaaagcttgtccttttattcgtgtataaaattgtagttgccttgaaatattctactcgtagttgtcttgctcaggcaggcttgtatacatgcttcaatatatggggtttttttttgtgtgttgatcatcggttcttgttggaatacatagcacttaacatggttagaacttagaaagtacaaagatgagaagtaaatttatactccctccatttcagattgtaagactttctagcattgcccatattcatatagaagttaatgaatatagacacatatatatgcctagattcattaacatctatacgaatgtggacaatgctagaaagtcttacattatgaaacaaagaaagtacatctttagtcgtaccacgttgaaatggtaatcgtgtgttgatgaaagtatttttattatttctagcctgagacaacataatggtgagttaaaaggtggtgccaaagcttcctctgctggaaggccatggaatctcgcatgccttattgaaggatttgtcaacagaagtgaaggttattgattgtaaccatcattttccaacagcttcagacttggttgagatgttactagaattgcgtatagccatatagtgctctagcttgtaagtgcaacttttcctttccagttttcacttgatttagggagtcatttcattttttctgaaattattttgtatcataggttggtacttttctgacatgttaccctaggaagctatgtttatttagccataccaaaacaatttgacaacatgactgtctgtactggtcacttcttttcttgttttgtttagtattatataattagtgtttcatcaaggtttctatgttcattgactctttggcataaagaaacatttagttattgttacctctttttctgcacagagaaacattaacattgtctatgtgctttagatactcaggtgccatctgcatcttttgcatcgaaatgaaatgaatgtttcccttttcaagtttgcactactacgtaagaattcctatttactgaattatttgtgtgcagcctgtgaatttgaatcaaaatggaagaacatctcccggaaaatggcacgcaaaaggagtgaacctagcatgacctcattgctgcagcatcgagatatggcattgagcagagtgaaaaacgatctggcctgtagccatctgaaaatcaaatggcactcaagttgaagttatttctctcatgttggtatgtacatgcatttaaaactatgcaaaaagtcacctgttactttgtaatttgtgagtgtgcttcagcataggcttttcaaattccatatttatgtttgaaaatcacttgtcttcaagctcaacactgttatctcgcagaatgatgaagctggttgttgtatttgtttatttaagattaagatatgaaacattgaaaattaagggtccggtgctttgcaaacattgtgtttctttacttggagactgcaccggtgtccaaaatgttatcatttatgatattgctatttcgatatatttttcttcaaaggttctccaaactacctggctaccccagaagcccagattgagtatcgtcaagcataaatgctgttatccttgtattgccacaaatatttgacgtatcagatacacacacagagcggaccgcgcgtgtcataaatatttgacgtatcagattctgtcaaacattattgacgaaatcttgtgttaacagtattaaagccatgcgttgatgggaaagattgaagccatgcgttgctacacgaaggtcaaatggccaaaccagaagaacctcaggtgataaaatatttaataaccagacaaactaaccaatcagcctgcgcgctctttaaccggattacatgattatgctctattctacataactaaagcagaattttcactgcagttaaatgtttttttcagcagtaccattttcagcaggcccgccattcgccagctcaaatggtctataaggcacgtcactcattggtcgaggaatcaatcgacctccaaaatcttctgggaagaactcaaaattgggaccaaagttgaacctgacttgacagtttggttggtcaggcagtgtatacattgacgcagctgggtagtaccgccctccaggaatgtccacaaaagcagtgccctggcatatcccattcttgaagtagcatatctcgctacctgcatttgcaaaatggattatttgatgaaaaaccagtgagaggttgaacagataaaacaatggatgctacaaagtaggaagtgtcatatagtgcaactttgcaaaacaatcattgttaggaccctgactttgtatgcgaaaaacaaacaagtaaccccttttctgtttaaacaaaaaagaccatgtaggcaagacagagagatctagtggaagatattaatgtgcacctattacaggatacctgcactgaatatctaatattgaaacttttcaattagtgcctttgtggcaactaaaatcttactgtagtgtctttcatattcaagtaggcataatataatgcaagataaggtggaatgttgactggataagtaaaaacacccaaggtaacctctttgatgtaggagggagaccttgagatcaggattagtacagtatcttatgttgtacttgtgatgtagacaaatcacagaacggaaaaatataagtatttatagttcagtataaatattatagaatgtatcgtcagatgaagatatagatactcttgaacaggacaatgaggtaaattttgttacatttcatggatatttcttgtctttgattgagtggcaaattaataagttatgcatattgtaaggctgctgcagaagcaaatcgttacattttcatgttgtgcttcctttgcttttctggtttacattctcaagatagcatcactcaagtaacataagctgcttcctttgctttcctggtgtacattttgacttatgaactgtatgttgcactcaccattaccatattatggcattatgcttctgcactaagcgcctccaataatacagatgaagatatgcaataactatatttcttggtacagaacactatgctttggaaatgatttcaagagaagtgagtgaaaactatctagtttgtgcaattgagatatagtgactactgacacacatgtaggtaaccttgtgtccaaacagggatcaagaattttctcaaaggttgaataggaaacatcaaaacaatccccccaagctgaccaatgggattgagatatttactacaaactcgtgaaactgagcaatacagaatgcaaaagaccgatgaagcttattagctgtacttttcagttttgtaaggacaagtgcactactatcaccctttaaccattggaagttgtaatgtttgttgtataaccatgcatctataaaaacactgcctaaaacctaaatcacttatttttttatgcaattctgccattggtaattggcacacagtattgcatataacgtcatcagatgtgcacccttgttattatgtacagaatgttatttgtgaaatagctagttcatacccatttgttttgtgaaacatagcatgtgttattttcctagcacggtgatctgcaactagtccactaaaacacatgaagtaacaccggtggcactcaccaggaacaggatcctaaatcctgaatcctaaatcactttaaaatgaaaatctactactggtaattccgtaattggtacaaattctacattatgccaagtattgcatataacatcatgaaacctgcatccttgttattacacagaattttatctgtgaaattgctagttcataccaagttgtttcatgaaaaatagcatttgttgttttcctggctgacaatctaccactagtctattgaaaagtgtagagtcaaacacaatggtagtatggtactgaccaggaactggatccggcgtcttctgctcagccgccttgggagcttctgcgcggaaaggaagccccttgtagtgaaccaggaagggctgcttgggctcatacagctccccgtcaggaagatgaatgtagaagccgaggacatcgccatcgccatagccttgctcagcgtaattggccctccatgccttgtgcaccttggtgccatccatgtcgcggtatccgaatccaaacacatcgtagccaacgggtgcgtggatgtcagcattgttggtagcccatccaaggcgggtgtggccggtgctgccgaggtgaaggaccttgacctcgaagtaccaagcgccggcagcgacgccgcgggtggcgcgcaccatccggtagccctttgtgctgccggcggtgaggcggtcgtcggagacctcgaccttgtcggacttgaagacgcgggagaggagcacgggccgatcgggcgcgtcgtcgttgcgctcggcggcgaatcggggcgccggggtgaggacgagctcatcctcgccgctggagggcttggggaggcggccgttggcgccgccgctgccgccggcgagggcgttggccggctgcttggccttcttcttgcccttgcgggagttgggcctggtccagacgctgttgctgttcttcttcttggacttcttgctcggcggcgccgggggcgcgagggccatgtgcttcatggcgccgcccaacgggttggtcccgtcgtcgtcgggtggcgcggcgacgcccgaggcatcagcatcggatgcatcggcgagcgcggcgtcggagaagggggtctcgggttcggcggaggcggaggcgggggtgtcggggagatttggggtatcggcggcggatggggtggcgtcggacatgggggtatcggcggacgcggggtggaacgcggaagggggtggggagggaggcgcatcgtcgtcggcggcggcgtccgccatggggagggtttctgtgcgatttggggtcggaattggggatttgggtggttttgctgctctctctcccgcggtttgggtttggtttgcgaaatcgcgagcgggaggaggatgcggtgcacggcacccggcacccggcctcccgcgagtggaaacggtagagcagtttgccgttttctgcctgcacaccgccgaaaatatatctctgcgatcactggagctagcaaaatcgatcaaaaactgctgaaacttgggctgcaaattgaactagaatcggactacatctgggtttcctccctggctcaacccgtactactgctgttctgggtgctcgaagcaaggtttaatcgttaagatcc

SEQ ID NO: 92246 - DNA, 556 bp, Oryza sativa
cgcgtcgcttttgcgccgtcgccttcgccgccggatgccgtcgccggcaacgcgacgcgcgcgtgccgccgccgttagccctggccggccggtcggctttgatgccgagccgagcccggcggccgcctctatcgccgcccgtccgatcggccccgagggcgatctgggccgtcggttccgtggaccggcggtggaccacccgcgtggtcccggtccacggtgaaccgctctccactgagccgctgaccagtgggccccgcatgtcggcgccgcacctcccccgtgctgacgtcaaccctggaaaatattgcgcaataaaatatttaaggatttttgttatagtaataaacacagtgaatcttctaaaattcataactaattcatccgagctccgtttaagcccattcaagtctcagtaaatcaagaaaatatgtagaatccattaaaaatggttttgttccctgtttcagtagtcttatagcctgtttgcaatgtttgccttgtatgtcgctagattccggttcctccgacgctccggtgtacttcgaaatagtcg

SEQ ID NO: 92247 - DNA, 824 bp, Oryza sativa
atgctactgtataaataagatgaactcgaggaagacaactatgatttggcaactcggtggcggtggcggcggaaggctcaatcctgttgggttggagcagatcaatccaaactagttgcctgaatccttgtgtgttcttgtttctcttgttaatttcttgagatcctgacaatctggtatcagagcctctcttgcttctcaaattctcttgattctgcggtgaaattgttccttggggtggattggagctgatcttcggatcggcaccgcgaaaaggaaacttgccccctaaggttcgcggaattcggagcgagagcagtaggtacctgatccagatccgaggccatggagactgataagaagttggacctccttctgcaacttgtggaagggaatgagaagaaacgagttgaggctgatgagcgcaccagggcggagtaccaagatctcaagcgtacggtggagtcacggattcctgccgtggagaagagggtggatgaactgggagccgcgttccaggagttgaatctcaaggtggacaagctcgagagtaagatgatgcaagctgccaaggtggagatcgggacaggaagtcagctcaaagaggaacaaactaatggtatgggtgggagcacacaaacccacccctctggtatgcaagacccaaattcaactccctctgcttttcatttctgtgaatcatttgcttagaaatctggtggctgtggtggtactatggaaattagtggtagtgttcccccaatgatatgcccacaattcagtggtgataatcctcagatgtggaaggccaactggggtgcagg

SEQ ID NO: 92248 - DNA, 709 bp, Oryza sativa
ttacaatattgagcgggttttgtgagcactgcatcaagatgattctttgttagaagatgcaacagtttattcagtaatgaaatgaatttgtacagaaacttacatccatgatcgctgtttgaatctttgggttctggaatgcaacagcaacttctgggtttgccattattttcgatactacctcctctggagtcatgccaacttgcgctgagcaaacacaaaatagattgatgtcatatatgctcatttgaatttgaataactttttacaaaatgcgatggaacaattttgcaatagatgaattgttgcaaacaatagaaaactagttcagcacaatggaatcacaatccagtttaattatctccacccacctaccaagtatgcaaggacataataatgggagcaggtgcgaaaaactctgctaggcgtatctagcaccagaaagtgacaaagggggtaaaagaacatatgctccatatgacttcactatagcccaaaaagaaagaaaggaagacagaaaagaaataaaaaacaggttcgcattaggggggaatagcacatatcatcgaattgctcactgggatagggtactaaagcatagcatggaagctaaacagaattccagtgttccaatcaggaactactaggtaaatgtggaaatgtttaattcactcaccaaactgctgcctgacttctggactgctaaggt

SEQ ID NO: 92249 - DNA, 8387 bp, Oryza sativa
ttctttttccccgtctgcttttccctccagatggtctacaccaggactggtagccgcgcaacaggcgagggcagcaacggcgaagaacgcgctgatggtgtgcaccccaacagtgattctggcaatggtccgccaccacttcccgagaatccgacgcttgcccaagttatggcacatcagactcagatgatggcagccatgatgcagcagatgcagcagcagcaccagcagatgcaccagaggatgatgcagcacgccgaacagcagcatcaacagtttggtccccctccccctcagtccaagttgccagagtttctacgcgtcaggccacccaccttctccagcaccaccaaccctatggaggcgaacgactggctccatgcaatagagaagaagctgaatctcctgcagtgtaatgatcaggagaaggtcgcttttgccacacaccagcttcagggtcccgcgtcagcttggactgtgacagagtacctccatgagttcaatcgcctcgcgcgatatgcaccagaggatgtccgcaccgacgccgagaagcaggagaagttcatggcgggtctggatgacgagctgaccaaccaactgatatctggggactacgccgactttgagaggctggttgacaaggcaatccgtcaggaggaccaacgcaacaagatggacaggaagaggaaggccgctcagttcagggcacatcagggaagtcaccagaggccgcgcttcactcccggacagcagggtggacctaccaccatgatcgtccgccagcaccgcccgttcaaccctagcaacttccaccagggcaccagtggcagtcagaaccaccatggaggtcagcccaaccgcggtgcagctccacgcccatcagtggcaccggcacagtcaggccagcccgcgcaagccaagaaggagacgggagcaaaaccagggtcctgcttcaactgtgacgagcttggccacttcgctgacaaatgcccgaagcccaggcgtgccgggccaaggtttatccaggctcgtgtcaaccacgcatctgcagaggaggcacaagcagcaccggaggtcgtactgggtacgttccctgttaactcaatccctgcaacagtactttttgattctagtgcaacgcattctttcatctcaaagaaatttgtcgggatgcatgggttaataagagaggaacttagcacaccgatgcgggttcataccccagggaatagctccacttcggttcaattcagcccttctataacaatagaaattcaaaggtcaccatttctagccaacctcattcttctcgaatccaaagacctaaatgtcattcttgggatggattggctgaccaagtttaagggagtcatcgattgtgcgagtcgcacagtcaccttgaccaacgagaagggagaaaccgtggtgtacaaatctctagtctcgccaaagaaaggggtctcgttgaattagattgagacggaaatcccagtggacaccgtagagaagaacttgagaaaattggaagatatacccatagtctgcgagtatccagaagtgttccccgaagacctcactaccatgccacccaagagagagattgaattccggattgacttggcaccgggaactgctccaatctataagagaccgtacagaatggcggccaacgaattagcagaggtcaagaagcaagttgatgagcagctgcagaaagggtacatacgaccaagcacttcaccttggggcgctccggtcatttttgtggagaaaaaggataagacgaagaggatgtgcgtcgattatcgcgcacttaacgaggtcacaatcaagaataaatatcctttaccgcgaatcgacgatttatttgatcaactgaatggagctaaagtgttttctaagatagacctgcgatcaggctaccaccagttgagaatccgggaagaggatattccgaagacggccttcaccactcggtacgggctatatgagtgcacggttatgtccttcggacttaccaacgcacccgcattcttcatgaatctgatgaacaaagtgttcatggaatttctggacaagtttgttgtggtgttcatcgacgacatacttatctactcaaaatccgaggaagaacatgagcaacatctccgtctggtacttgaaaagttgaaggagcaccagctatacgccaagttcagcaagtgtgacttctggttgacggaagtcaaatttctgggcgtgacaggagccccagtggccagtttagttttctgtaaagtcaacgtacaaccatcttcacacatgtcacgcccggaaattcactagtaatttccgaacttatttgtgcataaaatcctcgtccaggaatcagccgaggtacacaaactgacaatttaatatataaatccatcataataataacgttacacacttacaaaagaaaagaaaacagcagcggaataacggtctagcgatggcttcagctccactcccacaggcagctcaactggggtataagccaaacgtcttatccttctggatcctttttcttcaactgaggttgattgattattgcaagaatgagcatatgacatactcaacaagccacacagcaaatatgcaagtgcacaaagataccaaaggatggcataatataggctcatttgcaaaagcagcatttagcaaaacatttaagagaagtaaaacagtggagtaattaatcagaaattttaatcaacactgaacaacacacccatgctgcacaggcccaaccattctgaacaaccatacccggccgtacagatctaactccaaaccaggagctaaacaaattattaccagttatagcatccataattattgtgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctttgtacaacacaactcaccacagtgcaccattcctggatcataatcacccccttataaaacaaggcatggactccccagcgacccccatgggcttatctccgccacttctcagtctggtgctccgcaatgaaccatgttatacaaaaggtaaagccgttgcccacgctggcttgtggttggcacggttaatgtttcacaacagtagctcgcgaaccggtccttaattgccatgagcacgactctcaaaaccatgtgctcacgacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatataaagctcaactagtcaagttataataatccaaggtatcaaggaataaagtaatcaatgcaaacaggacataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattagtcttcttgaatacttccggcgcactcgcgaaccttcgcaacgacggaaacgacaagctaacacgcaaaacgaagaaaaagactaataaaaaccaaataaacagtacatataaagtactcaaacatgtagatcataattttagatgaattatgagacttgaacggcctcattctgacttcatatgaatttattatgaattttacaagattaaatctaattaaagcccatttaaaaagaattaaataaatttaattctatttatggataattttaatacgtagatctttattttacacaacttttgcaacttgaaccacattaaactgagttacaaagaattagttatgaattttcaaagattaaatcggattaaaacacttatatagattttaattgaattatgacgcaataatgaattatttttgaaaaggaaaagaggattattgcgtcagcgggctcgggttcacggtggaccgggtgcacggcggcggctcatggaaacgaacggccgagatctaccctatccacaacgaacggccgagatctaaacggtctacgaccggtctatggcgaacggcaacgatgacgtcagcgatgacgtcatcaccggcgacggctcgggcggcgcatgctcaccggcgaacgacggcgcgacgacgcaaacggaggacaccaacgggtagagggcgacgcggcgaactcaccggtgaccaaaacaacggcggaagagcaacagacggcgccggcgacgaggaagaagcggcgacggtcttcgggtcgacggtgatggcggtgctccggcggtcttcggcggcggcgaagcggtggacggggacgacgacgacctcacgatcccgatggtggcgacgacgaccgacgacggcggctgcaacggcgacgcggcgcggctgaaccgacggcaacgacggcgacggctagggctgcgcggaggcggcgctagacgcgacggcgggctaaggcaaaggtggcggcggatagaggagagctcgggggtgcttataaaggggctagcgagcggcgacggaggcccacggcgaccggcggcgagaaggaaagctagggttcggaggagagaagtcgatccgaatcaaactcgaatccacggatttccaaacgaaattagccgacgattccaaaagagaaaaggtagaggagattgagaagatcatttcccctctattgatttcaccggattgggaaaaagacggtcggatttggaaggagacgacggcggcgcggcgctagggttcgagcggcggccggcgcgaggaggaagacaggcctgacaggtggggcccacctgtcagcgggagagagagaggagagcagcggctcggatgcgggccggcttgggccggggaggagagagagagcggttttgggccgactgggccggggagggagagagaaagagagaggttttaggccggctttcggcccaaagccaaaagagacttttaaaaacctttttcaatttaaattattcatgaaatgatattccattgattaaaaatacttccttggctcaaataaatcccagaaaaatctaggaactttagaatcaagtaaagtatttaatgaaattttatctggccctattttatattggaatttattaattaaaattagatcttctcttttaggcttttaagatcatttctaataattccttttaaacaacaatttataatttaaggatttttaaacaagaaaagctcctaacaattataattagatcattaatgatcaaataattactgaactgttctttgtatcatttaggaattgagctctgaaaaatccgagaaaatttcagagagtgtaattaatcatggagaatttaataaaaattaaatccatccatgctttatatttaggaaattttatttcccacatttaacttcacttgtaaattaaagaacatttaatataaattctaataataatttattaaataatttataaatcctgaaaaaaaatcaggatgtgacaacacagctgtatatggccacatcatataaattgcattgaaagctaaactaccattaaagataaaaaaaaatttagttagccgtacacaatgcaatattaataaaagataatctcgtaagacgaaactggaatggtaatgaaacttgtgccttttgcaaggaaaaggagactgtcaacgacctgtttttttttttcactgtgagttggccaaatatatttggagcctcatggctaatggcttatgtgtttggagctcaaatgtcgtcccaactctttcgagcaatttttgatcagggcatagtttatataccaaatggaaaaaaaaaatcacattgcgggattggccgccatgtgttgggccctctaggaagccggcccgtaatatgttttgaaggataaagaagatcaagtctcctgatatggtgtgtttcatctgtttgtttccctcttatattggtcaggtttacaaagccaggaggatcaaatcaaactggaacaatgtgcggaagaactgacgtctacagcactgcactgtcatcagcaagactgagttctgttgggtcaagatggagttgtcctgtgaagctggagttgtatcgcttgggttgaagcctttcactgctgcacaaccgattttgccgccggttggcaaccatctatttgtcccggttatgcaaccgggacggcgaatccgggactttagtcccggttggtgttctaaagatgtggtcccgactatagggtttttttttcattttttttcttttctctttttcttttttactgttcttttgctatttgcccaaatcatctcagatcaaacattcatcactcatagcaatatagttcatcccaaatcattcacacaatagttcatccccaaatcgttcacaacaacaacacagatcgaatcacacattcaacacagattgaatcacacattaagaaaaaaataaaaaaaagaaaaaaaatacagcagcagcgccggcctccaccgcctgccgccgcaccggcctcctcgccggccgcctcccctcccggatccgttgccacccggccgccgcggcgtgaggctgcctccgcctccgcccggccgccgctgcccgtcgctacctgagaaaagggaggaagagaatgaggagaggaggaagaagaggaagagatggggtgaagagataaggtgagggtggaggagatagaacttattaactgatcccgtattctcctcctcgatctcgcgcacgccttggcctctccgccgcacatgccgatcttttttcccagttggttacaccaaccaggactagaaacatatctttagttagaggggtatggcaccgcctgttattcttttagccgggactaaaaatgatctttagtcccgattggtgtttccaactgggactaaagataaaaaagtagctcgaaccttttgaactgggactaaagataatagttagtcccggtttttattgcaaccgggactattgtggtttttgctcgaccgggcaaagatgttttctccagtagtgttttgatatgctggaatgtataaatatgttcagaaacgtctcaagttggagctgtagtacttttgagttttagccagtaaactttttttgctctctgagtctttgaatttcatatgtcatggcccggattagggttgacaacggggcgggttgagctggaatgcccccgcccccgctccccgacttctccccccgaccctgaccccgcagaggtggttgggtggaaaacgtcaccagccccgatccccacagggacctggcgggtgagcagggccccgcactacccggctgggccggtggacggcaagatagacaatggcgacgaggacagcgagttggaagacgatgaggcgagccgccgccgcctgcgcctggccgtcgacgccgccggccacgccctggtcaccgccgccgcctgcgccaggccatcgacgtcgccgcccgcgccctggccgtcgccaccgcccatgcctggcggtcgacgtagccgccgcctgtgtggtgtgagggtgacggggagaggagattgggagaggaaagaggataaggctagggttttatttttatattttagactattgttggattgggctcttttgggtcttccatggactacattttaaggtttaatttacatcccacggggccccgcgggtcacccgcggtgaaatgcctcccccgtcccctccccgcaaaaatgtggggccccgaccccacctcacccgtgggtcaaaaaattgaacccgcccccgccgccgaaagggtggggtccccgcagggagacggggcgcaaaatgcaccaagcccagctggaggagatccaggcgcgcgaggagacgctggactcggtcatgcgtgagacggaggaggagcggcaggcggcgctcatcacctcaagcgccttagacgaggtgctgggcaacatccgcctgcagtatgaggcctacgccgaggtcctggcgaagagggttgaggacgcccgcggggtcctcgacgcggccgcggcccaagtgcggcgggcatcgaaggtcgacgcctcgctgcgggcccggtcggaggcgcttaggccgagcgcaaggcctggacgagcgcacccgcttcgcgcaggagttcgaggccacgattcgcggcgga

SEQ ID NO: 92250 - DNA, 5527 bp, Oryza sativa
tgaggagcgggcgcgcgcgttggaccagcacgagacaaccttggccgtccacgaggcgacagcggccgaggcggaatcctcccttcgcctccgcgaggaggccgcgaccgagcgcaaccagaccaccattgccactgaggctttagtggcccgtcgcacagaggagctgtggctccgagaggaggcgtggcgggaacgagatgccgcgctcgccgagcgtgaggccgaggtgaaccgccgcgaggtggcggcgcgccggctaggcgagcagctcaccaaatgtgaggaggccgttgctgggcatgagacccgccatgtggaaagcgcccgtgttgagcgcacggcgatggtggcgagggcgcttgagctggaggccagggagaaggaactggcagcgcgcgggcagcccggcgacgccgagttggtcagccagctcaccgcggcccaagatactctcgccaacctggggtgtctggtacagaaccaggctggggagatcgcggccctccacctcaccaacgacatcgggcctggccaactctacgatgccatcgaacggctggagtgcgtgggacgccgggtgggcatctccgtgcgccgggacaagaagctcctgcccacaagaccggcgctcgcgcttcggctggacgagatggcggcggatctcgagaggctggaggaggaggtcggcgaggccgtgaagtcgtcatcggcttccttggcacgggctgcggtggagcttgtcctcgcgagtcatcaagctcgcgaccccaacatccttccgtggcacgtgctcgaggatttcccccagggattgagacgagggctcaggagcaagttcgggacgcggccgacgtgatcatctcaagctttgaggggacggccccttggttcaccctcgcgcttccctcagatgaggagagcgggagtgatgacggcggcggcgatgatggcaacgaggattgggacaaggtggtcagcggcgctgtacttggaggcccaggcactccgtgattgcccccgcctctcctcctttattttgttatgtgctcgtggtgaacgcttgaaactctaggccattgtgccatcctggttgtaaataaagcttctcctttgcacttttacatccttgctttctcttctaaatgcctgcggcaaggaaaaaaacaaagcgaacgcatttagttgacttctttacgatcaagttgccatttttactccctttgtcccgcccctcgggctcgttccggtaaaaagggggaatttgcacttggtccgcgacacttaggtggcgaggggcaaggccgtcgctccaggggagccgcccagcgggactaaccagaccgaggccacggtgatcgggggtcggggatggccatgtgtaggcccttccgagcccctagggttcgctgcagcccggggcacggcccgcgttcaggctccccttcggttattttcaggttatccaacgccacttagggtccggagcaagcgcgaatcgtccttaagccaggacgagccataggaaggagtaagaaagggcgcgcaacagcttttgattaagcagaaaaatttattgctgagggagggattggatacaacatatttaacagtggtagccctcggccaagcccgcacaggctgaggagtgtgcgggggttggcccgagccccaagaaagcaaaaaacgcgcgacattatgggtagaaacggtggagatgctcgatattcctggggttaggcaactccgtgccgtcctccatggttagtcgaaccgagcccggccgggggacaccgatcactttgtatggcccttcctacattggtgagagcttgctcagccctaaacacgactgtatgcggcgtaggacgaggtcgctgacttgtagtgatcgggctcggacgtggcgctgatggtagcgccgcaagctttgctggtagcgcgccgcacatagggcggcgcgccttctccgttcttccaaataatcgaggtcatcgctgtgaagatcatcttggttggcctcatcgtacagcgcgacgtgaggcaaacgtagggaaagctccgagcataggaccgcctcagggccgtacaccagggaaaaaggcgtttcccccgtggcgtggctcggggtggtccgattcgcgcacagcaccgcgggttgctcctcgagccaagaatacccgtgcttctttaggatgttgtacgtcttggtcttgaggcctttgaggatttcggcattggcccgctcaacttggccgttgctcttggggtgggcgagcgaggcgaagcacagcttgatgcccatgtcgtcgtagtagtcgctgaatagctcactggtgaactgggtgccgttgtctgtgatgatacggttgggtactccgaatcgggatgtgatgcccctgatgaacttgagggcataatgccagttgatcttgacgaccgggtaagcctcgggccacttggtaaacttgtcgatggcgacgtataggtgctggtacccgcctcggccgctttgaagggccctaggatgtctagaccccagaccgcgaagggccaaaagagcgggttgggccaaaagacctggttcatgaccagttgggaatcgcttagaactaggaggcagcggatgcccattccggctgccgctctcagtcccgctatgagtcctttgtattctgccatattgttcgtggctcggaaatcaagtcgaacgacgtacttgaggacatccccgcttggcgaagtcagcgtgactccggtccctgcaccttgaaggttgagagagccgtcaaagtgcataacccaatgtccggtgcgaatatcggcgttcgggtcttctccatctccggggagggagggaatatgggacggaatagagtcgtccgccggggtccactcagcgttgaagtcagccaaaacctggcttttgatcgtgtgctgtggttcaaagtgcagatcgaactcagcgagctcgatggcccaattcacgatccgaccagtgccctctcggttgtgcaggatctggccgagagggtaagacgttacaacggaaacccgatgcgcttggaagtaatggcgcaatttccttgaggccatcaagactgcgtaaagcatcttctgggcctgagggtatcaggttttcgcatctcggagtgcctagctgatgaaatagacggggcgctgcacctttcggtggggtcgacctttgtcgttagggcaacctagctcggggcgcccgtgctcgggggccccgagggggtctcgagccacgtcagtgcgacaggcctcggggccgtccgccggggcctctctctctcccacggggacctcagggccttcccgggggttgggggcttcgggcatcgggctgttgggggacgaggggccatcactagttaaggggacccctggtcccttcccatagccgggctcgcgacgcaggtcaccttcgtcacgctctactacaagggcggcactcaccgaatggggggtcacagccaagtagagcagcaacggttcctctggtcccggggccactaggataggggggaggtgaggtaagctttcagctggctgagagcttgctccgcttcctccgaccatacaaacggcccagagcgtttgaggagcttgaataggggcaacgccctctttcccagcctcgatattaatcgactcagggcggccatgcatcccgtgacgcactgcacatccctaagtttgctggggggcgcatcctctctatcgcgcgtattttctcgggattagcttctatgcctcatgaggaaactaaaaaaaccgaggagtttgcccgccggcacaccaaacacacacttctcggggttcagtttcatgcacgtggacctgaggctgtcgaaagtctcagctaggtcttgcaacaacgtgtcctggtggcgcgtctttaccaccaagtcatcgacatacacctctacattacgcctatttgatcactcaaagtaatacgagtcatgcgctaaaatgtagggcctgtgttcttgagaccaaaaagcatagttgtataacaaaaggtgcctacaggaataatgaaagcagttttttccttatctttcctagtcatgcggatctagtgatacccggagtaggcatctaaacaacacaaaaggtcgcaccccgcagtggagtcgactatctgatctatgcgtggtaaagggaagggatccttagggcatgccttgttgaggtccgtgtagtcgatgcacatccggagcttgccgttggcctttgagacgaccaccgggtttgccagccactctgggtggatgacttctcggattccaggagccgcatcacctcctctcggatgaaggcttgccgctccggggcttggtgccgtactttctgctggacgggtcacgcatctggccgcactgcgaggcggtgctcgatcacctccctggggaccccgggcatatccgatggctttcacgcgaagacgtcggagttcgcccgcaagaaggagacgagcacactttcctatttggcgtccaaggtactgccaatcttggcggtcttggatggatcatcgccaaggggaatctccttgacgggcaactcgtcggccgaggcgaggcgcctcttggaggcgcggggtgtggagggctccggggcctgcggcttggtggctgccgccaagttatcggcgcgctgctctgcacaagccagggtgactttgacatcgccaaagacggtgatggggccactgtggcctggcatctttatctggaggtaggcgtagtgggtggcggccatgaacttcaccaacgcgggcctcccaaaaccgcactgtagggcatattaagatccgccacatcgaagtcgacccgctcggtgcggaggttggtagagtcacgaaaggttaccgggagctcaacgtgacccagaagctacgtgtgtcccggggtcacgccgatgatcggcaggtacggctgaagcttcatccccggggacttaagggcatcaaaggcagccggggagatgatgctgaggccggcccccccgttgactagaggacacttcatcttgatgttgtggatggttcgggagatcacgagggccaacttccctccccaagcgagcaccgtcggatggtcgctctggtcgaaggtcagtttcacttccgaccagcgcgccttccatgttgcctcgtgagttgggatcgcggccagaagctcatgcctcatggccttgaaactgcggcgggaggtgtgagcgcaaaccccccgtcgcgagtggcgacggttccctgaggtatctggaattccaggtcctcgctgtcatcatcatcatcggcgggggcctttttattggcctccccccgccggtcgctagcgggggtcgcgggggccttgccctcccgttgactctgccgcttctcctcatcggcctttcggtaccgctcggccaagttcctgaccgagctgcagtcggtgaggctgtgccgatctgtgcccataggtgttgtgcatcgagcaccacttaccgcaga

SEQ ID NO: 92251 - DNA, 1679 bp, Oryza sativa
cttggacattatggaatggttggattattgtggaattggattcacaccttccccctctattcaaaatcctcaaaatggttttaggctgggctcgaggtgcatcgttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaagctacacgagctgcggcccggtagtcgagatgtcatggcacagggctggtgtcctgctgctaggggctcagtcctgcctacctgtcccggaggttccggccgtaggtggggtttggtcggtactcttgtctatggctagggtgggttggaaactatgtcatgtcttccgtccgtatgccgtggtggtatgtggcacgtggttacacgtgaggaagacatgtcttgtgggtaaagatgtacacctctgatcagagtataatctattcgaatagccgcgtcctcggttatgggcaagccgagcaatgtactcaagttagtgttttaattcttaaaacctgcttaacaactaaaatgtggaatggttggcctgggttggcttgggacgagctgggacccaaggtcgggttgccagttcggtctgaatcatcataggccttgggttaaggcaggttcgtgtgggttcacggccttgattaataatattgtatagcactaggatcgtgtttacaaagtagctttgagcaactaagtgacttttaatgctgtttactgcaaaccctaacccccttgacggagcgtggggctcctcaccgggagacctcgcaggcccccctttgccggttcggccgggagcgctaagtgaggttcttcgccctcgatctgaggaacgtcagcgagagaggaagtgcacaagacacgggcgacgtagacaggttcgggccgctgagaagcgtaacaccctactcctgtgctctggtggatctgtgtgtgaaggaatacagagagctggagagccagagagagttcaggctctagaacccccttttctctcctccctttcttctaggcctgggcctcctttttatctggtcaggggtcaccacatgggcctctagctgcctaggaaaggaaacatgctttttacaatgagggctagtctacagccggaagcgacctctgacaagcagagcacacgcctcctgccccgctcgccagctttaccggtggacgcccatttcaaccttcattcaatggccagcgacttccttgccatgcttgcgccgaagcctggactggatctgaccgggactgacataccaactccaggagttagcacgccggctccggctagggacgagtgccaggaagctctcatcattccgacgggacgaggcgaggcgtgtgacaggccgcctgttgccacctaacccgtgatctgaccggtctgtgactggtcacacgccgcgaccggtcacggaccggataagcgtgcgctgcgcggcattaaatgctgcgtggcgcgctcgtccaacccgctataaatgcggttaggtgagccccgctgtgctcacctaacccacacacgtggcgccaaaaccatagggggtcgg

SEQ ID NO: 92252 - DNA, 2033 bp, Oryza sativa
tgaatgaatcagggttccagtctaaagcaaactacataacaaagataaggtttttgtaagccaaaataaaaggatgtctttgctatttgttccacaaggatgagtatgataaaagcagcttttctttacctactggcttggctactggttcctccaacaaaaagggagaataaaaagaaaaggactcgtagcatagcactatagcagtgctccctcatttgaagttacttaatttagttcattattagctgttgttcctttgcctttgttgattgatgactttttacagacaagtgacagcaattggaaattgacaaccagcaaagtcacactgatttttttttatatagcagctactaccgacaagcaaccaatttttccattgcttttggagtacaactactagtgtcaggatagaaatgtttttcattagtattttttataactagtgctagtgatctgtcaaggatgaaaaggatgcaatccttcaaaaaaaaaaaagataagtagtgcagtcctgaaaagaaaaggaggtagagttgagcaactaaatgactaatcatttgtccaacaggcaaaatgatgagaattaactgagtgcttcaaatttctgaaatcttgggcttttctaaacacaattaaatttctgaaatcctcggcttttctaaacacaattgcaactttcaaagattcacctgcaactctctgtaagtaccactgttgacactgtatgcctaatatcctgtaatcagcaatcacattacaaaaacatgtgaaagtactcaaatattaagtaggtgctatgttcatccagacgacgatgtgaggtagcttatcctttgatgtatttcaattacgaacactgaactgccaacaacaaaaaataactagtattacactgcattataagttcagattccttagaatccaattacattgttgtgcgaatttcattgagctatggattttgggaagacagaagatagaacgaataataagcaaaaggataagcagtgcctttcctaaggcaacgaaacatttcgacattgaaacaattctatggctggccatgatcttcaggttgctgatcctggcgttcaccttgccaagcccaaacaatgtccttaagagctggtttcatgtcctccttccacaaatgttggtattctagtgtatctccattgttcttcttgatttctaccaaatgaaatgaaggagtcacctcgaagatctctgcatcgattgccaatacacctttccttccttcacttgcaccttccattttcagcacaccaccttctttctttttcactgtcaacttcgaacatgaggcaacatcctctagttttgagataatagctgaagctgattgacttgatgtaaaccttgcttctttctttttatcagtctcctcaaacaagccagaaagatcaaagccttccgaaagagaaataatatcgaaagcgttaaggttggttagctttcctgcatcctgtttctcctcagtctttttgctactactgctacccatggaggagaaaacaacattaacatcagcaagagctgtaactggttcatttgtctccacgttcttaaggattagcttgctatcaagtcctttcttgaaccagtaagtttccattatttttgtaattggcattctacttcttgggtttggatcaagaattctcgaaactaattttcgtacatcagacgaaaaccaagctgggcatttgaactctgctttcccaatctttctgtacatctccatcaaatttgaatcttgaaaaggcagataaccagccatcagaacaaacaggatcacaccacaagaccatgtgtcaaccttgacaccgtcatacccttttcggctgatcacctcaggcgccacatatgcgggagttccacaagttgtgtgtagaaggccatcttgtcgtcttgattcagcaagagcgctcaatccaaaatcggtaattttcaggtttccattttcatcaacaagtaggttctctggcttcagatcgcgatgataa

SEQ ID NO: 92253 - DNA, 755 bp, Oryza sativa
ccgccgttgttgggcgtctacgtcttcaccgaccggcttgccttcgccgccgccgactggtgtttccgcctgcacggctggcctttatgccgccgtagttgggcgtctacgtcttcaccgaccggcttgccttcgtcgccgccgactggtgtcctcgcctgcacggctggcctattatgccgccgttgttgggcgcctacgtcttcaccgaccggctcgccttcgccgccgccgactggtgtcctcgcctgcacggctggcctttatgccgccgttgttgggcgtctacgtcttcaccgaccggcttgccttcgccgctaccgattggtgcttccgcctgcacggcagacttattatgctgccgttgttgggcgtctacgtcttcaccgaccggccgccgcatccgctgactggtgtcaccgcctgcacggctggcctgttataacgccaactgatgctaccttcttcacggctggctacatcgctgtcactactaataggcatcagtatcgtcaacacaagctgcctacgtttgccatggctgccgactgatttcttcacttccatggctgcatgattctgccagtgttgattggcctattatgccgctgttgttgggcatctacatcttcatcgccggtcgtctcgtctgctgctgactagtgcccttacctctacgtctggtttatacagctaccactactgatggacatcatcatcttccgtcgccgactgattatgctgccgccgattgg

SEQ ID NO: 92254 - DNA, 4006 bp, Oryza sativa
tggatgaacttccaagccccagaacagcaagccatgcaaaccatcacagattggtggagtgagctctgtaattccatacctttgttgatgatgtggtggaacatatggctggtacacaatagaattttccaacaattgttgaagaatggattctaagtcgcttttctagtgaaggaaaaaattagcctaatagtcaaggatctgtctgtttcatgatctttcaatcaatcgctctctttttttatgtaaatcaatcctcatatcttccctagatgtttttttccttttaacagacatatgtaaggctctggtttactacttcttttctcgttctaatatatccggcaaatcttctacagtttgaagtataaaaaaagaaatagtttgaatattacacccttcattttattctattcaatcaaataaaagaataaaataataaagataggagccgagactccaataaatataacatcagataggagttcagactccaataaatataacatcaatattgttgtcaagacaaccgaatatgcacaatgtgttgaactttcaaattgacagttcactttcaaattgacagttcaaattattgaaaaacttatgcaattcaactcgcttccttttcttgtctcactattaagttaagataatttcaaggttgcagcaaccgctactaaaattaatgcaaaacaacttagtcagtctacagtggcagatatgatcaaggggaaaagaggattttaatggcgtaccgtcaaaggaattatttgtgcagtggttcaatgaagaaagctcccacctttcttgtttcctgtacaatacagaacaatacagagtattaaaaacctttataaagttgctggacataggaataacaatattatgctaatgctaaaaagatcagctgaaaatgcagcataataagaagtgtaaccaacaatgaaaaaagggtttttaatagcatataaaatgaaaacggcttcaaatattgttcaacaacacagggcactaaacaattatgaaatttatgttatcatatgaaaaaaataagagtaattaaaatattaattcaaatacgtaccagatacaaaaggaaaggataattggaatgtattatgaaagtcaaatagaacctcaagcaaaactgcaaggaagttaattagagcgattagtctatgaagattagtctatgaaaatcagaattggtgagagagagacgaagacatttagcgagcgagcaacaacaccgagcatgtcattatatagcagcaatcaccggcatcggcatgtgcatctttcacatgcacatgaacatgggaagaggaagagtaagaggcaaagtaaataagtgtgtgactgttagcggaaattaaagaggattattcgtgtagttgggctagcgagctcgtcgcttgcgtgaggggaggagaagcggcacagtacggctagagcgcgcgggggaatggggaggcagcgctgtggggcgaggagaagcgaacgcagctgagcttgtgggcccgctgatggcatgcgcggcggatggggaaggagaagcgagcgctttgcctggaggtcccacggctgctgcgtgccagagatgcggaggtgaagcgcgagcagcggcaggaggagaagcgagtggatgtgtgatgcgacagtgatcctttttttttttgacttcaaagagggaattttattgattacggaagagatgattacattcttggtctatcaagtctaagattcctgcgggagcacacaacttctactccacacacgatctagacctcatagccatttgagctaaagcatgagcaatcctatttgcttccctcttgatcttgcaaacctgcacactttagagacactgcatcatccctctcgcttcctttattgtcgctgccaagggtgatctcgacagctcctgttgtgacagagccttgaacacctctacgctgtcagtttccaagattcttggcatatgaatccattccatggctgcccttaatccttctagacatgccaatgcctcagcttggacagcagtagcacaggatttttttgcacagcaaacagcactaaacccctgcagtctctaatgatgattccagcagctgaaactcctgtgtcttctataaaaccagcatccacatttacctttgctgaaccttcgggaagggcgtgccatttatcaacctgattggttgtctgaacctgcagtaatttcaccattggttcattatacattaatccttttcctttgatgtcatcgctttgttgtcggatcggcaacagtaccttctcatagttgacgaggaaatttacagactctgcaattgtggccgtcccctttccatggatcatatcattcctgaggaaccatgctctccacaacaagtacaaaacacgcgccttgtctgaactattcaagctatccaacaggacaaggagccagtcaggcccagtcatagcaaacttcctttccggcggtagcgcccagaactctctgatggcttctcgcaacgatctcgccattgtacattcaacagtcgcatggaaaccattttcctcctttacaccacagatagggcagatgcctactggttgtatccttctttttcgtttattctcccaagtgggcagcctgtcgtgagcaagtttccatgcaaaaatcttaacttttggttgaacgtctgccttccacacattctcccagagcttcctttcaccattggtagcagtacttgatgcggcctgaacttgagcactcttagttaagttccatgctactccctccgtttcacaatgtaagtcattctagcatttcctatattcatattgatgttaatgaatctagacatatatatctatctaaattcattaacatcaatatgaatgtggaaaatgctagaatgacttatattgtgaaacggaggaagtagcttataggcgcttcttactgaaaaaaggcctgttttctcatagtgccatgcaggaaagtgagatgtctcctggtttggcacatggatctttagaatagcatttgcatcttcctccgtcgcaacatgtctgattaatgcctcattccaggcgtttgttccagggatcaaaagctcatgtacatacgtgagcctattccaattcttcttctgtataacctcaactttctcaccatgcgccacccatctattcctccaaatcttggtagtccgcctgtctcctatcctccaaatcagtcctttctttagcaattccagcccatgttcgattcctttccaagttggtgaagtattggacgggaaagctgtatcagtaagggagccattggggtaatactttgctttcagcaaccgagcgcacaagctattcggctccgcgatcaacctccatgcttgacgtgctaataaagcctgattgaaagaccgagtatcccgaaagcccaggccaccatgaagcttagggctcgtgagcttttcccaggatatccaatgtactttcctctcccctttgtcatgtccccaccaaaaattgcgaaccatctattcataatcattacaaaaatgttcaggcatcttaaacactcctatcgtgtaggtggggagagcttgagctacactctttatcagagtatccttccctgcagctgatagaaacctctcacaccaatctgttaatctcttagaaaatcttcccttgattggttggaattgttctgatttcatcctaccttcgggagttggaaggcctaggtatttatcttcaaaacctgctctttgaatctgcagaacagctttgatctcctcctgcctctcctatgagcaaaattcactaaacaacagagaacactttgctgggttaataagctgccctgtgcttttctcgtatagactgagcgcctccagcaaattctcgcttgatcaacctcggcttgaaaaaacaataagctatcgtcagcaaaaagtaagtgggagatccccggggctccccgacacaccttaat

SEQ ID NO: 92255 - DNA, 2242 bp, Oryza sativa
ttgctgggagcatcttaacttgcgagtccactcgagcaagggctttcttgaattcctctatgttcagctcttttgactccttaatagcattcccgtctgaatctttgagtaggtcatggaagtccttcatttggttagttttaaggtacaactcaacctgtgggtacctttcatagatgtcgccaagaacatttttaattttcttgacagtcaaagagccagaattgtccttgtctgctacccggaaaattgaagcaatatcttcctgaatatacatatcaacacaatccattaagaatgtcagaaattcataaacaaaagtagttgacaatacatgaaatttgtttgctaaacaattactagcatttatgttaagatggcattaacactacaacaggtagatgctagatcatgtcaatcttgcctttctcacaaaaagaatttgaagtaggaactgaaaacatcctccaaaaattttgaagttggttcagaaaggaacaccacggtgtaaatctttataactataatagtgatatgtttgagatggctaaacagcttcacacaaagttgcagtctttaaaccataataatttcagcatttgtaattttttatatttaatcatatgaacttattatcaaaacaaagacttagatataattaactggcaacttaacactgaaaagggctaattgctgtacataggccactatttgaaattcaattatgctagcttagtattctagagagcaggcgatgaaacatgttaaattataattataccataacatatcgagatgttcttgccaatgacaaaatatggtgcattctttacttgaacaaaaaatatggtatctttgcattgagaagtacacacataccataacttttctttgagttattgtcgcgcaatcaccgagagcatatacatcatcacatccatgaaccctgagccattcatcagtagctagcactcgtcggtttgcctataaattaaataagtgttttaaaaacataatttagtgtaatatgttgaaatgtattctcttatgagttctgtacgagatatacctgaccaacttgcttcatgaaatccattatgaggggacgggttccaataccagtggaccaaacagccatgccataaggcacagcaatctctccagttgcagaattagtcatagtgatagccttatcagacaccttcacaaccttaaaattcgtcttcaaatctatgcctgtcctcttgaatttatcttcagcaaattgggtaattctcttgtcaaacctgcatatatagaacattaaaacttttttttgcaaagaatatcataaaactgcatcaagaaacagaattttctgaaatttgaaggcctcctacatatgtaattatcaactaaaatgcttctgatcggtaaaactaaaagggtgaaggttcaaaattactaacataaaactaaaaatgtgaatattttgcaatggttcaacaagtacaacagatctcaaggtcttacattgtaaggatatgatctccagcttcaattactgaaatattcgcatacttcttcacatcaggatacaactttgccaagtcctcattgacaaagtcatgaagctctgcagcaaattctacacctgttgggccaccaccaataacaacaaaatgaagattcttcttcctctcttcctcagttaggtttggaagggacgctctttcgaaacatttcaggacactcttcctaattttttgagcatcttctacttcctgacagaatgcacatgacgattcaattcaccatgcaaaatatgttgcaaaattgaacaacataatggatataacatactaaagaaaaagaagttatgacgaaagatggaacaaggatattctttgtttgacaaagaacaagtatatgtaaagatgtaaaagcaagtttgctgaaggtaattcagacattgaccaagagataagctgaaagagtcgtaactgataagatgataaaataaaaccgagttttgttacaacagttaatttctttcattaacctactgccttattagtactgacctttagaaaatggcagttttcaacaacaccaggggtattgaatgtattaggtctagctccaacactgacgaccaggtaatcataatctacaacaaattcactatttccatctgagtctgatctgcagtggatctttttgttagttggatcaatcttgtagcactctgcttcccaaaatc

SEQ ID NO: 92256 - DNA, 1184 bp, Oryza sativa
gattggttaattaattacttgccaactaaaacttgataatggtgggtcgtgagcacatggttttgagagtcgtgctcatggcaattaaggaccggttcgcgagctactgttgtgaaacattaaccgtgccaaccacaagccagcgtgggcaacggctttaccttttgtatagcatggttcattgcagagcaccagactaagaagtggcggagataagcccatgggggtcgctggggagtccatgccttgttttatatgggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgtggttataggcgggttgagcaatgtttttcgtgattagtctcacacctctcacaatatttatggatgctataactggtaataatttgtttagctccttgtttggagttagatctgtacagccgggtatggttgttcaggatggttgggcctgtgcagcatgggtgtcctgttcagtgttgattaaaatttctgattaattactccactgttttacttctcttaaatattttgctaaatgctgcttttgcaaatgagcctatattatgccatcctttggtatccttgtgcacttgcatatttgctgtgtggcttattgagtatgtcatatgctcattcttgcaataatcaatcaacctcagttgaagaaaaaggatccagaaggagaagacgtttggcttataccccagttgagctgcctgtgggagtggagctgaagccatcactagaccgttattccgctgctgtttttcttttcttttgtaagtatgtaacgttattattatgatggatttgtatattaaattgtcagtttgtgtacctcggctgattcctggacgaggattttatgcacaaattagttcggaaattattagtgaatttccgggcgtgacaagaaagatgtgtcttgtgggtaaagatgtacacctctgatcagagtataacctattcgaatagccgcacccttggttatgggcaagcctagcaatgtacccagttagtgttttaattcttaaaacctg

SEQ ID NO: 92257 - DNA, 1315 bp, Oryza sativa
tccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcttgcacggctggcctttatgccgccgtagttgggcgtctacgtcttcaccgaccggcttgccttcgtcgccgccgactggtgtcctcgcctgcacggctggcctattatgccgccgttgttgggcgtctacgttttcaccgaccggcttgccttcgccgctgccgactggtgtttccgcctgcacagctggcctattatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcttgcacggctggcctttttgccgccgtagttgggcgtctacgtcttcaccgaccggcttgccttcgtcgccgccgactggtgtcctcgcctgcacggctggcctattatgccgccgttgttgggcgcctacgtcttcaccgaccggcttgcctttgtcgccgccgaccgatgtcctcgcctgcacggctggcctttatgccgccgttgttgggcgtctacgtcttcaccgaccggcttgccttcgccgccgccgactggtgtttccgcttgcacggctggccattatgctgccgttgttgggcgtctacgtcttcaccgaccggccgcctcgtccgccgccgaccgatgtcctcgcctgcacggctggcctttatgccgccgttgttgggcgtctacgtcttcaccgaccggcttgccttcgccgccgccgactggtgtttctgcctgcacggctggcctttatgccgccgttgttgggcgtctacgtcttcaccgaccggccgcctcgtccgccgccgactggtgcttccgccggcacggctggcctttatgccgccgttgttgggcgtctacgtcttcaccgaccggccgccttcgtcgccgccgactggtgtcctcgcctgcacggctggcctattatgccgccgttgttgggcgtctacgtcttcaccgaccggcttgccttcgccgccgccgactggtgtttccgcctgcacggctggcctttatgccgccgtagttgggcgtctacgtcttcaccgacgggcttgcct

SEQ ID NO: 92258 - DNA, 1032 bp, Oryza sativa
catatattctataacacgttaccctttgagcactcgctcgggggatatttttatctaatgttcttttctgagtgttgatttcaggaaaattctattcaacattgtcgaagacttcatgtctctgtggttctacaccaagatcgactaaggcgagtacgacaaatgttgacaaggctccgtcgtagactctgcgccttctcgatcactcaagaatggttggtggatctcaacaaggaatacggaatgaagagatggtgtacccgccaagataaaatttcatgacttcaatccaaattctcgattacagcaagacgggagacttagtcgtatgctctgtactttcttggttgacgttggagattgactcagacaaaccctttaggtgcctgcacgaggctgataaaggaaatctaacgttatctctgaactcaccgaaaacggtcacatgagctcgataacagttcctccaaggtctgctgtggagaataggaactcgttcatttgcattgaagtcgggggctactgtcagggttatggataccacatacctaatagtagttgactaaatcttagcaggacccaccacataccatgtcctatacggaaacaacctgcggatataggaggagttatggataaggaaagacaaccagagttctatatggaaacgacaaggactgctcggattgtatccatattggtttccctagttctacttggacaaggggacacttatgggtataaatacaagaccccctaggaggagaggggacacgaccacctcaatcaacaccaaccacaatcaacatacacggaacaatagaagccacaacatacaaaccaacatacaccaagacaagacgccggatatcgactttagggataagcacggctagtcccctacggtgtctctggatactgtcaggagagacgaaagtgctatctctgacctcaccgggcatgaactcgaggaggaagactaccctgttgtcgactacgagtcagacctacagaccgccatgtcgacaacag

SEQ ID NO: 92259 - DNA, 1666 bp, Oryza sativa
atcagctatctgagggcccgatcaagtccaatattgatcggctcgaagctcgcaagattgagctcttggcacaacttcaagaatgcaatgccgagctggatctggaacacaaaaagctatctgatctcccacaagctgtcgaagaacaaaaggcaaggctggaatcggctatcaagaatgtcgctgatctgaccaagtcattaaaagttatcctagaaccgatgctcaagatgcccaagccattgaagaagtagaacaaattaggcacagagctatatcggctatccagcgttacctgtctcagtgacattctgtaataggacttagtaaatttttgtaatcggctaagatactctaatacttatttaactagtcttaataaactttgtgccgattaatataattctcaaaaattttgcaacttttacatatatgtgcccttcgtctgcgatataacaatatcggccattgtacatcgacaaaacacaaccgattacaatataaaaacaactaagggcgatataacaatatcggccattgtacttcggcaaaacacaaccgattacaatttaaaacaactaagggcgatataacaatatcggccatctcaaggcgatgtgaatacatcggctatcatgcatcggcaacactagccgatcatgcattaatccaaacacttgggtaatatttcttcaagtatttgccatttagcgctcgtccataaacttcgtcatcaagtccttgcaacatgtaagctcctttagacacaactttatagatttgaaacagtcattcccaattcagcgaccacttgccaaatttgctctcctgagttccattcggcaaaatcaacttccatacaagttctccctcagaaaaagacttaggcactactttcttgttataatgtcgagcaacccgttccttatacttggtaacctttgcaagggctcttaatcttgattgaaccaagtcttccctttcatcggccatgagattatagtactcatcggctgtcaaatcgtcttgcaactccgatcttcttgagccgattctaacttcccatggtaaaacagcctcatgtccataaacaagtttataaggagggacttggatggaaccatgacaagccatccgataggaccacaatgctttggctaatcgaatgtgccactgcctaggataattagaaatctttctcttaatcaatttggtcaaactcttgttagacgcctcggcttgcccgttagcttgtgcataataaggtgaagaattcaacaatttgatacccatgctatcggcaacctgaacaaactcatcggacacaaagatcgagccttgatcggttgtaatggtttgaggaataccaaatcgatcattagattatatgctcttgaacaaattgtatagcatccccagaatcaattttcttcaaaggaatcgcttctacccacttggtaaaataatcggttgccaccaatataaacttatgccctttgctcgatggtggattaatcatgccgatcatatcaatcccccaacctctaaatggccatggcttgatgataggattcatagccgatgccggtgcttattgaattgctccaaacttctgacaatcttgacatcccttgtaatatttgaaacaatcctcggggtgcaggaa

SEQ ID NO: 92260 - DNA, 1462 bp, Oryza sativa
ggtgtcctagtgcaatcgacttgtttgaatgggttgtgatgactttcggcttaaaaagtgctggagctacatatcaacgggccatgaattatatataccatgatctgatcggctggttggttgaggtctacattgctgatgtggttgttatgtctaaagagatagaggaccacatagccgatttgaggaaggtttttgagaggactaggaaatatggcctgaagatgaatccaacaaagtgtgctttcggtgtatcggctagccagtttttgagatttcttgttcatgagaaggggattgagataactcaaagaagtgtcaatgcgatcaagaaaattcaccctccagagaacaagacagaattgcaggagatgatcggcaagataaattttgttagaaggtttatttctaatttgtctggaagattagagccttttgcacaattgttaagattgaaagccgatcaaaagtttacttggggggcagagcagcagaaagctttcgatagtattaaggaatatcttagctctcctctagttttgattcctccacagaagggaataccttttaggttatatttatcagccggtgagaagtcgatcggctcggttttaattcaggagcttgaaggaaaagagagggttgtgttctatttaagtcgtcggctcttggatgcggaaacaagatattctcctatgtagaagttgtgtttgtgtttgtatttttcctgtacaaggttaaggcattatctactgtccaatgaatgcactgtgatatgcaaagctgatgtagttaagtacatgttatcggctccaattttgaaaggaagagttggaaagtggatattttccttgaccgaatttgatcttcgatacgagtcaccgaagggaatcaaggggcaagctatagctgattttattgttgatcatcgtgattattcaatcggctcggttgaggttgtgccctggattttgttgtttgatggatcagtaggcactcatggttgtggtatcggcttggttataatttctcctcggggggcgagttttcatatcaccatgggcgatataacaattaggctgagtatgaagcagttctcaaagggttgcaattactcaaggaagttgaagccaatgctattgagattatgggggattctttactggtgatcagtcaattggcaggagagtatgagtgcaaacatgataaattaatagtttacaatgagaaatgccgagagttgatgaaggaatttcggttggtatctttgaagcatgtatctcgagaacataatattgaagctaatgatttggcccaaggggcgtcgggatataagccgatgatcaaagatgtcaaagtagaggttgccgcattaacagccgatgattggagatatgatgtacatcattatttgcagaatccatctcaatcggtttctcggaaactgcactataaagctttg

SEQ ID NO: 92261 - DNA, 1155 bp, Oryza sativa
ccttaacaggttcgagtatatcggctttgcatctcctcagaggttgttggtgcggtctaacccctagtttgataggtagccgatgttcaacaatcgatcggctgagtcctgggatctcataatactcccaagcaaagcaatctctgaattcttttaaaaactctatcaacttggttctaaattctggagataagttcttactgataaatgtcggcctcggtcgatcacttggacctatgtaaatttcttccaaatcatcggccgacacgaaaccatgtccttacttgtcatcgagatcatctactgtgtccttggtgtagacgtttgaaccctccacgacgcgctcaaaataataacttgggctctccatcttcaatcggctatatatcacaatcggacacctttagaaaatctccttcccaaacctttccagacaagcaatcaaggccatccatcacccaaagagctaaatcagcactggcaacgttaactaacctgtcggctggtatattttcaatcttgtcgtcttgccattaaatcaagcattgctgcatggttgatggaatataataattagcatgaatccaatcccttccaagcaacaagctatatgaacccttcccatcgatgacaaaaattgttgtagggatactcttgttaccaactgtcagctccacatttaaaactcctttggtttctgatggattgccaccaaagtctttgagcaccatatttgtcttgatgagatcctcagcattcctgcctagcttcctaaatgtggcataaggcatcaaattcactacggccccaccatcgaccatcatcttagacatcggcttcccattgacataaccgtttacatacaatggcttaagatgctgattctctgctccttctggcttctcaaagactgcttgttctggtgataaaaccaacctagccgatgctacctcaacttcatcaacatcggcttgcttggccccaaattctgcaggtagtgtgaaaaccatgttaaccgatacaatcacaacacttttccctttagccaatctttttgcttcatcggctgtggcttcatcggctgtaggaacttgattcttaacgcgccactcctgcgtcggcttcgttttcttcagccgatggttgatttcttgc

SEQ ID NO: 92262 - DNA, 1114 bp, Oryza sativa
gcagatccatattcaaggtgtgaagtcatccgtacacggtggccggacgtggtcgtcagtaattctaggtgtgaagtcattcgtacaagcgtgcaggatcaccgccgccaatgtcccctcagaggatatcctctccctacaacgccggacgcgcggaccgcagagtatcagccgccggggcgcgaggagccgaggaggatctccgttgcctagatcataggcggtcacgcagagtcgcggatgattgatggcgtggctcgaggtggcggcggcgtggatcgaggaggcggctgcggttgaggggagcgaccgagaggagggtgagagagagagagagagagagagagagagaggggagaggggtgcgtacggaggggagacgtgggacgatctcgagccattggattcgatgattctggatcgtcggatttgatgaatgaggagtgtaggagtgtagttggtgaattatagggtagatatgttcccatgaaacaatttattcatattctccatcaagtgcctaaagcactctctttgttcagcccatgggaaaactttttttacagcagtttctaggcctttgcaagcatcagtatgcacaactaaattctctactggccctattgcattacctaattgctccatgaaccaaacccaattatctttggtctctgaatcaaaaagaccaaaagccaatggaaacatccaattatgcccatctattgcattggctgcaggcatgtgtccattccacattccattgagagcagtagaatctatactaatgtatggcctacagccctctaagaatccatctatgcaagctttgaaagcacaaaagaatctgttaaagtgaaccttatctccaactctaactatgtcaatctcaactacactaccaggggatctcatttctatctcagccttgaacctatacaaccaatcaaatgaatcatcaaactttccaaataacttatctttagccctctgcaaaccataccacgttgtctgatagcctatggtggtcttgtatgtctcctgtagcttaccttgaagttcctttgcacccatgtctttcttcttcttcaaaaatggaatagccctttcagccacc

SEQ ID NO: 92263 - DNA, 1477 bp, Oryza sativa
aaatagcagaagtagtatcacccggaactaggaaagctaatatgaggcagttggtggcaggttagaagtaaatgacaagcatgatatgctcatgatgacaagcatggtatcctagtaatgacgagctgatctcgacgcataacgtgaaatgggtaacttctatgaggttgacgccaaaaatatgaactatgcgaagttctggaactgaagcaccatcctcaagtgccgcaacccagtcgaagtcagctaaaggttcaaccagggacaagtcaggtgaagagaagattccatctgcaacaggagattgagccaagcagtccagagtagagaagttttgctaggcaagttgttataaaagacgcgacggaagaagtcagacaagaagagaagaccgcccaacctatcttcttgctagcctcctcgaatctcggggacgagattcttgtaaggggggtggatttgtcacgtcctgataaattcatcccgaaataaaaatcattctctaaaaggaataatagaattaattaaaattcggaaagaaattggcaaacattaaaatacgtacaagaaaaattcaaatgtgacccggagaatttttgttaaattctccttggtctaaaaggagccctcaaattttagtggaattctcagagcacaaataataattattaagaaataaacaaagttaaaatgattttataaaaagaaaaaccctaaaaagtctttcccccccttttcccctcttgggccggctcggcccatccctttatctctctctcctcttccccgcggcccatccggcctcctccccgcgcgcgcgccgctgacgggtgggcccgcccgccaccctcgctgacgggtggggcccacctgtcatccctgtcctcccgccgctcccgccgcctcgcccgtgccctagcgccgccgccgccgcgaatcccgccgcctcccgccgtccacgcgcacaataaagtggggggaaatattccccgtgattccctctctctttccccccatttctccctctctctcccgcgttcaaacgggcggatttgcccccgcaaatctcgccggcgccattgatggcggccgacctcccgcgccggtttcctcccttccccggccaccctctctcgcccccggctctatataaacactccccgtgcctctctccaccgtttccgccactcgccgctctctttccccgtcggaatcgagctcgcgccgtcgtactctctctccgccgtcaccgccgagctccggttcgccgccgtcgttgccccggaccatctcccgcttcggcaccgcctccttccgcttcgccgcatcctcgccgacctcgtccacctctccgtttcggtcgccgagccgccggaacgccgccgtccccgtcgacccgagccgcgccgccgcctctctccgctccggtcgccgttcccagtcgtcgccatcgatcaggggtgagccatggaccgcc

SEQ ID NO: 92264 - DNA, 1064 bp, Oryza sativa
cacataaccctccccaaaccatccacaccacgataaggtttcacccccacccctaaacgggcagtggagcagtcccctcgtgcgccgcggtgaatccggcagctggacaaccggacaccccggccgacccaactccatcacgcccacccacgccaccggtgcctaggaaagggtcgagctatacttcagatcaagcagttacccactcccgcttgtggtaagcacggtaagtctcccagggtttcccgtgaaccggtccttaattgccatgggtgcgaccagcaaaaccatgcactcgcagcccgccattcagtgtattttaattaactaacaccattgcggtggcaccaatccaaagctatgctaatagacaaagtctatgtaataatgtgatacccatttgtgtactagttgaactaagcatggctaagcattttcctaaaccaacatctagtcattttgatacccaagttatcaatggcataaggtaaacaataaatggctgagtaataggacccatcccacatgacattgtaaaaggatgcaacatttaatagaaatgcgggatatttgtaaattgggtacaatatgatcaattgtaatgcatgacttgccttgctctcgcactgatgagacctcagcaacgtcttcgagaaaccgcggatcgacgaaacggccagtctacgcgacaaacaaagcacacaagcaaaacatgctataagactactgaaacaggaaacaaaaccatttttaatggattctagggatttttataaatttactgagacttgaatggatttaaacagagctcggatgaattagttatgattttcagaagataaactgtgtttttactataaaaagaaaagccttattggtttattgcgcaatatatattcccagatgatgtcagcaggggggcgccgacatgcgggcctcactggcagcggctcaaagggggtggtccaccgtggaccaggtccacggggccggggtggtggtgtatcacgtggcgtcgacgtggcaccacgtggctggccacgctggccatgggatggacggcc

SEQ ID NO: 92265 - DNA, 1553 bp, Oryza sativa
cagagggggaggaggtggcggagtgcggcagcgcgagcgtcaggttaggggcggcaccgatctgggcgacggacggggacgggggcgcgggcgcgctccatggcaatgtgcagagggaaggtgtggaaagaggcagcgattgatttgctcgcatgcgtgattttcggccggtcaccccgcgtgcgcgcaatctctctcccacagtgtgaccccgcgtgcgccggtaccgttggatgcgagaagcgttggatgatttggttccgttagatataaaacccccacgtaatgtaggtgtaagagtgagttggtgaattatagggtagatagactatagttcgatttttatattttcctcaattttctactattaatgtaggattttctagacaatgagagtactaaacgtggaggcttctttttctattaatttattaagttaatagatttctagtatttattaaagtaccatgtggtaagttaggagcgtttgtaggagtgtcatatggcggtttaggattatttgtaggaagtttaatggatttctagtatataatagatagatagactagttttcacgagccgagctaagccgaatcggctcgttagccccccttacatgcgcgaggttgatccgacagctaatggcagtggactgagatctattatattattaaaacagccttgaaaggaggcaccacgttcgctgtggaggctaaaaattcccacattaatcatagaaaaagaaaagaagaatccaaatagaaatacaaatataaaaatagctaacattcggaattaaaaatatgcattattgaaagaggagtccatatagcaacccaatacatgattaattaaaactcggaataaaaataaaataaattttgaaattagaaaaagaaaaaaaaacaagagttcgagaaggaatacaatttaaaaatatcttaaattcagaattaaaaaagtccatacaggaatccaatacaagattaattaaatttccgaataaaaaaataaaaaacaccgaaattagaagaaagaaaagaaaagaagagttcaagtaggaatactgtcagggttattgataccacatacctaatagtagttgactaaatctcggcaggacccaccacataccatgtcttatacggaaaaaaccttcggatataggaggagttccgtataaggaaggatgaatagagttctacatgaaaacgacaaggactactcggattgtatctatattggtttccctagttctacttagacaaagggacacctatgggtataaatacaaggtcccctaggaggagaggggacacagaacaatagatcaagaccaagatcaacatacaagccaacatgcgccaagacaagacgccggatatcgacttcagagataagcatagctagtcccctacggtgtctacggatactatcaggagagacataacgatgtctttgatctcgccggatgcagattcgaggaggaaggctactctgttgtcgactacgagtcagcacttcagaccgccagtcgacaacagttatatagg

SEQ ID NO: 92266 - DNA, 1223 bp, Oryza sativa
gaggggacttcaggcaagtgctcccggtcattaggaagggcgctaggtctcagataacagatgccactctgcgcaggtcctatctttgggattgtatggttcaattggagcttgttcgcaatatgagggtgcagagcgacgtgtggtttgcggactacctccttcgagttgggaatggcaccgaggaggtgaaacggatatttgcatgtcgtgcaaagagaatgaaacggacctcgaaaggctcatcgatactgtgttccccaacctaaacgataatcttacgaacccaaactacatcacatgtaggaccataatgtccacccggaatgagttcgtggatcgaattaacatgaaaatgattgggcggtttagaggagaggtggtgacatatcatagctttgatcgaccagaggatgacccttataactattacccgcctgaattcttgaactctctaactctaaatgggctacctccgcatgtgcttaagctgaagattaactgccccatcatgctattgaggaacattgacccagccaacggactttgcaatgggacaaggctggtggttcgtgagttcggaagaaatgctattgacgtagagattgtggtagggcagcatgctggtaagagagttttccttcctcggatacctcaatgtccttcggatgatgagatgttcccctttcgcttcaagaggaagcaatttctggttagattgagctttgcattgaccatcaataaggcgcagggacaaacaattccaaatgcaggcgtctatttaccagagtctgtcttctctcatggtcaactatacgtcacgttgtctagagcaacctctagaacaaacataaaaatactatcgatgccggtagaagacaagaaacaaaagaaaaagtctaagcgtactggcgtgaaggacaatgagaagaaaggaaagaaattgtctaaacagacagcagcatacacaaaaaatattgtgtatagagaggtcctcacagattagaaaaggtatattatgtgactattaaccatccataatatgcttgcttaaattccattctttctgtaatttttatattccaagtctaacatttcgtgtgtttttttcttggacagcagtaaacattactttcggtgggattttggcacggactatatgcaccattacgggtattgtgatactactttttttctggatgatattgatctggagcccttgc

SEQ ID NO: 92267 - DNA, 1140 bp, Oryza sativa
ccaccaattccttgaggctgcacgtgatgagaggatcgaaaccatgcactgtcaggttatcacagtttatcagtgttagatgagtgagggacgtgagattgtgagcagagccatggactgaatgctcaactcgtcgctgatattgagttccctgagggaagcagggaagaacttgttgctccgagctccggcctctaccatggaacaccgatcgaacatcttgccacatcccctaatttcgacttcttggagtgaggatagatcatggagaccccctccatccgccacaggaagaaccaggttcttgcagcaccagattctgacatagctcaataagttggaggatgggagttgcaatactgcttcctctccaacctcaaatgaagagaagatcaagtggaactcagtaagagctgggaaacggtttagtagctttgtcaatgaatttctggtaagacgacaatcactgatttcgagctgctgaactgaagggaagataacaccctcttcaacttcactaaataacatgctttcacatcctttgacggcaagtcttgttagggagctgagcttttggagatcagtcaatgaaacgtgtggcatttcttcgatactcatatcttctactttgtccaggttatcaaagaccaaagcacctctgtatccatgtgagatcagcttgttttcttgaagacgcaacaaatctgtcttacgctctgagacaataacacatgtcaacatggaagtgtgaggtatagggggcagtgacaacttggggcaattttcaatctcaagagaacacaggttggggaaccatctggtgtttatgtcttgtgcataggagacagagaacctagaggatggcacaagcagcatagagagattgggacaattttcacacctgatgcttgtaatctttgaaaacaaatggcaatgagctcccccaacccactccacaagttctggcatatcaacaaatctaactttcttcaggtgtaagaaactcctctgtgtaacaccaccaaaatctggtccgaactgacgaatgccagcaatattgatcaaagtaagttcctctagatatatgaattgcccgaaaggtggaagagtgccccagagatgccctctagatggagagat

SEQ ID NO: 92268 - DNA, 648 bp, Oryza sativa
gcataataggccagccgtgtaggcggaggcaccactcggcggcgacggaggcaagccggcggtgaagtcgtagacgcccaacagcggcggcataataggccagccgtgtaggcggaggcaccaatcggcggcgacggaggcaggccggtggtgaagtcgtagacgcccaacagcggcggcataataggccagctgtgtaggcggaggcaccactcggcggcgacggaggcaggccggcggtgaagtcgtagacgcccaacagcggcggcataataggccagccgtgtaggcggaggcaccactcagcggcgacggaggtaggccggcggtgaagtcgtagacgcccaacagcggcggcataataggccagccgtgtaggcagaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgactgatgcaggccggcggtgaagtcctagacgcccaacagcggcggcataataggccagccgtgtaggcg

SEQ ID NO: 92269 - DNA, 5561 bp, Oryza sativa
cgctttctccttctttttttttaagaatctgagattgttgtgtgatgtatttgatttgtgtgtgatgtgaatatgtgatgaattttgtaaaagttgtgatgtaattttttttaagattttatgatgtttttgagtatttgagatgatcgatttgtggatttggagacaatttgaggatgattgatttgggattttggggacgggatggagtgaaatcaatatatttaaaaataatgaagaaaagaatataataaaaaggaacgggaaagaacaaccggattagcctctttagtccaccaaccggactaaagatgctttatctttagtccctgttagtaacaccaaccgggacaaaatcgatttttaccctcggttttttcacccgggactaaaaataacgatatttagtcctggattcgtagtcccggttcaaaaaccgggactatagggggttacgaaccgggagtaataaccctttctccaccggtggatatttaacaacaattgtgcatagtggtttgtgtttatgctcgtgtggaccaacggaatatgttcccaagccaagatgtcacaaaatgcatgactctcactcgtttggatgagaaagaacctcttcccattctcttggcacattccattcattaatgtaggcaattcagaaggaaagaggagggggggtggggggtgggtttaaaacgtgatcgacagtaatttgcatgtttggtagacaacgtttctcaattaggaaaggggaacagataatgtgctgtttaaaatataaaaagtgcaccttttgctgaaatcttactactctcgcgtttcatattattagttgatttaacttttgttttagtcaaatttatttaattttgatcaaatttattaaaaaagaaaacaacattttcaatactgaacaaccatactataaaaatatatttaatgtttcaaaactaatttagtgttataagagttgctacatttctcttaaattttagtcaaatttattgaagtttgatttagaaaagaaagaaaaaatcaaaacgactaatcctacatacttataaagttcatctccgctaagtgtagttaatactatttctcacttctctcattaagccacatcacccccaattatttctagactttggatgattgatttatggtctaaattatctcttctttcttctctcataaaaacatgcaatctcaattatttttaggctcaaaattgtatcaaattattttagctttgatagtaaaactacaatttatttgtacatattatgtaacttaattttccgcagcaacacggtggagtattcatctagtagtataaagcaaaggagagtatacagctagtactccttcgttccatattgtgacttgtggtgaggtcttttagttttgtccgcaaaaaaataattttatcaagtttatgaaaaaatacatcaacatctgtaatatgaaattagtttattaaaattaactatgaaatatgtcttagtagtatacttacttggtatttaattactttttgtacaaattaggtcatattacataacttggtcatgttagagaacttttgactttagacaaaactaaattaccttacatggaacagagggacaacaaaacgcaaaagtataacatagagtcatatatataaaagcatgcgtaggtcatggacattaaatattagttgatggccaagacatgacatttatatctaagatgtgatgtgagataagaggtatctatactatctttatagttgatggccagtaatatagatggccaaatgggtcgctcggcatggcttggcccgagcacaaccaaggcacggcccaaccaacacgatgtgccgggccgtgcctaccccgcaccaacagcccaggtatggcccagtcaggctcgagccgtgtcatgctagccagaagacacaattagcccaacgggcccatgccagactaggcaagctaaatctgagacaccttgtacatctcagttttgcacaacaaatgcaaagatgtaactaagttacaacaaattcattcataattttcacaacaaagggaccacatacatcacaattcaattattcacaacttcacaaatctacacaaagccacaaaggtaaagatgaaagtagaacacatatttcattgataaagtaggtgtaggtgtgtagtgcaatggttgcctcgttaaaaacctttcgaggtaaaaactcgcacctcatgagaaaaccctagaaaggaaaagagtacagaccacagctttcaaatgttcataataaagtcttacgagtccaattacagtcatctagtgtttacatcatcatcaagatacaaattctcaaagtacttttgaagctccatattgtccatggtatgccgagcctttgcatctccgtccttgagcaatgccatcacttgcaccatgtatatcaccccacttacattttcatcctcgctccgtgtaaaagagttaacccgggagtgatatggttggaaggaagaggctttataagttggttccacccttgcaaaactagcaaggtggtattaaacatgcgcacacagctctcatggaccacacaagcctcatcctaattgggccaggatgtcacaaccaactggcaactgaatttgtttcttttgcagcaataagtcaaaaatcttgtcggctttattaatgtcaaagtcatatttctcctccttgtttgtatccttgacccattgacacatagttgtcttcttgaccttagaccactcggccaaactgatttcaaggtcttgatcatcatctgagtctgaaacacaactataaacatagttgaccttcttgaactttttagcctcctggaatctttgttcatgagccaataccttctgaacatggtgtgctaaactctcaaagtcttgtgatgaaaatttctcccttatcggcccaatcaatccctggaaagccagatcagccagtggtgaatcagccaaatttaagctaaaacatctattccttgtatctctaaatctctaaatataatctggaaacgattcattagccttctacctgattacggtcaagtctgataacttcatctcttgaacaccgctgaagaagtatttacgaaattgtttctctagatcatgctaacatctgatagaattgtatggtaaagaagaaaccaagtgaaagccgatcccgataatgatagagggaaaaacctaattctcagagcctcgacagccgatgcttcaccacattatgccaaaaatggctaatatgctcatatgtagtcacattatcctgccctgaatactttgagaagtttggaatattgtatcggtttggcaatgacactctgccaaaatattctggatatggatgccgatacatgatcccactatctttaggcttaatcctaaattgttcccttaccacatctacaatcatattggccaaaggttgctgttgaactcctccttgatgttgctgctcatactgattatttattggttatgctggagtttgaacaaaaggaagtgtgtcctgccgatactgcaatggtgacagcggttggaattgattattgatattgaaccttggatttttctaatactggaaagcattagggttcgtgttgcaatacttgtagactcttgccatctactaagacataagtgctaagcctaacatgatcaccctaatgcggaatccttaggttactgaccgttgtttgaagccattgatgctgtttcccttggttttgtcggtgtagaggtagtagtggtagcagtagcagtgtgagaaccggcttgatcccgaaggggtcgccggcgatcacctgcggggtagcggcggccttccggtcgccacctacactgtcccggaaccaccacacgttgtccctccagcactcaacttgatcggatagggttttgggaattttcggggagaagatgatcgtggagagatcgtcacctatccacgacaccggcctcccctattagtatagcgccgagggagatcaggggcaatccaaattatggaaggatttggcgctaccgatcaatgcgcgtaatcacgtagttttggaaattgaatcgcgttaatcctgggtggaaaacggcgtcgagattttggcaatgggtggaaaactgtcgtccgagatttcctctcgatttccatgccgagagatatattttcctaacattctcccccctgatcttgaggctaatgagtttattcttagaaaaatagatttactaaggcaacgtgtcagggtagtaatcatatcctaccaagacaccggtacctatagttcactataaaacttcgaaagaactctatctaatcttaatgggagttagttaggactaatgcccctatttccaggatcttagtcttaatcaaaggcaatcagttattcccatgccggctacatgatctttaaataaattgggaggtaagcctttggtgagcggatccgcgagcattgacttagtgctaatatgctggtttgatcctggattctatctttcacaacatgatacttaatgtcgatgtgtttggcagcaccactcgacttgttgttacttgaatagaatactgcagctttattatcgcagtatagtgtaattggtctagaaatgctgtcgaccactcttaaacccgggataaaattcttaagccatacggcccgccccgttgcttcataacatgccacaaattcagcctgcattgtcgacgatgcagttaaagtttgtttagagcttttccatgaaatagctccgtttgtgagagtgaagacataacctgatgcagattttttagtgtctacacaacctgcaaagtccgcgtctgaataacctaggacttcaagttcttcagatttcttatatgtgagcatgtaatccttagtgccttacaaataacgcaagacctttttaacagccttccagtgatctaaacctggattggactaaaatctaccaagcatcccgataacaaatgctaagtctggacgcgtacagacttgagcatacataaggcttccgacagctgaagcgtttggtaccattttcatctgatctgattctaatttatttttcgggctttgaaataatccgaatttatcgcccttaactattggagcaggtgttgcagagcacttactcatattatatctttctagtactctgctaatgtatgatttctgagataatcccagtactcctttagacctatctcggtgtaattcaatgcctaaaacataagatgcctcaccgagatctttcatatcaaaattagatgacaaaaattctttagtctgatgcaacatattaatgtcactgcttgctaacagtatgtcatctacatagagtactagtattataaattttccacccttagtcttaatgtaaatgcaattatccacctcattctccttaaatccgaatctcttaattatttcatcgaatttaaggtagcattgccttgacgcttgtttaagtccatagatagatttcttaagtttgcaagccaaatggtccttgcct

SEQ ID NO: 92270 - DNA, 5340 bp, Oryza sativa
cgcgacggcctatccagagttctgcttctacttctccgacctcccgagcaatgacttcaacaccctcttcagcctcctcccgccgcacgccgcttcctccggtgacggcagtgggcggcgctacttcgccgccgccgtgcctggctcgttccacgaccgtctgttcccggagcgatctatcgacgtgttcacctccaccttctccttgcactggctctctcatttacctacgcatcaatatagatttcaaggtgtgtaattcacctactccctccgtctcaaaatataaaaagttttagagttggacacggtcattaagaaaaatattagaagtgaatgataggattgtgactggatgagtagtgaaggtaggtgggaaaagtaaatggttgggaagagaaagttggtgaagaagttgttatattttaggataaatcctaaagtttaaaatttgttatattttgggacgaatggagtaattgaaaggatgggctttgattacacaggtgctggacgaagtcgccgatacgcggtcaccggcttacaacaaggggaaggtgttcgtgcagggaagctcggaggagatcggcgcggcgttccggcggcaattccagtccgacatggcgcgcttcctgcgctgccgcgccgccgagctgaaacccggtggcgccatgttcctggtcttcgtcggctgcccgtcgtccgccggccccaccgaccaaggccgcagcttcaacctgctcggcaccatgttcgaggagtcgtggcgcgacctcgtcgacgaggggttgatcgacggtgggagtatggacagcttcaacatcccgtcgtacgccgcgacgctggaggagttcagggaggccgtcgacgccgacggctcgttcgccgtcaaccggctggagcacgtgatgggaagtcgtctcgccgtggccgacgacccccacgaccgctgcgtggttgggcgcagggtggcgaacaaccaacgatcgatctttgggccgctcgtcgaagcgcacatcagcagggcgctcgccgacaagctatttgtccggatggagaggcgcacaagagagctcgccgatgagctcggggacgagatgggggtccacttccacatcgtgtgctcgctttcactcgtctgacgatatctacatcgtacactgtcctaataatgaaaaaatatattcaaattttgggcacaataatttaaatataataattgtatttgctaaataagtctgttgaaaatatgatcataaatcggcatattttaattcagaaaaacaagataataaacatggcatgcgagtaggaaatgatccagtgctagtgctaaacataaatatgctttgagcaagaaaaaacatcatctacaaacatgtttgacactagaaatagaaatcctatatactcgaagaacactccagagtatgttgaggaattagtattatctctgttgacgttgacattctctccggtcaggggcggatccaggaaaaaatagtaggtggggctgaacagactctaccctagacctctttagcggacttatattctcgtggttgcgtggaggatcactggtatctgtgttgtttgaactagaataatacataagcattattctttttggcatgttgacaaactaaaaatgtagaaacaattataaattttaatcactacctcacttgagacacaaatttagactgtctattagtattagaggtaaataggttaccaatttggcaattgcaacttcaaatattcaatcaccggctgctggctgctgctgctgcaagctgcgtccagcggaccagcgtccttgcgccctcgcggcctcgctggcttgcgggtcaccacctccccgtcggcgcgagcgcgcagcggcactggagctggaccgtcgcctagccgcctcccgtcggcgcgtcggcgcaggaccgccgcctggcggctggcgccctggcccgtcttgccacctccccggcgggcgcgccggcgctggaccgccgcttggccgcgggccgcctcccttcccggcttcccgccctccgggcccctcgtccgctcatggctcgccagccgccgccgccgcctgcttgccgctcgccgcacgcccacggggccacgggccacgctgcctcctagctcccgccctcgtcagccggtgtcgccaccgggcgtcgggcgcctcgccaccacggccgcctcccgtcgccggttgcccatcggcccgcgtccacggccggtcgaacgctactacgctagtgttagggatttggtagacagggagagagaacgccggctgggcggctggggaattcagagaagggagagggagagggaaccctggccgtgtgccgcgcttgagctacaggttggaggagtgggccgggccaaaattggaagattaagctcatgggctgctcttcatagccggcccaagtcgccaaaacatcgtcttcaacctccagtttctcctccagccgatcttaactcccacaaacggcgcatccatggaagaaatttttagtgggggcttaagggggtttccatggtcccaaggatggtagtggggtctcaagacccccccgcccccgcggtaaatccgcccctgtctccggtaccaccgttccatcctctgtggcgccgtcattcactccagtagcgccggtgccggtgtcagccttcatgatgtagaggaagaagatgaagcagaccgtcgatgcagaggaagtagacgtgttgcaaaggatgtaaccgatgcagagccgtcgcatcgcaggatgctccccccacccgcctacccttgcaggtacacaattagatagagtttcggaggcctactcatcccgagtacctatgcgcacaggtggtcagaaccggggaaacagtagctagcgcaaggacaaagattaatgttatgagattgttggaataaatgggctaggcccaatttattcccaataaattctattggcccataattaatgttacgagattcgaatttaactggagagatctcaacttaaatagagagctattagagagcacctgttgaatcgtttaggtggtggtgggactaccacacgcgcgccgagccgggctgatgccgaggcaaggcgtcattggctgctgttgctgctactgctctctctctcacattattttgcaactgacagaaattgaatttgtaacggttgagaatcaacaccattaccgctacaacaaatgacagtcaatcctgatttaattatcagattaactctattggttgctctggtaacaggcctattgattactccagcatcgggcagattcccctctcgcacactgtataaacccatcagacctgttgattactccgataacgagcacatttccctttcgcgcactatataaacccatcacaattactctgacaatgtgagtagattcccctctcgcgcactacataaacccattagacctgttgagtactccgacaaagggtagattcccctctcgcgcactacataaacccattagaccagttgagtactccgacaacgggtagattcccctctcgtgcactataaaacccatcacctagaaagacacatctcttggctttgtaacaaccctccctctagaaccgcatagccagcccatccgacgggcggacccacttacacatacgacttctgttacactttcgttctcgcttcatgtaaaagggttaaccgggagtggtatggttggagggatgatgccttgtaagttggttccacccttactaaactagcaaggtggtattaaacatgtgtacacagctctatgggccatacaagccatatcctaattcggctaggatgtcagaggctctgtcttctctagcacactgtttttgctctgtggttctcttttttcctttgttcgtatgctagcttctgtttctccggttctgatcaccaacgtacatgggtgctcgggacaagcatgcctttgaaactccatctgcttgtgtacctgcacgggtaggcgggtaatcaagtttttggggagaatcctcctacgcgactgctctgcatcggctacgtcttctgctgttctgcattggctacgtcctctggtatgtctacttcctctgcatcagctgtctgcaccgtatacttcctctccatcgcaatatcttccactggcaccggcgctattggagcaggagataacggttacgcaccaggaggagggaacaacaacataggagagaacgtcaacatcaatggaggcaatactaatgcctcatcatccattcagtggagcgttctctgggtatatctctattcttatttttgtgttaaatatattgctagacgtttaattttgtacctgctagcatattcatgtttagtgctagcactagatcatttcttacagcaatcgtcacgattacaatcttgtttttctggattaaaatatgccgatttataaccaaatttccaacactctttattagtagtagaaattaatccgaaccgttaatcttatttaatcgaagggttcggatctatttatactaccacatcagttagcggtactacaaacgtggaggggtactattgtgagaaaaaaattaggggcagagtatataatcgtcattaatttagcagtgattgaacttttttccttgttttttgattttttcatgaaatatgagcaatgccagcacaatggataatcatatatcgatttagccggggaaaaaaataaatgataaagtaacttctaatcattatattatattagtaaattactaatttactcctaataattctgatagtataaaatattatcagtagaaagcaccggagtattgttttttttttcttcttttttagatgaaagcctcgtcttgtttggctgcgtgacttttcgcaccacgctcgagaggaacccattgtcttgttccgcggtcaaacaatggattatccaacttggacagtagcaatctgctgtacctacagggttgttgcgtggagctacctttagttattccaaacaatacgcctctttggtaaacttcgaaaggaatgatgtgaccaacaattagcaatttgccactaccaatttatcgccagcggtaacgtggaaatcaccatccggacgtggtcgctactccatctgatttcacaaacatctgctgcactaaaaggatttttttcgtgtggtcaaaaatatttttccgtgcggaggtcttgcccgtctgcactaggtgtctgggaaaataaatatttgcgtgctggtgggtcaaccgtacggaaaaatgcatcttcctgtgcggtcaggttaagcgaaccgcacaga

SEQ ID NO: 92271 - DNA, 1035 bp, Oryza sativa
acaacagcggtcataaaggccagccgtgcaggcggaaacaccagtcggcggcggcaaaggcaagccggtcggtgaagacgtagacgcccaacaacagcggcataaaggccagccgtgcaggcgaaaacaccagtcggcggcggacgaggcggccggtcggtgaagacgtagacgcccaacaacggcggcataataggccagccgtgcaggcggaaacaccagtcggcggcggacgaggcggccggtcggtgaagacgtagacgcccaacaacggcggcataaaggccagccgtgcaggcggaaacaccagtcggtggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacagcggcataaaggccagccgtgcaggcgaaaacaccagtcggcggcggacgaggcggccggtcggtgaagacgtagacgcccaacaacggcggcataataggccagccgtgctggcggaaacaccagtcggcggcggcgaaggcaagccggtcggtgaagacgtggacgcccaacaacagcggcataaaggccagccgtgcaggcggaaacaccagtcggcggcggcgaaggcaagccggtcggtgaagacgtagacgcccaacaacagcggcataaaaggccagccgtgtaggcggaaacaccagtcggcggcagcgaaggcaagccggtcggtgaagacgtagacgcccaacaacggcggcataataggccaaccgtgcaggcgaaaacaccagtcggcggcggacgaggcggccggtggtgatgttctgactgatccattcctagagcgtaagagataagcttaaagccatgaatcccttttatgcatatctggatctggatcctgcagaacaaacatataggatgagtagtatctgatataaatataatactcgagaaaaaatcaatcatgaagtactgta

SEQ ID NO: 92272 - DNA, 799 bp, Oryza sativa
aggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggacaccagtcggcggcgacggaggcaggccggcggtgaagtcgtagacgcccaacagcggcggcataataggccagccgtgtaggcggaggcaccactcggcggcgacggaggcaggccggtggtgaagtcgtagacgcccaacagcggcggcataataggccagccgtgtaggcggaggcaccactcggcggcgacggaggcaggccggcggtgaagacgtagacgcccatgaacggtggtgtgaccgaccaaccgtataggcgatgacaccagtcggcggcgacggaggcaggccggcggtgaagtcgttgttgcgatcagcaatggcggt

SEQ ID NO: 92273 - DNA, 3082 bp, Oryza sativa
tgttgtatcagagggtgatcatgtaccctgggagtataaggagaacgaggtaattgagggtgcaaggtatgctcataaggatgagatgaaggaggaggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaaaaaattcaagtacaccataagctatgcaaaggcctggagagccaaacaaaagatcattgagatgaggtatggcacatttgaagcttcttatgataatttgcctcgtttgttagccaccattgcccagaggaataataatacgtactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacctgaaaactggtactggttcctagagagagtgcacattgcagtggtgcgtatgaggcccaacgtttgccttatacatgatcatcatgcgggtatgttgcgggctattgactacttgaagaacggttgggatgagaagggacttccagctaagtggcctgatgttcggagtcggtggtgcatgcgtcacatgggtgcaaatttctacaagcaattcaagaataagcatcttatggagctttttaagaggctctgtgcacagaaccaagagaagaaatttaatgagttgtgggacaagttggatgagttgacaacgaagcaaacagatgagcaatctcgcagaccactagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttcgggtacttccattggttgctattgttgaattcatccttcacggcacgcaagcgtactttagggatcgatacaagaaaattggtccgtccatggccgataacaacatagtgtttggcaacgtagtgacaaagtacatggaagataaaatcaaaaaggcacggagacatcgagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttactcacacgttcttgctgctgccggtgattgtggcatatctcccaatgtgtacgtctcaaattatttcaggaaagaagcaatctttcatacatgaagtgaggagatatatgggttcgggatctcaggatcttacacaacgctgagtgcccaagttttttatattccagatccatctaagttaagggtgaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgctgttgtgatgtaatgagtgttcggactaaatacttctatcgtgtaatttcaattcaatgttgttgtaatgagtacctccgactattgttgtactagtagtattgcgaactattcggtgttgtatcataatgttatcgtgatgactgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttgtagaccgctggagacctgagacgcacatgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctaggaccggccaacacccttcctccgtactctacagtcgggcctagcaaggcttggttgctccagttcactgtaagtaaataagttgttattatcatacatgcttatttgcgaccggatgagtgttttgtactaacatttcattcttaattg

SEQ ID NO: 92274 - DNA, 2223 bp, Oryza sativa
ggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttcttacaattatttcatttatcttgcataatataggacaactactgaattttttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgctgtcatgcgcgtcttctcctgtcgcagcgccgtggacgtcgtacctccagctggtccggtacaaccacggcctcgcgcgcctaccgtcggagcaggacctcgacctacggcacctgtttcgcacggtactgctcagcccagaggttttttaagttttgtttctgtttttctacgaaaacatcaccccgtcgtaacttgatgttccatcctcgcaggacctcgtttgccttcgagcgcccctagcttcggagcagtgcgacctacagcaccggtttcgcacggtacagttcagcccagatattagttcatttttgtttcagcttttgcacgaatatgtcaccatgttttaactgcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgcccacacggtactttactttttattactactgttaaatacttgtacgaaactgatggtccttgtccagcaggatttgcagccgggatcttcggtactggggcctcttcgtctcacgccggtaggactggtcctactagccagttctacgatgacgacttgcacggtgcacaccaccacgacgtactaggctcctctcagcttggaggagctccagaggcgcacactcaggagcagccagaggtcatacctgtacaggcaggacgggttggccgtgccgtacccccggaccgactcacgtactcccaggggcacattagggcgctaggtatgagggacaggggtaagaggcctcgtcagtagtgttctacctcttcagtccttatgtgaccgtttcttttggcttacaaacttgtaaagcagtactacttttgctattactactgcagtactacttgtgttcgtctcgtctacatagttcttttcattcatatggtactagaacaacttatgctcacgacaacacactttcggcgcttcacggtagtgtcagatccagtagcgcgcacagtccacaacagcacacatgaaaagcggattttcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacaccacacacgaaaatggaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacaatccaaatatgccctaaaaaataataaaattgtattttaccagtcttggagattttaatcttgtatagttttcaatataaaaagatttgataactattgatatttatacaaaaatatagagcacagtataaaatcgccctcccccagggcggcaagggggccgcctgcaaaattccatgccccctcgccgcccatttgcaggcggcccccccacagtacaaaatcgccctagcggagggcggcaagggggccgcctgcaaaattccatgc

SEQ ID NO: 92275 - DNA, 1683 bp, Oryza sativa
ggcgggaagcagcagaagttggtgctcgacgccgccgacgacgggttgcacctcgccggcgtgggcgggaagcagcacaacttggtggtcgacgccggcgcgggcgggaagcagcagaagttggtgctcgacgccgccgacgacgggttgcacctcgccggcgtgggcgggaagaagcacaacttggtgcttgacgccgcccccgacggattgcacctcgccggcgtgggcgggaagcagcacaacttggtgctcgacgccggcacgggcaggaagcagcagaagttggtgctcgaggacgacgggttgcaccacaccggcgcaggcaggaagcagcagaagttggtgctcgacgccgccaacgacgggttgcacctcgccggcgtgggcgggaagcagcacaacttggtgctcgacgccgccgacgacgggttgcacctcgccggtgtaggcgggaagcagcacaacttggtggtcgacgccggcgcgggcgcgaagcagcagaagttggtgctcgacgccgccgacgacgggttgcacctcgccggcgtgggcgggaagcagcacaacttggtgctcgacgccggcgcaggcgggaagcagcagaagttggtgctcgacgccgccgacgacgggttgcacctcgccggtgtgggctggaagcagcacaacttggtgctcgacgccggcgcgggcgggaagcagcagaagttggtgctcgacaccgccgtcgacgtgtcgcagcacaccgtcgggggcgcggagcagaacttgctgctcgacagcactgatgacgggttgcaccacaccggcgcaggcggggagcagaacttggtgatcgatgacgacatcgacgggtcgaaccacaccgtcgggggcgcggagcaagacgatgggttgcaccccaccggcgctggctgggagcagaacttggtgctctgcaccgacgtcgacgggttgctccacaccggcgcgggcggggagcagaacatggtctgcgacaacgttggcaccatcgtctccgggttgcacgacactatcgcgcgttgggagaggaacttggtgttcgacgacgtcggtacagccgttccctggttgcgccacaccggcgttgatgggaagcagaacttggtgtaccacctcgccacggccaccgtgcagagcgtgtggcgggagaattgcatggagcagttcaagctcgtgctggaagcgcttcatcaacctcatcgccacctctatatcgccgtcgacatggagttcgcagcggacgccgccaccaacgtgagccataggccagtaacctccatcagctgctaccaacacatgcgcaggtacgtgaacggaggtggcatttttcagatgggcctcacatttgcattcgtcggtgaaggcgaacaagctccctcgccgctgatagcactggagatcaacttcgacttcaacgtcaattcgccaaagtaccatggcaagtcgatagatttcctatccagtcaaggccatgatctcacgcagcacagcaaaagaggcgtcgcgccggagtttgtttacgaggggctcctgcgccacctcccgttcggcgacggctccgtcacctgggtcgcctttcacggcgactatgacttggctttcctcctccgcttgctgcaagggggagaccatggcggcaattgcctcctgccgcct

SEQ ID NO: 92276 - DNA, 1141 bp, Oryza sativa
gcagccctaatccccctcctctcctgcatataaatctctctccagctcgcctttgcaccatcgccattgctgcatcccagctaagctcgagagagaagcgagagagagagaaagagagagagaggttggtgcattgcggcaatggagatcgaggcggcgaagtgcgagtgctgcgggctgagggaggactgcacggtggagtacatcgccggggtgaaggccgacttcggcgggaggtggctgtgcgggctgtgctcggaggcggtgagggacgaggtggccaagaagggcggcggcggcggcggcggcgggcggcagctggaggacgccgtcagggaccacatgtccttctgcggcaagttctgccggaagaaccccgccttccgcgtcgccgacggcatgcgccagatgctccgccgccgctccagcgacatctccgccccctccggcgcctcctgatcatcacccatcaagctccggcgagagagatcaagctatgagctctgaacacgaagacgacgacgagcaattaatggcgccgcggcggcggagctaattaagctaagctagaggctaagctaagcttaagcttaagctgaaggcttaacgccatttttaacctcgaaatctcaatcaatcagctgcctcgtgtggagaagggtctccgttgaggtggtggtgccaagtgtgaagccttctttggcctagaagatggcttcttaaatcttaatgatgaacattattgttcgagttttggttaattgtagcaaggatgagattaatattgattcattgtacaaggagatgaatagaagttcaaccactgctgcaatgtagtattcagtggtttcatgaattcaattaatttgtttatattcttatcacttttaggattgtactccatttgtctcaaaatataaagatatctgaagttcttcatgaagattaagaaaataggcgaaattgaattagggatgatttatgactgttgatgtgagtaagtatgtagaacttcacggagattaagaaagtaggtgaaattgaattagggatacatgttactattgatgtgaataaatatgtgcagaaatttaatgaaaaattgttgcgattgattgagataagaaaatagatggagtaa

SEQ ID NO: 92277 - DNA, 1959 bp, Oryza sativa
tttgttgatgcaacacctcttcagtctttaggcatgtgtttagtcaatttagacatgtgtttagtttttatggtttatcacacttggcaccatggttcatgtatcataaaggggatgtttagatcagggtgtaaagttttggtgtgtcatattggatatacggacacacatttgaaatattatacgtagactaataataaaacaaattacacattccgcctgtaaactgcgagacgaatttattaagcctaactaatctgtcattagcaaatatttactgtagcactatattgtcaaatcatgaactaattaggtttaaaaaatttgtctcgcaatttatacacaaattgtgtaattagttttttttttctatgtttaatacttcatatatgtgtctaaacattcgatgtgacatggtgtaaaatttttgcctgaaaactaaacagggcaagcttgggtatttgcattacttggtatagttgtgtttcattctaacattttttccacaaaacctgcggtagcttagtagttagactacgcttgcctagcgttgggcctatttgtttccgcttcgcttcggcttgtagaccgcagccaaatttcaattttagaattaattcatttgttgtataattcttggcttttgaccgcaaacaataaaatctgttctaaaattgtttttcttctttggtcacttgtcctgtaaattgtagccaattttttttttcgcagggtctctttatttgaagaaaaaaatatactacagaataaaaattttgtaagatttttatcatgtaggatttttctcttatataaccatttgaaagtttcctttcaccctttttagttccattttcgcttatgcttatgcttctctatatcgcttattagcaactaattcgtgagtaaaacttttatttatgtgtcataagtagtataaaataaaatattataaattaaactacaataagaaaacacaaaattaactttacaattaaatcttaacaaaacgatagggtttttttctctctctttttttcttacagtccagtcaacgatcattattgtattttttctgtactctgtaactgtattctagtgaaaatcttatattgattttcatattcctccgttttgaaaatcctatatttcaaacgtaccataagtccataacttccatagtagccgtttccgggtacattctactgggtgcgcctaacaagatttctccgcttcgggcatcatcacccggcatttctcctcccctttgcttctgttttcgtcgtcttcccacgccgcaaaccccacacgccctccacactccaaccacttcgcctccaccacagcgcgagagagaagcttctggaagctagggtttccccgtccccatggccgccgcccccgacgccgctgtggtggtgcccgtcctgctgccaccgccggtgccccaggtgcagccgacgctgaaagacatcgtcgtggagttcccggtggacggcggccgcggccgcctcgtcgcggttctcccgctgccgccggaccacgagctgaggaggtcgctggattccgtcgcggaggccctggcgagcggccgcctcgccgcggtgctcccgccggcgcggaggaacaccgtcgcggcggtcctggcgcgcagccgtctcgccgcggccgccgccgatgcgctcatgtacctggcgctcgcgggcatgtggatcttctaggcgggcatggccgcgcaggacgtcgcggcccgcgccctcggcgagggctcccgcgcgtacgccttggcgttcgaggtctcccgcgtcgccgtcctcctcgtcttcctgccggtcttccccttcgccacgttgctgcacgccgtccgcctcgccgtctccgacaccgatgagccagacgaggtacaccttcatgtccaaattcttactactgtatccgaatcaattccgcatatgaact

SEQ ID NO: 92278 - DNA, 10534 bp, Oryza sativa
ttgaatcactaaatagcattcagtgataggaattatctgtagtgattcagtgaagcaaatgtactactaaactttccatgttacattatagaatactaaaaccttaaaatacaaaggtgcttgacagatgcaaggtaacctgaataatcacaaaataaaaaataaaaatggaaaacaaaggagcataataatagaaattgtatagttaggggaaaaatgattaaattgttacgtattactgtcgaagaaatttccccacaatagtccaacaacatcgataaaatggttgtggattatttaatcctgtaataaacccaagacgaaatcaaagtagttaatcctatgaagaaattgaagggaataattaaactgttagtgcaaatactgttatacagggaaaaaaagaagggatcaatttgggatactgaaatcggttggaaattcataattgaatcacgaagaaattagtgtgattactcaattagcatcaatcaatgtattataaaaagttttagctgaatgggaaaagaacctacgcaagcagtggaacaacccctttgttggaagagccgatcaatctacagatgtggttatatggaggagaagctacttgctggcggagcagagatccagggacgactgttcttgtatggagaggctgcttgttggccgagcagatcgatccagctgttgtgtaccacttttcttcaactgttgtgtatatcatcatacataaataggattagaaaaaaggccagaataatgcaagtaacgtattgtttcagaaaatgaagatgaatagatgggactgttccaaacaactaaaggatagttaaacattagattcagggtgggcaacagccaacagaacagactgccaccaagtctaattgctgcaaagctctaaatgactaaataacaaaactactactcaatcaagctgcaaatcaccacacgaatactaacttccattctaaatatcttcaagattgaatctttacaaagaacagcatccaaaagctcatacagacaccacatgtacactaaattctacccaaggcatcgtcaagattgaatctttagagttcagtatccaaaagccccagatttaacttccaaccctgcaatacccataccataaagaactcctaattacacactatagttttttttcccatgtacttgtgaggaccgcgaaagcagcttcacccaaggcatcgcctgctgctgctgctgttgttgctgctccttcttcctgcgcgagctcttcgctgcagcgatggccgtcttatccccttcttgatgtgcaacgaagcatcaaaaccctaacagctctatccaacaaacccatgtgcgtcccaaaaagaaggaaatccctcctcacctctcttggccgccacatcctcgcccgagctggcgctcttggcggacgcggtcgctgccgaatcctccttgattctcccaggcaccgacgtgtcggcaacgtgggcgctgcctccgcctgattcaaatcggattaaaaaccaccccgatggaaaatcaaatcaagaagaatctccgatccataggaggaggaggtgagaaaaaaaagtctctctcaccttggggcgcttcggtggagggccggaggaggaggaaggggacgggagaggagcgctaggatgcctcggttttccgtttcttgctgtgtgcgcccaccgacggttccgtttctccatacacgccgaggaggcggctgctgggagcgtgaagcacctgtggcgctagggtgcgatgtcgcggggaggagggggaggggcgactgcagcgccagggctagggggaggcgatgcggccgtggggcgggggcagggcgaccggccatcggatccgtgcgggggttggccgtcgcccgccggatcccgtgcctccatccccaccgtgtggaggaggccgccacgcgccgtcgcctatgcccaccacctccaccgctgtcgccgtgcgccgcagtgcggtcggggtcaccggatccggtagcctgggctcgtcgctggcaaatctgatggcctcgcttgcacagagcggtggcggcggcgcagagatgatggacggatgaaggtgtggggcggtggcacgcgtgaaaggaggaggaaaccaagagggagcaacagcagcgacatgacgacaatggctggaggagggcaagactgcggctgcggcgacggcgacggcgacgacgtgcgtgagtggaggactgtgaggcggcgcaggataagaggagggcaagagcaaggcgacgtagcccaggggagcgatgcggctagggttcagtccaggctagggaaatctgcaccgtccgttcctgtcacgccctgaagttcttctccctagcaaaaatccaattgataaattgttggaagaaattatttgtttaaagacaagagagaaatcctaaattaataaatacaaataataatcggaatcgacatgtggaatttttcttggattctacatgtcaaaatatgctaacaggaattttagtggaattttcagagcattggaaataattttaaccaattaaaataagcaatgtgcaatatttaaatcccgggaaaaatctttttcctttttcttctcttctttttccctttttcctttgttgggccgtcggcccactcatcccgcgcgcccgccctcctctcagctgggccggcccactccctccctcctctctccgggtcaccgacaggtggggcccacctgtcggccccttcttcctcctccagccgatggcaccgccgccgccgaaaccgccaccgatgccgccggtttccccgtttcccgcgcccactccgcccgtgccgcacgcccacgtcgccgcccacgtcccgccgtttcccgccctcgcgcgcgcccgagaatggtcggattcattttgaatccctcctctctatttctctctccacccccacgtcgccggccaaatcggccacccccccggccgttccctcccctccctcgcccataaaacgctcccccgaacctcctctcgcgtttccctcctttgttgcgccctcccgtgcttcctaccgccgccgcgccgtcgcaccgagctccgccgcctgccgccgccctccggtcgcgcgccgccgctgctagagccgccgccgcgcgaagccgtcgccaccgctagcttcgccgtcgcgggggctatcccggccgccgctcgcttgccgcgcgccaccgccgcaccgctctttccacgcgccgccgcctccaaccaccgctagccgttgctagtgccgtcgccgcgccgctccgttgccgctgttggcctcgcgagatcgaggctcgtctcgtccatcccgcgcgccccgctgtccgtcgcttgccgccgccggccgccgtcgtcttcacccacgccggccgaatccccggtgagaactccctccccttctcttcctctcgcgcgcgccgccgctcctcgcgtgcgcgtcgccgtgatgcgtcgttgctcgcgtcgccggccgccgtcgtcttctcgccggccgccgccgtcggtggccgcttgcgccgccgcatcatctaaccggccggccggtttgaagccgagccgggccgaccgggcgcctcgccgctccccccctttgtgacactgcccagtgggcccgcctgccagccgccccctctccctcccttagtgccgctgaccagtggggcccgcatgtcggcgccgccccacccttgctgacgtcagccctgggatgaattattgcgcaataaattcattaaggtttttcttttatagtaataaacacagataatcttctaaaaatcataactaattcatccgagctccgattaagtccattcaagtctcagtaaatcaagaaaaatgtgtagaatccattaaaaatggttttgttctctgttttagtagtcttatagcatgttttgcttgtgtgctttgtttgtcgcgtagatttcggccatttcgtcgatccgcggttccttgaagacgttgctgtggtctcatcagtgcgagagcaaggcaagtcatgcattacaattgatcatattgtacataatttacaaatgtcccgcatttctattaaatattgcattattttacaatatcatgtgggatgggtcctattactcagctatatgttgtttcccttgtgccattgataacttgggtatcgaaatgactagatgttggtttaggaaatgcttagccatgcctagttcaactagtacacaaaaggggaatcacattaatgcatagactctgattatcggcatagctttggtttagtgctaccgtaatggtgttggttaattaaaatacactacatggtgggctgtgggtgcatggttttgctagtcgtgcccacggcaattaaggaccagttcgcgggatgccctggaagaacttatcgtacttaccacaagccagcgtgggcaacggctaggcttgtagtgtagcttttctctagccgacgtacctaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatgcgaagggtcttgtcacggcctctttctggtatgtcgtggtggcatgtcggcgtacagaaacgtgtcgtggggctgtgtcttgtgggtacagttgtacacctctgatcagagtaaaactattcgaatagccgtgcccgcggttatgggcggtcgaccagattcaccgtgattagtctcacccctagttagctaatgaactggcgtagttcaggtggttggtcgggcctgttgcaacgtggtgtagcgttggacagtgactggttaatactgattaattactacaactgttttactgctttcaactactgcttttaatgctagctttatgcaaatgagctctttagcctaccttgggtatatcctgcatcctacctcctcttccggtatgacttgctgagtacagtgggtagtactcagtcttgctcttttttcccccacaccagagttgaagtccttctcagttgaagatgtcttgaagaggttggtttcgtcgttgccgtcaaggatgcctgtggaatggagtcgcccgctgcaggagtcaagtcttcaggcttagctcgcttttatcttttccgctgcatttgtaatcctttttatatttttgtaagacgtggatctgtatgtcaacaattgtcgtttgtgtaccctggctggtcctggacaggggtttaatgcacattcagcttagaaattctggttcatgaatttctgggcgtgacaagtttcccgacccgacgattgcacgggcgtggaagggccggcacaatgggacacgtattctaggagagatcggacggtggacggtagcgatgactgatatgtaattaactggaagtacagggacttttttgcaaaaactacactcatataatctcctaagtgcgggggtttatttgcaaaaggaaccgctgacgtggcatgcctaactctccagcgatcccacgcgctttaagtaaacaaatattacagtttggagctttttttttttttgagagctatatagtttagaactcaatctaagtgctcatttgatttagcgtttgaaatgagaagacctattacagcatgatcaattaaatattaactaccataaaattaaaaataagtaacatccaaaccatgatgaaaaatatattgtctaaattttataatataaagaatatgaaaatgatagatgatttcgggcctgttcactttgatgctattttcaaccataccattttttggcaaagttgcatacatatatatatatatatatatatatatatatatatatatatatatatatatatatatatgtgtgtgtgtgtgtgtgtgtgtgtgtttttagtttgttgccaaatttagtaaatacataaaaaatcctgtcaaaattttggtaagtttttttttgctacaatctgaacatacccttcattattgcccacggtataagatgagcttccttcctcgccataaagggcaatagcagtgcatgtatcctatttgagaagctaaagccccatctagggcctgtttagatcctccaaaatggtaaaagttttgccattttagagtactttgtgctattttggatctaaacactagtagcaaaagttagcattttgtcatttgtcatttgctagtctagggtagcaaattttgccaaaaagtgctctaggaccgcgcgctctctctagtactaaaatggcaaaattttaggatgcatctaaacactccatgctaaatcttttgccactaaaacttttaccatttgctattccaaatggatctaaacaagcccctagataagaaacggtgtaagaaataccctccacagtgcatgtggtcttaaatagaggtctttcttacttattatagtgggtcccacctttctcttctttctcacttttcatcttcccccctctctctctcttccctttgcctttccccactggccaccgacgagtgaggcgtggactacccaagtggcgacgtgccaagcggggaacaaagcagctgcgaggcagcaccacctctccggacgacggcgccgctgaggctaagccacatacgacggcaccgccgagttcgatggatctgaagtcgggtggtggcggcgatggctcatcggggcacggctacggctcgttgggaaggcatcagcaatgtgaaccactgctagagtgccctcgctaactaagggcactcctagaggaactcatctgctaatagaggccagaggtagttgggttcttcaaaatccgaagctattcggtgaggatactccaacccacaatggatgtcccggcctaaagtagtcccaggtgacaaaatccctccctagcgctctcgctagcccaccgacgtcctcgttgacataaaccaataatgatataacactataggtttgctttagtttgggtagaaaaccaaagtgaggcagtaattatatagtaccacttttgattcgtaccgaatcgagtgatgggccaacatggatttgtttttcctttttacaaacggttttgctatttcacctgtgacagattttttgggcttatgtttcgattttttttccatacgatttatatttctctagatcttttgggcttctatgtttcgaattttttgtctgcagaatttatatttctctacatctaacttttccatacgatttatatttctctagatcttttgggcttctatgtttcgaaatttttgtctgcagaatttatatttctctacatctaacttgcagttacactcacttacagtgtatcaaaattatatttttacaatcgtttttctctagatttacgatttttttatatgcttgtcctttttctgatttaatttaaacgggccatattcgttggttaaaaattctgcaagatttaaaactctaaatctgtcgagagatcatgagaagatcacgtagttccttaatgtgatcatcccatgtacattttcttccgggcatacaaaaaaccaactcttttttatagtatatcggttactaataagcactactaacactgcgtgtatttaacattaagatgacatattataactgctactcaactaaataagattttccacgttactaattaaccgcacgaaattaattaagccatcagcaagccgctcgtcgccgtcgccgtcgtcgtcgttccagcatatcatctgtgccactttcaacgcatgcagttgcagccatggtgcctcgacctgccgcacttcctgcacttgccatggagcgcctcgtcttctctgcgaacgcgctgcgcctccatgatccgggcgacgcgccacacgtcgcgcatggtggccgcgcccgagcggatggcggcggccgcgttcgccgggagcaccgtctggcacagtagctcggcgagctcggcgtcgctcaggctcagcgtcaccctcgtggcggcgttgagcgcctccgcgcgcgcgatccgctccagcagcggcgccggcgcgccgtcgagtgcgaggtcgtcgtagagcatcctctgcgcgacggcggaggcggcgtccgcgttgtcgtaggtgcgcgccacggcgtcccacgcgtccctggccgtgcggtggcggacgtagtccgggaagatgcggtcggagagcgcggcgaggatgtggccgcggcacaccgcgtcgtcgcgcgcccacatcctcctcctcgcggcggcatcgccgtcctcctcctcgaccccggccggcggcggcggcgggggatcgtcggagaggacgtgggcgacgccgacggtgtggaggcggagcagcatcgactccttccacctgaggtacccctcggcgccgttgagcggcttgacgttgacgttcgtcgccgccgctgccatcgccctagatcaaaccgagaacctggcagagacaaaccaaagcaggcgtggcgtcaggtaagcaaacaatgagactcgaagcggaggcgcttcttgctcctctcgagcatttgcacgaacaggtggtgcgcgtacgagctggactccggtaccgatcgccgtcgatgttcgtgcaggtgattgagaacccgaggggcgagggcgctgttggcgaggaggaagggataaatagggagatattttttttccaaaataaataagaagcagctcccgatttttctgccagattgatcaagtgccgacttcattgtagattagattgattcgaaacaaagtattaaaatgtgacacgttactatgagtctggacacttgttttttataggacggatggagtactctcctagtctcattttaagtgcaagtgttgatttatgtgtttatgttctcttttttaattttttttatgattagtatttttgtggttattagataataaaatatggataatattctttgcgtgacttaattttttaatctttccataaaagttttaataaagcatgggacagctgcacttaaaattgacggggagagtagcgacagtttgtttcaaatgctagtgcggagtagtagtgttcagtttggaaaacatacgaggatgttggacaattccgtgagtatctaactaaatctgatagttgagaattttgtttgtaaaggttttgtaagcaaattttaactacgcggagcagtgctcaaagatgtaacgtgccaatttgtctgtgaaagtacttttgtaatcttataaactcatgaaagttgataaacctgttgtagggaataattatagcaaagttttttttaagagaattatgagcaccccaaatttatttatgaaagaacgtatatactccatatagatccaccataattatgttttggataaaagttccctttttactggttattactcccttcgtttcagattataacatgttttaactttggtcaagcttcaaatttgatcaagtttataggaaaaaaatagtaatatttccgacccaagataaatttattataaaaatatatttaactattaatttaataaaactaatttggtaatactccctccatctacttttgatagtcatatttcatcttgacacacagacaagaatatgtaattctacttatcatccatttaaatatgctactagttattcctcgtaaagaaactattcattaatatttatatttctcgatgcccatggagccaatcttgtgtgaaagaatggagagtcacgcattaaatctaagaaattcattcagatgtaggttgttggattgaaatatgcctatcaaaataaatttttcagatttggaaatatgcctatcaaaaatagttggagggagtataaatattactatatttatctataaatataatcaaacttaaagcaatttgactttaaaaaaccaaaatatcttaaaacctggaacgaagggagttataattaacagcagcaaattaattaagccatcaggaagccacgtcgctcgtcgccggccgtcgttccagcatcgatccaaaagcaccatgatcaacccatgcagttgctggtatggtgtcccggcttgccgcacctccagcacctgccatggcgctccatgtcctccctgcaaacgcggcgcgtctccacgagccgggcgacgcgccagacgtcgcgcatggtggcgccgccgccggagcgcgcggaggccggcccgcccacgctctccgggagcatctcgcacagcgccccggccaggtcctcgtcgccgagcgggagcctcgtggcggcgttgagggcctcggcgtgcgcgatctgctccagcagcggcgcgttcgcgtagaactcgaggtcgtcgaacgccctgcgcgccacgccggccgagagcgcgcccgcgccgtcgtaggcgcgcgccacggtctcccacgccgccctggccgtgccgtggcggacgtagtccgggaagatgcggtcggagagcgccgccaggatgtgg

SEQ ID NO: 92279 - DNA, 1423 bp, Oryza sativa
tcatgcataaggaggttcaggcgttggcaaatattgcaaaaattcagccacaccacatgagttttctgttgatgatcttgggaaaaattgatgcaaatgcagctcttaaaaagatagcggctagatctacaccaccagtaaaaagagtaataaaagcacggactgcacggtgagctgcaaaagaaaccaatcggacatacctaatcagggcctccacggatgggcggttgagaccacattggcaaggcttgaatatttcagtcgccatgtgaagaactgttgatggagatcaagaagaaagaagcctaccttggaaagttgtcatgacctgaggccatgacgggataaacaccgccaagaaaatagctgggcggcgtcggctccggggggaagggatgtagatttaggctagggagaagaacattgttggaagggagagattagactaattgatattcattccttaattcataataaacacaatcccatccttatatagatggtaccaacttgacccctaagtaaagacttaatcttatcttatctctaactaactaataatcttatctttaacttaattgatctggattgcttatgggcctctgccttccggcccaatgcccatgacattatatcctccttttgagcagctcgtccttgagctgcaacacgatctttgctggctgagacaactccctaaacaaagcctaacatgactcaagccttttacatctcggcttgctaaattattgcaaactaataaatctaagataattgtagatcgccatgctaacttgatgtcaacaactgctgatggaccccatccggaagcactacgagagaggattagtctcatcacaatgcaaagccgaaaagccaatctggcctgctgatccatgtagagccacgttgtgcagcaacaagaaaaagattgttgggctagcacgtgagacccatccagccagctatgcgaaaaaagtggagcctctgaattcctttctcgcacacgccgtgaatgcggtgccgccgaattgcccattcactgcaccaactgtcgtctccaaaactagcggcgctgcctctgacatcagcatcgtcgccgcaacaagatgtagcccagttcgtcagcatcgctccccttcgttgacaatggcgccgttgccagggccagcggcaaggatcccctggaagcgtccgctgtctgatgctcccttgttgctgctgcaatctgatagccaaggactgtgccggcttgaacgatgccggggagcgaatcgccacccacggtcggttgggaagcaacccatccttaggtggtggtctcccatgggttgacctgcccctcgaggcgctgatatgcgtgcaccacttcaagacctgtggatgttgttgtagtgtatagaacagacaaggggtgcaggaa

SEQ ID NO: 92280 - DNA, 2902 bp, Oryza sativa
cagccagaaattgccagttggttgtggggctgcaacttgatccacagaaaagaaatttttctagccacattaatagaaaggccacatgttctcaaggggtgaccgagccctggcccatgtatgctgctacatagcctaaccaacctcctatgcttttggtcttgaagtcatattggttctttgtgttcaaactcatagggttggccgatgaggtgacattcagacctgtgatcatactgatatctatgagggttggagtcatcggcccttgattgaacagaaaggcattggtagtgtttgaccagaagtaagaagcagctgccatcaggggttcatctttggctgagttcgctataataaggtcaagtgcttggccgattccaatttcatcccagtgaaccctcttgctggctgatacacgtttgaaccatgtggtccagctcttttctggtggaactttctctagagatggccaggatttgaaggtattcttccagtaacctagatctgggttggttaatctgaaggggatcctattggtttcaccaataatgaactcggtggggtctggattgccgactgggccaagaaagtagtgattttcatgcgacaggctgagaatcgcaactaggttggaaaggtactacaaatccaaagcaattcagagggagagagtgatatcagattggagaagatcgatttgctgctaaagaaggggatttagctgatgagaacttacctcagcgtattcggccgatggtgcaccaggtgggctggcggaagacgacattcgtgcgggcggagatctcgtcgggaaggaagtcgcctaggaatcgcctttgcgccagaggaatcgccggagaagagagagaaaaggtttcacttgagtggtgaaaacggaagtcacggcgtgagatttctcgggggtaacggttagtatttaaagcgctggaataacggtcaaacgcggtcgagtgcgaaacttgctcggagtcggcatacagcaaatccggaccattatcgaatatcctagacttgggggacatgtgttaacaaccaaatttggtaatatctatgtcaggaaagaggatctcatcaaagtggagtcggaggtggagatcgagttcggaagcagagcaggaatcggctggaatccagatcggctacggttaggatcggctggatctgagtcgggctaaataagccaatatagccgattccgacaatacaacttgtacgcgacatcgggttcaagttaatgtatttcaaggtgattgccacgcacggatagagtcctgggaaggcaattgtatctattaattaggatatcttatgtaaattccttatagataaatgtgggcaaaagtctgccgcaaagacttatagtatcttagagtttgttagagataatggtcgtatccggtatgggcatatcttgtaattctcaggaataaatagaccccgagccctatgtaattttttaacacacacgttcaatacaatctcggcgcatcgccacccttttttgctttagttttgtttcgacgaattcttcctttcgggttgagctgcatcgatttcgatcttcaacaagaggtaaaattcgttatgacggattgcgttcttaggattagtgcttccatctttatgatactctaatcttgtttatgtaattcgtcgagttatcatatgtcttacataatatctagcaatatcgccatctaatctactatcggccaatatctgtatgcagaagacagccgattaggttagatcttgacgttgatctagattatataagatatctaccattctatgaaacttctagcagcttgattgtctaagtatcgctcttcttttcatacttaatactgcatcagttgagtttgatctattaagtcgtgcttagaatatcgatctctagcctgccttctagttgccgattagaatagcattggagtttcagccaatcgtatctgatttaattatatttgttttatatgctttactgatatgttaaatctgccctttatatcaagatattgttgtatctaagtatgttaggcctttgtttgatatattatacctacttttatatcctgatatagagttgtatcggagtattagccgatacatgctagatctatctgatcggctacgctacaaacatatatagtcttgttattgatatatatttcgatctaggtgatttatactgtctcggtatggtgaccgatctatcccaatcacttgatttaagtatatatcgacataaggagtatatatcattaatatctacagccgatcaagtagatttagttcttcttcacttattcatgactgccgatcgatacacggatgacatcggcccaaagataaatgatatgtcattggcatctagccgatcggctatcatttatagatttaaccacggtttctttgcttctatttcttgttgattacaggatcaaatcaactggcacgctaatacatccgaaggcgagctttggacctgcactggagttaagcagatctcccaggccacgtgttttctgtcaacaatgacaaatgggtcccactaacttatagcttttctcatccatgctatatccctcctaccaaacaagaaattggatcgccatatccatacaaaccaaacaaaaaaaatggatcgccatatccaacaaaatatggatggccatatcccatccatgcatgaccgtgaaccaaacacaccctaagaggatgaagaagatgaggaggggctccacctcgtagatcgggatcgccaccgctcctctccccaccgtcgctggccgttagccggcaccctagagggaaatcgtgctcactgaatccctcctccgccacgcccagtcccttctctctgctggcgcccacc

SEQ ID NO: 92281 - DNA, 1927 bp, Oryza sativa
aaagtcatgaaaaataataacaatacatctatggttcaggtgtagtggaaactgcaatatagttgtagtcgactgtattcctgtccttgttgaatcgagtctctctcactgcaaccaacttgaccttccaccgctggaataaacttaccctgcattccagaaaaaaaaatatcatgagacacggggtagagttatgcaagacttcataaatttaatcatgatattaacagagctaaaaaaaaggctgacaaatcaatcaacagacaacagatatcgtttgcaatggaggggataaaattatttgaaatatgctcatcctaagaagcaaagatatgggactatgggagaaccaccatggaattactggcgaaacaaacaacacactaattcaaaagttacaacggcatttatgaatttattctaaccgaaggaaaacaaacttcattcttttcccaaaaacaaatagtgattgcatttgcaaaattaatagaacagatagctcaataatttatgatggaataattccttaagacaaagtaacaatgccaacgcaagtatatcttctgaattctgaccaaggtccattcaacagcttaaatagaagaacagttcaagagttgaacccaatgatgcacttatcgaagtaaagacgtggttcttaaaacgccagtatataaagcatacctttctggttcaacagtccttttggccagcatgagtgccaagaacacaggcaccattgcagcagctagatgcttaagagtatgaccgctaacaatttgatgggtccatttatatataggtttatctgcggcctcttctaccttagcaaggaggtaaaatcctggaattgttttgagaaatcagaaaacagaaaaatatggtgaggtgctgattgtgtatgaatttccagaaaaccaatcaattaacttggtcactgcgaatcaatttatgatatgtagaaatagattaaaatgaaaaccatttaagtatcatcaacagttattaggtgcagagaaatgatcaattgaatgattcataatatataggtgaaccacaaataccacatttttcaacctaaatgctaatgaaggtacatagatcaaatactattgatcaagaataacactaacctgctgcccacagccaatagctcgaatgtgtatacattggtggaattacaatagccatcacaggtattgcaatgcatggaacaaactgaattactgcatatgggcgaagatcgtcaaagaacctacataagagttaaggcagcaaaatggaaggtgtgaaagaagtacagaaaatatttctgaggaaggatggttaaacaattggagaagcttgcctccaatacatgatgcttagtgcaccagcaataacaagaggtgctagggactttgttcctgccctatcatcaaccctctcaataatgaaaatggccatgacagatgtgaaagcaattgtcatctacatagaacaagcaaatatgccatcctttaacatattaaatattgataaaagcaagggtgaaaattatgaactgatgacatgctttatgtctctgacaggcaattctgaagaaaacaagccaaatatactagagcgtatcaggcaaaagatccaagtggattagttaccctgttttgattcaagcagatcacacccaacagaacaacactatctaaacagggccatagcatattcagattatactacacaaggatctgagttgaattctatcccaccaaaaaaaatgtatgcattgacattctgagacagcttcaacataatggggtgtgtacaaatcctagagcaaggcaatgtaagtctagaaacaactcaccggcaatctgtcccaaactagtgtggcatcattcggtttgagatgataataggatgaaccaaaagcaacagcagtcacacc

SEQ ID NO: 92282 - DNA, 757 bp, Oryza sativa
tcctgcagcccccaatataacctctggtgttgactgcgcctcctctacagatgcatgattgacacgggcctgaacaagcttgggtccggcacgtcttggcttcgggcacgtacataccatgtgtccggacttgttacaattgaagcagagttcgggcatttctccaaacttcttggtctttctggctaagctggcagagctgactgaactgactgagctagaatcattagtggacttggagtagagttgaggctgtgctgctcactgttactgtgattgtcactgttgttggtgccgttgaaattaccggggtggtagggacggtgttgccggataatcatggtggaaggtccaccctgatgtctcatcgtgaagcgaggcttctgactcttcccctaaggagtcctgaactgagctgccttccacttacggtttattttgttacactgctcttcctgacggatagtcttgtccacaatcttatcaaagtcctcataatccttggagatcagttgattggtcaattcatcatcaagaccagacagaaacttttcctgcctctcggcatgtgtgcgcacatcctcaggagcatagcgcgcgagacggttgaactcatgcaaatactcaataactgtcctagttccttgctgcaaagaacagaactctctcttcttttgtgccacaattccctcgggaacctgtgccttattgaaactctgacaaaactctgaccaggtaacttctgtcccagttggac

SEQ ID NO: 92283 - DNA, 7979 bp, Oryza sativa
atcacgcgctaatgctcgtattaattagttcgaccgagagggacgtgctcattttattctttttaggacgacagggacacgcacgtcgtgtctcgatcgatcggtttaattagcatcatggaccacacaacaacattgctaggctaggctgttgttcgaggaggccaataagttatactccagttcgatcgatcgatcgatcgatccgtttatagttttagtagaaaatttccggatttgcggagggggtatgaaaactgcggtggtccacggtccatcgtgaccacgacacacaatctagctggactgggaacaaactgcgctacgttagtctgctaattcatcagaaagtccaggttgatgtgtgctggcaggcagggctcgctcgctcgtcgcgtacgtacgatttgatggacagatacatctcttgtgtgtcgtccgtcacggggtgtgtggctgcacgcgcatatacagacgcatagctagcgatgtacgtacacctggcaataagtcgtgtagacatgtcgtgtcttgtgtaaacaagcagacacggcttgcgtacgtcctggccaatggcaagtgtgaagtgcatgtgttggcctgaacggtcacgctctcgatcgctgcaggctaacgttcggatgaaccacaactaccggccggctgcaaattgtcgagacctcgaccgatcgatcgatcgatcgcattaactcgcatatatgcatgcggcgcgtgaccgccgtacgtacgtccgacgccgcgcgtcttgtcactgcacaagcgcagagcgcgtatgcctcgcggccgtgatcgatgctgcaggcctgaggccgcccacatgcatgtggatgcatgcatatgcagtacgggacgcagctggcgaccatccaagtatccaaccagagacttcagtttgcaatatttgcacgcagcggtaccaatttacatggagctagtacgtactctcgtgatctatgtctctcgcagaggacaccgtacactagctagctgccggcctctcatcatgtacgtactactttctccgtttcataatataaattattatagcattttcttcatttatattgatgttaatatatatatatatatatatatatatatatatatatatatatatatatatatatatatatatatattcgttaatatcaatatgaatgtgagaaatgttataatgacttacattgtgaacggagggagtaattcaaaactactttccggtgttcactacacgtacaacatgcatgcagtggtgtatagaggcgtataggcgagccgatcaaagaggaggtcaaatcgtggtccttggcaggggcgagaaatattggtagttggctttatttttaattgcttagaatgaaggttctgagccttagtttttttttcacacttataagtacaaattcaacttctacatcttacatatcgtagtcctgagcctgtattaatatgtgatatatcacttcataaatatgtaagttcaaattcaacttctacatcttacataaatcgtggtcctgtacctatattaatatgtagtatatcactccataaatatgtaatcgtggtcctgagcctgtattaatatgtgatatatcattccataaatatgtaagttcaaattcaatttctacatcttacatcagaaaaaacaaattaaactacaactagttaatgtatgttcatagttattttttttttgctttttttcgcgaacgcgcaaaatgattgcacatcaatttattaagttttttttttgcgatatgtagaaattgaattttaacttacatatttatgtagtgatatatcacatgttaatatatcttctcaaaattcttaataactatttgaatgacatacaatgacatacaagtaacgagtatacgtctccgtgagagtttaaaatccactctagatgagtatgtaggagtaggaggaggaggaggagcaatgttggtgaacagatcagactgatgagtatgcagggcccgggggcgtattcgacatgagcacacatgtttgttgcattcgatctgtctcgaaatattcgccgtgcacccacattcccctgttttattggggaggggagcgtacgtagacaggataggagtcgtagtagctctcgatcatgtgatctgaacacatcagtagagagagagactgacgctgagatggcaccaacatacatatacatgcgaaatacgcagcagcattcgttggccagctggtggggtgacatagtgctgtggatgcatttggctgcatggaattttgacaaacatctcgtgaacgcgaactgttctaaccttgtttctatatgcccgagactagcagaagtactcgcattaggccccgtatcgacgtaagatctgacattttgtctcgtgtgcatgagatttgcacttgtcactatcctcccctgtttttttaaatgattccctgaagaaagttttctcctgagaaaacgatgtccttgtctgattctatataacttgcatctttggactgaattagttactgttacaattagttagtttggtggggacttgtcttctcggatgcttggactagaaaagtaaaaaagaagaaacaaagactgccgtcttatatctgttgaccatggataaatctcaattggcaagtagtagttatactcatttatcgcaaaagctgaaaaagaaacaattgcagatttagacaagtctgctgaagtgattcagttggcagtagcttgtggctcatcgctcacgcatgctgggtttcagaatttagaagagaaggggcaacggatccatgcttatcatcattgagatcgatgctaaattgtcatgattaaggagtttaactatagcatttttgtggattgtggttgcgccaagtctgttccaaagtaccatttttgggaatacgtaaggagcgtatctttatattaagaggagtaaaagtctgtacaggtgaaagagaaaacacagcaggagacgggattacaggaagtcacccaagagcattaaaccctattctcgcgatacaatgttgcgacctgagcgctctaagagcaagtttaatagtatagcccactactagctccaatttatttatagccaatctaatagctaattcatacaataattgcttactatactattagtatatggtcccacctatcatacacacattacgtcttggagttcgtgctgcagctggctacagatctgtagcccgctgctcttctctctcatcttttatcttattaaaatatggttgtagctgactaatagtctgctattgtacctgctctaaaggcatggccggtatggcagtattggtgagccgccacagcgctgcctcttccaccattgcccttgcacttctgtctagcttctgtgcttctggttgaacaccctgttattccattccttccagattgttcatgctgcgagagtagcaatggtatcgaaacctcgccgttgagagctcggtaaggtttccctcttgtcacacaactaggagtggaatgaggtttcattgacgggcaagcactccgagcgaccgattgccaagagcagtagccaccagagctatcttgattctggacatgcgaccaaaatatggttgatgctttcctcatgctcatcgcataggacacacatgctggggtggggcaagcccctgatgcttaacctgtccgccgtccagcagcggttgagtgcgtccagccaactgaagtaacggcaatgcggcggcgccagcgatttccagatctgcgtgaattaaaacgggattagaccgaggaacaatgcttggtaggcggagcgggagaagtacaggcctgaactctcccatttccaaataaattggtcaattggtcctgccgatccgagagctctatctcccgcaacaacgaccggagatgttccaaagtaccatcatcgatcatggtatgtatacagacgagaggtagcgacgagacgagtcaagttgtaggattcagacaagatacgtacgtactcgtaattgttcgtgccatcccgctgtgccggcccgaaattctgttcggcgacaaaaacccaacctgaccaataatgttgtcgatcatacacggtacaacgtacaatacaaagccatgcatgcttaattcacaagcctgtccttgaacatgaaagatcatcgaccatttctgttctccttcacgtgcatcaatcgatcgcgatgaacacacaagaattcagctagctagctagcgaaataacaactccatcgatcgatcgatcgatcgcgatgaacagggaaagaaaactgcatttgcgatgaacagatagaactgctcatactgcctaggattctcggcctgtactctgtaggatgcaacagaggcgccgaggcggcgtgccgcgtgccactgcaacaacaaccagtagctccaaaggtcacgtgagcgacggccgtgatcgagcgatcgagctgaggcctgagcggctcagctacagctagctctctgaaactctctgctcgagtaggtacattcacatgcgatttggcgcaatacgaagctctctctgtcgcgtcgagtatacgtctaccctacatgcttcgctcactcacgttgtactacagtctacagctgcaagggtacaaagtacaaactggactagtacgacatgctccagccgtccagcgagcaagcgcactagtagtaccagaggcggagtaaaaaggaaaaagaaaaaaagaaaaacgagaaggccgactgaaacttcggtttgtagtgcagaagcccaatttagaaatttttcggcctatgggcctcatcaatgcgacagcccagcccaagttttgaacgggaaacttattattgagtgtattgtggcccaaagaccaattcagtccttaacgtctcgacccagtgacacttttccgtcacatttgcagtaggcggtgtccaactccaatgtggatgactgatgatcgcgtcaatagtcaataacgatggtcaatctagccgaatggcatattctctcaaaaaagaaaagaacatatcaggcacgggcaaagaaccacctcaaatcatttttttttcatacaaaggaaaaagaagggaaagaaccacaaaattccccttttgcgatgacacggtgcctccctccatccaaaattagagccatccaggcatccagcacaaaggcctggccggcgaaagggccaccaagcggcagatggcggcttcccgaatgttcgcggcttcgcacgcacaggaattatgcactcatcgattatctgaatcacattattaaaatatttttgctaagcagagggataaacgaaaagcaacacatcaagccagtggcggagccacgaaaactccattaaattttaataatgatgagtaaattgatgatgaaatttctataacaaagactagttatattgaaatttatccgggctccaaaatttatctgactccgccactacatcaagtggaagcatagcatggtagttcacatagggctataaactgctgtaacaaaaactaaacagcgataatattgtttttaagacgataacatctcaatagtcaactcccaaaacttgagacgctctcatcaatattgtcattctttctcatctgtactacctttcttccgtttacatcatttgctccatttgtacacatttgactaggtaacacatcaactaagcatcagctgcaaaaataaatcaatgatatgataacacaacaaaagtaaactgagccaagtatcatgagaatatagaagttagtgctttgagttttgactatatatacataccagtatatcgcgacatgctggacgcagtcttggtgaaatctgtagcatccggattagtactggcacctttccaccccatcctttagaaatattgcagtttagccatgtttgaagtggattagtcttccatttgctgctattcaaaatgctttcaagtttttccagtcttttgtatcttccattgctgctcgtgggacctccaaagagctcgaagtacaggattccgagactaaacacatcagtctatgaatgaaaatgaagaaaattcttttagcaaatttgccgtagcaagctagaaattctatgaatttaaaggagagttcatcatactagtaatctctaatttgtcaaggttttatatactacttaaatattagtaatggtggtattcattctcacactaccccctaccactaatatctgagcccaccaatctattatactattatatcacctttcaacaagttctcccccatttggccatttcactattagtttcctccaaatttcaaaatcacctatttgtttaataaaacaaatgatagtattacttaaattaaatagtgcttattaattgatttaataagctagaatctcaatttgtatttcattgcaatgcacgggctctaagctagtcaggtaaaaaatacacagaaaatggtgaatgttaccttctcgttgtgagtatgcatgttccacagctcaggagacgcatggaactgagtaccccagaacctattgccccttcccaaacaagaagcagatcccatgaaagcacctaccagaaagataaacatgccgtattaagatggcaggccaaatttaaattatgtcatagggatgttagagtacgaataaatatgatatcagtacttaccacttccgaaatctccaatcttaacattgttcaaattatcaagaaatatattactgggcttgatgtctctgtgaatgaatcctttttggtggagatagtttatgccaagaactgcctccttgaaaaactcaagcttcatcaatgtctccatttttttttcggtccaaataatcatcaaaagtactgaaaaaaaatcaatttcaacaagtgatcagattgtgacttcaataaagaaacaagtgaacaaacaagaagtgtattaccatttgcacaactcctgtgccaggtatacagatgaataatgagttccagccttttcttctttccaagcaatatatagtttctttatatttgggtgacgaagcatcttcataactctggcttctctggttttataaaaatgacagcgaaattattagggtctaggaaataaataaatcttccatcattgttttagttacagaaactaagacaatttatattacctgagctcttcatcagcatgctttcttggaacatcacatctcttaacagcagatctatgggcacctttctgagtactgcatcggagcacttgaccttccgctccccttcctggtacagatgctatatttaggtctacacaatatactatattttctgaagacaaagtattaatagtgctcacttacctagggtctggtggattgagaagtgatttttcaaagaaacctcaaattcattcgcaatttcattgcaaatgaatcctttatattgcaggtcctgtgttttgtcagatagattgctctgttttcaaataagaatgattgtcataatgtgttgcacaatagtataacattgacaaatgaaaagaaataaatactaactgttaaaagacttttcccacgtggtgaatttgttgattccatatcaaagctccaagtagaatgccaagccaatctagatttatctgcacattacaagcatcactgtatcacataaaattatttaaagctgaaaagtgatgcagctcttccttatagctatggtgcaactatgaacgaaacttggatgttgagaaaaaaatacatttagcgaacatactcgatacaatttaggagtgaatttcaactgtttattttaattgctcacaatcatggtcagtatatttcgtgtcatggaaccaatttttcctaatgccaaatggtgcaccaaaatgagaacattgagacatgtatcaattaaattggcaggttaaatagtgttgcaaataacatgtgaaaacaaagaaatta

SEQ ID NO: 92284 - DNA, 2602 bp, Oryza sativa
ctgcaacatcaccgcacccaggacaatcttcaatagatggcagcctcataccctcattccaacaaaatctaaagaactcgcaaccccaatgaggatcaaagccatcaccatcttcttcatgatacctctcctgctgtttactatacctcttcttatatttgttaataatcttagccgaattcacttgaaaacctcttgcacgaccaccatcgactgttcggccaactgtatgcaccatattgacaggaaaaggattgccatcaactttcatcggccttttagaatcatcaaacttgattttacctccctcaatagctgcttggatttgctgcctgaagaccttgcaatcattagtcgtatgagacccagaattatgccacttgcaataccttttcttgcccaactcttcaaccgatggaattgtgtgtccggcaggaagttgaatctgtttttctcgaagaagcaagtcaaatattttatcagccttggttatgtcaaagccatacctttcctctttccctgagttctttgcccattgtcatggtataacctttttgctcctaacccactcggctgtagctatttcagaatcatcatcctcatcatccgatccatacatgtaagggcagacatgattcacctttctagaattctttctagcctccgcaaacctttgttcatgcaaagctaccttctgtgtaagatgcgacaagctttcaaagtcttcagatgagaacttctccctgatcggagcaatcatcccttgaaaagccaaatcggctaactgggcattagtcaaactcaagctgtaacacttattcctcatctcctgaatctctgaatatattcatgtaccggctcatcatgcttttgcttgatcgacgtgagatcggacaatttcatctcataaatcccactatagaaataactatgaaactacttttctaaatcggcccaactgttaattgacccatgtggcaaagaagaaaaccaagtaaaagccgatccagccaacgacaaccggaataacctaacccttaaggcatccacagccgatgcctcaccacactgaactaaaaatcggctaatgtgctcataagtcgatgtagtatcttgccctgaaaactttgaaaaatctggtaccttaaaccgattaggtagaggaactctttcaaaccattcaggataaggttgtcggtacaaatttccagcctcctttggcctaagcccaaaatgctccttcatgacatccgcaattaaatcggcccatggtcgctgctgaggtgttccctgaggttgttgtggtatgggctcaaactgattgtattgaggaacaaactggggctgagccgatcctgcctgttggtattgaacatgcggtgattgcggctgatactgataattcaaattgcccccttggtaattctgaagatctggctgaatattgagcaccaaatgctcgggaataacttgaggtatcaccgtgccatctggttgtacatgatgaaccaagtgctctgggacaacctgatttgtagcatgctgcacaggctgaccaccaggtgttgcaaacccagccgatgcattcattgagccttgctgctgaatcgactgaacgacctgctgctttaacggtgtctgctgaatcggctgtaaagtcggccgtcttggtggtgtctgttgaactggttgtatgacctgctggattgggggtgtttgttgaataagttgcacaacttattgcctgggtggtgtttgctgaattggctgctgctgggttggatcaacagcattctgaggaggtagaaacatggatgcaacctagtcttgcgttagccgagtcacattttgtccagcatgttgtggttgctctcttaccaacaattggggattgactaattggcctggagccaaaggcggcgcagcaggtacgggagccaatgctggtgccgtcggctgagccggtgacgcactaagaagggctgactggatgactggctgtttatcggtgattaatgtccgataattcgggaatactcctcctggtaggtaaaccggtcccgtagctttatactcggccattgaaccatcaaccattgacttcatcatgtttgacaaggtattaattaataccccagattggttgatcaaagcattatacacggcatagtcaacccgatcttggaagttattgaaaaactcatgtgctgcattaccatcctgattaagatttccaccttgtaatccttgggaattatcatcaagaccttgaacttcttgagaaccatcaccttgatctccttgagaaccatctgcaacaccttgatcacttggctaagccgcaccatccggagctgatttgacctctccatccttaaaagaacctgtcccaggaacatcagcaaccaccttaactttatacttctgaactagcgttcctttacgggtttctgtgaatgagctcaaaaattggttcctcgcttgctgcatcattgcctcaagatctttttgctgttcaagtgtcaatttgtccaaagtgacgggcataattgtcacgcccagaaatttagcctaaatttccagactattttgtgtattaaat

SEQ ID NO: 92285 - DNA, 10127 bp, Oryza sativa
gcgatcctagagtggcttcagctccactccacaggcaaaactcaactggggtctgagccttggtcctctaacttcgtcttcagctcagaagcactacgcttctgaaaagggggaataatagcaaggctgagtacaaccacgtactcagcaagccacaccaatgatgcagacgtgcaaagggatacaaggacggtttgtggctatttgcataaaggcagttgtaaaacattttatttagcaaacagtaaaactgttgagtaattaaagtaacattaaatctccactgatcaacgctacaccacgttgaacaggcccaaccaacccacctggactacagtgcattgggtcgatttattaggtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccactggtgcctaggaaagggtcgagctatacttcagatcaagcagttacccactcccgcttgtggcaagcgctgtaagtcttccagggtttcccgtgaaccggtccttaattgccatgggtgcgactcacaaaaccatgcacccacagcccaccattcagtcgcattttagttggataattacgaccataaaacatggccagatgtctcgagcacgcggctcaacaagatactagtatgtctaatactgcaattatcccatcgactgagctagtggtaattcagcatggctaagcatatagttctagctaggtcacataagtaacatgagctagtcaatttatcacccaaggttgacaaaggatagatatcaagtaaacatggcacaagcgagcagataggtaaaccctgaccccgtgtaattagcaaaacatgcatatttatttgcaaacagtaaaacatttgtaaattaggatcaacatgctcaaggggaatgtgtgacttgccttgcttcttcactttgatcttccgaactcttttccttgcgaccgcggacttccgaaacgacggaaactacacgctggcacgcaaaacgaggaaaaactctaataaaaaccaaggaaacagtacataaaaactaaacaaacatgtagagctcaattttagatgaattttgcaagttgaatggctcaattcggagttcgaatgaattagatatgaattttagaagttttgagccatttaaataaatttctacaattaaactcgatttattgcgcaattattatttatttttacaaaggaaatggtcctcgctgacgtcagcaaaggggcggccggcgccgacacgcggggcccaccggtcagcggcacaagagcgccggtccaccgtggaccgggaccaccgaggcggtcaccgccggtccacgggaaccaacggtccggatcggcccaagccgatcggacggccacgagacggcgcggctggggcacgggcacggcatgaaaccggctcggccgagccaaggcgcggcggcggcatgcggccaccggcggcagcagccggcgacgcggaacagcggcgggcggtcggcgaagaggaaaaggaggagggaggcggctcaccgagaggcgcggcgacggagagacgaccatggggaggcgaccggcggcggaaaggatggcggcggccggcacgggaggcgacgggaacggcgttccgacgacgcccgaccatggcggagccgcggccgagggccggcaagacctggggaaattattggagcggttagggagggaaataggcgaccggagcggcgagaataccacgccggagaggaatggtggggctcaccggcgaccgagagataccacgttccggtgggtttccggcgatgaacaacggtgaccgaggtgctgcacggcgctgcgaggcgagaggtgaagacggagcgacgcggcggcggctaaggcgacggtggcacacggctggaggcggcgtatggtggtggtggctcgggatgcacggtggaagggtggttgcggtggtggaatggggaaacggagcggaggccggggtagagcttggcacggcgttgccggcggcgcaagcggcgaggtgcggcgacgactagcgcggcggcagcggccggctgaaggcggtgtgtggcggtagtggctcggcctcgcgatgggaaggtggttccggcggtggaggagggagatggagtggatgccggggtgcggtggggtggtgtgatgctataggtggtggcggcgcagcgcggcagcgacgggagcggcggtggcgggcggctggagatcgccggcgagcggcggcgatgcggatcggcgtggagagctcggtagagggcgtgggagacacgggaaaacggggaaagaggaagaggaggccacggggattgattttatagctcaagggggcgaggagagggccggggagcggcggatttcgaggggaagtagggcagcgtcgtgggggagagagaaacgcgggaggcggcgacgtggccggattttgcggggagagtggggggggaaacggcgcggacgtgggcggcgaggtcccacggacaagcgcgcgcgcgcggggtggaggaggtgggcggaaacggcggcgacgttggacggctcgggcggccatggcggttgctggcccgggctggaggttgggggtgaccccgacaggtggggcccacctgtcggcggctcggggagaggagggaggatgagggaggcgaagcggacttgcgcgaaggagggggcaagccgggccgacggcccaaagagaagggaggaggggaaaaggagggcggccgggcccgagaggatggagagggagaagatcttgggccgaaagcggcccaaagacaaagaggggaaattttatttgttttctttttattttaattgatgcaatgatctttgtgctattaaaactatttctcgagctccgaaaattcacggaaaattccggagagtacattagggcacaaagaatattacaaaatattcccggccaatgatttttaaagggaaaattttaattctcccaataattcacttgattaagttgatttaacttttatttaatttctagaaaatacattatttaatgatttttaatcccgaacgaaaatcggggcgttacaataatgttgctttcatcaacctcaggcagacccaacttaagcatcttagctttaactgatccaggttctccagccgaggacggcgatgctggcggcttctcggctatgaggaaaactgctgctgtgattctgacttctaatgtgtcccaccgggcgtgccaaaagcgtgttgacaaaaaacacgaggcctgggagatctgcttaactccagtgcaggtccaaagatcgccttcggatgtatgagcgtgccagttgatttgattctgcaatcaacaagaaacaaagacaaagaaaccgtggttaaatctataaatgatagccgatcggctgattgccgataacatatcatttatctctgagccgatgtcatatgtgaatcgatcggcgatcacaaataggtaacaaggaactaaatttactcgatcggctgtagatatcaataatatgtaatccttatatcgatatatattcaaatcaagtgactgggatagatcggacgccatgccgagacagtataaatcacttagatcaaaatacatattaacaacaagattatatatgttcatagcgtagccgatcatgtagatctagcatgtatcggctaatactccgataccactctatattaagatattaaagcaagtaagatataccaaatagaagcctaacatactttaaatgcaacaagatcttaatataaaggacagatttaacatgtcaatcaagcgtataaggtaaaagtagttaaatcaggtaagatcggctgaaactccgatgctaccctaatcggcaaccaaaaggcaggctagagattatagttctaagcacgacttaatagatcaaactcaactaatgcagcattaagtatgaaaagaagaacaatatctagacaatcaagccgctggatgtttcatagagtggtagatatcttatataatctaagccaacatcgttatttaacctaatcagccgccttttactaacagatgttagccgattatagattagataatgatattgtcaaagattatataagatatatgataactcgacgaattacataaacaagattagagtatcatagagatgggagcactaatcccggaaacacaagccatcataacaagttttacctcatgtcgaagatcgaaactgatgcagctcaacccgaaagtaagaactcgtcgaaataaaactaaagcaaaaagggtggtgatgcgccgacattgtattgaacgtgtgtgttaataattacatagggctcggggtctatttatacccaagaattacaagatatgtccatattggacacgactcttatctctaacaaactctaagataccataagtctttgcggcagacttttgcccaagtttatctctaaggaaattacataaaatatcctaattaatagatacaattgccttcccaggactctatccatgcacggcaatcatcttgaagcacaccaactcgaacccgatgtcgtacacaagtcatattgtcggaatcggctgtatcacttaacccagtctgactcagacttagccgatcccagttgtagccgatccggacttcagccgattttactctatttccgcaacaatccttatcttcgattctgcttcgactccatcttcatctccgatgctgatatcaccaaatttggtcgttaacaatcatgcgttaatatatcattctattttgcatgtagagagtgttccaacccagaatacacccgtcccacatggattctaccccttattcctaggagaaaattgggaatatgccatgtctcaatgtaagaagtgggttttcccaaatacgattttcatcaatatcaccccgaccgaaagctataggcttccacttaggccgagtttagttccaaactttttcttcaaactttcaacttttccatcacatcaaaactttcctacacatataaacttccaattttttttcacatcattccaattttaatcaaactttcaattttaacgtgaactaaacacacctttactacgccatggatggagtgtacgagctgttcttgttggcttccttcattttaatggcttggagggtgatgacgacgagcttatggatccggcatcgttgtcgatgagcgcgcgggttagttgagtgcacaggtccagcaaacgatgacgacgagtgcgtggatctggcgccacccctgatgagcgcacgggtccaaatgatgacgatgatgagtgcactggtttcgccggccgccgtcgtcacttttcttcatctttgcatttcttaatttgagaaatgctagaaaaaatttattttatgttatcataacttaccgtaccctacgtaaccggcttaaagatgaaactaacaaaatggttcaaacttagaggtccaaactcatttagtcctattcacgtcaatcgtcttatcgtctgaatatatgacctcatcaactatattatcatgtactccctccgtcccaaaaaaaggcaaaccctaagtttccgtgtccaattttaactgtccgtcttatatgaaaattttttataattcgtatttttattgttattagatgataaaatatgattaatattttatgcgtgacttgtctttttaatttttttcataattttttcaaataagacggacggtcaaacgttgagcacggaaaccagggtttgtctttttttgggacggaaggagtagataatcagatttagcctcttttaagattttggcttttttggtttgactttcttaaactgaacctgtttttaattataggtgtgcaatgaagattttattttataacttcgataacctcattgttatggcttttaggttttgaacgtgtactagtcataggattactacaaacatccaatgtaggagccaattccgaaagagtcgtcggttgcggtttagccggtggtgccccctcaatcgcacgtcgggtttgagcggtgatgttgtagcggtctgacttaccactactaccgatcagaccagcatattgtgctaaatttaggatctaccatattgagagaattattggtacttttcataatctaatatcgttgtatctgaagatattatgaagatgtatgctattataggaagtagttgcaccgccaccaagcaatcggctatttagccgattctctgcttattcatgagagcatgtagcgttttctcaaagatagaattaaaacagataaaccagttatttaaactagcaacacagtgcagtaatagtgtagtactgccgccgttgacagcagctgacgacactctattttcgttgatgccggtggcgaagtccaacgccgacattgtctcgccatcgcctccactgcagccacatcccacatagtctcgcttccacagcttgtgcctatatacctcaccaagaaccaagtgcgatccgtcatggtctgcataacagcagcgccccgcgggtcagaggaaagctcccgaacagctccatggcgagcggtacaggatctcgtggcaaggcagcacaggagcacgggagccacggcgtggcgccggcgcatggtcgcgtataacaaccacgatggagattatttgtagctgcccagagatgaatgtctcggaagatggtgtaggcgtgtagcgagtacggaccgacatttacacattctgatcatactacccttcatcatgaatggactgacgtatagacatgattggtactcctaccttggtacctattactaatacccattagtaccggtaaaacagctcaaaacttaaattgcccagaaccaaaatatgattacaaatggcacgaatcctgtagaggattcgagaagtttagaagtgttttcagctttcgctgcctttatgaggttccacaaaattcgcagtattcggggcacttcgttgcgtcacaagtatcctgggttatttctttttccatgatgctgtcccaggaaagtgtcaaagaacgaacaccttcctgtcacctaatctgatgatcacttgctgattgcagttgaacataggcaaggccacccgtcattccagctgcaacgttcctccttactctaccaattgaggaatatgcatatgtcaggaccagcgtcggagccaaggcccggcgaccctgagcagctgcccgggctctgccggctacatgcaaccatgtcccattagattaaatctaattacctagctaatcatatttaatcaccgtatgaattgaaacaacaatagtatatagtgtacatacttataacgatttagtgtaaaatagcaaagcaaatgctcactctaaaatgatctacaaatttgtatagatttgtgtatactatatttgttgttaaacttgcctaggctcacgatccgccactagtcaggacaaaacactgtgatcctcatttagcagcatgtcctacttacttcccccgtttcacaacgtaagtcattctaacatttcccacaatatatctagattcattaacatcaatataaatatgggaaatactaaaatgacttacattgtgaaacagggaggatttgccaactacacagccaccgatcatgtactcgcagcaatgatctccagtgccctgacctcaaccactgattgaccaagagagtttcacctgttttgcctgtcacaaatacctgctcactagtagccaacacagacaagcgtttccagctatagtagcttcgtcaggaagtcaggaacgaatcctgtgctatctagtacactctacaggagctacaaccatctctccaccacccatgccctgcaaattcttttttaaaaaaagagagggtattttaaatctggtcaggatcaattttcaaatgtgctgtatacatttggtacctttccaacataatcattggcctctctcaacttgcagagtattccaggagttagaaaacatccaaaagactggccctgcacttccagtaaacctaaaaggcaaaaaacaattatgctcctaacttttcataagagaaactaaagaaaactaaaaatagaaaatggttaacatcgtaatgttgagctggcctgcaaagcctgtgtcagcgtacttcttcgcaatgacacctgctacttgaccacagacagccctctcaacattataatatcttggaacctcctcattctcaattacatcagatatctgcaaaatagaatatataaataatgctgcatcattaagcaagatacaagtatacaactgcacacttcgctttaaactacaattaagggcatcgatcgtcaaaattaatttctggtttcaagctgaccaaatagcagaatgaaggattactttgattgactattcacaaatcagtcactagggaggttaatgtaactgagaaaggaatggaaaacattacatcaggatttgcaaggattgtctcatcaagaacagggccattagtgtggacatcttgaacacatccagtagctattcatagccacagaaccaaaaccatattcatccacgcccatgacactagccataaggacatattggcaacttctgaatccaccatccaccctaccatcctctctcacaatcaattttgcataagtgtcaggagaaaagttaactagcattagaacaaacaagatatttcaatagggtaataacaaacaaatagatgaggctaacctggtgtgcttctgaaagaccaagttcccaaggaccggcagaatgcttaatcaaactaattggcctagctccagtgccaccatcataatctgatgtgtgacagaaatacaaatatttcaaatataagttttcataaataatctaagttaaatgctgcaataatctaacttcattcgaagaagactataatgtttagtacatccattcagtttgtaaattagttcagtatcttcattagtatgagattttttggaagagaccatcatgcgctacactgctaaaattttggggccattctactccctccattccaaaatacaagtatttccagcattcaaaatttgttccacaatgtaagcatttccagggcactgatttcaatgcacggaaatccataaattttcagccaattaggtgcttgggaagagaatctaagcaattcaaaattcaaattttgaccattgtggtgactgaaagggaatcttatgacttaatgttagtactccctctatcccaaaatataagggattttggattttgactggttaggacacatcctaatactacgaatcacgaatttggacagggagcctgtccgtactaggatatgccccatcctatcaaaataccttatattttgggacggcgggagtatatgctaaacaacctagaaatgcttatattttggaacgagggaagtagtaaatttctcaaaaaaaatcctccaaaatctctaacagcttctaggacactttttttcactaaatagtggcattcgttagcaagtactcagcgtcagtgcatatcccattcagtaaaatatagctaaccaatatctcaaggaaggaaatatttctcaatctggagaaagacaaactacaaaagggagttatatcattgtgaataccatataaattggcaaattatgtagcataatattgcaaacaaaaccctatgcaacttgatgaggtatgcattgcatccgtagcaagagttaatccgcgttaatatgtagaatgaaattagttaacatgctctgcttctttatttctgtgagatacagtacacattataaagtaaatttggcaaat

SEQ ID NO: 92286 - DNA, 2956 bp, Oryza sativa
catactgcgaatcaacttgattcactgattattgacagctacctgggagaacctatccttttccagattatgtgtcaagatgtatcctccactgctcaaacatgctttttctgtcaaccagcttaggttcaagctagttgttatcaccgaaaagtatttttagcattttcttttaccctaaaattgctcttgactcagtgctaatcagttgtgaggcaacacgttatccagaaaaagaggatccctgagttcctccacctcccaaccaaccccattcaacacagacaaggacagaggagtacaaaacctagttatcgagaaaagacattttgaaaataggggtgctttgaaaaactccgatgagctctctgttactatgcattttctttctcctttctatggacaaacttttggtagcatgtccgtccgaatttaaactagtgtcatttgaagtcacagtaaaattgtttatcttacgcctctgtggaatggaacacctcactctatgagaagcatgattctagcatttctagtttatcactagtttgtcaattggaacatgtaacatttacagaatcttccatgtgggatgatccattaatatcaaaatagtattcattataagcggatgtagagaagggaaatggcagaacttatccagcaagagatggatgactggaaatcagaacacatatgtacagacaaaagcattacctgcaatatctcgttcaatgacttttcaagggccagcttcacatcagcaggatgcagagcgccactttcataatcagctgtaagttcctccatgctcagaaaagtcctaaacaagatagaagtaatcacaaaccatagaataaaagcatacaaatataatgcatgattacgttatatgatttagttgtgaattgttaggtattgatgacaccgacaggacaaaacaattgtactaatactgttgaattgtaaaattaagatttgtccagaaatctgcggaagtgactctgcaacttcttactttttgccaccattccctttcttctggaccacctcaaacattccaaaccaaggcaagatgatatattttatgtactccaaacatggattgccttctgctagttttggagggcagaaagctttttccattttaaaacatatatcctcctgaaatatacaacaggtaaatattgaacaatctccattgtcaaccttcaaacaataactaatgatttcgccaaaacatcgatcagacgatgagctgcataaggtagcatatttcaacaactctatggtcacactgattgacaaaaccaaaccccataccagaactgttcaaaatgtcaaataacataataattatcacatatagggttcaagtaacaaaaaagctaaaacaaactggttaataatcatctgttgcagtgcataagaacaaagttagcctcttttcaaacaaagaatggggagtcttcccttgttactcatctccctggatcaagatgagtttattgcctaagcatataatagcaggttcgagttaaacttatgttgcagtaaaaaaaaaaggatggaacgaagagaatatataaacaggattggcatcatataggatgagtataacggtagtaaaaccttatcatcttccatgaagatagcccaagctggatgcctcctgttctccatttgagggtattgtaataaattaggaagcatatctgtagtttgagttaaggatgtgcacccgagtatgtttcggtgcatgtaccttgtgcaagtgtcttggcatgtaagtaccaccatccaagaaccaaataccaaaagcacaagcacatgtaacaacttggaacaatacatataaaagtgaaaagatactgtccaaaacagcaattgccttattcttctttttgaaatgcttataatattgtctagctaataagttggcatcatgctgttccattcccaacagccatatgtctgcctgcagttgataatgtatgcattgcaagaagctttaaagaagtccattacaaaatcccatgtaaaataaaatacagaagcatatttgaacactattactttagttgatatggcaatcacagaattggttgcacaaaagtttcacaacaatcagtctagtgaaagtgaacagatacataatctacacttgaaaccaaaaaaaaaagaggagtatgttatatcaataggccttgtgtacaagaattggtgaggtgcaagatcaaagggaagcaaacagggttggactgcatagtcaaataactatattaatagaactacactaattgcttccttcatttgtccctactaagtttaaagcaccaccactacttttgctcatttaacaaattagcccctgatatttccagaagttattaatatatcagcggttactgttagataaattgactgaaacataccaatggcaacacatttgcaaacagaggtagtaggtacattaaacataccttctgaaataatatgctagcacactgcaagcaaatgtaaaaaatctcatcaacatttaattttccaatcgcataagaatttctactcccacaaaatctgctaggtaaacagtaataagaggacctgcatgtactgatccaacatccgatgctcaatcagtaggctctccagtgaaataacccttgaaaactcaaatgattcaaacaagaatatacctttttattctacgcacactgtttgtccttgcaatatccatgacaattggccagtactcatcaccatgttgacgtatttcatctgacaaccagactagatctactttatcaagagccatgccagttgctttccacatctcaatattgtacctgccaacagtccgcatcttatttagattgccactaatctcactgttcatctgggaaaaccagtctgccattaagattttaactttgaaaccagattcaaccattttatt
